United States Patent 8,067,671 (METHODS FOR GENETIC CONTROL OF PLANT PEST INFESTATION AND COMPOSITIONS THEREOF) - sequence listing, part 19

SEQ ID NO: 21049 - DNA, 1381 bp, Heterodera glycines
aatttagggacaaaactctaggcggaggcagctctgtccctctggtcagatcagatgagatggctctttgtgagcatcctggtctatggccagccgagtaatgccatagaattgtggaacaagtacaaagaccaaatgtacaatccgcaaggcattattactctggcacagcataaagtagcagagcttgaagccctagccgacattgattggcggctgcacagctgctttaacttaagctgtgtgcattttagcctgccagacccgccaacttcaattgccaaaaatactgacgcggcaattgaagagtttttctttggcgatgatgatttgaatttgcctccagggcaaccaaatcctcgtccacagccaaatacccctccgccacttaacagcgaccaacagaaggtctttgatgctgttttgttggcaatacagtcgaaccctagggattcgactgtcccccgccgtttcttcatatacggcgatggaggcacaggaaagacattcctgtttggccaaattattaggcgcttgcgaaaggccccatacacctacaaagtgcttgctacggcatccactgggtgtgcagccattttgctgccatatgggaaaacagcccattccacgtttcgtctgggtagagaagtgtcattagacaaactcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggaggaaaaacggtcattttcagcggtgacttcaaacagtcgctgccggtcgtgcctcatgaaggcttaaccgctcaggtgacagcctgttttcaaacgtctccgttgtttggtcaattcaccacgatgaaattgaccatcaaccagagactgggccaaggtcagcaagcgtacttgcaaatgtgccgccaaatcgggctcggagaaaccggagagcacttctggattcctccgcagttcctcgttaagagcaaggaagagctgatagattatgtctatcctaacttccaacaactccttggcaatgacaaagagctgctcaatcgtttgattctcgctccgcacattgacacgtgtgatgaagtaaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtatccggcttaaagtcggatgcgtcgtcgtccttcttatca

SEQ ID NO: 21050 - DNA, 2353 bp, Heterodera glycines
ccctcctataataaagcgccctattttcgagtaggggcttctggtaaaaaacagagcccgccgttggttttttaaacacgataaatgtatattattagatgttgacgaatgtgaagagactatctctgccactactaccgtatgcccacaagcgaatacggtgtgcacaaattttgtcggtggctttgattgccaatgcaaatccggcttctctggtgacccattgaatggtgaaggttgtaaagacataaatgaatgtgaaatggctgaacattactgtggatggtaaattaaaaaatatttaaataaaaatcttaatttgttatcaatacggtaacttttcaatccattataatgaacagagaaggagatttttttgcatgaaaaatcacaaaaatgaacaaaaaattttgtatttaatttgaaaataaaatatataattataaatttccaatatttaaaatcaaaattggtcatgaataaattttatgcattaatttttgagaaaattttctcattttcgtagaggtaatcaaattttctaaatttatttaagtctatatttatcagtatgttttcattttcattgtgtttttgttaagggatttacgaaaattttgcaaatgtcctaaaaaatgccaaaatcggtgcaaaattatgttcagtctaaaactgattaaaaacatacaataaaaataatgaaataaagcaataaaaaagcatttttcatttttattatcgaaaatcttaactgatttttctcaaaaattaatagttttttcaaaaagttttaaatattgaaaaactaaaatataatttcctgaatttttcgttcacctatattcattaggaatgcaaattgtaaaaatttggatggcacttttcgctgtgaatgccatgatgggtttgagcaagtgccaaactcatcggccggcaccaaatgccaagacatcaatgagtgcgacgacaaaacagtgtgccatcatgcagcaacctgtacaaatgtggagggcagctacctttgccaatgtgtggacggtttcattggcaatggcaaagagtgccatggtaaatattaagttctaaatttatgaaaataaattaatattaaatgcctatgaaatattattgagcaaaaatatcactttgaagccatatatttgtgtacagagttctttttttttattatttattttttgttttttaaaacaaaaacaatatttttttagccaccaaaaataaaatttgaaatttaataaggaggatcaaatttttgtaattctcgactgctcctgtcgttatcgcaaacctacaacatgtttaatatttttttaaatttagttgaaactttgaaaattgaaaattttgtggttaaaattttagaaaaaaattgtgattagggtattcaacaaacacactgttgaaaaaatatttggaaagattgcttttgttcaacaaaagtgtaattctatgcttttgaaagttttaatttttttaaaatatttgtcaaatattttaaatataattttttttaattttagagacaattttgtttccaattgggcagaaacgcaatattcttggaatttcaaacaagcaaatggattccaaagttgtgcaattggacttgccaatgcaaatatttggacaaaattattcccaattttacgtaattttaaaatttattttaatttattattttaattttcattttaaggtctcatctaacggatatatttcatttaatcttcgcttcaatgacacaatgaattttgatgaaatgtttaaaaattttcaattcaatggcggtgggccaatatttttgccgttattagcaaaatttgtgccaaattctaatgaatttatcgacattcaacaaattgatggttagaaattaagatgttttttttaaattttttataaaaattttgtaccagttggcaattttactcttctcaaagcttcgatttttttgaaaattcttaattaatttctgcaacaaatccaaaaattattttcggtactattttataatagaaacgaaacgttttgcagattttattcaaattattttgataaaaataatagagcaccaaattttatagggaattcgaaaaggaagacaattattatttatttattttaatttattagtttaaatctcgtgtaaaaaattattaataataaatataatttcaattttaaatcagaccaatcgccacaatcaaagggtccgctaaaccgtatcgccatgcaaattcaacagcacttaaagattgccgatttttagccctaccggctcgtcatcacattatggggtgaaatgcatacagtatcacagcaaccaaataca

SEQ ID NO: 21051 - DNA, 1093 bp, Heterodera glycines
  misc_feature (19)..(20): n is a, c, g, or t
  misc_feature (56)..(56): n is a, c, g, or t
  misc_feature (110)..(110): n is a, c, g, or t
ttttttcttcatttacaannatatcagaatttgtttctaagttaaaatttgttttntaattattcttgcaatgattataccaagcttttaaaaattatcgattttaattntactactttttgccagccctactcattaattatcttatactttaaatgcccagcaggatctttgttgattctcataaaaaaccttttctatttttaagtctttctcccgaaaataatcaaacaattggtccgggagtttcgtgccatctgcaaaaaatttttagtacttttatctctatcttcgaattctctgaagatagtatataaaacttcttttagcaatattctcaaatctgttgtgcacgctttgaatatatattttttatcatttttagttgcatttgaaaaaagttacaataaaaaattggtgggtgaaagatttatttgtcaccctgctaatgaatttgcattgccatttattacggacaaaaaattgtaatgattttaaaaaagtcgataaatccttgtgtcaaaaatattgtcgaattcaaaatgtgccagctcatccggttgagttcttcacagctgctgctgctgctgcccaaaatctgtggttatgttacaccataatgttgcggttgcgaatgccgtacatttgcgacgcgtgctgctgctgttgctgctgctgctggcggtggtgccgttgttccgccgcccaccgtatacggtgcgcagtgcgcgacggtagtccgtgctaaagcgcgtaatactacggtaaatggaaaagccagaaattttttaaaaagacagaaaattcagcgtttttcaaagaaaatctttaaatttccaacaaaactgcccaccttatttaaattttttaccaaaaaaatattcctttgacataaattgtctgttaattgccagccaaatccaaaatctaatttgtttaaaaaaatataattcagttacaaaagtcaataatccgtaattaatttcagccctgatcccgattgtgctgggacgttagtcaaaaaactatcaaatgaaaatttttgggtacccaaaataatcagaccaaatgttattttatgaatacaacaaca

SEQ ID NO: 21052 - DNA, 1132 bp, Heterodera glycines
tcgagttttttgatctcggtttctcgattctcagatcccgggaaattttcggtctcgagtatcactgttccaccgctcccctccatcagtgtcgggaactttcccccctccttttccccggccccttccgccgatcgaacgacaccttgagcttttcggcaccaactggtcaaccaaatgacagcgtagcacacgaaaattcggcggaataaagcagaaagacataaatgttagttgtattggcattttctggcgtttgtgccgggtcgccgaatgtgcacatcactggcctgcataaaaacaattgtacatttgaaatgtttggctagacgagttgtcatgaaaccaaaccaaagttacgccgaaatattatctatcaatcatgaattgttgggtctttatttttcagaatttctacgtccactcaagatttcagctcgtccggtttacgggaattggacaaactcccgaaaattgaaacgaacacaggaacagaactcagagtttggcaaggtacaaaagtgacacataccgtaccgtaaaatgttaccatttttatggacaatgtttctcccagatcggaacactcaaatttggccaaatcaaacacacacattcctaccaaattggccatttgtcgcccgccatccgatcaatgccaatgcacaattgaagcgtcgtggcggcatttacgccgacaaacggcacaaattgaatgtaaaagcatgtaccaagcgtgaggtaattgatgccgaaaaggaacacaaaatttgatggaataaccgatcagcatgaacgaagcgtacaagcgatcaaaatgttgcatttcgagcgcagcgacctgtagatttgaagatggtgatcaaaaactttatgaattgttagcaaaaaatgccaaatgtagaacataaaaggtaactcgcccggtgggactcgaactcacgaccccagcaatccgtgccgtgctctaaccaactgagctacgggcgctccttttagaagttttctcaggtcctttatcccactttctcccacactccgttccttctggcatcacacatatttgtgatgtcgacagtccaaaatggggataacattgaatggaacttttgggtaaaagccggaatcaaat

SEQ ID NO: 21053 - DNA, 1046 bp, Heterodera glycines
  misc_feature (8)..(8): n is a, c, g, or t
acccctanttttggtccctaataaacaatcaaatgctcacattcgcgccgatttgactgaactgattaactctcccaatttgctgtgcggacgctcggcacagcaagtgaaagactttctcaaagagttgcatctgacaattgacgaagtgctcaaaaatgtgaagaaagatgaaaaggagagaaagatggaattggaagtgtgacggaagagggaaggaaatcggacaattcatttgttaattgttaatttattagtttcgatgaatataaaagtatgatgactttggaatattaaattaaaatggatttaaaggtgcgagatatttaaagcttaattcaaaattaattgaacaattgttaaatgtgtgccatttaaccaaagacatttggtcgcacaaattaaatcaattcaaaattctctttctcatcacttcgctcattctttcattgccctttcgtccacagaaaactggcggcttaaataataaaattagcgcaattttattttatatattttaattaaatttcaatttaaaattacattttgtgcatatactcggaagaagaagccgaaaagtgagcgcgagttgctctattttcattttcagcagtttctctgacatcagcagaagcggcttctgtagcgaaggagcaaaaaataattaaatgtaattaatgggccaataaaatggcacttttccttttgcctaattgaccgtttagcccttccccaagggcaattgctgaggagtgcttttcataattggccattgaagccgcggaggaggacaatgcgccggcagcttcggcataatcactccgctgctttcctgagagctttgagactcggggagatgggcggccaattaggccatcattaacactcttaaaagcatcaaatggctaaaatgagaaaaccaatcaaaaaccaattggtccgcttcgtcagctgaaaaaaagaacaattaattaatttaattgtatttatataaagagggggcggagttaattggttattaaataagtaaatgttttatattctat

SEQ ID NO: 21054 - DNA, 1025 bp, Heterodera glycines
gggaatgccccttgtgattttgcttttttaaaaattaatttgccaactgatcgcgagttgcccccatttcggcgccggtgtccgccgttttcaacagacgacgaatggtacgacttggagtgcgttcgaccgccgctttttccattacgaccattcagagcgctcccatgtctatcagtgccggcagcatttgtaaatgcttcggcattttgtcgatccttttgtccttcctcggcacgcacttctatttcattttgacgccgggctgagttgcctggaaatgggcgagttctgtttggtcatccgtgttgccgataaccaagtgcaccggacgcggcaatttgtccgagttgatttttcccgtcgaattcgccgagtccatcagattggcctgcagctgtttctctggcctgtccctctagaactcgcagaccaggctctccaggttgtccgagttggccactccgttttatgattgattgtgctaccaacggcggactaatcggctgccgatctgataaaaagttagggagagcatttaaaatgatttggccgtgccgtggtttgcctgaccctttcgcgcgacgggccatttggtggccatgttgggacagatcttgtcgaacagctcgttgttctgtccgttgttggccggcttcttgcacaacactccatttttcttgcccggcatgctcaagcgcaactcgtggaccacgcgcaactcgtcggccacgaggtgagcaaattcaggcggtgcctcttcaataaaggagacggagtctccgccgaccttaaattggacgggaacagaacgaatgaacagtcattctactgtataattttccattttttgttaatccatttgagtgttttgaaaataattttaaaatttttgaatttgtttattatcggcccgcaatttttttattcatttaaacgcacgaaataattaaggaaaattgaataatattcccataaaaatgatgaatcactgaagaacctttgcgcacaaattgctttgcctg

SEQ ID NO: 21055 - DNA, 2006 bp, Heterodera glycines
  misc_feature (24)..(24): n is a, c, g, or t
tcgtcgtcgtggtagtggtgtagnaagtcgtggtggttgtgcttgcggtcgatggctacagaaaaaaatgtattcgaaattaaaaaaaaatttcttagcaaaaattgtaaatcgatttttgagtccaatgaaagagccaaaaaattttcggattgtacttggatttcacagatgtttccttagtttcatcttgaacaataagagaggccgaatttttagtttttttttcaaaatttttaccgagagaggcccaatttttttaaatttttttcaaaatttttaccgagaaaggcccaattttttaaaatgcttttttcaaaatttttacagagagagcccaattttttaattgttttctcaaatttttaccgagagaggcgcaattttttatttttttcgaatttttaccgaggggcccaattttttaattttttttcaaaatttttacagagagagcccaattttttaatttttttttcaaaattttaccgatttgttataaagcaattcggcattgcaattgtctttatcacacatttcacatcgcgcaacatagccatccaattgattggcatctttcttttgaagtgatgcgcaaaacttttccaacttgttatctctgcggtggaaatgagagggtgggtcaactcagtcccggccagttccgtcccataggctttttagggttcctcatttttcccattctaggtaattacgccggattggaagagggccatttgggcgctgcttcgcctggcgtgcgccaaccttttcgggcctgtttggggatggatgtatccctagtctaaatcctcctgacccaaaaattttagggtaacactgtagtttgcccccccttttttttggaaaaagaaattccaaaaatttttttcataaaaacaagtttccaggggtttttggggtcgctgatcacgaaaatgttttcatgtatttaaaccgattttgaaccaaaaatgcgaatttgaattttcgactttttgttcgaattcgggtcaggggttcggaattggccgaaatggatgtcattcatattcatgatcagcaacccaaaaaacccatggaaacttgtttttatgacaaaaaattttttgaaattttttttccaaaagtggggggggggcaaaccacagtatttataaccaattttagttcatcccggatttgtgattcgctctgaatttgaatttttcgggagccccgttgagcggacaaaaagacccaatccaatggccaaatcagtatggccgaacactgttgactcccgacccccttactgatcatttttgccgcaatacaataatgttttcgcgcagcctttgaagaatgcaaattgttgtccgtctgaaaaaagggaagaaaatttgaaatcggaaaattttgcactcgagaatttttcaactctcggcacctcagatcattgggctcggctctcaccgacccgactcagaacatttttgtggtttaaatttcttgcttccaaatccagaaaattttaagtcctctggaattacgattcccgatttattttttcggcttcataatttcaatttcctaacaattttgggtctaggtatgtgccatccctgctctatgtataaacaatacatcagcattgtaaatttgggaaatatgtaaaactattttaattatttctttattaattaattgattacggtattcgcaaatcatcgaatagcattgtacagcttcgttgcactgaaagtatcgtggtacgacatttgagggtttgacatttaaggaactaacacttgagggtccgagatatgaggatttcccaacagagttgaggaaccaaaatttggggacactcaaaattaaaaaaaaaagtgaagaaagaatgcctttccccaagggcaaacgggatcattttgatcatttaaggacattcataaatttccaaacgtcaactattgagtgcacataaagcaatgaaattccgagattgcacagctttggtgaaacct

SEQ ID NO: 21056 - DNA, 2215 bp, Heterodera glycines
attagataaatggagtacactcttggctggattatctccccgcggccaaaattacggaggaagacatctttactcagccaaaccgggaggagataccccgggggaaatcattgtcattttatcggagacaatcggacagcttgacatgcgcactgatcagatccgcgctagtcaaccgaatcgtcaggcaaatccgaacggtgtcaaccccgccccgccgaatcaccatcatcatatccctctccccccaatgagcttattggattttgacggtactccttcgcgttatgagcaattttggacaaatttccgcgataatgtggatcagcgacctgatttgtcgcctgctcagaaattgcgttaccttatgggccaattaaaaggagcagcccgagatttgagcataggttaccaaataacggatgcaaattacccaatagttaaagaagtactcacaaaccgatttggcgatgattttaagcgcgcgcacgacctgcggagcgaacttttccgccttcccaaagcatccgcctccaccaactcattacgcctcttctccgaggcggtggagcgcatttgtcggcaacttagttccttagaccccgccataaatgattccccttatgtggtgacggcccttttggacaaattgccccctgaaattcgccttaaactcctcgaacaggagcgagacttcggctcgaaatggacagccaagcaatggcgtgatggcttgtcaagcctggttcaactgcgagaagcggcatacatggatcgggagattgcccgtccaaccagtcaaatcgccccacaggctcagcaccgtaccaacggacgcttcatggcccaaaatcagccacgacgggcttttccagttgtcacaccctccaaaaaaggagcagtgcaacaccccctcccgaacaaacctcagaccaactgttcattatgtgaaaaggcatcacataggcctaccgaatgccccgcatacccaagcgcaaaaaaacgacagcaacggctgacggagcagggcaggtgtcatctctgcatcagaagtggccatgaaatggctgcttgttcagccaccacaaaatgtttgtggtgcaaggaccgtcaccatcttatcgtctgtcaaaaatacaaaggcgaattgtcatttccctttaataaaaagggcgcaatagccactcgggcccaacagggagcccgtccatcaaatttctccggccattcaatggcggtacctgttgctgctgcttctgttggccagagaaagggaaaaattccttcttatttgatgatgaaggccattaaggcgtacaaccacagagaccctttggacccagtctccgcaccgacattttttgacccggggagtcagacctcatttattgaaactgatctgacccaggaaattaatccccgtcgggtctcagtagaaaaaatggtcgttggtggttttgttggaaatcaaaaagaaactttttcggaattcatctccccctgctattcagtgctgctagctagggaggatggcggatgggaagaagtctttttgaatcagacagagaaaataacgtcgtccatcgactgcctgatgacaccagcaaattccgaggattcagaaaatccattgccatgctacgtcaagccaagaatcatgatcggtgttagagatttttggcgttttatcttggattgggatgaaattcggcccggaatttacagaatcagaaccgtttttggtgtcatttttggaggggaagattgcggtgtccccgagaaaacctcaaatccgtcgttatgttgtccagtcctccacacacctcatcccatcgaatccgatgttgccaaactttgggctttagaaacgatcggtgtttccgattctccaattttaaaagatgacgaggtggcgcttgaaaaattcaacaaaaccattaaaagggacaaggaaggacggtatgaagtgggccttccctggaagtcagagacggaatatccgcctgaaaattttcgaatcgctttttcgcgattttccgccctggtgcataaacttcgcaattcaccgcgtcttttacagggatgcaatgaaatcattgaggattatgtagcaagaggaattattgaaagttcgtcccggacttgtgccccccagcattttttgccccaccataccgttatggggaaaaaattacgaattgtttttgacgcttca

SEQ ID NO: 21057 - DNA, 2910 bp, Heterodera glycines
tttgcttgctgttccttgttactatttaaacagcttcattttttcacatttcttcttttttgggaaacaaatttatatattttttaataaaattccgtgctttcatttatgaaagaaaaaaaatagacaaaatttgtgaaaatgtttaattttgtcaatttggtcctcgcaaattttagtttttgtcgcgttccaagacataatttatccgatgctcttggccttccataatgaacagtttggtaaaatgcatgcgcacctctttacgggtgattgatgctttctgaatcattttatgtctatcaaaatgagtaataataaccaatagcacacctccgctgcgttattccatttccatacggtaatatcgtattggtccgttgggcattggatttccttgtgaaaaatcatttttgaacactccttttggcacattttcgcatcaatttggaagtgcgatatcaatgctttcgtcttttctatgcaatacaatttggcctcataaatcgcttcgtcctttagcaatgggaaaatgctaaggactaaatgccttcccaagtcaatccgatgctccacagaaccgtaaatcactggcaactcatcgtaagaaacaattcccttaattgcttttttgttttgcctgttaaatgccctttaaaaacccccgttttattatttagtgccaccacaaatgactcattgttgtacataaatctccatttgagcactttgaccgtaacgtcgaactgtcggcacacaatgttttcaaaggggaaaatgaccgtttcaatttccaccattttgccactcttttctgtctgaaaaaacgaatgggacgggtaatttttccaaatgctgccgtataatgtttgccatttgttgccatttaaatcagtacaacgaacatcaatcgcataactgttttaaaatgaatcaaaatatatttaatattatttttttattttgaaacgtatttaaatattatatacctaaacaaagaatgctcgtacagacttggagaaacttccagtgtcaatttactgccaatgcttgtaatttggtggaattttagaataaagcaaatccatgctattaattgcattaaaattcaatttgtttaaatctctaaaaataaataaaatgaaagaatttttgcatttttaaatcaataaagaaattgattttacacgtatctaaagaaattattgtgaaaacgacaattttattaaaattaattacatttttgatttaaaatatttttttatactgaaaaaattcacatcgtcggtgaaagttttaaagtgaatttgaaaaattattttatttcggacaccataaaaaagaaataatattgaaatgccatcgatttgacttggggtttttcaattcggagttgtgctgtcaaattcattcattcattgataaaattcgtttccattgcttcgatttccgccaataattttcggaataaaaactttctgaaatttgtcacttttatttcggggatttctatgaaaattcgcatgactttgctctcgcgtgctttaattcttctcacaatggcaaaaagtttttcaaagttcgcgtcgtatttttccaactcaaagaattgccttcgctcgaacaatttgccaacaaatttgtccatttcaattcgttcctcagatcttttgcttttttctgtgatttgcttccacacaaaagcgcggtaacggtcaaaatttttgcttccaaatttctcaaaagatatccaattttccataaacgaattcgaatattccgtgaaaatatccgacaattctttcacaaaatttttcgatgggttttttgcccaaaataattgacggaattttcttaagcatctcatttttgtagtgacttttgtaatcgaaaagcactgagcccgccttttgtctgtaggaagtgttgattttgcagctgctcaccaattcaaccacaaattcttccaatttttctttggattcacttgaaagttttgtcagaattaactccaaaaatttgccaaattttttgtcatattttccgatttctttccaattcattttgtccctttccattaaatggtccactttctctttcgcatatttcatataaatgctatacaagcggatcacttttaaaagaaattcaattaatttaaaataaagatgtctaaaaaagatgtctaaattaaaaaaataagccacttaaaaaaatttaaaaacggcataaaatttttcattttttaaaaatgttttcatttatttttatgactaattattaaggttataaattttttctgctcatatgctatgaagaaaggggcttaaaaataacattactacgttaaaatttttgatttggtaaaggtttttagtccatataaatccatatttcaaggctgataaccctactaattatattgaaattatcaattttgagttctaaaatttaacaaaacacagtgtaataatgagcaaagaatatagcagcgaaaaaccgttcttctatttttcgtaagagcattagcacattttatttgaaataggaagaaacgcctgacaatgttcccactcccattcatttttaaattttttttgagtctgaaattattcacaagtttccgttcgtatattcagcgcgcctttcaacaaccgtagtttttattagagtccggtttccttttgcagatttatttctatgagagatgcgcgaaaaacatattttagaatccttcgattcatcgcacctattctctcctagaaatccctattttggaattttcgcccctcagatttgcctctatttggggtttcgtcccgttttttgacctattttggctttgtattccattcgaaatttagaattcatcctcattaattcagaaattgttttggtcccaatcaattt

SEQ ID NO: 21058 - DNA, 2795 bp, Heterodera glycines
  misc_feature (35)..(35): n is a, c, g, or t
aaaaataaccaaaaacttttcacataatgttaacngagacacaaaaacatttgtcggaattgcaaaaattaaatgggaaatgggcaaatgaaaagcaaaaatcagtcattggggggggagagaatttacaaaatggcatttggcaaaaaagccacgggaaaatgagaaaaagggcgataaaggagagaaacgggagaaaatgatcagaatattatagagaagacgaagcaaagaatgggaaaatgatggacagataaaaggaacagcaaaagatggaaaggaaaagcgggggcggagagatgcccagcagatgttttttgttggccatataatgtgagagaatggcgatggaatgggggggagggggcggctgatggcatgacaaatgggggaaagcagtgaccgaccgaccaacggacgacccccaaaaactgcgggggacggacggacggacggacagacaccgcttaactgcactaatccgtttaaaaatagttgcattcaaagggcggcacaatggagaaaagcgaagatcttgaagacaaagcgacaaaaagagcattggcacggattgcgtgaccttttagggttggcatttgtaaagggaaggggcggggaaggaagcggcaaagagagggggagggagtcattagctaattaggcatgcgaaacataaacatttgtacaagaagcggttaaatgggctttgagtcattggcatttccctttcgacaatttccaacactaattgattcattttcgacttccaatttccctttcgtcgtttccccgtcattttccaatgattcaatttgccattctccgattggactttcttcgttcatcgttttgctctccaactgatccgtgccggcaatgtcagcagatagccgtggtcgtacatgtaaattcgcctgtcatttggtttcaattggccatcgatccgccatttgtcctcaattaataaataaataaattaattaattgcccccgctgaccgatcaaacggattgtaagtgatgtgattggcatttccgtacaaattcacccagcggatgttcggctgacggtacttttcccggtaaaagtcgaacgccaccgaaatgtccgttgtcaattcggtggaactgcgcaccaaatacagaaccccacagaggacaaatccgttcgaaacatcggtgtgattaatctgaaaaaagagagaaaataaggcgaggcggggagggggggggagcaatcggcggggttccgcgcaaaaggcgccggaagatttttggacaataactttgcttgttgtcaatcaaatttaagtcttcttggtttagttggatagctagcagctaatgtgtttgttattattctgccaaatctcaaaaatttctttaaattttggctttaaggactcaaaaacttagtttttcgtatttttttgccctgatttttttgtatatgaaaaagaattttaaatttgcagattaatagaattttcaagtgcttcagaacaataaaaagaatgcttaatatggttgagaaaggaaaaaaatttatcaaaaaagcatccggcgacgttttttcatgatccgtgcgggtgggaaaagcattttaatcaatttggcggtaattaggtaattaatgacaaatggtaaaatataccattgtcagattccatatgctgtacatggacaaattgttgatgtccattttggccacgctcagataagggacgtcttcgaaatggaacagcaactaacaaataaataaatgggaatggaaatttatcaagcagtacggtactcatggtgtcatacagtacccaaagtgcgttttcgtccaccgcaatgtccatgtaacttttggaagcattgaacaaatactaaatttaattcatatgtatttttttctttacagtattttgagctaaattttaataattgcctatttaaatgcttttaatttatttattaatttaaatttgtttttttcaattttaacgtcgtcgtatttatgtgcgattccttccgctatttgaacttcgtcatagcgatgcgaatgcagctcatatttggccagcattggagtgccagaacggtgataaaagaaggagccgttgaagaagacggaattggagccacggaaagggtgggggagagaatgactgacggagggacgacccctggggggacaaaggggaaaagccgaaaatcaaaaaggaaaagccaaaaatagagaggaaaagtcgaaaaattaaaaggaaaagcagaaatggaaaatgaagaaaagcacgaaaactgaagcaaacgcaaggaaagcagaagactgtgtgccttgatgcaacgagaactactcacctgcgaaggtcggcctcggaagcgaattccatgagagaatcgccttcaaaatggacggccaaccaacgtttgtttaagtcagcagccgagcggggataagcatctgagagggagggggagattaaaagcatgggaatggtcaaatctgatcaaatttatggccaattccgtattggcaatttaaaagaactcatggacatttaattgatcagagaatattctgttgatcaaacagttttcgtatcagcgatcactttgtgatcattgttaacccaacctctcatccacgcgccgtaaaaagtgttggcgtgggcatgaaagatcggcttgccgactccgtccaggaagcaatctgtgaaagaggacaattgacaggattatcataagcgacgcaacggtcttttttggatccgactttaaggatggctttcaaatgccttttcatcg

SEQ ID NO: 21059 - DNA, 896 bp, Heterodera glycines
  misc_feature (85)..(85): n is a, c, g, or t
agttgcgttaagacagatttgacatcggaattatgaccttcagggattggagttgggaacgaattgatttggcataccgtatgtncgggttgaccattttgctggggaacaggaaaggactcttgatcggtgaggaattcttcggagtcattgtacgccaatttcagttgggctcggaaatgagcggacattggaaaacgtgaaaaacaaaataaaacgaaaaaaaagacaaattaggggaaaacaaatttacggaaaatagacaaaaaaagggaaggggaaaatagtgggaattaggggtattttcccggccgttgtgtcgcgattggcggggatttgcccaatgcgattttaacctttccagactcttgaataggactcaaaaaattgttcacacaaaaattcaacaaatcactttatttctcgatcactctttaaattggcgaagaaaaatgcaacggtgaaaagcgatgggacgcaatggaaaaagcggaaattgcacgaatagggaacagaaagggaataaaaaggagcagggaacaatcccttttaaaggctttatgtgggggaagggggagagggtggataagcaaaggcatcattgaccgggcgaggaggcgttgtaaagtgtaggggggggggggggtggaagaaggcttaatcatttcgcaaaacgcgacactcccgccgccataaaaaatggcacatgtgcgaaaggtgatttggggaaaagtggggaacagggggggccatttggaaacttgatctgatttaacggaatcggcactgcggtggacggcttcattccttctttttccacgaaagtcacacgttcgggattgaatttgcgtaccgcccgaggaccattctgatagtgcttgatcgggccgactcca

SEQ ID NO: 21060 - DNA, 1508 bp, Heterodera glycines
actcagtcaaatcattaacactaaatcccgatcattttcttccatggtttctcctgatcaaatgtaatcatgcagtagtgattgaactgtctgttcttcagctgccctcccactacgaccgcgatggtgccaatgccaatgccaaccatgcgctgttggcacggggcgacttggccaacgacgacggcaacaacgatccgatgggctttggccaggcggaagcggaccaaacggcacgccatcggcgcgggccggcactcatccttctgctggtcgtgttgccgctggttgttggcgcatttacagtgagtgccgttttaaaattccggaaatgccaaattcgaattttccaaaaaaaaaatcggacggaatgccaaaaaagtgaaaattttttaaattaaaacggaaagatttacttttaattagagtgccacgggaacgggaccaaaacacggacaactgagtaccgaagtcccggttttgaccaggaccgggactagtcccggttttcccagccaaaaattcccgggttttgaacccgaaaaggtcccggtcccggttaagcccaaaattcccgggttttgaacccgaaaaggtcccggtcccggttaagcccaaaattcccggtcctgtggcactctacctttaataattaattttcaaaagattttattttaaaaatttgctgtccgtgtcgtattttttttaaatggattattcgtggtgactattttcccaaaaaaaaacattacgccaaacattgtgccaaaattaaaaatttttttcgttcccctccccaccccccaaaggtgctgctcgtctttctcaactaccactgcaacatgctctgatcattaatttggcacaaaaaaagagtgattgatagacaggatttatatagatatttttagcttttatctcgcctattcgcttttttgcattttaatttcgccattgtaaaattataaaaaattatactatttttttttattaaaaaagtaataattttttctaaatttaaaataaaaaattttctttcattttctgatgctctaaaaaacctttaaaataatttaatgatgaaatattttttgcgaaataaaattcttatttttaatatttctttttaaaataaattttctattatttatatttttgtcactaataattagggctgggatttttatgtgctaaaaatcctgaaatatgtaataaaatatgtgctaaaacgcccaaaatatgtgttaaaactagagtagagcgggaccgggaccaaaacacggacaactgagtacaactgagtaccgaggtcccggttttgaccgggaccgggaccagtcccgggttttttcccggttttcccagccaaaaattcccggtttttcaacccgaaaaggtcccggtcccggttttgctcaaaattcccggtcccgctcaactctagttaaaacccaaaaaaggcctaaatatgtgttaaaaaatgcaaaatatgtgctaaaaattggaaa

SEQ ID NO: 21061 - DNA, 977 bp, Heterodera glycines
agccgcccaaatatgtgccatacgtttttatgtgccaaaacgccaaaatatgtgatttttatgtttttataagtcgctctaaatcaaaaattgttcggagaaaatgctatttttgggcttctctcgccataactaagccgcaaaaaaaaaatatatgttaaaacataaaaatcccagtcctactaataatcgaatattttctttattcttaacaaaaataattttataattaattccctgttttacattttaattaatttaatttaatttccatttttatcaatttatttttttattttaaattatttatttccaatattttccatcaattatatattatttttgcaaaaataaatcccttctcgtccccataaaaagtcaatcataaatatttacatccattttaccacatcatttccataattttctccacaaaaatgggcgacgccgccagcagaagtgcttttgtttgctccaattattttccatttaaaacgccaaattaagcgccaaatttaaaaattcaaattttcatttttgcctaaaagttcattcatcgcccggcatcctcattttcccccacatttggtgtgccaatggaagtgccgccgccgcaatattcaaatttggcggcgggcaccgtccgactaagtgccctcaggcgatttttgtgccgtgccgtcccccacccattttgccctcaagcggtccaataaatgatggtgggaggagcgaaaagtgtgccgtcttcggcgcccacaatggcacttttgctgccaccttctccggcggttggaaataaaataaaacaaaaaaagtgtatttattttgtttgtttttactcacggaactccccccgccaggcggcgccgttttttgaagaggattttggcacgaataaaagtgccattgaatgggccgccgggcgggtgggaaaacgaaaaataatttattggcgaaatttttattatgaaaaa

SEQ ID NO: 21062 - DNA, 1970 bp, Heterodera glycines
aataattagggtttgtaattatatgcacatgcatattttttcctggactgcgggaggcctgaaatgcacgaaaaacatgttttaacttgtgttgaagctttttaggacctatttcgatatgcatatttgggcgttttttcaacaaatcctttattaaaacggccccctctattaaagcggccattttggcctctaatgactgaaaatttttcaaaaatttttgggtttttctgacaaaaaagtaactttttaaaaaattggaaaattatgccaaaaatagtcagaaaaaaaagaaaattatcaatttttaactcaattttcttcaaaataaataaattttacttttattttgtatttttcgttctaaaatgattattgctactattttttagctattttcgggatttttatgcttaaatttaacaaatttgatgaaatttgtaaaaatggccctcaatttggaaaaaattatgtgcatatttttcacttttaggtgcatattttgcaatttttggtgcaaatttcatgcgcatattttaagattttatgtgcatataattacaagccctagtaataataatcatttttttacgaaaattttatttattgtttcatgaattaaattcattcggtatttaaattctaaataaattcttttgagaatacttgcagaggattttgtaaatcgtgaatcgttagaatatttacaatcctgttcttatcaatcgactttttgaattttttgtaaaatttggctaggtgtacgctttatgaacaattcattgatttatcgcatggacggtaaaaaaaagaaaaatcgccaaaaaaaatcatcagggtaacgactaaggctgcaatttttaggctctaaaactggcaaaaagttttcggggtcgctgattgcgaatcaggcatccttttcggccaattccaaatcccggacccgaattcgaacaagaaatcgaaaaattaaatttttttatttttcatttttagtctaaaaatggtttaaattatttttaattgaagcactgatgactttcagttcctttccgtgtatttaaacaatgctaaccaataatatgaaaagcaaaaattttaattttcgactttttgttcgaatttgggtccgggatttggaattggcagaaatgcataccggattcgcgatcagcgaacacgaaaacttatagtttggcatattttattctgaagtgtaaaaaaatttttcaaaggatttgttcaaaccccgcggcgaagaacctgctgcgaaccatgtgcggcgagctggccgcggtaaaccgaccccgactccaagcagttgtctatttcgtgcgtttgaatcgattttcatcaaaatgtgcttttttaaaattgaattttcgattttgggttcgaatcagggttcggagtttggaacagtttgaaacataaatattgaaaccggaattccacatcagtaatacaacaaatgcttttattgtataaaaaatgcgcgtaataacaaaaaaaatttcttccgttctttgatcacataaatgtccctgaaagaagaaaaaaatcattgacaaaaagtgtgataaaagttgaaccgttcgctcggcgctggcggcggcgtgggagctgatgagcgcccccggctccttgagccgccgctcccttgcctcccaggatgttctcccacagatcatcctggaacatggcgagttggccgtctccttcatcgccaaaaaaaaatgtaaagccaaaagaaaagcatcaaaagaatgacgacgacgaaaagggcgacttggattaacatttcttaagaaaaaagaaattttaaaaatgttgaaaatgttttatttttaataaatttgcatttatgactttatcaatgtgtatacgaaaacagttacaatttttttatgaattgatacgcatttttaggaaaatcgcaaaaaatatacattgtaaactgcggcaacgat

SEQ ID NO: 21063 - DNA, 1681 bp, Heterodera glycines
tttgatggcatctacaaaaacaaagtcagcgtgaaaattctagtgtgacaaaagtatcgaggaaatttaaccaataaatgcacacaaacaacatatttattcaaatatagaaaattgtgtgaattattgatgcagttcagcaatgacgtcacacgtgaagccgctgccaaaatcaatcagcctggtcactcacctatccaatattgttgaccacaattccataaggggcaggtcgttgttgaccacaatcccataaggggcaggtcgttgttgaccacaatcccataaggggcaggtcgttgttgaccacaatcccataaggggcaggtcgttgttgaccacaatcccataaggggcaggtcgttgttgaccacaatcccataaggggcaggtcgttgttgaccacaatcccataaggggcaggtcttgcttggttcaccacaatcccaatggctagtgtaggaatcctacgctaggtcattagtcagcgtaggaatcctacgctaggtttttcaaaaatgatccgaggaagcgattttccactcccttttatagactttgagctcgagtaggataactacattagcctagtgtaggaaaggctagtgtaggaatcctacgctaggtcattagtcagcgtaggattcctacgctagtttttcaaaaatgatccgaggaagcgattttccactcccttttatagactttgagctcgagtatgataactacattagcctagtgtaggaaaggctagtgtaggaatcctacgctatgtcatcacgtattcgtgatcagcgtcataaaatagccctaatgacatgtttttgaaagatttttggtgaaaaatttttccactcaaaaatcctggtcacccccctttggactggaatcccaaaatcacttttatttttataacatttttcaaaaaagtgataaaaatgtgaaataaaatttataaaatagagctaaaaattgcggatttttgtagcattttacttttcctgaatatcttttcagaagcgagttataaatttttttctgaaaatccgaatttttacagaatttctagaataacttttttcatatttatgttacaaaagccaaataaaacccataaaattctcctgatttttctccatttttaatgctttatttaatcaaaattggtcaaaccttaggccagatatgaattttcgaatattcgaccaaatttccaaggaccaaaaaaattaaaaatattttcgaatttttaaaaaattccaaaaattctgaaacgtaaaacaaacatcatattcgtgctcagcacctcaaaataccccagaaaaatatttttgaccccctttttcaacccaaaaaaaatttttgaaaatttctagggggcctagctcgaaaaattttgaaaattttcgaacatgtagtacaccattcgatagcatttaaaaagttctacaattttgccctaaggagttttttcgataaaaccaacccctgacgagttatgggcccgggactcaaatgtcccgctgaggccaaaatttttttctatttccgggaaaaaatcgaaatttttccgaaaaaaataccagtcgatagagctcgaaaaactatgttttggaagtggtctccgtttctctgggaaaaatcgttaaaaaatcctaaaattcaaaaacccgaaaaccta

SEQ ID NO: 21064 - DNA, 2662 bp, Heterodera glycines
attaatttcaattatttcaacaataaataaatgaaatcaatttctaaaacataaattgaattcggttgggttttccttttggtcatttcaaaaataaaaccataaattcttttttttataataataatttggtttatattttttatgtgttcgacaaaagtggtcgattggtggagcattggaagatggaacggctaattgccaccagtgaaatggtcaaaggtgttcaaattgttcaggaaaagccaggaagtaaaataaaaagaaaaagtaacattaattaaaaattatttattaagcgccaataattgctgtcattgtgccaaagtcattcaaccaaataactgttgctgatctgaagcaagaaatgatcgcaatctgccgggaacagaaggcaaattgcatgattaaccagaattttatatttacaaaataaaatatattttaaagtataattaatttttttttaactaattaatttaaatatttaaattaaattaattgaaaatttcattaaaaattaatataatttttttttattaataatacatataaaaaatttttgaattcaattttttcaatttagcttaacccgcccgaacaggtggccattgtgaaggattttccccgtgtgaatacgcgaattcaaaaatataaaattcgtgaagaattgaatgccaggaaattgtccttatattaattttttagaattttaaataataaatattattaatttattttgcttcaatttaaagaaaatttcatttcgaatcttccatttttcactttgatcacgaggcgaataattatacggatataaaatcacgaagaatattaaattatattaaattacaaaatattattttattataaaattttagtaaaacctctaaaatggttaaatacgggtattgaaaatcattttagagaaacagcgatagaataaaatttcaaaaataattttaagtgaaataagaacctcgaaatttcatatttttttaatgcttatttttcacacaagtttttcatttttttaaagaattaattagagtgccacgggaccgagaattttttgggttgaaaaaccgggaatttttggctgggaaaaccgggaaaaaaccgggactagtcccggtcccggtcaaaaccgggaccttggtactcagttgtactcagttgtccgctaccaggtcccggtcccgtggcactctagaattaatcaaacaaaattatccatatttattctaaaaaatgatttttttaaacaaatttccgatctttagggacaaaaaggtcacatttgtctgctgcgggccgttctaataaagttttttccgacttttcccctaaaatagaaatactaatttcttatccaacctgttataccaccacaattattattcaccatcgcatttttggttgagcccaccaccaaaaataataataataaaatcaaatcgtttgtcgtcgtcgccggtaattttgaattggttggcgatgtgattttccggtttttttgtccgtcccccgtcccaaccccctgctgaaaagaaagatgcgcaatttggttgggagatgaatgtgaaatttggggggaggggcggaggatgggacgagcggtgaatgaacgcacccttttttggtgtcccaccaaatttcactacaataaattactctcggaaccaaaaaaagatttatgctataattattataattatttcattaatattattttatagccccgcccccacccctttttggtggtggaaatctccgaaaatccaaaacaaaacaattgcgtttttacttttatgggggcacttttaattaatttaatgggcgaactggtggcaatttggtttctttatcagttaattaattggttaattaattaattaattaacccctctccccaaattaaatttaatttgttaattgtacggggaaagaattcttatcccatagtttaatgttgaaaaattcgctaaaattttgttacttataaataatgaattttttaagtatcccaaagaatattatataaattaataaaagaaaaataaaatttattaaatattttacgcatcgaattaattaatagttaattatgtcataaaattagaaaatttgcattacaattcccatttaatcgtttgttatttattgattcaatttagggggtctccgattaacattttcaaaagttaatcaccactaatatgtttgtaatattctgcatgcaaaatgttacattctttacaataacaaaacaaggcatttttttatttaaaatattcaaatttaatacaaaaattttttaagcatttatgtcacaaaaaaattaaaagaaactaattttatttttaacttagaacgaagaaaataaatttaatacaagtgcaacttgataataaaataaaataaatatggctggaatttaaaaaaaaatttttttttttctaaaaaccaaaatatattaaaatttaatattttaaaaagatggaaatatgctaaaatatgtaaataaaaatttcaaatttttgttcgccaacataaaaaaaatgtttttccaactattcaaatctaaaagatccaggaaaaaggatatttaaacgaaattttcccttgtgtaagaataaatataaataaatttgtaataaaa

SEQ ID NO: 21065 - DNA, 2094 bp, Heterodera glycines
  misc_feature (1964)..(1964): n is a, c, g, or t
  misc_feature (1975)..(1975): n is a, c, g, or t
  misc_feature (2002)..(2002): n is a, c, g, or t
  misc_feature (2010)..(2010): n is a, c, g, or t
  misc_feature (2013)..(2013): n is a, c, g, or t
  misc_feature (2046)..(2046): n is a, c, g, or t
ttgtcctcggctgaattgtcctaggctgagtttgttatcccagctgactgatcctgacgcgagaacaattatttaaaaataatacaaaacgccagaaaagcaattttttttttgttttttttctgaaaacaaacataaaaaatatgtatgaaacaattgcgaaatttcgtttttttttgcgcatttatgaaaaagccatatgaaattccatttttgcaaacttttttggcaaaacatcgcattttacctaattaaaatttctgtaaaaaatacccactttttatcaattgaatgctcttagtgtttttataatccgtgaacattggcacttcaattgccgcactgataaatgaaatcgcaattttcattgacacaaaatatttggtcaacagtttcacatcaattggcaattttgaaggcgattcgtgcatttgggccgataaagatttcgaaattttattccagcttaaatttaattttaattaaaaaatttcaattaaaatttaaataatgacctaattaaattaataaatactaaaaaattaataaattttaattaatataaaagggttaatgatttggtttggcgattttatgatgaaatgggggattggcaacacttaaaatggcaaatcgtaacagattttattaatttttaaataaaatttagatatttattttcataaataaagcaaaatgaattttttaatagaaggcaaatcgtgcatttgggccgataaagaaaatgaaattttattccaccttcaaatttaactaataaatgccaaaaatttacatttggcttagtttaaaaatgattaataaaaaaattttaaaataaaaagttagtttttttttgctaattgtttcatgtatttatttaaataaaaaattaagaagctttttatatcaaaaattcatattgttttcttggtaaaaaaaattctagcattatttaaaatttaaaaaaattgttcaaattgccgtcattaagaatgaattttttaaaaatttaatttcctaattaatttttccattaccaaattttggatttaaaaaaaatttcctagatttcttgtgctaaaaattccagccaatactaaaattctttcttaatttagaatttaaatattaaaaaacaaaattactttttgagtccttccgaaaatgtttgataaatgtgcagttcaatgattgccattatgtcattcgacggcacaaaagcgttgtttattgtcatctccaacattctgccaatttttatggcgaaacgttcaattaaactccgatgagtttggcgaagtgtgtcctcatcataatccatcgcattttccaccaaaattttgtccaaattaattgttccaccacctccgccaccaatgttttgttgatatttgtttttaaatttgaaattcaaaatttcaatgtcattttcgaacaaatttttaattttcggtggcatttggccaagcattttgatgacaattgaaaaatattccttggccatgtcgtccacaacgtaccaattgtccatgtaaatttgtgtaagattttcttttgcttccagcagcgaatcaatttgttgaataaattcattttttgatgtttggtgattttttgatcttttatagcttgaagttggctagacatatttttaaataatttatttttaattgaataaaatttaaaataatctttttactcgttttcagttaaatttaaatataattattctttaatcatttaaaaaagaaaagcccaaaatataattcttcttttatcaaatacataaatatttaattttagttaaaataaaaattaatttatatatatataatatttttaatagaattaaaattaaaaaattttaaatcgtttgaaaaattgaaagcccaaaatatgcttttacatcgttttcctgataatgttcatttttggctcttttattgcttgaacttggctanatatatttttnaattaatttctctgaattaaaatctanatatattntanatgcgtcataacattatttaaaaattcatttanaattgaaattaataagggcgaaatttttaaaattaatttataattgag

SEQ ID NO: 21066 - DNA, 1241 bp, Heterodera glycines
aaaagaaaacatattattaaggagttttgaggttgctgaacacggttatgacatccatttgaccaaattcgaacaccgaaccctgactcgaacaaaaagccgaaatttaattttcgacaaaattcaaaattggatggaccagcggacggctggcggacgggcgacttttctctgattgcttcttgcgcttagatggggtgggaaacgacggctaatggctattcactttttgcgttgagggaaggggattttggatgggagtggacgatgattacgtgatgcgatgagaggaggagagacgaggcgggagggggggggggggatcgttcgtcattagtcaaaatggatgtcagcttcgtgatcaaagaccccccagaaccccaacaaaaacgcttgacgacttttttaaactttggggaacaaactgcactattaccaaaattacaatggggttttccgaatttcagtacttttcgagaatattctggaacaatttacttacataaaacttagactttaagctttcgattaataccaagaatgtatgtcttgagtaagaaaaaagttatggcttaagaaactaagtgtggtcattgattggacgtgtaactgtcgatttagcaaacaactcatcgcacagaacaatttgcaaataaatttctgatgtcaaaacatcaaaaaagtgctgttacgccaccaacgacgacgacaacggcggcagagagtggcggcgaaagagacggacgcactgagacgacaagcggacagcggaaacgacacagcgcaaaccaaacggactcggcgaacggcgccgctgggggacaaggtttattcccgggctttggtttctgctgggaggtgttcatgtccacaaaaatcgccacactgttcgtcattggtttgagtttaaaatggccgggagtaaaattatttgttttttcgaaaaaccatatcggagatccttttgataattgacccaggtgcgttttgaaatacccaagtccattgactcgttaagttaccgattgactgccggccaaacaatttgtttgtttagggtcgaataacgccgttgttttgtcctcttctgagtcggctgcaaaggaagcaaaggtcagaaagatgtcgacaacatcgcagaacaaggttttaattggggatggaaatttgaaatcgactaggaacggcagggcttggaaaccaaagcagggcgggagtctcggtacaaagccttcattttt

SEQ ID NO: 21067 - DNA, 1891 bp, Heterodera glycines
  misc_feature (308)..(308): n is a, c, g, or t
  misc_feature (1878)..(1878): n is a, c, g, or t
tctctctctctctctctcgctctctcccagtctctctctctcttcttttctctcaccctctcctctctatcctctttctctctccatttttctctctctatcttcttttctctctccccacttttctctctctttttttctctctctgtatcgctctcgctctttttccttacatattccataaaagcatattcgttttatttcattgattaatgttaaaaattaagcaaaaagttatatttaatttaaaaactaaaaaagtgaaaacaatttaataaacattaaatatgcggtcagggtcgtttcgntaccgccggttttcgtacgggggacattttcgtacgagttcttgtacaagcgtcagattcaaatagaaaaacttaagaactaataaaaccaaaatttatcattttttgtttcccattcataaaattttgtagaaaattcataactttataataataacaaaatccgggacaaactaggtcgcatctcatagtttcggaaaataccagcgagaaaattgttaaggttttcgggattggcattcgcataattgtgatcattttgagggacaatattgttattgatatcgttatagcgttggacgagacgaagaatgcgtgcgtcggcatcgcgatacttctttttctgtgcaccatcatgcaccaatttatcattatttagttttgttttaattacttgctgctggttcattttgtaattaataaaagcttaactttcaaaacattaaaagtaattaaattaacaaattatttgaatgcaattttttttttttgcatatccactcgtacgaaaactgcggtacgaaaacgtccccggtacgaaaatggcggtacgaaaacggcggtacgaaaacgtcctggcccaaaagaatggcatgtgccacttacacttttggtggaaatgagggcaaatgtgaagtagtgataaaagacaacaaattgaaattttgatttgaaaagcagaaaagtagaaagtcagacctccagcaaagggaaatttggttttttatagaaggagaaaacaaaaaaattttgaggaaatttagtaataggtaatagtttaatgttttttatttatttattttttgaagaaattgttagaggtctggtagaactatttgttgaaaagatgagggaattgtttttcgagcgattgcatttggtgaacaattttgtcggtgggtggcaaagaacttaatgcttcatgacagacaaggattgttttgtcaaaaatttccggcggtttggaaatgtcttcgctggcctccttctggtttggtccttttgcaacaacgggagtctggtcatttgtcgtttgtgagagctgggttggaggtgccaatggagttgggttttgttgacgttttcggagacgcgcttcgtattcatctttgagttgttatttggacagtgccgggcggacgaacagacgggtctggttctgttgagaacgaactcgagcacgctcgcgcttccatcctccgagtgccacgtgttggtgtgtgggtgttggcatgaccaccttgagcgggcgtggagttgttcgctgcgggtcgtaccggccgagtcgaaagacggtggttggttcggcctcaacttcaagatggtccaagattttggtggtggcttccctgtcttcctgaacacgctccgatgggcaaacggcattgctttccgggaggccaataaacaccaatctacgttggcgttcttgttctgcgagtgcggcagtgattgggtccattgccggtgccattgaacgtttggcgcgaggcggggtgatgtttgttgcgttggttcgcttcatgtcgaataattagaaaataatatttgttttttgtcgttgttaatnacagaaaactagc

SEQ ID NO: 21068 - DNA, 2342 bp, Heterodera glycines
ctcgttattttcgctcacagagcacttgtaagacctcacaatagagtttaaagacttgtaaattgattgacagctctggattgctgaaaataacgagttcacacaaaaggtcgaaaagtcgaacattgttcgaactctacaaaaatgatcaggaagacatttccagacagggggttgctccaaggggggtcaaaatgttgttatttttgctccaaaacgacgtttagacccacttttaggagttcgaacaaatttcattaaccatttccggtcacagaacatttctaagacctcagaaaagagtttaaagacttgtaagttgattgacagctctggattgctgaaaataacgagttcgaacaaaaggtcgaaaagtcgaacattgttcgaactctacaaaaatgatcaggaagacatttccagacagggggttgctccaaggggggtcaaaatgttgttatttttgctccaaaacgacgtttagacccacttttaggagttcgaacaaatttcattaaccatttccggtcacagaacatttctaagacctcagaaaagagtttaaagacttgtaagttgattgacagctctggattgctgaaaataacgagttcgaacaaaaggtcgaaaagtcgaacattgttcgaactctacaaaaatgatcaggaagacatttccagacagggcgttgctccaaggggggtcaaaatgttgttatttttgctccaaaacgacgtttagacctacttttaggagttcgaacaaatttcattaaccatttccggtcacagaacatttctaagatttcagaaaagagtttaaagacttgtaagttgattgacagctctggattgctgaaaataacgagttcgaacaaaaggtcgaaaagtcgaacattgttcgaactcgttattttcgctcacagagcacttgtaagacctcagaaaagagtttaaagacttgtaaattgattgacagctctggattgctgaaaataacgagttcgaacaaaaggtcgaaaagtcgaacattgttcgaactctacaaaaatgatcaggattaggtctaaaatctgaattaaataaaaatgaatataaagtagcgtaataaagtgatttaatacatttaacttaaagtaattttaaaatgcattttttcatttgaaaatattctttttcatattagaaaattaatatataaaaacgaatataattaaggaattaatatttattataaaatgagaagcaaaggggaaaatttttcaccatttagttaacaattatccattcctttgaactcaccctgtggccaagtggttaagctcctcgcttccactctcaacggttcgagaccgcgaccatgtttttgattttccacaatttatcggaaatagtcgcgcagctctcgctcgtttaaattaattaattaaaatttaaattaattaaattctcacgcacaagtccatccaataaggtttccggttgaagggatcaaagatcatccaatagtatggggggggggggggccaaataaaattatcgattaataaatttaaaaaaacaaattaaattaaagtcgatttcattagtcagagaaatcatagaatgtactctctctctctctctctctctcgaggagaccatccaataggtttgggtttgtggaaggggatgtcagagaaaaaaagtagacacactcaaattatcgatcgaaatcaatcgataatttgattgggaatattatctacttttctctctcttcctctctctccctctctctcttcttctctctctctctttctctctctcttcttttctctctctatcactctctctcctcttttctctctctcctcttctccctttctttctctttttccctcttctgtttctctctttctcgcttctcttctctctccccctctctctctctacctcctgtttttctctttatctctctctcctttttttcattctctcaactccttttttattctctctcgatttaatcattctctcactctctccctcttctctttctctttctgtccttttttttctctctctcgctcctcttctttctctctcccccctctctctctttctcttatttgtctctgtctcattcactcccatactttctctctcttttttcctttttctctaatcatttctctcctttactctccgctctttgttcctaactgtcttcatctctctctcttcttcactctatcttacaatacaacttatctctattatctctgatttttcacttcatttctttccatccaaataaaaacaatcgccgtcaaaactttatttaaatttttttgtttactt

SEQ ID NO: 21069 - DNA, 999 bp, Heterodera glycines
ttcgttacatccaaatgcaacgttcaacgtctggtgtaggattgatgtagtctaaaatgaatttttaacagacgcgcccactacgaaacagtttactcagatggagagtagatttgttcgttacatccaaatgccacgttcaacgtctggtgtaggaatgatgtagtctaaaatgaatttttaacagacgcgcccacgacgaaacagtttactcagatggagagaatagatttgttcgttacatccaaatgccacgttcaacgtctggtgtaggaaggatgtagtctaaaatgaatttttaacagacgcgcccactacgaaacagtttactcagatggagagaatagatttgttcgttacatccaaatgcacgaacgtctggtgtaggaaggatgtagtctaaaatgaatttttaacagacgcgcccactacgaaacagtttactcagatggagagtagatttgttcgttacatccaaatgccacgttcaacgtctggtgtaggaatgatgtagcctaaaaagaatttttaacagacgcgcccactacgaaacagtttactcagatggagagaatagatttgttcgttacatccaaatgcaacgttcaacgtctggtgtaggaatgatgtagtctaaaatgaatttttaacagacgcgcccactacgaaacagtttactcagatggagagagtagatttgttcgttacatccaaatgcaacgttcaacgtctggtgtaggaatgatgtagcctaaaatgaatttttaacagacgcgcccactacgaaacagtttactcagatggagagtagatttgttcgttacatccaaatgcaacgttcaacgtctgggggaggaaggatgtaggctaaaatgaatttttaacagacgcgcccactaccaaacagcttactccgatggaaagtaaatttgttcgttacatccaaatgccactttcaacgtctggtgtaggaatgatgtagcctaaaaagaattttta

SEQ ID NO: 21070 - DNA, 1921 bp, Heterodera glycines
tcaaggattgatcggaaagagactctaaatgagcattaattatgcctttggctaataaaaaatgatttggttacatttttgtttgttgatttttagacagaaaattgaatcttatggaatacattttttgtcgatcgttaggatggaaatatgaattataattaccttttgtgtgtgtttttagattgaaaatcaaattttaatgaaatttgttttcaatttttattgcatttgtttgttgatttttaggtcgaaaattcgaattataacgctttcttaatgaatgactaacttcgtgttgatcaaaaagaaaaaatttaaaaaaaaaatacaaatgagggttgaccttcgctcccacctgctggccaggacatcgggcgtttatccaaaaatatttttaaatttaaatccaaaaaaaaattaaaaaattattttacaccaaaaaaggtttgcgtgatcagatgaagaattccatgcaatcagtgccttgtgatgtcaaacaacaggtggtgaatgcttgcaccaacatgttgatcaacaatttgccgttttcaagcgtcgaagaggcggaaaaacaagcattggcccaatacccagatgctttggttagtttaactgatttgcaactttattcgggaaataagttcatgaatttcgagaaaaaaatgataattagtggataatgggttaaattttttttaaaaattcaatgaaaattgggtcccacttctgtcgaaaggtgaagccgaggaaaaaagtttgaattttaaattattaagaaaaatgaggtactttatttaaatttcactcattcaattttgactaaaattaaaagaaatgctacaacacaagaattaatcattaattttaataaaatggtatatttcgcacttccgaaaataaatttatttaaaatataaaaaatttcaataaaattaattacttttattacaatagaatgcaatgcaagcaatgtggaacaaagtgaaggagatgaagtcatgcttggcaacctgttttgcagggcgagttcagaatcaaactgcacaacaaattgtgcaacaattttcggttaaatcaattaaataaataattgtcatcaattcattaattagtctcaattttccctaattagagttccgatttcacgtcaatgaccccaagggacatgtgcaaccaaggcgtgaatatgcaccatcagttgtcagcggaggacaacaagaatttgcatgcgtgcagtgcccaacagattggcacaggcatggagccattcggaatgttcaaacatggccaaggtggacctgctgctgatggtatataatttttaaaaatttataataaatgtacggtaacgtgtacagtagtattacatgtgttgacaaagaattaaaaattctttggccaattccaatctgagatttctgttttttagtgacatactgtacgaattttttatataacgattgatcaaaggagggttgggcactttggagacatagatggataaggaagcgggttgggggataaatttcgtaaatcgtacggggggggggggtccgaggcttttcgtataattttcggggaaaatcgaaaaagcactgttattgattgacaaaaaattttttatggtatatttgttaacatttttaaattctatttagttttttaaatttcgtagaaattttggcctctgaggcgagggggtgggtatttcgtatcgtaaaggaaaatttctgacctcccctcggcccatgctacttttcttttaattttgaaaatttcatttgaattagcaggcgcaaatggtggcgctgctgcatttgccaaccaaaacaatcccatgggcaacggcggtggcatgatgatggcccctgcggcgattggtgctggtcaacaacaacaggcggcgccggcggcaaca

SEQ ID NO: 21071 - DNA, 1086 bp, Heterodera glycines
  misc_feature (10)..(12): n is a, c, g, or t
cttgcatggnnnctgcaggtcgagcaaaaaagtagttagttattaatttgaaaagagccaaagtacacggagagaaatgtcggaaattgggggggggggggaaagaaaaatggaaaaataatttaaatagacataaaaaggaagactcctttgagtgaattaatccgaaatcggatgatcagatggtggtcatgatcattaaggaagtgacgagtgatgatcagactgatgatgatgatgatcataatgagtctccatatttccctttgcccacgcgacgccattcactcacaaaacatccaaccgaaccgatcaaaacgaatgccaatcgatcggtagacaatttatgtgatttgtttttacttaaaattacttatttattaattttgaagggtttaatgaaaggagtgaattgaaaagcagaaattagatgagacacaattgcaaaactgttgatcagtctgatcattttgttgccccgcccgtccgatgatcgaaacgaaacccatcccaccacaaccgccaccccaatcagcagaagcagcagcaaaacgacaagttgctgctgatgattgagcctggcgctggtgatgatgatgggtgggagggtaagctcttaatgaagggtccttggcttgctttctttttgctgtcattggtgctgcaacagagaacaaatcaaagggggaatcgatgggaaatgaatttggatggcgatttggggaaaggggggggggggggatcatcagaagggatcaccagcaagggattaggattatcctccgcttctgttggcgagggacggacggacgacgaaatgcgctgggagagagaagaaacccactcactcattcattcaatttcggggatgaactgcataaattggacgcaataattaactcagagcggcggcgaccaaaagccatggaaaggcattttttaagtgaaagccaaaaaacacccacaaattttaatgttaaagaaattctttttttaataattcctagcctaagttatggcgaatatattcttgagaggccacttggaaatgcgtctgtccaaaccgttaattggcagccaattttt

SEQ ID NO: 21072 - DNA, 1728 bp, Heterodera glycines
atgccatttgaattaaagatgttttcttgaaacaataataatacggcaaaggttgacaaaatataaaaactgcgataatttgtgcgaaagtgtcaatcctttatcgcaaatggagggcgagaagagaaaaaaacaaagttttagtccactttaaaatttcattgtcgtaatttatttggaaaagttgtcaaaattgttatacatacaataacaaatcgaaagaaaagcagcaatccgcggaatcatattcttttaattattttgttaatttattttattttaagccgtattagaatgatgggtctacgattaataccaacagagaaagataagttatcaaaattagacaattcaaaaatgattatttctaccgtatttcaaggaaaaataattagtcattttgagtattagacaagggtaattgtttagaattgtggtccagatgaaaaaaaaataaaaattttctttccaatgaatttggggtaaaaaaaggcgatgatcacgaatctaattttattttgaaaaatcaatgattaaaaaaattagttttttctaagattttaatttttaaatttcgaaaattattattttttaatcgggaacacaattttactcaattgcctttaatagcaatttgaaggatgttttcagggtaaataacggtgtcattcatttagtaaaccgaatttatacaaaaaatgttcgcataaaaaatcaaatctctcgaattttcttctccacaaatactcatacattaaaaaataatcttaaaaatttggttctaatgcactttatgagttcaatcggtttttatgagcacaatcaattaaccatacctggtttttgtacaaaaaattgtttatgttcgattgagttctgtaatttggtatcattctaaggtacaaagtctgagtaaggtaataatgagaaaacaagagattccaaaacttattttcggctcagaatcagtttccggggattttcgagggtgctgaccacgaatcagaactcggatttgcccaatcccgtatccggacctaaactcggcaaaaagttgaattttttctaaattatcgttgagataaatcaaattttggcaaaattgcgcatttttatccaattaataattggagcattgttacatcattaattgctgttaaagcaattcatagctttttaaactcaactttttgttcgaattcgggtccggagttcgtaattggataaccggagtgtgaattagtaattatcaccttcaaaaactgatttttgagccaaaataaaataaatcaggactattattctttaccattgccaggaagacccaaattttaaaacctgacatgtttttgccgaaaatttattggtcgaatgtagagatctacaaaggcaaaatgacttgctgagccgccgattgtatgtgcatgtgattgcgcatatgcatttgtgcatgtttgtgtaaatttttaataaaacttcttagtttaaaccaaggatgcgatctgttctgatttgtcagaaatgttctgatttgaagggtccaaatctgataaaataaaaatgttctgatttgtcagaaatgttctgattttggggtagcgaacaaaatttgttctgatttgtcgcttctccgaaaaatctgttaaatttctttataaatttggattggcgtaccgtttaagaaaaatattattcaattttggcattataatttctttcttgctgtta

SEQ ID NO: 21073 - DNA, 1402 bp, Heterodera glycines
  misc_feature (1282)..(1282): n is a, c, g, or t
  misc_feature (1359)..(1359): n is a, c, g, or t
tgatgataatttgacacaatcattttctatcacttttacattttcccaattaatgcgctgacagatcgaatgagtttttgccgaagcttttcaccgcgtcttcaactggcactcgaatactcccaccatatatgccgggggatgatcccccgcccagcaggtggatgaccttttttttgctgcgagttttcaaaattttggtggacggggttcacgggaaaatttttctaaattttcctttttcactaaacggacaatttcgtcattgatatcactaagagccctccgatgaagatgatgagtcgtccgaagttttgtcagaagtcgaaccttccgagcccgaggccgatgatgagccggagctgctctcggaagtttcagtggtcccagtttccgtcgtctcctcggtcgtctcttccgtgtcgccgactctccgctgcccggtctctgtggcttcctctttctgcttctcgttcgccgccgacccgccctccttcttctcctcctcatgtcgctactgtgaaagaaaagcaacaaattttggatttcggagtggggcttttcggggacgccgatcactttatgaaattcaaagttttatcaatgccgaacctcggaagtcgaaaattgattgttcgccaaaattcacagaaatttttacaatttgaaagtgcggcccaaaaagcgctgattttaaagacaaaacttgtgtgattcactaatagccgaaccaattcactacaaatcaaaataaattgtgccaaccaaagggatccaaaacaacgacccttcgctccatttctcacttaaaataaaatgttcacgtgcattcgccaaaattaggaacacacaaaatgcaaaaaatgtagcagaaagggggggggggactcattcattcatttgtcgttgaggtgaggccaacaatttttcctttcccattctgtgattttcccactcattcgaagggatgtgtagtcatttttgtgggaattgtgccgagtttggcaccttttactggcacaaacaatcctttgcgactttttcattctcggaaatggaccaccgctcgctcactcattcctcaattaaaaaagcaaatgaatgaaaaggacgacgacgacgcgcccgagaagtgaataataatttggcatttatggcaattacaaaaaataaggcgcggatgggcgggcggacggaacggaacataaatagacgaacgaacagcctcgcctcctttcatttcccttcgccttattattcctccacagtcgccttctacctncacggatttctctcggttccatcgctttttgttacaaaatgttgaaaaatgaaacaacagcgaaatttgcttctttntgtcagtggtcgtcgcccaattccatgcgtcgtaagtgcaccg

SEQ ID NO: 21074 - DNA, 2107 bp, Heterodera glycines
atttgggcaggcgaacgtaaccgacgcggcccgaagtcttctagcgtgaggccgaattcagtggaaaaactgcacaatcgtacgacgaagaaatgtttggtaaaagaaaggagaaaaattagggaaaaatgggggaaatttggcaggctgaacgcgacccgataatgcgcataatggcggaccaattgtgtgaactgtgccacggaatgttctcccacgtgaaccccaatttgcgtgcccaatgctccagccaatgctacaaaaacgcgcaattccgcaaatgcgtggagatgtacacggcactgcccgaggggcacccgggcggaacggtggaaacgaaacgaggaaaaggggtggaagggagagaaacagaacaatggcaatgggcgcagaagagtgaacggacgacggacgaagccaaacgcaacggacgccaaatgggcgacaaacggacagtgtccattgtgaaatacttgtgaaggaagggaaggaactgtgctgatactgctccgactccttcgcatttgaacacagtccatttggaacaaatacctatatattttatctcttcattttttatcacgtttatcgatatccggtgattagccaattatacatacatacaatatacatacatagacacaaataatgatcacacaacggttttgatggaatgtgacaaatgggcgaaaatcaacatttatataccaaattaagacgcttcttttccagaaaaagtttcacttttgccaggcaaccaaaaggggccgataaaggaaggcattttccaccagacagcagtctactagagatcatactcataattttgaaactttatggcataatgtcactttgtggcaaaatttggtcattttctggacaaaatttgttaacaaatcacattaaaaattacaatttggcaaaatgcgccgcaaaaaatgaaaaagctgtttttgagcccgattgcttttgatttttaagccctattggcaaaataagcattttaagtttctaagactcgacccttctaagctcctttgttgtcatctataggaggttatttactatggctgaattgttattgtctaatggacaagcgattcggcaaagaaaacgcgggggcgtcggggaggttgtgcaggaattcgatgcctttctgaaggtttctgacgatgtcaaagaggagccgaaagcagtgaatggcatttgttagttttggtcttttacaattcagtcagtccttcttcaatttaagtgtttgtgctttgcttccttttggtcgccgttcttctcattggcgaactttacaatttcatgaccaattctgaagttgagtatcgttttgctgttgacaccgactttcaagagtaagcaagctcataggattttgcaaatatataaaaagttttgcacttttttgaagaatccattttagtaatccgatgttggacattgacatggtcatcgccgccccctgcaacaatttggccattatgccaatgggcgtcgattcgttggacggcgagggcacaactcgcttaaagaagagcccaactcggtgcgttctgctgaaaattttcatgtgctccaaatatttagatatgaaatgagtcctgacgaagaagagttgtggacggcgttgcagcgagtccaccgggagcactttaagccgggcacttccctgaaggctttgaacgaagttgtctcggaaaggaatttgaatatcacaccgaatttgcttcttttcagataaaatttgtggacgacgaaattgaggaaggtcttcaagaagtggaggaagagaaggagcggaatgagcgaatcgaaatggaaattaagcgggccgaggcaaaggccaaggggcgaggggagggcacggcggaagagcacgtcatcatgatgatcggcaacggattcggcatcttccagattatcgcctcaggacgtggtgagtcaacgggaagtcgtatcgagccaaaatttccaattctttttccggcggcaccgcagaatgaccataaaataatttgacaattttaaagcaccataactttttatagaaggatccaaattaaacattcttggtatcattcgacagctctaagag

SEQ ID NO: 21075 - DNA, 1023 bp, Heterodera glycines
ataatcatcttctacggaaaatttttcccaaccccctagaatttttttttcgaatttactcagattttcgtattttttcacccgcaaaaaatttgtgtttaatgaattttttcttacataaagtgaatagaaaatgcttaaaggatgtctgtacgttatcttagagctgattgctgttagtttgattcggttgggcaaatgttagaggcgatttaagcattttggcccttaatttctccggaaaacttggaaaattcaacacaactccgcctaaaagacagatttctgtctgcaaaagaaatagaaatgtgaaaaaagatttgttctttcttatttagcttattttatcagtttctttttggtagttattgagatttgattcgtttttatcaagtgtctctattttaaattaacacccctttttcgggaaaaaattcataaaatttttttccatcgtcatttcgccttctcctttttagaatcttaatattttcagaattgctacgtacagttaaaaattcagctcgatcggttcatgggaagtggtcaaactcccaaaaaacagggtgtctttattttaaattaacacagtgtattggtggctaaaggttttaaaattggaaaattcgcctctttcaggtcaaatcagcgttgttcaattgttgtcgacgcaaaatggacgcattggtgggacggttggggcgaagtgcggcggcggatgcgtattttgtacgatgcattcggccaaatgagtcgccagcagaggaaaatgtatttaaatagtaccaaaatcggcattggaaagattttaaattttaataattaatccgattttagcatttcgaccgttccgtcgtccttcgccaaatgcgtcagatggatcttttggccgttgtcgagcagtgtcgcgcggttattcacagccagttttggatattcgcactttgttggcgctacattattctcgagccgattttgcgtagtcctaaattaaaaataaaataaatcgcagtgcccattttt

SEQ ID NO: 21076 - DNA, 706 bp, Heterodera glycines
gagtaagaaatcattctcgtccacctccccccccccccccattcattcattagtcattttcccaccctcatagattacgcaaatttcactcccgacaaaatgcgagaaaaagagacgacaattcttcgaggggcgccgactgatcaattttcggcagcaaaattataaatgggacgggggatggaaagtgcactttcggcggatgtatcaattaaaatgggacaagcgaagaaggagtgcgcgcatttgttgttgttttttctgttgaattataatatttttaaaatcactccaattaatttaaacaatttgctttcataaatcattgttgggatggcacacattaattaatgttaattacttttcaatttcaatgagcagattttgtcaataatcgatattaaagtcgaaaagaggaaaatggttggaacagtttcaagttttggtattaaaatttaaaaattagtttccgtttgcctttctcctaaattcgggttttctgtccagcatttttcaacaaatcctctattaaaacggccccctctattaaaccggtcatttgggcctccaatgactgaaaaattttcaaaaaatatcattttttgtgtattttctaataaaaaatgtttttaaaaaattggaaatttatgccaaaaatactcagaaaatagaaaattctccattttttactcaattttcttcaaat

SEQ ID NO: 21077 - DNA, 2077 bp, Heterodera glycines
  misc_feature (2054)..(2054): n is a, c, g, or t
aaagcaaacgattgccaaattctctataaaagggaccattttttaaaaaattctctcattttaatttctcccaacaacgcctctctctatttttgaattctcttcagctgctgctccattctattttttaattcttagactaagcgtcgttttctgttgttcattgttcaaaaaatgtcttaaacttttgtttttcattctccaaaaaatccttttatgtttttcaaaatcctgcaaaatccatttgaaaaacttgaacccactgactcagctttgcttgatccggcaagggttacaaaaaccggactcgttcattcaaatctcccctgtcctttttcctaacaaaattttcaaataaaaattaattaaattaatctgctttctctttttaagcgaaaatggttttagaatcttaatattttcagaattgctacgtaaaaaaacgctccttaacctatgttttggagtttttaaagtcaattctgaatttttacacaatttttggcatttttttgaaggtcaaaagccattttggcagtttttaaggcatattttagtgcatatttgggcgtttttcgggtttttatggcatatttgggggatttttagtgcatacaacttataaccctattcattaatatgcttaattcttaacttaattttaataatattttttcatttttttaaaccgataaaatattttaaaagcataaatggaaaaacattaaaaatgaatatattctaattttaaaaaatggtaaagcacttaagtaacaataagcatccaaaaaaacctaaatttaaacaggaattaagcactaaaatagcaaattaagcataaaaaccgaaaataatctactgatcacctacagcacgaaaagggtattaaatgacaaaaaaggcacttgaaaagtacatagataaaagcagccaaaaattcagtttacatagagcagcaaattgtgcgatatattctgatttggatggtccaaattctgacaaaaattactgcttttatcataaataaatatgttaaatttgtctattttaaaaattgtttttagaaaaaagtgccatattttcgcaccttctttttttaaattgactcttaaatccgaaatctaggtgagtttatttgagaccatgcatacgcatataggcgatataatggaatatacaatacaatggaatacagctgagaaatacatattatgctttatatcgtttcatcgcattgaatgtttgttggcaccagcatcattcttcatcccactcgtccgtcctctgcttaagtttgcatgatgatggcacttccgttcttctgctgctgctggcgatgaatggcgacattggcacattccgtggcgacatcgttgcgcaatttgcgattagcggcagcgaatgaagcattctcgggccgttttttcaccagcgaattgttgaagaacatctcgaagacgaacgaacacaccatgacgatgtcgaacacctgaaaaatccagaaattggaaaatgcagaatcaaatgggcggccaaactcacaaaagtgaccaacggcacatttgtgtcatccgcacggaagttcatgcaagaccaataaggtgtccaatagagcagcaaacacgatgaggcccaagcagagcaacaccagcaaaggacagaatagagggccatgcaatagtcgaagcacttaaaaatgaaaaacaaaattagtaaccgactcaatggaaaacaagcaaatttttgcaactcgtaacccgacaaaagcaaaactgatttcaatttgatcaaaaaaagcataggatttgactgaaaagcaatttgttcgcgtttttgtcgggctgatgtgctgtctgtgttcacgcattgaactcacttcgtattctgccgcagagcgtaacatccggaagaagccaatgccaatggtgagaagcgagcacaatgcgagcaacagttgggcggaaaaggagtccacaacagtgtcgaggagattttctgtcttctcagtccagaaaaaaaacgaaggctgaaaaaaacaaatggcattttatttncgattttctgatggctttttgct

SEQ ID NO: 21078 - DNA, 3695 bp, Heterodera glycines
aaataaaatgtataatttttaatttattgtttaatttattaacatataaaataatgacctatgcttcctgctgagttccccttttatagagagatttgatgttgtgattaatttccaaattgttttataaaattaaaattattcctaccataaatcttaaattttatttaattatttatttttattttctctcttgccataaatttttctttattcgaatttaaagacgaattgaattattcaataaaaaaatttaatcaattcttttttcttcagttttgaaaaattaagaaaaattatttaaaaattaatataaataaagagataatatgttttaagttaaaaaaattatggatattaaattccacaaaatcttaagtcagatttttttgtccagaactttttttaaaaataatgaaatttttttaaagttctggtaaaataattttgactcaaaacttaatgaaaatttatgatcataactttttatgaatttatgtgtcttacattttttgtttttttaccacttggcggtttataggaaacgacccagcacgcgtttaaccaacccaaaacacgaaaagcgtctttttgggccaaaaacgaaaccaaaaaccatggctctgaaaagcggactaacaaaatctggagattctcgttgcaacaaggactaaacgcatatttttaagcgggttaaatatatttatgattatttatgaattattttatttaatcttaaatatttttcataataattaaataaaaattttaatgtgcattttcacatttatatttattgttattattttataatttaatcttaacattgcattatagttttaatcatttgaagatagtcgaatgctgctggccttacaaattagcaattgagtcgaatactggccttagcaattatttttactagtatatattataatttaatttaatttttatttatttattttctttatttcgatttccaaattctatgataaatgaagtgttattatgtgagctaaattcatatttatctttatatttttataaaagaagattttaaaattgtcatagaaacttgattcctaatgatttttttattatgatatgatagcgtaagaatctcacttttgtttttagttttgaattatgtttaaattcattaaaaaatcattttttctttgaaaattagttaaagtatttaaaacatcataattaatagttttatattgaaatcttatgttttggattttaactatctgaaaatgagtttttttttcttatttcaattttttgtttttaattttaactatgaattgttaattaaaaatgcatttttttatctattagatattattttccgatatatttaaatataaattttatataattcgtttattataatctcaattttttgtaacagtgttggtttatcctattttaaaaagtataagtatattatcatacaaaattttataaatgttcgattgactaataaaattcattatattataaaactcacatttttattgttattagttggttttttaataacaccttgatgaattgtgtcggcattttagtaaaagttgcttcgttgtcgtttgcttgtttaaaaattttttattaattataaacttatctaataagcatgaggttctttatttaattttatcataatttataaagtatagtatagtaccataagaattttataaacttttgtaaaaatatttataattttttttagaaactagattgttttggcacaaacctcaattttttgattataactatatacctttaaaatgtttttttatttctagttgaagataattaatttgaaataaagcgtttaaaactttaataaaacgtattggataaatttaatcttttaactaattacttttaattattcaagcgtaatttccaccccactgctcatcagatacccatgtatttcaatattcttttttatgtatatttaaattagtttgaataatttaaactgatttatttattcgattaatgtttaaaaagctaaattaaagatatattttattaaaatactattaaatcagttttaatcaaataaattatataaaagtttaattttccgaagattattatgtgaaatttttaaatcatttattgttaaaaagtagtattcaaaattatcataatataataataaaatggtgaaaatgtcaagtatttgtgttttgtaatataaaattttataaaaattaaggataaaatattgcataattatttttgatttaaatcatttatttatttataatattttcgttaacaatgcaaaaatttaaaacctttcttatctaacaaatcggtaaaaaaaacattttttaacagcacatttttttatattttctatagaaaatcagttaactttttataaaattttctaaggctttttggggtgctaaattttaatttcatttttaagtgtttttttaattagataattgcggatgtcataattactcgtgacgcaatcgaagatcaaatcgttgtattctttggctgaagtttcttggcctttataatttattattactgtaaaaaatattaataaattatattttaatttctttcttaattgtagaatggaataacattctctttcttaaaattttacaaaaattaccaatgctaagagcgattttatcaacaggcgtaccggtttgtattaccatttaatagaatattaatattttttaatgatgatattagttgagctcctctgtttttgaattttgatttaatatttatttttttactgtttcgggcaattcaaggccagagacaataatttcatttttaattaattaattaatttggttacacagtgtttttatactgaaaatcagtactaattgcgttgttaaattgcccaaggctctttaaaaaggaaaaatatttttgtagactagcgggaaaccacatcgataattggggccaataattttggtgatatcgtagaagctgttgttgggccttcagcaagccaataaaataaacatattatagctttatcatcctatgctttgcttttttctctcttaattgtgctttctatttgttatttattaatttattgctgtgagctttcttatttggtgtgtctacggaagggccgaaacacacttaggatttcaaatttgtaatacggaagggatcgtactgacgaggcccacccttccagttaattttttggcaaaagtatggtccgcaaaagtacggtccgcaattgtcgtccgcaattgtacggtccgcaattgtcgtccgcaattgtcgtccgcaaaagtacggtccgcaattgtcgtccgcaattgtcgtccgcaattgtgggcgcttttgtcaacaaccgaatgcgaataggaactggaatcttctgactgggaattaccgacgctacgaggaagtgctaaattttttagatgaatttcactggccaaaccatgaaaaggtgacagacaacatttaagtaactttgcaaaattattttcttttagtcattgcgactgacaaatctgaatgaatgccgtgacagcaattttcacgccacaaacatcatttgctgcatgttccatttgtaaagaacaaaatgagggattaaaaaaaatgaatggagaatcaatgtgtggtgagacggtccagttcatacaggtaaa

SEQ ID NO: 21079 - DNA, 1169 bp, Heterodera glycines
  misc_feature (1017)..(1017): n is a, c, g, or t
  misc_feature (1106)..(1106): n is a, c, g, or t
  misc_feature (1116)..(1116): n is a, c, g, or t
  misc_feature (1118)..(1119): n is a, c, g, or t
atagttcatgtttaaaccctttcgccagcgacttcccccccccccaacatcttttacaaccgcctcccttacgaacgaacgaaggtggggtgcgccaggcctcttacgatgagggagggggtgggggggggggggggagtgcgccagctcacctcttgtgtacatatgtgtgatcacattattttccgcttctgttattagttacggatggaaattacacggaagcacggacgagaaatgagttggtacctgacctgacacagttaggttcaaattagtcagttttgactcgagtttcgctacaagaaagtataaaatataagtttaggatgtgaaatgcacaactatgataaacgcaagttaatcccgatgaattatgtaataatcagccaagctcgtttattccctacaacgtaatactgctcgtttattccctacaaaataatactgctccaagctcgtttattcccaatggaatacgaatgatgctccaagctcgtttattcccaatgaactacgtaatgataagccaaacttgcttattcccgatgaagatataaaactgagccaaactcgtttattccagatgaactacttgataatcagccaagctcgtttattcccaatggaatacgaatgatgctccaagctcgtttattcccgatgaactacgtaatgataagccgaacttgcttattcccgatgaagatataaaactgagccaaactcgtttattccagatgaactacttgataatcagccagctcgtttataccatgaagatcgtttattcccttatgaactacataaagagcccaagctcgtttattccctacgaactacactaataacaacaagggaattaagttttattggaataataatgaattggtatgttaatgatttattaacaaattataaaaatctaatttgcataaattttttgctaattagatttgcgaaaatttgaaaaacgaaaatttgatcatatgtttcggtccatgccgtccaatctcncaattctctttattatcttttagttggtaatgtgggtttttggccaaatcaattcataaattacagcaaatctttaaaatcccgatccnaaccacattnanngcagttcaggctcgtttttttcagcacagtatggtgttgtgactgagtcg

SEQ ID NO: 21080 - DNA, 1358 bp, Heterodera glycines
gtgcagaaagggactaagaaggtacataacctgattgacactgaaaagcgagccaatatccccattagtcgggtgaagcattttttggtatccgtttttggcttagtgatcctggtttgagcataaatctttgttgtgactgggtcgtagactataattgggaaacttcaagatttatgcttaatcacaagagcactcagtcacaaacgaatcccaagtatgcctcactcactaatggatgttttcgctcgacttttcagtggcgaagcgacgaagacttacgcacctacttcctcccgtttctgcacactactagagtgcttatcggcataacaaattctgccgtggcgagggatatgaaaatataatcaccttcgctaaaaggagtcgaacttgaagttccctttctgttgtgactgagtcgttgaccatttgaccaaatggtctatgactcagtacaacagtggtgtacactgtcatcagggctcatcatcttggtaatttaaccccttccccctttttcagttgtcaacagcatcatcatggtggccgacaggaacggcttccagacggtcaacgagacggtaaagaacttatttactgtggacacgtattctgtatgtaggattcttccaggctgtcaagttgccgaagtgcgcatacgtaagcatcgacctggggacgatcgttcaagacccaatcgaggagtgtgtcgaaaaacagcctgcacaacatttaaacggtaaactgaaatcggagagcgagcggggcagacgaataacagagatgtacataaatataagcattaaaacgcttagttaaccccccccccccccatttaaaatctattctctggtcagtagagtagaaccattgtgaaattattaagcttgattggagattaagttgccgtattccatcgattaaaagacccatatcgattattaggtccctcttcttttgagggggttgaacattaagtactataattgagaaaatactgtagtctaactttgtcaattaatcaacaggtttattttttgaattagcgcacaagaaatacttttggcataatgttttaattgtacacctaattagagcccggaaatttcaaatttgcggatcccgctgcgggattggtactgaaaattctttgcgggacgggatcccgcgggattaatcccgcaaatcccgcatttaaaatttgcgggatcccgcgcgggattgcgggattttggaaaattcgaaaaaatttcaattaaattcaaaaaatttccaaaaatcaaaaaatgctgaaaaataaatttttaagggctggcgggatgcattaaaaggggttgatgggtcgactaagattt

SEQ ID NO: 21081 - DNA, 1962 bp, Heterodera glycines
tttccatcatcgatccatgctttagggtcctaaagggcaatcatctcagacttggcgctatcaaactgggaaaacgaacagttcgccctgtttttgagcctcgtaatcgatcacggccacaccgacgcgctgctttttgcactcgcgaaatcggacgccatcaaagggaggcaatgggccgggaaaagaatctgaaagccaaaggaaaagccttcggcactttcatacaaaggaaaagccaacatcggttgaggatttaatcatttattccgtttcaatttcgtctccctttcccccgtatttcatttttctttcttcccccaattttttcccatttgcccaccctctctcctcttctccttctgtgccgttgccaatctttcatattccccactgttgtttgtcgctaatttgtccggttttggtgccattcgttcgtattcccttcgctttgtcgccgttttgtccgttttttccggtggcgaactttttgcttaaatggtgaaaatggtgagagaaggcccataaaatttcgattgttgcttaatcggcgtgatccatctcatttattaccttcagtctttttgttttctgtgtttgtcgactccaaattcacataaggctgctcttttccgcactttgcaaatgtttttctgcccttgggcaaagtgtccgatttgagggccatcggcacaatttgagcaattaggccaaatgaagggacggacaaagcatcactaattattattaattgattgacagattaaaaacaattcattgccacaatgttaattacttttctcctaaatattttggcaattaaatttaattatttcttttgggataaattgacgtcgtcgaaatagcaacttcgaattggcaattatgaattaattgcaaaacgaatggggagagaatgaatggcgtattaattgggcgggaaagagcttaggcggacaaaaagccgaacgaagtgccaacggaaggggggcgggtgaaactgatgcctaattaggccggaaattgaagtggcaaaactcccgcggggtacttataattatgcttttccgctgaaggcatttgggtcgccgttccctgctgtcgccctttgcgacgttgcccgcacattccctccccctttcctcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctgggaatttttatttctccggcctaatccagaaaaaatcactatctctttttttggaatattttacgtgtcaaagggtgtgcatttaagcgactcgctgtgcttgcccactgcatttcaaatagctgggaatttttatttctccggcctaatccacaaaaaa

SEQ ID NO: 21082 - DNA, 1043 bp, Heterodera glycines
taaaaaacaatcaaattaataatcgccgtttaacagatggataagctcaaaaaaagtgttggttttatggaataaaaaaaacataaataatattcgaatagaacaacgtaaacaagacgaaaagatcaaacagaaacgagttttagttaccaagaaactcagaaaagaatttttcgttaaaaagttgcttctcaacatgtgacagggaaagaaaatataaatatttctttttcacagacaatttctttttccctttctttgacatttcgttagtccaaagaaagtatcgttctctaccctcactctttcatttcttttttcaattgcttagaattctaacttaccgaaattttaccgaaactcaggttttaaattgttggtctttctttctgcagctaaaataattctcgaccgacctgttattttatgtatcaattctgaaatattattatcatgccttgcttgagagatgtcatgacaactcgtacaaaaggcaactcgtacaattgcttaggttaggcttaatcttgcttggactatgtttaggctttattttgttaaatacgagttgccttttgtacgagttgtctttgtacacattgtacaaattgcttttcgtacgagttgccattgacccgcttgacacgttgtttttaaatttttatttcttgaaaatccatttgtagcagtaaaatgaataatattgatgatatttgcaaagaaatcgaactgcgtctgtccgtccatggtgcgttgcttggttctggatgggctacgatggagaccactgtcacttctctgctcaacagttagtggcgattagttttaagaaagggttggagttggatataagggaaggagggggcggggggaggttgtctttcaactccaacaatctgaaattctttagacaaccaaaatgacatctcaattctgaagagcttgcaattagaacaagaggcgaatgccggattactggtccaaaaagttgacggacttctggctggaaatgcagcggatataactgccatgggttcgtaaat

SEQ ID NO: 21083 - DNA, 894 bp, Heterodera glycines
agaaacaaaagatggaggaggaagagcgaaagatgagggaggaggaagagcggaagaagtgggaggaggaagagcggaagaagagggatgaggaaagagcggaagaagtgggaggaggaagagcgtaaaaagagtgaggaggaagagcggaagaagtgggaggaggaagagcggaagaagagggaggaggaagagcgtaaaaagagtgaggaggaagagcggaagaagtgggaggaggaagagcggaagaagagggaggaggaaaagcgtaagaagagggaggaggaagagcggaagaagagggaggaggaaaagcgtaaaaagagggaggaggaaaagcgtaaaaagaaggaggaggaagagcggaagaagtgtgaggagaaagagcggaagaagagggaggagggcaagaagagagaaggtaagcgaaaacactcggacgaattggcggagagttcggcagacgaaggtgagagggattcgagatttataaaaggtagttaaatattgacacattcaaggacgattgaggtcaaagaagaagctgaatgtttattccggatttgatcacaagcgaagttctctcaataaggtacgtcgaactaacccaaataactttgtataaacttcgaaatttagactatggacacggactatgacgattctttttggtctgacagtgattagtaaattaatcacttcgcctaattattttttgttgtaacatttaagcctcatatatcatcattttgaataaaaatgcgtatcattataaaaaaaatgagtattgaaacgaaatgtaaaaaaacaagaaaagtgaagaaacagcagacactatataagtcagacactacattaaaaattattgaaaataaaagtgaacaaaacgccaat

SEQ ID NO: 21084 - DNA, 2226 bp, Heterodera glycines
  misc_feature (53)..(53): n is a, c, g, or t
  misc_feature (2111)..(2111): n is a, c, g, or t
  misc_feature (2127)..(2128): n is a, c, g, or t
  misc_feature (2165)..(2165): n is a, c, g, or t
aaaaattttttctatttcggggaaaaaatcgaaattttttccgaaaaaaatanccagtcgatagagctcgaaaaactatgttttggaagtggtctccgtttttctgggaaaatttcgttaaaaaatcctaaaattcaaaaaccccaaaaaaccgttttttaggcctagctcgaaaaattttgaaaattttcgaaattttaaaatttggaaaaatgcagctttaaaaactctacaataagtctgctggcaccccctcgctcagaccaaaccctgacgtggtattcacctggtactgaagtgggaaaaaaaaattaactgagtctccgtgtctgtacaggtccgggatttggtctgatcaaaaaataaaaaatactggattatagaggacacttctgcggagtgccctcacagcgggaattttttgatccgagtttcagaaaaaaagttatgggccgtcaaacgcacgaaaaattgagaaatccgtccctgggactcagtcgtccgcgcagaatttttctctatagttttcccggatgcgcctcaaaaagttgtaagacccttccactactttcagggcgctcccggccttcggccgggagattttgtttttgcaaacgaaactccttgtcaatataacatatatagtaactagcgggtgcgtgaaccgtcggctatttagctgggaaaaagcgcttcgcgctttgggagcttcgctacctagattagctatcgggttgtgaaaagatttggaatttttaaaaaattatcagcgatttttaggccgcttcgcggcctcagacgggcgctacgcacccgttttttaaattcggtgatttttaggctgcttcgcggcctcagacgggcgcttcgcgcccgtttctaatttttgttgtgcttttcggccgcttcgcggccgttttttaaattgtgttgagtcggacgggcgcttcgcgcccgttattaaattttgatggactcagacgggcgcttcgcgcccgttttttaaattgtgttgtgcttttcggccgcttcgcggccgttttttaaattgtgttgagtcggacgggcgcttcgcgcccgttattaaattttgatggactcagacgggcgattcgcgccctttttgtggcctttttaggccgatttgcggcctcgaacggccgcttcgcgccgttttttaaattttagaacagatacaaaagtgattagaagaggtagaactgtgattagaagaggtacaacagagatgagaagaggtacaacagtgaaaaagtgatacaaaagtgattagaagaggtgcaaccacggaagggaaaggcacaacagtgatttgaagaggtacaacagtgattagaagaggttcaacagtgattaaaagaggtacaaaagtgattagatgaggtgcaacagtgattagaaggggtataaaagtgattagaagaggtgcaacagtgattagaagaggtacaacagtgaaaaagtgatacaaaagtgattagaagaggtgcaaccacggaagggaaaggcacaacagtgatttgaagaggtacaacagtgattagaagaggtacaacagtcattagaagaggtacaaaattgttagaagagatgcaaactgtgattagaagaggaacaattttcaatagacgtaaaagttgagtaaatcaataacgcacaccatctcaaacatgagaatgtaataaacagatggcatataaaaaaatacaaattatggacaataaaattaactaatttgaaacaaaaaatttattcatcaaaaataatttaatttaaatttaaaattatttattaatttttaataaaacaaaaaggttcaaattaagtaaaagcattgaaaatgacgaaaaaaataaataatgtaaagtttttataaaaatttaattcaaataaaaaaatgtaatttattattaataaaataaaaaatattttaaatgaataaaacaacgaaaacacgaaaaaaatttaaaaacaacgttggaaattattaattgaatatttatttaatttgaaattaaattattttttttacaaattcaaaaaaaaaataatgaaattctttaatttaaaaaaaataaatttaaataatttanaagaaatcttctattnnattaaaaacagtcaaaataacccaaaaatgcacaganaaataatgttacaccgtccggattcgaactttgcaccccccccccccaaaaatgatgcctc

SEQ ID NO: 21085 - DNA, 1580 bp, Heterodera glycines
  misc_feature (19)..(19): n is a, c, g, or t
  misc_feature (107)..(107): n is a, c, g, or t
aatttttaaaaatacaccnccacaaaacacgaaaaatttagtttcatcgtcatttgggcattttcaataaatattttcgtcatttttttgcgaacatttcttttttntaatgagaattttttcgaaatttggcaaacttggaggtgtttttgatacaacgaacaataataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctttttagtccatatttcgggcttttttagtccatatttaatgtccatatttcgcgttttttaatttacaaccctaattattaacaaaaataaatctgctttatttgttaaggattaattgtaaaattagatttaattgagttaaacatgtcctcttttattcaggtaactcacgtagttttcacagacggtgaacttacgcaggaatcgtattaataaaaatatttttaatttatttcttttaataataattttgttttttatgaattaatttatttaatatttattatttgaaaaggactaaaatccattggaatatttattgtttctgaattatttgtcacattaaatattaaaaattcgaatatttattatttttttcattttcttgctcatcgctgccaatcattattattgtattatttcgtattttccatttttattaattagtttaaagcactcaggcaaattttacataattacgccatataattaattttaataattaatttctttatattttagtaattcacttatacatttaaacagtttaatcgacatcaattcttttttcaatttgctatttattttctctatatctttttttatttttataatatatattgttatgggcaagtcaaccgcgatcatggcctattctataggatttatattccacggattgtatttaaatttgatttcagtttttgtttattgtcataggcggtattttttaaaaattgaagataacatttattgaattataattaacatttatttctttgtttttggtaattttttatttctaaatttttagaaaatttatttcttgaaaattcatttacaatataaatattatttttttgataataaataatttaatgttcttgttaattcataagtggaaatcaagggtggagcgcgtacagaaaaaaaccgcggccgcgcattcaaattgccgcggccgcgcccgcggatcgcgcaaaaaaaaaaacgccgcgaatcgcggatcacgcatcgcggtcgcgctccacccctggtggaaatgctatttattatttcagttttggttacttttttccactaaataatttttactttctgctgaataaacttatttggatttttattatttttttaatttaaaaaattgatagttaatttatttaattatgcactcaaaaatattaattattctcttattatgcgacatatatcagggatggcacggaattcc

SEQ ID NO: 21086 - DNA, 2719 bp, Heterodera glycines
  misc_feature (2677)..(2677): n is a, c, g, or t
  misc_feature (2680)..(2680): n is a, c, g, or t
gtaaattccacagcctgcattctcggcgaattctcaaaactctcgcggcaaacgtgcatttttccgagtcgccaaatgactttccagtccctcccttgccgccgcccaatccagcgaacaacttcctcaatcccgaaagatcaatcgtcctcccccgtcgtcgtcgatacgtgcgtgtttgctcattgtacgctacttgtgacggaaagaacgggtttcggcgaggaattctgtagttgcccggtcgcagtggatcatatggcccattcttcttcaatttgcctttgcctctgacttcctccgttggctgtctctttcgaattctctctttcacagcttgccgctcattccttcctctgacaggagacaaactcgattctgtcgtgacgatttgtgaatcctgcatcactgtccctggaggcagacttgactccgttgtgacagtttgcgggtccctgccttccatcacagcacttggtgaatccataatggcagtcacttgaatttgactgacttcgtcctccgcagaagtgttaatttctagagggtacaaaaggttaatcgctcgaaccagagtttttccttttgtgtgtactcgtgccgtgcgcacgagtccatccctccccttcaaaagcttttcgacttttcccatcgtccaaatggaccgtgggtcttcctcttcttcaaccaggacaatatccccctctcttgggagacttccttctgctcggttggttcgatctctttctctgagcgaaagtaagtactccgttttccactgtttccagaatcgatcaattctttttattgcaactctcatcaattgatgcaattcccctcttttccggggttggtatgcatagtcgggatccattggatcttcgtccgacaatggaaggcttgtttccacacgtttatatggcaataaaaaatcgacgggtctgagcggttgtgtgaattcttcttctgattggaatgtaagaggccttgtgttcaccacagcttcgatttcgcaaacaagagtatcgaattcttgcctttccatgaggcttttccccactgttcttcgtaacgcacttctggtgatacccaccagtctctcccacgcgccaccttgccagggtgctcgtggtacgttgaatttccaactcactcctgagtggctggtttctaccagtatttctcttctccattcctcttttatgcactctgctccagcaataaaattggtgccattatctgaccacataaggcttgggaggccgcggcgtgagctgaaccttcgaaaggtcctcaaaaattctgttgccgtacaatcatcggccacttccaaatgaaccgctcgtattacgagacaggtataaagtgcgatgtagactttaactccgccttttattgttaatgggccaaaatagtcaacgcccgtcttctcaaatggccttatcatcgcaactcgttcactgggcaagtttggcatttgtggataggcatatggtttaagcctctctttgcggcaattcaagcatccgtgtcgctcagacaatatcgtgtttctgatgaaccttcttcctttgggtatccagtgcttttcccttatgtatcccaacagagtactgtgacttggatgcttcattttccaatgtgcttccagcacaatgagttttgtggtccatgcttcaggaggcaagaaaatcgggaatttcgtatcctcctttactgttgcttctccaatgcgtcctcggcatctccagatttctttgtctttgaacagacgaagattttcctttgttttttcctccgttggaaattgtcgttgtgcttaccatatcagcaaatgttcggatgcacataattcgggcactgacagtacgcccttgtcttggttcccgtgcttttttgggcccattttgctcagaattggcaacaaatttccattgtatctgttttttgccaccgaatgtatccagcgtaagacataggcacccacagttttggcctttttccagctggagtaccggttcacatcaatagttggttggaaaggcacctcattcatgactgcggctgttttcacttcttcatcttccgcacttgccctgagcttctcttcatctgggtgataaacctttgctggttttggccacagggccttttcttctgataaccatttggggccatgcttccataacaaatttctgctcaactctcttggtgttgtgcagcgtgatgccacgtccgcgggattatctgcactgaccaaatgtttgacttcaaactgtccacgtatttttgctaatcgatttgaaacaaatcgatcgcatttcttatgctccttaattcgttcaacggaacacaagctgtcagtccaaattgttgtctgtgttggtttgagtttgagatgttggagcacgtactttaacaacttcactcccagcgttatggattgtaattccatttttggaattgttgccgcaacatctgatatgttggagggcttcaccaggctctttgcaaacaccaaattggcgctcattttttctgtcgattcccggatgtaaatggcaacgcctaagccttttccgctcgcatctgcgaagcaatgcatttccttgtccacttcgtcttcgttgtcgactcttcgtgcgaatcgaatttggacctctgtcccctctttcgnttngccagtctccatgatttgattccattcatgaatcaattc

SEQ ID NO: 21087 - DNA, 2142 bp, Heterodera glycines
caattggaagagtgcatgtcgccattgaatacgtgccgacttcggggattcgcttttggatcaaaaggacatggtccgaatttcactatttttccaaaaaattacgttgttttatgcactcaaaagcactttttaggagtcgcattgtctgttcttgtccggccgatcgttctcaaattgtgttggcatttctcaaaagggtaaccaaacacatgcagaaaaggctggttgagcagtgggaattggtcaaggcacgccaatcgccggacgaaggtccttttgctcttacgaaaacccatttacgactcgagaagtcacttttaaattcagagacggagcccaccgaagaggaaatggtcgccgagagcacaatgagtcttttttctcgagaatgcgcttcttttgcttcgacttttattctcggcgaatcgttttcccccaaaaatgtgaagaaagaagcgatagtttcacaaatcgcccaaattctgctgatggacaaggtaaatttgttgagaccgaagcactgaaatgaactgaaaacaacggcaaaggaattgttcctcgacatgctcggactgctcgccaaactgatcacttgctccgactcacaggcggcggtcaaatgcattccgatgctcaacgtgatcaccctaaatgtacgcattgagaagcaaataaacggccagacaaaggatgcacaacatcaacatttgtttatcttcctcacttttacagtacgccacatcatttgacgaacaaaccgcggttcaaattctgatccatgccctccaaagtctgcaaatgtatgtgtccgatgaactcgctgcaggacccattctcacgctgatcttcaacatttattcaacattccgaccaaaataccccgcacttcttgaagtcttgagacaggtttcagttaacattttagttttatactatttatctgtttaattggatcaggttccgaattccatgcccgagaatgtcgagcagttcgaccaacgaataataacaacaatttcaaaacgaagaggaggggaaaatgcacgacaaaatcaagagggatttgatgaggaaggttttgatatcggtgagaatggaggaaggcttttgaaacatggaaattttcaaaatacagagaaaagtcaaaattcaccacggccaaaaaagttcgaacggaacggaggaagacggagaaatggattgaccagagaaatggcggaagggagattgttcttttccttttcactttgttctacttttgtactggagacgggatcattcgttgtttttgttttttgttaaagcgatttataacaaaaatggcagaaaaatatgaaacacaaattgttttgtgtgagattaaattacgcgtcacttttgttttccgtccgttcattttgcccgctttgccttcgattgcgcggtggcccctgagggttcctttctttttgttgcgcccgtcgatgcttcggccttttcttgcgtcgattgcttcttccgtccgccccttcccccctgggcgcccttttgctccaagcccaagtcgcccatttccttctccaccagtgaaattaaaatgttgcaacgtcgttgtaattcctgaaatcaattacataacataaaatagagccccccccccccgcaacaaacaaagtctacaggcccgtaacaagaaaaaaaggccagcaatagtatttctgctttggtagtgccctgatccagtaatgacccctcctcccctaccaattaaggctcataccatggcagttcgagagcgaataaaccaatcaaatcgaaattggggagcggttcggatattttgacgcaattcgtcgtataaattttcattatcaagtccgatttcataaatgttgtagaggagaaatctgcaaaaatgagatgaaaataactcattttcccgaaatcataacttacatagggcttatgcataacttatttatttaattttaattgccaatgactccctttcccccccccccttttcacctgtcctcctcctccgtgtaatttttacattttcccgtcccgtactgaagacggagttggtgctgaggtgccttgtacttgttgattttggcctccaatgcctgtttgatggcatgccttttctgaatgcgt

SEQ ID NO: 21088 - DNA, 1200 bp, Heterodera glycines
ctaaaattcaaaataataatttaaattagttagtccacaatatggtttctaattgtaagaaaatttactgaaaaacattttttgtttgaaagattttagcaattttttaaaattttatgatgaactatcaagtttttctaaatttttacaaaaaagcactgaaaataaaaaaaaattttttttttaatttttctgtcgaaggaaatgaaacaaatgcccacaataattttcccagtgtggcattgtgccacggcattccaaaccatccgcccgtccactgacattgtcgccttggccgccctctgccgtgggctttgtccgcgtgccattccatcatggtcggcgatagcattcacaaaaatgaacgccgctgtgccggtgtccatcagcgactgaccataatactgtgttttggccatacggcgcgggaacagcgtgaaatcgaccgccaaaatggccaacgaagtggcgaccaaaagcacggccataaaacgaagagaaaattcaatttacataaaaaaaatcaaagaaaaggtattcacaaaatttacttacctagcctaattcgaaaaaataagtctaataaaaaaaaattattgagaaaattcaagaaaaaaaaaaaaagtcaaatttttctgaaaatttagcaaatctatttccattaatccttaggttgaaaaaagctttaaaataattttaaaaatggtgaaattttggtttttttttttgcagcgacgttgtgtcccggcgacattttggggtgtacccgacttttcacgaaaaaacaaaaacggataagaaacgccgaaaaacacgccccagaaatgcctaattaaaatgtgcaattttcttttgaatagcatttaattccctcggctgatcattttcatgtacgtgtcgagaaggggtgatgcccccggtcgaagcaattcatcccggaagcagttctttcccccccccccccccccctccagcccggaaaattttaatttttcaaaaaaaaattagtgaatttttcacaggaaaatttaaagaaaaaaattttcagcgaattctctctcacctgaacattgtgtgcgcgtcgcgttgggcgcgtgccgcgtccacgcgcagcggacgcattgagcgcagcggcgtcacaccgcaggcgcgcgcactgtcacagcaagcgaaaatgacggcacagagcgcgagctgaac

SEQ ID NO: 21089 - DNA, 787 bp, Heterodera glycines
  misc_feature (778)..(778): n is a, c, g, or t
ccacgtcacaaatcaaaaacaaagaaaaaaccagatcaatttttaggtggaaagaagaatttgtcatttttattttctgtcaacttgtatcaatttccttatttagtcttcctctcctattcccacaattaatttcctcattttctcccctcatccgattatccctactttctcctccatttcctttatctctcatcccatccgccctccctctcattacccttccccccccccccccaatttcctttctttctcttccaattcatctccctctcttctccctctcattggcttttttcctctttcgctttctctctctctctctctttcggtctctttccactaacaataagtgcaaaaacagtgtgctccgtccccttacgtcgtcctcatggaatgcgcgatccgttccgtctcgtgcaacattcgctgggtggtcgggagaagtcgtacacataggaggggcgcagttggtactccgagggaaggcacagaatgccattggtggccaaattggtgaacagccgacgcatttcatcgggcgactttttgtgggttatctgaacggcgtgccaaatcattttttaacccaataactgcttgcagatcacttgccaaatattcgttgttgcagccccgggaacgatattcagtgtctggaatacgcttatgttagtcgctcagagcgagaataggaaacggcaaagaataaaatttaaagaattttcttgcctttttttagaaattttatgatggttaacggaactaagttttccanaaaattttt

SEQ ID NO: 21090 - DNA, 1338 bp, Heterodera glycines
actaattgatgagtattattatttgtccatcatagcattaaacggtggaaatatttgaatgaccaaattaattaataattttgacctgtcctaccagggcctggtttcgaatgaaaattcccgtgttttcaaatttcaaaaaatgcccaaaagttttcagagagacaaaaaaaaccgctgtgttactctcgagatgggaaatttgccaaggtttttgggccttgtctcggttctcggataggaggttttgctctctggactttttcaaatttccaccagttaggcctctgcccaaccatccaaggcgttcaatcctgaaaattttcagagaaatctaaaaccactgtgcgtcttggataactagaaatttctagggttttttgtctcgattctcggggctgggtgaggagggttagttactcccatggttttgactttcgggacccttttttaaatttttcccagttacacctctgtgcaaaatcatccaagggccttgaaaatttccaaaatttcaggcccactaagccgcgcacggcggggaccccatttgcacttattttagtacaaatagcagagcacaaaccgttagccatctcataactccccgcgcccaatccccgcgccatcgaatcgatttttcgtgcgtttgttggagtggggatggggtgggggcgaaagctttgctttgccccaccgtccgtccggcggcggcgaccgttgggcagacgggcgggcggcggacagagcgccataacaaaatgtaatggggggggcaggcgcgacgggggggggggtgaaaccagagaaggaatggcaatttgtttttatctatcggtccagaaatgaaaatgttgtcgggatttttcggcaggattttcatgcagattctcattagttagggaaatacaagtttccgcgtggctcagtcggttagagcccgtccctcattgtttggagagccgtgggttcgagtcccacacacccgcctgtcgatccccaacaaataattgccgtccacgggtgcagtacgtcccccccccccctcggatcagttcccttaaaaaaattttcctttataaattttcgaactcttaatgattcatcataaaattttgagaaaaaacgatggttcatcagaaattttttgaaaaactactataaaaaattatatacaatgttttgtttgtaaagaatttgttaatttttggattgttttaaaaaatttcgggggaggaaacgagctattccctgctgcccacctggtcgcagttgaaccatgcgcagcgaccattctggtacaggggataatgttgctggtcatgaggatggtttggg

SEQ ID NO: 21091 - DNA, 1536 bp, Heterodera glycines
taaggagagatttttaccaatttcgttgcctaaatttctgattttcttttttaaataaatgcaactgcttaatttattagaattatgttcaaagtcccaaaaaaacacacacaaaaaattcaaaaaaaaaaaatttacaaaatcaattttctgctataaaatttaggaatttctataaatattatttatatttatttttaattgcgagttttcggccattgattgaaatggaaatgattttacctaaagtctcccgaatttctgataaataatcccgatcagtcgtaaagaaacgcagaaagtgatcagtgttccgatcgactcatcccctcctctgatcggcttacataatccaatcccgcccggaggtcccgacaaatctgattaattactctcaaatggctgtggaaatcactttcattaacttcagtttgaagatcatttagtcaattattaatttttaatttttaaccctcacagcccccaatttttttttcaaaaattccaacaatttttcgtctttttgtgccccccccccctcgccccccgtgtgttcgaccttaatcagcgcaagcgcatccgaagtgtcaaacaggcgccgattatttgcgcatccccaatttttggcgcggcgcctcaaggctgaggtgaagtccccccggggggggggggaataactaatgttttttttccaaattaaaaaccacacacaaatcgaatgttttttttttgttgatcagagaaatttttttttattacattttactattttttcaccaaaaactgacaacctaaaaatgtgcaagaaattttcaccgattttttaaaaatattttaaactaaccctttctgaggtctttggaaaaatatggaatttcaaaaaagcctcaaaaaacttagaaaggttagcgcatcaaatttcggtgtttcttcagggacaaaaaaaaaatttattatgactcaaaaatttatttgagaatttcaaaagtaaatttaaagcctcataatttttgaatgaaattctgtgcgaaatacttttgtttctgatcagttttgacactttcttaagaccatttgtgttctgatcaagaagcatttatcttgataatttttgacaaaaaatatatatttcaatattaaaatttacttttttagcggtgcaaaaataattaaaattaaattattttttaaatggcacggaaattgcatttttgtgccctcatttggctggtgttatggttggcgttgagcactgttcgccaagtgtttgacatcattggcaaactgtgggctttggtactgatcgacatggttcaggtgtgccctgatcactttttatttggcttattggcattgattaagaaaacgatcacaaaatccattgatcagtgacccagatttactcaaactgattaggaaactgctaagaagcagccaaaatcaccaaaagtgatcataaatctgaaaaggactcagctttgataaacacactttaaatgtgcctgatcatttaaattattggcactgatcaagaaa

SEQ ID NO: 21092 - DNA, 1466 bp, Heterodera glycines
cacttctatgaaaccatccaataaattcttagcaataataatattattagtatataaataaagcattattcaaaagcaaaattaataatcgataaaagcatctttattttaatataggtttaattatttgtaaattgaatatcatgtaaaactaattaaaaatctttaaacgttataattaagtgagagacgaagaaggtcatcttttttgaaagatcagaaatataataaaagaaaaataacttttcatcaatatttgatttaaaatttttaaatacgaaaatttaatttaaaccttaattttataattttgagatttcttaaattctccctggagagtacaaatgcggtgcctccagttcgtcaatgaaatatctaattaatttattaaaaatttttcttgttatctaaattaataattaaaaattataacaaaaacaaatatatcaatacttttgtaataaacatgcattttttgtagtttagtagatggataaaaattcaataaaactatgtattcaaaattaatttatttttatcggtggccgaacgtttcgtcactgaacctttcgacactaaacttttcgtcactgaacctttcgtcactgaaataaaataaagaattatttattagtgaaaactattttttttaaaataaagttatgtatttgaaaaattctaaaaattgttagttttgtgtcaatttaacatagtattttaaacacataaatattattaaaatatcagtctttctaacaatttgtttacattcaaagcaattactttgccatggaaatcggttcggtgatgagaataacctttaaccctctcggccctccaattgtggtgtgggtcatttctgataaaaatatttggcaaacaaataaaaaggaatgaagagaaggcaaccagcggtcattcttatgattactcccttcattttcctaataaaatgcaagaaaataactcatcatccgacgaagagggtcaattgctttcatcttcatctgggaatgaagaagcggctaaccaagaattaattcaattcatcgaatttaagtcaaagcgaggtgcctcacttcttgcacgtgatgggtttgagtaccaattcgagcgcaattcagccttagttgataatgttgaatattggaagtgtgttaaagtgagtaacaaaataaaatcgaatggatttttctttggtcagaggccaccctactgcgcgggtcgcatacatgtccatgctccttggcaagagcaaaatggcattcggtttaaatttggactgctaaaaaatgatcaacactctcacattgccgaacccgacaaagaatatgtcaaatagcagccaatttctttttgaatttccttaatctaagattcgttccgccatcgaacagttgaaacaatctgcaagagcccaataaacccaatacagaacaagagaacgcggtggatgctgcgagggc

SEQ ID NO: 21093 - DNA, 2629 bp, Heterodera glycines
agcaacagttgcgtgccgcgttcagctttggctttgcgcatcggttggttcggcggtacggcgcggcggccggcatttttgatgcaagcggacgggaacagctggtggtcggcacggagaccggcaaaatatgtctccaaggcttaggttaataatagataatatatattttttaaattttttgtggaacttctccaaaattaaaaatgaaaactattctttttatatttattttttaaaataaaaaataattttttattaaatttaattgaataaatgttcagcaaaaaaacttactccgattcaatggctaaaaacggaggaaaagcaaatctttggcattttcaggaatttgtgaaatttcttcgaaaaaattagagcaaatggaaaaaatttttttaatatagtttttaaaacaatttttcatcgtagcaaaatttgctttccaaaacttctccgattcaatgccaaaaagggaggaaaaagcaaaaacttggcattttcaaaaaaaacaaaaaattattttcctttgaaatttattttttaaagtttggaaactacgaaattgttgccaacaccaatttattatttagagtcagtgttcaacgtgaatgagccgatcacatgtttggccatttacccgcgaatgcaaacggacgccgaccattacgacgtggcactgatcgggactacggtataaaaaaaattgaacaaaaagagttatacggtaatatgtaaaataaaattttcaaattatatatgaaaagctgattttggtgccaaattttcatatatttttaactaaaataattttttttaaatttaatttgtgcaatttttgcaattttcgaaaaatcaaatagcataaattttaattatttagttaagtatattcaaataattgttatttaatttatgcaatttataacaacagtttttggacttatttattataattaatctcgaattaattgtgtaattaatttcatttcctgttttagggaagtttgttggcattggacgtgtacaataatcgcacgtactttaaattaaaaagtaatttaattagctaatttgacgcatttaaaaaaggcttttccaccgccacatgcccgagggcgtcaactgtttgcgcgttgggcacgcggacgcgcaccgcgactcatacgtgattgtgtgcggttgtggcacaacaatatggggtagcgcattaatttgtttaaaacatttcgccaaagtttttgttggcatttttaaataaatttggcatctttcagaattttaattatatttgtttataggcttccgattggatggcactgatgtgttctggaccgcattgggctacgaagtgaatgtgattgaactgtgcgacatggacggggacggccaaaatgaggcaaaaaataatggggaaaaattaatttaaaaataaataaaacaaattaaaaatggaatttttttgaattttatcaattaaaaataataataataaattgttttttttttgtataaaataaaggaaggaaaacgttttaaagatatttattaattcatattaaaaatttacgaacaaagatttgttgttttataattaaaattaattaaattaaaaatttggaattaattctttttgtaaaattgagtcaaaataatttgaaaatattaaaaatgaaatttgcaaaaaatacaaaataaatcaaaaatattataagaaaaataccagcagagataaatttgatttaatttaaattagcttataaaaaagggaataatttttatttttattttttgtataaataattatttgtcagttaattgttggcacaaatggaacggacatcaaagtgaggagcaataaataatggattgtcaaaaagaaattctaatccctttttattttaaaggtgctcaaaaatgcgtcattttttgccgaatttgatgagggcgacccgacattggcactctgtgccatggggcaaacattttgaatttatttttataaaaattcaatagaataaatttttttagatttatttatttacgtttttattaaaagaagaatcaaaatgaattttttgtttttttttttgatttctgattgaccctttccaagtttaaaccattaaaaaataaaaatataaaattgaaaaaaataaaaaattcacacaaatttaaaaaaaattgagtgagtttaattaaaaatttggccatgttagcttctttttttgtatcatgcataatgcttattttggatgttaaattataccgaatatacaattccaaaaatgttaaaatttaaaaaaaaattttgttaattaaacttttaaaaaataaaatattttaatacaaaaaaaaattaaagaaaaccattttttttggggggttttacaatttcccaaaattttcggacaactttttaatggcatggaaaaaatttaaagttttccatctcaggcccgcccgcttcgtgttcggcctcgtctccggcgtggtgggcgtgtacgcaaacggcgagcgcgtgtggcgcgtcaagaccaagtcgcccattgtcgcgctgctccaattcccgaacagcgcgcgcatcgcgtgcgtttggcagaacgccaagttttggagacaaaaaatt

SEQ ID NO: 21094 - DNA, 1198 bp, Heterodera glycines
  misc_feature (87)..(87): n is a, c, g, or t
agtggtatttcgtatggtcggtattgcccggcgtcaatgcccaatatgcgtccggcctaaaaattttaattttccgattttggcccnaattccttttctgcctcgagaaaaaaattgcatttaatcccctcactcaccgctctgacgccgttgtaaaaattctgtgccccttggccaaccaaatcagtcaatgggccttggaaaagcatcgcattgtcccgtcccgcgttggaaaagccattggacggggggcggtcgaagccgacgggagccttaaaagcattgggaaagaatcgcaagaaccgccttttgccttgtcccaatacaaccgcccctcatagtcggcagaaccaacttggttggggacaaagcccgggttggagaaaaccgcccccggcgttggtttcctattcgggtcaatgccgtcgttcgctgctgcttctgttgggcccacggcatttctgtgagcattttgccgagtgccattcggagggggcggggcgaagggttggcttaagtaaattgtacagttttgccagtgtcccacttgacactcgctcccattgccccacccgtcttgtgccggggacggcgccattggcaaaggcaacggaagggaagggcccccggcaacgatggcaccctcggggaatttggaatttgtttcggcaaaaatctgagaggaaaatcattgagggactgggagaggtcggctccgccggccgttgctcgacctcgtccaacatcgcgtcctcatattcctcaatgtttgcggtgctcggcactttctgtgtctaaagaaatgttcaaaaaaatgtaaaaacctttggctaaactctcacattaataaaagaaaacaaaagcgaaatggacacaatcagctgatgacaaaaaatggcgtggaggaaaaacatttttttatattgaaaaggaaggcgaaatccgtgggaaaaaacaatgggacagacccaaacgattttaattaactaattaattgaccaatggaaaagaaatgtttgttgttttttctgctaagttacgtaatgcgtttggttttgttggacccgatcagctgctcaactgctgactgatcggacctgtcttccatcgtttttcccatccgatcggtgagcaaacgaatggtcaaaacgatggacgtcgaatgcttttgcgagaattcccggcactggacgatcga

SEQ ID NO: 21095 - DNA, 912 bp, Heterodera glycines
actgactttggatgcaattggcagtacatcagtgtagccacctgatagtccttaataaagcctttgtaacgcccttgcggcagtgggatttgcatgacaaaatcttgcttaaaacggctaaattaactaattttgatataggatttttaacaactttagcaaaatatccaatggcaaattcgtcggcgtaagtgagcaaatggaaaatgcccaactgagagaccataaaatccttcagatgattcatcaggtgcgtgccataacccttgacctaaaataacgcaatgcatgggcataataagcaaattttgtttcagtattgtgtatattatgatccaattttgtttgttttgtccatttgcctgttcatcggctgctactgcacaaaacacaatctcggcaaatccctgttcggcaaaaggacggtagcaaatggaggcaatggcacctttgtttttcttgtaaaccatcaaattgcgatgggagcggtcgaacaccaaccgagcaatgtattcacgcggcattttgggaagttggacactgactaaatacacaaaattcggattttatgattttcggatacaaatccaaaaattcccgttttgtttttagttgtgggcttttatagagtatttctccgctaacgtacaaagttgttgaatttcgaacagccagcgcacttttcgcttgttttggtcaggtgaaaagtcattccagcagacgtgcattgagatgactccccgctgctcctcctgctcggcaatgcttttcttagcctcagctgaattgttaaataaatttcactctgacctaacctcaaaaactcactaaatgtgaggctgcaagaagaggaagaactgctggccgatgccgacggcactgttaggggtaaattttcgctcccacccattt

SEQ ID NO: 21096 - DNA, 1011 bp, Heterodera glycines
ttaaatcaaaagcaaaataaaattatttaaagaattaaaagtaaataattatgttaattaagtttaataatattatatattatttaaaatattcgcgatataattacaattttatattaattatatacgtggtgagccgaagattaaatgattaagccaaaatctatgaatgcttcttatttattgtaaaggagtcatctagcctaattgagcaaatcaaacaaagcaaacaatctaagaaaattcaacttttcaacttcggctcacatctatctatatgattaatataaattttactatgtatcgaatattttaaatatatatatatataattaaatttattaacataattatttttgcatttaattttttaaatttgcttttaatttgatcattggcacttttcgcatttcgtctcagcacgcttttcaacaaccaaattcaaaaacattcttcgtaataccatcacgggaaaagaaaaaatgaatttgttggataattattgtcttttccctcggcttcattaatcgcataaattgaaatcacttttaaatatttctttcactacaacatttattcattcatttattccgtaaagtttggcattttgtctctttccaattcatttcattcgatgattcgtccgtttttcttccgttcgtttcgtttgtgcctttcttttatgcttttatgcctcgcctcggctaaacaatatttgccaaattggtcatcaccaattataattgactttcaattcgctaattgcccaaccttttccggcggcggtggtgccgccgcttcggccggtgccgctgccgcctgtccgtcgtccgcgggcaattgaagcggaatgaccggcaccggcggttttgccgcatcgccctccgccttcacctgctccacgtactttggtggttccaaattcttccggatgttctccaattcctcaaattctttgcggccccattccggtggcggtcgtccgctgccgtgcacaatttttggctccgg

SEQ ID NO: 21097 - DNA, 2044 bp, Heterodera glycines
gcttctccaagtcgtacttttcaccctccaatttgacaatgcgcgcgtgcaactgcttgatctttgccttgatgtcattgggcaacatgttcgacacgtccaccggtcggttcacaatggacatgtaattgcgctgaattggattctcactgttatcccatatatcccttgcttatccccccccccctcccaattggacgtcctcctcactgttatcccatatatcccatgctaatccccccctccccttgctcactttggcctcctcatgctgctctttgctcagtcctcgcggtttgctcgtctgtcccggcattccctgctgtgcgcccttctcgcttttctcgggaaccacaaagtttttgcctgctccttccgcgtccgccgccacaaatccgccaaatccgccggccatcatcaggtggcgcttccgcttctcctcgtcgcgcttcgctttctccgcttcgagtcgtgcctttcgttcctcctgaacgcgtgtcggcttattatatcacttcattctcatcaacttgctaatgcacacttaaaacttattttggcacgcaatgttaatgcctggcccatggatcagtctgactgtgccaacattcactcgccgatctctcattatttgctaatgagtcaatcagtgccttttcgccaatgcttcacctcatccttccgccgtcggtcctcgtcttggcgccgtcgttcggcgaattcggcctcctccttctcgcgctccgctcgcctctccgcttggcgttctttcaaaacgcgcagttcgtcctcaactgcagcgagttcctggcggcgtcgctcgtcattgtcgcgcattttggcttcctcctcctcctcgtggcgcttcttcaccgccagcatcgccgcttccgcctccgtcatcgattcttctgccggcttcggctgagggggcggcgcgcggcgaagttgcgccgtcggcgcgacggactccgtaacactggtgcgacgaaattctctgaaatgcccaagtatggctttcaattggtctcggtctttgactctcgcctgtccgcccttaatttctcgaaccgagtctcgagagtcacttcctctctttcccctccccctttttcccttcctccttccctcttcgtccctcccccttttcctcttcctcccacattactaacttttcccttccttccccacttactctttcggcgcatcgcctgcccctccgggtgaccccggctcttcttcctcctcctcttccttttcttccgccggcggtgcctccgcttcggcttccggcgccggctcctcttctttgggcggtgccggttcctgcacgctcacttcatccgcggcaatactttcctcctcaacctcttcgtcggaacttaagggcaaatggatgaggagagagaacactggaaaagagctagagtggaaaagacagagagacgaggaaagagtgcgaaagaaaaagaaaaaggcgaaaaaagagagtgtgagaagagagagagagagagagagagagaaaagaaagagagtgagaaaaagtaaaagctgaaatggaattaaaatcaaattattattttattttatattattgtttatttatcacctccttaatttcaaatggcattttattttttatttacacttttggactgccggggcttttcatgtcaaacggtggggaagggataagcgggaacagaaaaatgggtaccggataaattggatttgaaaaagccggccttccttctctatagctgctttcctaaattaaattctgacaaatttaaaccccaaatttcggcttttggtctaaccctcccgcctctctccccggaatgtccttttcagctgaccgatcagttcctcctcctcctttttcttcgccatcatttctcaccggggcacccatttgggcgtcgctttgatcattttgcgccgctgtgccgtcccattggtctctctgtgctgactgatcagccggtggttgacgcgtcgcagcgcgtgccggtgcagcacaaagagcggactgaccgcgtgc

SEQ ID NO: 21098 - DNA, 2899 bp, Heterodera glycines
aaataatggaatacccttaattttgaaaatttttttttaaaaccaattagcgttgaaatattttcaggttaagttagtcctgtaccggggagtatgcctataaaatttggtgtagttttattaattatagaaagtaataagttagataaaaaaatttgatttatgcccaaaaaaaatatgggcgctactgatcacttcttcaaataattatttgggattaaattttcactaaaaatttaagtctaaaatttaaatcttttcttttttgttttacccaaataactgccgaacaaatcgtcccgtccgagccgttccccgagcattgctttctccgctgatcggagcagccgtgccactttctgacggcattcaatcagtttgcgtcgtgccaaccgcaaatgttttgtgtcaatttctttggcatccgctgtcactgaaaaactggtggtgctgctgtcaatgcctgaactgctcgccaatgacgggcctcctccatcgacatgggctgctgcagttgagctgttgtgctcttcagctgttccgctctcagctgaatttgatgatgccaaatgcagcattgaagaacgatgtgcggctgctggaaatgtttaccgttttttgattttgaaatttatttcaaaaatgaaagcgtaaattcaaattttatttaaaatgcaattagcataaaaacttaatttcttagataaattattccatttattatatgcaaatgttctcgaattgttctatcattataagggtggggaaattataagcacataaaatcgcaatatgcgcataaaaagtgaaatatacacagaaaatttttacaaattaaattaagggcaaaatttctcaattcttcaaaatcatgaaaatttcagcaaagaaatttcgaatacagctagtatggtatgaaaaatcttttagaagaaaaaacaaaaaaaaattaaattaaattatatttattatttttgaagaaaatttaataaaaatcgaaaattttccatttatataattatttttatcataaattccaattcacccccccccctatcaataattatttgggacagcatttaaaattttttacaaaattccaaaattcgtctaaaaaatttcccatttttcttacaaagataaatcctgaattcctattaccatttatgtgttcctgttggtgatggtgttgctgattatgattgctttgtttggcattgtccaacagttccatttgtgccatgtcccgctcgaccaccgtccgttcaaattgcaattgcatttcacgcccatgcacttcccgttggcgcaactcctgctccaactcctccagcgtgttgttcaacgagcgcactgtttggttgagttcggcacgctctctgtcccatgccgcttcacgttcagcaactgctcgctgttgttgtgccaactccgttttcagcttaccatggtcaactatctggaaatttgtgccggaaaaatttgataattttaaaatattttgcctttttagagtttttaaaaatttaaattaaaaataaaatattataataaatatcgacattttgaaaaaagcctggacctggatttcctgtaaaaaaaatccaggaaaacccaggttgcccaaaaatggcctggacccgtatccaggaaaaaaacaacacctggaccagattcaggtcgttttctatatgtaatataaataatttcaaaattataagattaatttttaactattattctataaaaaacaaaaagaaagaaaataatttttaacgaatattctttaatttatccttgactctttctgtttaaattttggcatttatatatatatatatatatatattttttttgtcattttcaattaaaaagaaataataaaaaatctaaaagtgaaaaaaaaaataaattttcaataataattcacaaaaccaaattttccaattttgccactgccattgcttcgttgttatttgttgtggttgctgttatctgctgccgatttagtcgtttagcatattccaactccgtttcatatgtacgcaacttaaaaaagcaattaaattttccgatgccaaaaatcaaataaatttttaaagataaataaaaataaatatcctagcaaatgtttagaattcgcaaataataatttaaattatttttttaaatcaattaaattataaaaacgaaaaaaatgccatatcttctcttcatacggctgatttgttcacgtgccgcattctcctcatctgcgtgccgttcccgctcacgctcgactgtctcacggccgcgtcgaagtgccatccgaagtcgttcaatttcggcatcttttgtggacaattgttgtacaagtgtgcacatcatcaaatcagacacctgtttagaacattaggagcagagattaaatgattccaagagactgttctcggcaccaagcaaatctaagttctccaatatcaattagtggcactaattgacctcatcgggccatgagtttttttaaggttgaagtatcgttctcgagaatttaattctcgaccagcaattatatgctttaggaaatccaatatcgtaaaatttgtgccgaataagtaaaaatttctggcctagcattagcacctgctgttgttgttgtggttgttgttgactgctacaacctgctgttgatggtcctcctccagctgaaaattgctgtggcggtgccatcaaaagagactgtcgacaattttgtggcataggccgagaacggcattgtgccgatgcgggtgattgggtcgaatcaaccggcataactaaattttaaataaaatttgccaaatgccaaaatccaccattgaaaaagcatacaatgccagccagacgaattttgctcaaataattcgttgccgacggcaca

SEQ ID NO: 21099 - DNA, 988 bp, Heterodera glycines
catacttttttagcttcgcccacactcatacttttttcgtttcgccacactcatacttttttagcttcgcccacactcatacttttttagcttcgccacactcatacttttttagcttcgcccacactcatacttttttagcttcgccacactcatacttttttagcttcgcccacactcatacttttttagcttcgcccacactcatacttttttagcttcgccacactcatacttttttagcttcgcccacactcatacttttttagcttcgcccacactcatacttttttagcttcgcccacactcatacttttttagcttcgcccacactcatattttttagcttcgccacactcatacttttttagcttcgcccacactcatacttttttagcttcgcccacactcatacttttttagcttcgcccacactcatattttttagcttcgccacactcatacttttttagcttcgccacactcatacttttttagcttcgcccacactcatacttttttagcttcacctacactcatatttttttagcttcgccacactcatacttttttagcttcgcccacactcatacttttttagcttcgcccacactcatattttttagcttcgccacactcatacttttttagcttcgcccacactcatacttttttagcttcgccacactcataatttttccgggtcttttgggttgaaaggcagggataaaaccgaattttaattatcaaaatacaacatccctcaacaatcaaaaaaaggcgtccccgcctttcagcctttttgaaccgaaaggggtgtccaacaggtagttcaacggcgggtgggtcgaaactcgcggtggcgcctattgtttggatcgctgtggtcaatttcataaggccgatagcgagtgtttgaacgggcagcggcacgaatttcccggagctcgaaacaactcgacgatgatcgggccgatctctcgccgat

SEQ ID NO: 21100 - DNA, 766 bp, Heterodera glycines
ttggtgtaaaaaaatttgcccaattcatcaccatgatcccaaccaaagagtgattacggatcataaagcacttatttggatgtttcggagtaaaaacgaaaccggaaattcccgagtcgaccgatggcttctcgaattaagctcccgcttcattctaaaagttgaattccaaccggggaagaaaaatgttatcgccgatattatttctcgttcaaagcagctgaccaaattttggagccaaaaaacaatcaagaacttggcggacgtaaatttttcagtaccttagactttatgtcaggttactggcagatcaaaatggaagaaaattccatcgaaaaaactgccttcacaacagaatatggcctttatgaattcatggttatgccttttggcttaactaacgcagtggctaccttccaaaggttcatgtctcgtctttttgacggaatgattaaccaatttttgttcgtgtatatcgatgacattctaatcgcctcagaatcattcgaagagtatttgatacacatcgaattagtcttttctcggattaaaactgccggtttaaaattaaaattggaaaaatgccatttttgtgcgaccgaactaccatttttgggtcacatccttacgagagaaggaataaaaatggacgcagataaactgaaaccagtgatcgaattgccaacgcccacaacaaaaaaagagcttcattctttgctaggatttaagacatactataggaaatttatacattcctttggtacaa

SEQ ID NO: 21101 - DNA, 2632 bp, Heterodera glycines
tttggtgttggttgtgctgatcactactgttcgtcctcgtcgtactgctgttgctgatcgaaatgtggtgctgtctctgctgctgcttttttccgccactcgccgccgccggactttccttggccaacagtgcggcgcttttctttttctccgcatccaaaaaagaacggctgaaaacgaattacggattttaaagaagtttgtaattacgggttacggtaaaacagtttttactggcaagaaacattcgtttttttataatgtgaatttttgtttccagaagcttctccctcctaattaccaaaaaatgcaataaaaattggccgttttttcataatattttttgcattccaaacacacaatttcatgtagagatatgggtcagacaggtccaacaaatcagcatcaacaccgtcctggtccggaccatggccatcgttttcatgaacaactgcagttgcagtggcatggcggtccgcaacattttggttcttgatggcatcctctgttgtattgttggacatgtgttcaggatcttttggatgttgcacaacatcatcatcctcatcatcattatcttcgtcatcatcgtcctcttcctcctcctcctcatcatcatcatcggcatcttcatcatcattttcatcgtatttcagcgccgtaacgatgggtgccgttgttcttctctctgttggcactttctccgccactcgtccagtgccaattttggcggcggcggtttccttggcatttttgtccccgacagagaggcgatcatctcctttttgtggttggagttgtttttgtccatctttgtcgtcatgttgttgtcctccatcaaccaattgagtctttgccaacacaattttctgttgttgctgctgttgggccttccgtgccatcgtcgcccgtgccgcctttcgccgcccaatcgtcgccattggcggcgctttgttccctccacgcaccaaaggccaaatgtaggaaaacaggaacaaaatgaaattcagcgttcgccagaataacctgaaagcaaatcaaacaaataaaaaatgtgagaaaactgagtgaattaaaaaaaatgccgagactctcgagcgtcatttgcgattaaaattttagtaattggacgcacttgttgaatggtcccgcatctttggccgcctgcaaaaattgggtccgccgggagggtgccaacaattcagctgcatcgtcgttgtcgccgtcgtcttccaccagtgcttttgccgtcgacagcacaccgttcttttccgatgctaatgacgatgaagcggacactttgtcatcctgtggctggcaatccacagaaattggaggagcaaattgttggcgataagcacagctgatcacacgatcgccctccaaataagcgcaagagaccacacaaatgaagcagaaccttagacagaagaagagagtaaagaggggtgcgagaggaaagagaaatataataaatgagatgccgacaagcaccgccagggaattttaaattttttttttttaattttgtgtcaccataaatgtaattttttccaaaaatagcaaaagtcattaaatcctcaaaaaacagaacgctatttacacctaaaaagccataaaatgatgaaaaatcatcacttaaggggtgagtgtatgaagttgtgaaacgtacgttaaagcaagcacacacgtgtagtacatcatgctctcgaagggcggacggggcagtgcggcgtgacaaacggacaatagttggggcggaatagtggccactaggttgaatgtccacggcgtgccgttcatgtgcatgtacagctgcagcgtggcctcgttgctggtcagcaggaagtcgggcgtgtagctgaacaagacaaacagaattggagaaaaaccccgacgggattcaagacagtcaaatgggttttggtgtcttacaaatagcatttttggcattttaaaaagttgaaaatttcgactcagtcacaagaccaagactctcggaccgaaaccacagaaaatccattaatgttaacgcacgcaatgtccagcagagttgtctcattggggtcgagtcgaaaccggtcacagttcaacacgcgaaagccccggttttcgcacggcgtgttgctgacggaaatgttggacacactgaagctgacctgtatgccaatcaaagaaaattgactccatttatcccagctaatcgctcacttcgccgctgttccgcaccacaaaggaacgccggacggtcaacgtggtgggcagtttgtgcagctgccgtcgcgggttggcacagtcggccaaatgctggggctgaatttcgaacagcagaggcagggaacgtgccgttttgttgtcgatgtccatgtgcctggttttacattgaagattgaacagggaaagcaattagggattctttctacgtcaatgactatatcttatttttgggtgccgaactattttcaaaaaccctgttggaattagagacggtcggactccagttctaatcccggatttctttatagcggagtccatttttgccaaaaattttagcagaaataccaaggtattccacatcatgtagacgaacaaagtcgctttattgacgaactattgactgattatacacatt

SEQ ID NO: 21102 - DNA, 766 bp, Heterodera glycines
  misc_feature (553)..(553): n is a, c, g, or t
tcataaaatactaaagagaaaatggaatgatttttacaacaatttaaattggtgaaaaaaagatcgaaaacaccaaaacattggcgacggagtgaaagcgaatggcaattggcaaaaagtgccgagtctggccgatcagtagtgatcaaagcgaagtgagcgagcattttcagttcagacaatgcattggggctgagaagcgagcagcgattcgcggtgactcatttcctccaattcgagggcctaaaaaattgggcaaaaaatggggaaattttacaaaaaataaataaataaataattgccaacttgctgtggtggcaaataaattggtagatttttagaaaaagcttacctattttgacagtttttagagcctaaaagcattagccctaaacaccatgtactttaaatagattagataatttaaatttcatgaaatgtgcattatttaaaattttaaaattctaataatttttaaaatattcatcaaagttttgattgatgaataaactaaaatactagattttttttttgtgttttcatgaagttttanagaaaatgtaaattgctttaaatatttttcagttcttaaaatttttctcgaagtgaggggggacagattggcaattccactccctcccctctgcttggacatgtgttgccaagaaaaagtgccaaaatcggactttggccgcctccattttcagctgatgactctgctcagtgtgccgtttgatcagctgttcctcgtggttgccacatctga

SEQ ID NO: 21103 - DNA, 1826 bp, Heterodera glycines
atcagtttaattgggccatttaattagtatacttattaataattttttgtttattctgtggccaatcgcctcctctcctcagtgaacagcttcacattcttctcattcagctccattatcggtctgtctcgttctgctttcgtctttaaacaggcaataacaaattacaatttttcccccgtcgacactgaccattaattggattagagaagaattttgaaaaatcggggcaaaaattaacattttaattgcaaaacatgtgccaaaatcgtcggacttaggccgcctccatttacaacttacactgtgttgcttcatgggaagcggtcaaactcccaaaaaatagggtgtccctattctaatgcaacacagtgtatagctctgttcacccgaaatccaaaaaagtaaaaattgcaagaaaaattggtagttttaaaaatttttagttattctcttaacaaattgcatttaaaatttccaaaaaattatccggcagcgcttaacggcatcgccagacccccattttactaaatttttgaaaaaggaacccaaaatggcaaaaaaaaaagtcattttttaatgagacgacgtaaacatgagataatcatcatagaacaatcgcacaaaacataaacaatcaacattccccgaaaatccaaaatttcgaaaaatttattgccaaaaagcaagttttccaacatttttgagcataaccttttttttcgattcccattgaaaatcgatgcaaattccgcaaaaaccgccgccaaagaaagaagtcggattcgaagccattttaatagggtaaattggattagtaaataattgtttgctgtatgctatcatttaatttcacaaatacaccgaccaaaatgccatcgctttttctttaccgttttagtccatttttcgctgtttctccaattaatttgaccattggcacgaataacgatcgaattttggagtgtatttcgcgccacattttgccaatactcggaaaaaacatttgtgccatgcaattgtccgacagaattttctgccgtttgcgacaattcgtcccatcatttctcaacgattgttcatcatttcgcgtggtgtgctttgtctatttcggccaattccgaactccggacccgactcgaacaaaaagtcgaaactccaaattttcgatttagcatttttggttgaaaaacagcgtcaattatcatcacttattgaaggattgctaattcgaaaatttggactttcgcctttttgttcgaattcgggtccgggattcgtaattcatcacaatgttcctataaaattttacttctatactacaattcttaattctgcagaagtttattttaaacatttgtatcactgacgcattcaggtgacgtaaaaatgagatattagtaatagaataattagaaattgcattttaggttttgaaataaatttatgcaaatatttgaaaaagactcttccattgaattaaaaaaatacaatatagacgattgttcatcacttcgcgtggtgttaattttgcatattttttaataatttttttttgcatattttttaataattttttttgcatattttttaataatttttgcatatcttttctgcgcatatgtttttatgaaaattgtaaaaatttctaggaataatttcataacaaattcggactcctaaaatttctctaaatctccgtgcttttctgtgccattttgggatttattttacggcaaatccattgatgaaaatattggtgggctaatgaccgcccaattttcaggcatcagagaatgggaacacttatcatggaggggaaaaag

SEQ ID NO: 21104 - DNA, 2399 bp, Heterodera glycines
  misc_feature (6)..(6): n is a, c, g, or t
aataantcgagattatgtacttttttaaatttttaaacaatttaatcaccaaaatcaacgaagtttggagaaaggaaaattttgaatgtaaatttttctcaaatcgtctggcgaaaatcccataaatttcatgttttaacccttcgctaagtttttcgcttcccacctcccttttttgtcccttttctcacattttttgccaaattggcaaagagtcgccacggctcgcgcctcttcctctccacctccggcaaatgttggccctgctccaatttgcgtcctgcacctcctcccattttcttccgctgctcctccgcttttgtcgacgctttcgttttgtttcgatttgctccgcccgccaattcaaaaatttttcgcttctcttcggtgcgttccttaaaaatgggacaattaatcaggcaattagttaattaattactaataaaaaataattagtttaaaaaaatgttttaattagtgagaaaaatgattggaattaaaaagaaatttagaaaataataatgaaaaaagaaatattatcacgagtggtttagaaataccaaaaatttaaataataaaaaaccaataaatttaataaatttaataattttaaatgataaattagcattattttatttgcattatattttggcattaaattaatgttttttgttttgttttcatttactcacatggatcagctgtttttgaaggtccgtgttcgccttgcgaagtccccgaaccaatgagatcagaaagacaatgaacagaatgaggagctgaaaaacacagatgatttgaataaaataataaataaaattggcagcacgagaatggttgggataattacgcccggcgatgcgccgtatctgagccatctgagcgcccttttcggcacatttccaatgatcagttccgtgagcacgtcgtagaaacggtgccgttctcttcaacagaacttatcattgtagatttgaaaatttaattaaataaaatacactataaattctcacgcgaatggtccacaaagcaccgaaggttgtttggatgtaagcacataaccaacggggacagtgcataagagcagagcggagaggagaatggccaaaaagaagttggaggaccttaattgggcgaatttggccaactcgatttatttcaatttttggaaatgaatttaaaattggggtagtgtaattttgaaatgaaacattttttgagaaatcagatcggattcatttaatcagtggaaaaaattttattaatacaacaaattagatgcgattaccaattttaataattcaataaataattttttaaaatttaacagttctgtggataaaatattttgcccgaaattgttgacataaaaaagcagttagttgaatatcttaataaaactcttcatgagtccataaattttatatagtattattatttttaaataatgcaaaatacctgagaaaatgcagttgaatttggaggaatattaacatttaaatgagaaccaaatatttcttattttgctttttttctgtgaattttcaatatttaatatttggtcagtgaaattaaaaatattccaacagaatttgccgttattttctgtcgattgactgaaatcacagcaaatgcccccgatttaaaacatttgatcatccgccaattgacttggggattaaatgcggattaactcgtcccaatccgtggaatttaatgagaattttcactgaaaatggcctagcaaagcatcggtttaatgtccagcagagaaagtacagctgttcacgggcaaaacgatgcctcaaaattgaaaattcaatgcaaaaaatttttaaaataaaagaaatggaaaaacaaaagttcaaaaaaaaagaaaaaaatatatatattccaatgataaaaagcaaaaggatttggaactaaatttacaaagatctgtttttattcttcatataaatttataaaaataattttgaatgatttaaaaacaaaacttcaaatgaataatattattaattaattttttgcttttcacctcgacgcccgaaaaatttcccgggccggcacattgcaagtgacacaagcccagccacggatatacatgatgatgatctggcaagggaatcaacacaaatgaacagagacaaaccggacaataaaagggaaagatcaccagcttaacgttgtttatcgcggggagaagcggcgcgaagaaaaggccgagccaaaccatgcctaaggcaacgggggaaggataattaagagggtaattaaaacaaaacggataaatttgatgaaaaatgagcaaaggttggaacagttaataaaaaatattaattaatattccacatttatgtaaaattggattggtgtaataagttgacactaaaagagca

SEQ ID NO: 21105 - DNA, 3450 bp, Heterodera glycines
atttcgtggaagaattctcagcctgttgaacagtcattgttgccttaattcgagtggatttaattgccactaatattaaatgatcgcctcactcacccgctcgaaaacagccaaagacgacttttgagcgtcaatttcagcgtcagggacaatggccaaagaaaggacgacaattgggctttggaaatgaccgttgtccaactgaaaacgcaaagttagcccataaaatgtcattctatttcaccaattttgagcatcggatggtaaaatggcagtcgccctgcactttgctttgccgcgcgtcgatgtccaaaaagacggagccgagaaaggcattgtccgcaatttggtggacattctgtcacagtgacaagccagtcaatcaacagagtgaggatcccaccagcttgaccacatttccaggccaacattcgccctcggccggctcagaacgctcaaaacgcaatttgtacagcgcagcgacgagcgattcgaatccgtcgaggagagaggacaaatggaaggagcaaacggagggggcggaggaggggcagggggaggagaggagggaatggcgtttgagctgaacgaagcggaaattacggagataaacggaaaatgaaaacaaataaattaaatagtaattagagtgttaaatggacaaaaaggcaccgcagttgcgaattcgacgtcgcattcgttcaactggggaccaattgcgtcgaaattgagtgagcacttttgcacaatttgttgagcttcggcgagttcggcggcacattttggcacaaatttctgaaaataaagaaaaatatatattaaaaaatgaagctaatttcacttcgatgacagtgccaagaaatgagtgaacgttttcgtaagtgcccagcaaagagttgctttgggcccgatgggcaaacgactggaaattggtgagcagtgccaaattgtgtcgggcggagaccaaacggcgtaaaaaggtttccttaaagaaatttaaatggttttaaatatccaaaaactcaattaaataaaacaatgttttccactgcctttcttcacctgctgttcgttgtgttcaaaatattttctgtagctgaaccatcggagccgtcggtcgacctgttgggtccatgggccgttcaaatgtgaagtgcgcactccgaattggttctgctcgtcgctgctgagtttcacgggccgctcacaaccgtccacaaaatttgtaccagcctcgaagatttcatcggaaagtttgacgaattgttttcgctaaaaggaataaaatgaaacgagtcactagccataaaatgtgcaaaataaaaagaaaagcaaagtttttgcctcgacagaagccaattggatgccggactgctcgaactcggccagcaaaagtcggcacgtccgttcgctgaccgcgtccaattgctcgcgctccaacgacagtctcagcgcttcgtaaagttccgaaaattcacaaaattcatttattgtcgcttttttcaatttgtcaccggtgttgtgttgagcgtttcaacaagagaagtgaagtagcgcatcgcttcctccgccgcttttccccactttgggtcggtgtgcatacagcggacgcaatccgtctaatatgggaacaattctccgattatgatgcgtctcccagaaactaagcgccgaatttagctccgtggccctctgtttgaggcatttaattggacgagggccgaaattcttcctccccccccgccatcagatgaaaaaatcaccaaatcagcggccgaacaaatttcgttggacagatcgtccaccagagacactgtcgttttctgtaaataaaatcagtagtgtacaaacaaatgcaaaatttgccatttttttccctctgtcggctgccctttcggccgctctttgcacaatttccttcacaaattcgtttgactttgcgtccaccgctcgcgtgagcagttcaaagccgtgcggagaacggagaagaaaattgccgaaaaggcccttaaaggacggaagattgggaataaaatccatgggcattttcaaatttacaaattcgacaatttaaataaaacaccatgttggcagatgcaagcgacgcatttgttgcgggtttgccaccatcggacgaaaggtggcggcgaaagagtggcaaaaagtggcaacgggacgaattggaaggaaaaagtcgcattcgaaagacaaaatgcaattaataatatgcgaatggaaaaagtaaaaataagaaaccaaaatgtgattacaaaacaaatgaatgccattgcattttgagttggaaatgcttttaaaattcaatttatcgtaaaatttcagacagaaatcgtaaaatacacacattaaagcaacaaaaacagaagcaatagacaaaggaaataggtaatttgctgtgctttaatttagaagcgtccaaataagcccgggaacaaattggagcaatggcgatgctgaataaacgaggaacgctcctaaaaagaagagagtgaaatttgaatgcaaagcaattagaaagtgatggggacatgctgaagccgatcacgggcgagcacattcagccgatcaaccaaccgcacggtttggccctggacactggtaagtgcggtcagcagaaccaacagtttttggtccgtcgattgctaaagtgtccaaaactattttgaaaaagaacaataaacaaagtgtaagaaccaaaaaagcgttttccggcgcattgttcgcatccaaaacggccaatttctggcacaatttgttaatttcttgcaagattgaattgtcacgctcaatctgatcattctgcacagactaaagaaaaggaaattctcattgtcggaatcggctctaatctccgtgaaaaatttgtaattaaaaaaaggcatatttagccaatcactttgattacccaatgtcattgaaatttccacccattctttgccaagttctgatttcgcccactttgatatattggctggcgatgaacagcccctggtgcagactggcgatgctgccaatttgggcgcccaattgtttggaggcggtcgattccgccggtgcgccctctcgcgaatagcgtgccaaatggtccagtccgatttgttcggcgacttcgttcacaattttgacgggcacttgctgcaaaagcagttgttgctcgtcggttgggtccacgcgcgagtcgaaaacggtgagggaaagctgaaaaacaaagagcggttggaacgttttttaaaatatttaagcggtttctccccgccgaattgtgcgataagtaagaccttatcgcaggcgaccggttcactcgcattgaatttcaacaaaattggcgcttcgctgtgaaccatcgccttaataagtcaaacgtataacatgatgacgttgtttaattgtcaaaaatgaaaatattagagctcgacatcttgaaaaaagcat

SEQ ID NO: 21106 - DNA, 1372 bp, Heterodera glycines
cgatgccgacagaaaaccccattgccaatcccgcaaaaaccgttgccgagcaaagtgatcggattcagcaaatgcattttgatcatgtaaaaactgatttgattggactctattacagttcagacgactatgaaagaacttgatgaatttaatgcaactaatttttttttcaagaatcatccaacgtaaacattcttggtaccattcgagagctacaagagtcctctattagtatgcaaaatttcaaaaaaaaaaattgaccataactttttgaaaacacaatcaaacttttgccgaatcatttaggacttattgggctatcaaatgataccaagaatgtttaattaagatgtttctaaaaaaagttatggtccattaaaattgtcatctaattatttgctggtcgttggaactgtaatagagccttagattggaattgatttgtgatcaatgatcatcacacattttctacgcttttcagttacatcgatcaaaaggtcgtcgcatttctccagcgttttcaccgttttttcggcgcttatgcaatggatttggacattgtcactggaaatatgcgcattttggaattaattttggacaacattttgccaatgttccgcgattcaatgcgttatctgtttttgaatgccatcgcttttcatcgtctgtgccaattggactcatcaatgctcagcgattgtccggcacttcgctatgtctctttcaatgaggacttttttctgccagcttttccaccggatgacagcgccatggcatcggatggccaagtggtggcaaaatggctgttcacgccccatccgaacggtgtgccaaagtggctcaaatgctctgtaaattcatcggttttccaatggacgttaacgattgaacaattcaaaacggtgattatgcccccccccccctaattaattggtttttctgtggctggtcccagctcatttttggaaaaaacaattaaaaaaaaggtcgtgctaaacattttttaggcttttcggggtagctgatcacgaatctaacatccattccaccaaatttataaccccggacttcgaattcgaacaaaaagtcgaaaccccaaaattttcaaaattatgatttttgttctctgactgaaaggctaaatttagtcacaaacgatcaaaaaagagtctcattcattctatgcagattcgaacataaaaacattgaaaatttttaattttgtccgaggttctaaatccgtcgaaatgggtgtcagttttcgtggtcagcgacccaaaaccccccaaaaaaggtgttttacatgtttttttgaagaatggcccaacttaattattacatttttctctgttttttatccctcgactctaga

SEQ ID NO: 21107 - DNA, 1204 bp, Heterodera glycines
  misc_feature (96)..(96): n is a, c, g, or t
ttggctcacgcgttgtccaattggatgggatgagatcaaatgggacaatgtgtggaacgaattgagtgctgctcgaccgaaacggattagcattgngatcagggacggcagatatgacgccgggtgaacaaaacaatttaattaaaatgatcaatgcttttttaaagtgcaataaagtcaaatcgtttttgttcagtcttctcgacgccgcttcgcccgggccgagtgatcactgatcagcaacagaagcacaatgaatgaattaattattaattgatggatggatgtgatggcgtgatcgaaatgatgttggcactttgccatttcaatattatgtataatttgtttgtttgtatgtacctatttgacctttgcttgctttgccgcaaaattcgtctatttccattgtatttgatgtgcatgtgtaaaatgcattgtgataattaattaggacttccttttttggcaatcctaaagaattggggtccctaattgtatttatttatttttgattttcgactcaaatcagttttaaggggtttcgagggtgctgattaagaattcttaactcggttttgcccaattctgaacctcggacccaaattcgaacaaaaagtcgaagattcaattttttcgaattccacatttttgttcaaactttgtttacacacacggaaacgaatttaaagtcatcaaatgcttcaataaaagatcgtttaaacctattttagagtaaaaatcgaaattcgaaaaaaattgaattttcgactttttgttcgagttcttgtccgggattcggaattggccgaaatggatgccgtattcgtgatcagcgaccccgaaaagccatgttttcatgattttttaaaacaaaaaaaattttcgataaaggggggggccaccttatttttatgtcttttatatgatttttgctcatcggtactcaaatgtacgctaatattttcgtataaaaatgccattgtttcttcttcccctcctcattccattcattctctcattctttctccctatattttccccggtcattttgttgctgcaaatgccttcagaaattcggtacgtttattatttcttctttttttctgacgttttcacatttattttgctcaacttttaaatttttcaaaattcacttaattttgaggcttacaaatagcttcattggatttaaactaaaatttca

SEQ ID NO: 21108 - DNA, 1886 bp, Heterodera glycines
cctagtgcttagtgatggactagcgagtggtgtccgtaggaataaaagccaaggcgtggctgcgtcctgtccaactattccctagtgcttagtgatggactagcgagtggtgtccgtaagaataaaagccaaggcgtggctgcgtcctgtccaactattccctagtgcttagtgatggactagcgagtggtgtccgtaagaataaaagccaaggcgtggctgcgtcctgtccaactattccctagtgcttagtgatggactagcgagtgatgtccgtaggaataaaagccaaggcgtggctgcgtcctgtccaactattccctagtgcttagtgatggactagcgagtggtgtccgtaagaataaaagccaaggcgtggctgcgtcctgtccaactattccctagtgcttagtgatggactagcgagtggtgtccgtaagaataaaagccaaggcgtggctgcgtcctgtccaactattccctagtgcttagtgatggactagcgagtggtgtccgtaagaataaaagccaaggcgtggctgcgtcccgtccaacaattccctagtgctaaataattcacttttatatttcgtagctgtacacactgagttaattttgggctcccagttcaaaaagtaaatgtgtgtgtggcaaagtggtttttgtaagatagtaaaggaacaaagggcggaggttcgagtccgttgtgcaacacgactatttttatttatttttgtccaaatattaaaaaatgacgatttttgggaattgtttttgaagctttttcccaaccaaattggacaatcttggtattattcgaaagctcttgggaaggagaagctttttctaagccaatgctaagcaatttgatagttaggaaaaagatatgagtcttcgaaaaattgttttccttataactcatgaaataatgtataagccaaaaaatggctgtattactgaatgtattatatttttctctatctttatgcaaaatttgaagcgcatttaacataggacaaaaaaactaaacatagaaatgtaaattccgtttttctctattaacagagataaagaaaaagtacgccaaaataagagatgtttttttctctgcactctctatttattgacacatgtctctttttttgactcgctgtgtgtacagaatgaccattctttgatattccaatggtttgtgaccaaatttagtatgttttaatcaatttaggaactaaagtgagaattttggagttttagactttttgttcgaattcgggtccgggattcgaaatttgtccaatgaaggtcatattcgtgatcagcgaccctgaaaaccccccataaacatgtttccaagacttttcagaacaaaaaaactcttcgtcacaagggggggggggggtaccatctatagtattacccgcttttcttcttcttaagaattgattagaaagtatgtgattacgccataaaaaaagttttccttttctttgtagaggctttatttccgtttatcaaaacgaaatgcgccacacgcaaagcggcgggccaacgcaaccgccgaacggcacaatgactccgccccacccgcaccatcgacgccagcagcagcaaatgccatcggcacagtctgtcggcagtgccgcccaatttggacgacaaccattcggagccggcggtgggccgataatggcgaacaatgcaatcgcaaatcgaaaaaagcgcagatttgccgacaaaatggtggcaccggaggtaaaaatgggctcggatgcctaataatgttaccatttgtaattgccactgcttattgctcatgttttttcacagattcgttctttgatgcccgaattggatgcatacgtcggccttttgtcctacgagcagaa

SEQ ID NO: 21109 - DNA, 1485 bp, Heterodera glycines
tttcaatctctgagactcaattcttaggctttccaatcgctgggactcaacccaccagcattcaaatgtctgggactcaaatctccggcattccagacactgggactctaggcaacaactttcaatggcattccaatctctgggactcaactcaccagcatttcaatctctgggactcaaatctctggcattccaaacactgggacttaacccaccaactttcaatggcattccaatctctgggactcaacccaccagcatttcaatctctgggactcaacacaccagcatttcaatctctgggactcaaatctccggcattccagacactgggactcaacccaccaactttcaatggcattccaatctctgggactcaacccaccagcatttcaatctctgagactcaattcttaggctttccaatcgctgggactcaacccaccagcatttcaatgtctgggactcaaatctccggcattccagacactgggactcaacccaccaactttaaatggcattgcaatctctgggactcaacccaccagcatttcaatctctgagacaacccaccagcatttcaatctctgggactcaacacaccagcatttcaatctctgggactcaaataaccggcattccagacactgggactcaacccaccagcatttcaatgtcattccaatctctgggactcaatccaccagcatttcaagctctgagactcaattctcaggcttttcaatcgctgggactcaacccaccaacatttcaatgtcattccaatctctgggactcaacccaccagcatttcaatgtcattccaatctctgggactcaatccaccagcatttcaatctctgggactcaacacaccagcatttcaatgtctgggactcaaatctccggcattccagacactgggactcaacccaccaactttcaatggcattgcaatctctgggactcaacccaccagcatttcaatctctgagacaacccaccagcatttcaatctctgggactcaacacaccagcatttcaatgtcattcaaatctctgggactcaacccaccagcatttcaagctctgagactcaattctcaggctttccaatcgctgggactcaacccaccaacatttcaatttctgggactcaaatctccggcattccaaacaatgggactcaacccaccagcatttcaatgtcattcaaatctctgggactcaacccaccagcatttcaagctctgagactcaattctcaggctttccaatcgctgggactcaacccaccaacatttcaatttctgggactcaaatctccggcattccaaacaatgggactcaacccaccaactttcattggcattccaatctctgggactcaacccaccagcatttcaatctctgagactcgacccaccagcatttcaatctcggtgactcaaatctcccgcattccagacactgggactcaaccca

SEQ ID NO: 21110 - DNA, 4131 bp, Heterodera glycines
  misc_feature (4074)..(4074): n is a, c, g, or t
agaattttgagaaaaagacattgttattttcttatataaacatttgtattatataaaaaaagatttttttatcatttaagcaaaaagaaataagacaaaaacagataaaatgcatttattaataaagaaaaggcaaatctgttaaggaccgacgcgtcttggcatgaaattaaataaaataattaattagtaaataaataaatattcgatttgaattaaaataaattttttattaaaaaaaaaattaattcaccatttgtagaaaccaaaacaccttttaattaaaaataatcttaaaatgaaataacaatttaaggaattatcaattgctcaacctaaaaaatataaaaaattaattcacattcaataacacaaaagtttcggaaaaataaaatgaatgccaatttaaattttaacgaactttcaattattagcaaacaattttaaataaaatcaaaagggaattcactaaagaattttgtgctcttttctgtgggcttgttaattttcactagaaaaatttcccaacactaagaattttttcaaaattttcgccgaattttagtgtattttagcgtgtatcgatcactaactatgaaggagtgatctgatcaagttggtgtaaaagacttttttattcagcatcaaaagataagcatgcatgaattatttcagatttttataagcattttgaaattattttttaaatttggttcacttggaaagataattaaaaatcgtattatttttgtttactttttattaaaaagaatacaatttaaaacaaacaataaacaaaattattgaacagcaaaaataataaaaatatttaggaattcaaataaattgaaaaaaacaataaaaataaaatttaaattgtttaaaaatttatataataatatatttaatctcggcgtgagcacattagcttgataaatgccgataataattgtaaaacaaatgatacctactatcaaataacattaagatactttaaatactgcaatagtatgcaaaaattttaatttcgtattttaataattaaacatgcaaataaattttttaataaatcaataattaaactttaatttaaacaaatttaattaattttaattttaattatttgaagtaagaccgtcataaggggtctatcagaatatcgtgctaataaaattttttgttattcaaaaattttttacttccttttttttatttttttaattaaatttttaatttgatttttaatttggattattttaacaattgttttttgatattttaattgatggctttctaatccatttaattgtcgggggtcggggaccccgatcggggaatgaccaaattttattttaacccaaaaaacaaatttttctttttaaatgctcgtaaatgttctcgaaactgcaaaagcagctatgaattgacaaaaaaatttaaattcaattaaaatagtttatttattacattaaaaattaacatacaattaaataaacggaactgcttacctttttataatcaagcattgaattaaaataagagatataattaattgattttcagtttttaatataagattcggcttattttggcttttttcaattttttttaatatagatattcacaatttatgtgacaaaaaaatcataaaatgtaaggatctttttttgttttttatttggttaattattagaaataataaattttttaattattctaataattttaatgttaatgatgaaatataatataaaatccaaaaaattgagtattcaaattaaaaaatggcaaaaatttttattaaatatagaactaattaaaaaaatattttatggaattaatattctgatagaaaacacagttaaaccataaaaatctgtgccctgacaaacaaacaggaaattcaaataatttaaactaagaaattttgaaaattaagtgaacatttgtccacaaacggataataataattattattttgcattaattattcggaaagtttttcaaaattaattttttttttttttattaaattatcgttgaataacaaaaaaaaatacaattgataaaaggctaatgggttaaaataaaaatgctgattggaacttcaaaatatgaaaataaaacatttaaacgtattgtataacttttttgttttataattaaaaggaatgctaatgatgccttttgccgtaggtcaacaataataaaaattctttgaaataatgcctttttaccacttcaaattaatgaaaagcattggaattgcaccttttattggtcatatgttttgcttctgattacaagaaattttgtaatgtgtccagcggtgttaaaattacaaaaaagtttttttaaaaggtttttttgtattattttgttcctttttccccccaaacctttaaaaaacgttgcgcgggcccccaaattttccctttttcccgggggttttacccccccccccccccccccctttaaaaaaaaaaaatttcacaaagggtttttttttttttttttttccccccccaaaaaaaaaaaaaagggttttctccctccaaaaattttttccccggtcccccccccccccccccttttaaaaaaaattttttttcccccccccctttttttttttttttttttggtggggggggaaagaaaaaaaaaaaaaaaaaaaaaaaaaaatccccccccccccccccccccccccccccccccccccccccccggggggggggccccttcttttttttttgttttttttttgtttctccccccccccaccccccccccccccccccccccccttctcttttgtgttgtgtgggtgtgggtgtgttgtgtgctccccccccccccccgacaccatcacacaaaccaaaaaaacaaaaaaaaaaaaaaaaaaaaaaaaaaaaaaaaaaaaaaaaagaaaaaaaaaaaaaaaaaaaaaaaaaaaaaaaaaaaaaaacggttgtgaggtgtggtgtatgattcatattgggaataaaagccctctgaatgttcgggccagatttggggcgaagccaagagaaggaggtgagagtcgggttggcacttgtttgccgtggagtggggtggagacacttctttggaagggaggcagatgaggccacgtggcggtggaaaggaaacctttaagcatttgaggagggtgttggtggggggtttgtacccttttcggaggggtaggccgtgcatgaaattcctgtttttcccatgtcgatgtcattggggcgtaaggcggcaatagtttcggcagtagtccagcaatccgagcattgacttaacaaatgggaagcacaactttttaaaaatattcagaaaataaaacacattgtcagatggactgaccgaaccgggcaaaaacaatcgcaacttttgcgacttcagtctttgcgggtcactgtaatccacagtacgcacccatgttacgatggaacccttgggggatttcctctaccgaaaagactatacttgaatttaaacaattttgaatagcagacgttcacagggcaattgccacgtactaagcacatcttcttcggtcttctcaatcctgagggatcggcacgtgtcagggaatgggtttgccacttatggaaggttaggaatgtgcctcccggcttcagggactcagtccggtcaaactcaatggacgcagtacaatccttctcagttctggcacatattcgggcggttgatcgtccaacaatcactattcagaagtcaactttctgatgttggtgtgttggtggtagaccgtactgccacagtcctctcctcagttttccttcgctgcgagactacgtgcagcaagacgcgcaagaacccatcatccagcctagttgagtaattttgcatggttgcaaaggcgataccaggttttgggtaaacccgtaagggaaacccgggacttggaagtccaacgagaaagacttgtaagtcgtcttcgattggctcaggaccgagttaactcttccatggatcgtgaagagcgagctcgtaaacgaatgttacccctgcggagaaagttggaaaagcctttgcctcctcttntctgccccatagccccttaaaggtttgggccagcctgatggagagcgaaaggaattt

SEQ ID NO: 21111 - DNA, 1360 bp, Heterodera glycines
tattaccagcttattttccggttctttttcctcatcttcagccgagaacttcgccgatttccaactgattccataaatgacgaacccatcgattgctgttgatttgcactaatgagggggcggttgtcagaagaaacatttttcgcttttttaacggggggtgccatcaaagaaaaaacaataaatttgcttaatgaaaattttcggcgctatatggaagtgacaggttttgaaacaaaaggggggacccttttgttttgcaaaaattttttgagataaaaaaagcatgataatttgttatctggggttttaaacacaccatcccagaaatgagctccaataccaaaaaagattaaaatacttgtctcagtggtctgtgagaaggtcaccaaaggggtgggtcccaggttcgattcccagtgcatgctattgatgtatttctatgattttaatgaataaataaaaggaaaagtgaccaaaatgattttaaaattgtttacaaatttttaaacatttttatttgtcatgtgtaatgaaaaataaccatcaatcctcgatcagtcaacgatatcgacgtcggcatcttgatcactttcttcattcgttttgtcttcctccgcttgctcccgttgttcctcctcccgcttaattagttggattaaaattttaaatccccttccatcaactcaccagcttcaattcgtcgagtctgccggtgtccagcagccaattcgagacgaaatgatgctccagctgttgtcgcatttgttcagagtccggcatcgtcttccaaagttgctcaagtcgccgccacacggaatgcagtgcctcatctcctgaaaaatcacaacttttaaaattgaacccccaaaaatgatatggtcccaccctgctcatccaaaagggctaaaaatccgtgttggcgcgcaaacggaacaaagtggtgaagcagcaaatgggcttttgtcttttttgaaagaagcgttcgcaccattggttgttcgtcgagaaatgccttgaactggtaaactgccgtctccagtccatccaaatcacctggagacaatggctgggccttaaattaaaaaaaattatttccacaaaaatgaaaaccaattactttggtgaaaatttggattttccccaaatgtgccattgttttgcaaattgttcagatcaccgccaagaaacctggaaaattttcaaaaaacaaaatttattttcaccatttcacttcgcgcccgtcaatttcattgaggtgctcaatttgttcccacaacgatccgcagaaattcttcaaattcgttcgtgaatcttttgcgggaaaaacagccgcaacaaaattgttggaaagggaatt

SEQ ID NO: 21112 - DNA, 1819 bp, Heterodera glycines
tcagttgggccgtcacgtttgggccggcacggttgggccccagcatatttttccaatataattttctacaacttttttctttgtcatccaaatccattgatatcattcaaaagcttaatgtatttaaaaactttttctaagctattgcttcgcgattagataaatatcaaaaaaagttatacatgaaaattgcgaaaaactcgaaattttgaagttttttcttaataaaaatttttccaggcttgaaaatcttttcgctttttgtaaaactaatagagcatgttaatagctttcgaatgataccaagattgttggagttggataacaagtaaaaaaactatattgaaaaacgtgctggcgcccaaccgtgcgcgccccaccgacgggcggggttcccggaaaccgttttaaaataaaattttataatgtctattttaattattattggggtgttcggaaagttctttcatagcggtcgttttatgtaaattagaatttttttcgcacccaaccgcaacctttggccaaattctttctgttctataggaaggaacagattttgctgcatatgttacgagccatttcattttcctttctttgtaaattgattttttaaaattatcccaatggagcacccaaaatcccaaatccgatcacttttattgtacgggtcaaaactttgctttgatcagttggaaatttattaaaagcagtttttgtggccaaatcaagtccggagaatccaaatctggcttcagatttgatctctgaattttctctggcattgtactgctccatgtcgttgacaagaagttgaagcagtacagggtcatagaacagcaactgactaaatctgaggcgatattcggattctccgggtttggtttgcccatgaaaacatcaatttcattttattaggtcctttcagaacaatgttgtacaaagagggtgctgaatcttggcacttttgagcacccattttcagacaggacaatttaaagaaataactcgtcggtcttggtgactctttttcagcttgtcagatagtcccaactttgctctacaaaaccataatttgttttgtgcctttagccttttcttggccaagaaatcagtggttgaatttggtgacttttttaagtagaccgatcagtttatttgagtttaactatcttgaatttaatcgacagatcatttttaaattctcaaaaatgggagaagattgtggagaataattgggcatattttgattaattttgagttattatttgatttttataaatttttgaatgaaatttttggtcggggtgacagaacttatacaacaccccaatattttcctatcactaattttcgtcttttctctttttaatttccaataaattttaatttcttccatatataataaaaatgaagagagaatgcgccaaagtgagagaaattacaaagaaaaaaagaaacggcgagatagtgtgcaggcttttctctgcacagagaggaccaatagttatctgaaagacataatagtattttctctttccttagacagtgagagggaaaacatagaaatagtaaagaaaatacacattgcagagaaaaagagtgtccgtctgatggatggcagacatacataacacataaatttagctgcttacatattttctctggcctgtttaaaaataggtaatgtttaggtattcattttcatcaattgacccttacggctttttgtccatttagtagcatggctcgcgaaaaacactacacattacttttttggaagggaacgcgatttccaaggtttttcgagggttaaaaa

SEQ ID NO: 21113 - DNA, 1229 bp, Heterodera glycines
cgaagacaaccatcagctttgaaatgggagttggggtccatgggcgacaattggatggacatgcactgaaatgggtaggcgggattagggatatggaagagataaagggggggggggtgaggaaaactcattgaattttgttaccatttttacaattaccgtaccctcgggggacggggacaaaaaaaggggaaaaggaaggaaaaagacaaagaaaagccggagacgaaataaaggtaaaatgcactcactcgggaagtgatattctggcaaacattgcatttggccgaagggaccaacgtcgttttggccaagtcgtgggacataaattggccaaattgcatcagaagggcgttgaactcggagacggtcacttgctaaaagcgatttgacagaaaaaattggaatatccgaaaagagcaaaatgcctttgtggtggacagaatgttcaggttaatctcacgcggatttggcctcagtgtgctgcgaatagaggctaaattgtggatgtttaattcgaaatagtttttttttgtgttatttacaaattggctccgataatccgttgtcatattcgggcgggagcagcctaaacaattgctaattaaatgattagggcaattaaacagagtcatttaataaataaatgaaaattaaattgttattaaggccctaagtccaaatactaaaagcattaccgactgtagggacggaaagcggcgccacggagaggcaaacggaaattgttgcacgttccgtccattgtgcggaaatggaggttatagcagagggaactgagaaatgaggagagggaaggggtgattagaggatgacacaaagacaattaattaattattctaattagttggataattacaatatttattgtcccccaccgttcacattccgcttcgtccagtcgcggcacacacgcattggcaatgttcgagcggaccacctgttcctgagagagcggacgacgtcccgaattgtctgaacatcagaaagagcaattagtgaccggcaatcattcatttgatggtctttggccaaatgatcagtgatcatttggaaaattcccggggaattggccaattctttcttcttcagctgaaaatattcaccttccgttgccgagactaagcgttcccggattaacacttcagccgcgttcgatgggtcggcttggatttgtttgcagcgttgaagaggcgagcgactgagcacag

SEQ ID NO: 21114 - DNA, 1643 bp, Heterodera glycines
  misc_feature (1616)..(1616): n is a, c, g, or t
acacaaacagcgggaaaaatgacgcttttgtaatcgttggcaaaagcgatgttcgtcggcaccttcttccttttttggcactttcttccctttcccttttctcttttgtgccgtcgccgtccgctttttctgtccttttcaacataataaaagtgccagggcaatttgagaaggaaattaattaaaaagaaaaattaaaaaatgagagaaattaagaaaaactgtaaagaaatgataaatgttttaataataataattggtaaaatgacggaattggcggtggaggcgagtaaaaacgacgcgtaaacatcaaaaacgatgctttaaacatttcgtttgaaaaaaatattggccagaaagccctcagggaccgaccaatttccgagggggggggcaagcaaaaggcatttccgacaaaaaatttgaggaggtaaaaaagggcaatcaatttgcgaaggttgtggcagtttaggggcataattactgcgcgaggaatcggcgcgagaagaaaactttcgggggggggggggggggtaaagcgccgaaagacacgacactccttcccgaacgaagaagaagtccgacccaactttaaacttgacgaattaattgaccgaccccggaaaatgctgcgcgttgaaccggttgaagaagagacgggggagggagaggagggacactggggaaacattggacataatttgaggaatttggcgaaaagtgcaaaaaatatctaacaaattatacaaaaaagggggaaatttggggagggggggagcgaagttgaaattaacagccatgagaataagcaaaggcataatcgatgtttaatgacgtgctaacacaataaggaacgaagtgcaatttgcagacagaaagagaatgagcgatgatcaattggaacagaaggagaggggagaacattgatggcctaatcagaggtcatttaggggggggggggagaccagtttagagagaaaagcaacgccccgggggggcaacacctcctccccctccgacgccgccgccgtcgccgaattcggctgctgatcagtcagtgcccccgtccccgccccttgtcaacactttttgcagcgatcaccccattatccccctccccattccattaatcgggggttcatatcactgctgaactgtggacggtggggcggcggtgacgaagttggaaccaccggcaccagcatttattatttttattgttcaacccaacaccgaaggcctcacaaaattaataaattctcaatcaaaaattatgttgactcaaaattcgctcaatttgtcaacgaagtgtaaaagtgacgtcatttgcctaatttaacagcaaaaaaacaaaaaaaaactgctaggaggagaacgaactgctagccaaggcaagaacgaccagagaaagagcgaattagaacttcctaacaaattacaaaacatccctggaggggatggcagtttgctggtgctgaaaccacacggcaacactgcttacccaacaattcaccccataaggacctccccccgtccgattgggccaaaaatcggagaagtgcccttgtccccctccccccgcctcccctcccgtccattgctttggcccctcagantaaaacacaaatttcacatttgttcct

SEQ ID NO: 21115 - DNA, 2449 bp, Heterodera glycines
  misc_feature (2447)..(2447): n is a, c, g, or t
aatttgtgttatttcccagcaatttgtttaatttaatggaaaactttaaaataattagcgaaaagcacaaaaaatgtttttatccattaaataaatttaatttcaatttaataattgcctcattaattattgagagtacaataatttgttttgttttcaagaattcaaaaaatgctaagaattggtttgcattgaaaagggcaaattcggcggggcatggaaatgcttaataattcgttgtacttgaagctgttcggtgggcaaatatttgatcaaaaaaggtgggctgaaaagcacgcgaacggagtgatgagtttgaagcggtcatcagaaaagtgcaagaacaattcactgaaatgcttaacacaccgtttcaaaaaacgagatgtgtaccaataaatagagagtgccagagaaaaacattatctttttttctctaattttttgtctccttttggcgtactatctaatatttttattattaggaaaaacaacattcacttcgtgatgtttaactttttttctgcatgttaaatccacaccaaattttgcaaatcgatagagaaaaaaattacgaacataattggagggtttttatgaataaaagtgggttaactaaaaagttatgccgattttagcgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttggacatttcgtgggtttttactcttttggacatttcgtggcttggacactttgtgggggtgccgattttagtggtaaaacttttggatggacgaggaaatgttggaatttggcgattcgctgccgtcgacatcagcgacgccaatcggcgatttggtgccgttcccgtcgacacccactgcaccaatggacactggagagatgacaccgccaccagtggccatcgacgagcgatcaccgcgcatcgaacagctggaaaagcaactgaaggaccgggatgacaccattcaatttctgcgcgagcaggtccgaaaccgagaagcgctgatcagtgatctacgtcgtgtgcggcaccatcaacggcgacaccaacaccagcaaaagtgagtgaaatttcgatgccttctcttttcccaattaattttctcaaaaattgatcattcattttttgtcaattttagcaacgccaaacagaggaagaccaaggaaggccatcgacgagctccaacgcagctcgcgaaaacggttgacggagcagattttggatgccattgatcgggaccgatcgagatcggcaagtcggtgttcactggagcgcatccaccgagaagtccggcacaaatacggccattatacaccaaaaaaggcaccagcgaagaagggcaaagatgaaatggaggccaatgacggcttgcttttgatgacccaacttggcacacagaaagcttatcagcggatgaaagcaacccttcgtctgatccacaaaaaattcgacattttaccgccattaaaaaaggtgcatttgggttgatcagaaagtgcaatttggtgttttggttggtcaccctcaaacgacggatttgcctacgagcaaattgaaaccaatggaggtgttggctttgtgtgtgttgacgtcagatctgcgcttgagtcccgattttgtgcggccaaagacaatatgatcagctttggcaacaatatttttgtgaaaattagcggagactacggtcaaagcttcaccaaattactgtctcatttttccaagctgtgcggtcaaattcgccgtcaaacaattttattgttgctgtttttccggccaaagacagcagagaaaatttggagcggtatggagaggcactttgggggcaaattgagcaaattgatgcgttggcggggaaaacagtgaaatggtagacggaaaggctaaactattaccattttcaatttaaaggttcattggtggcgacatcagctttatttggtcattgattggtcactgcggttcagccgttacaacttttccgtccccaatttgcacgtgccggactgatcagatgcttcaggagcaaagctgccaacacaggtctattgatcagacaattaagcttgcggaacaatggaggacgacgttgcaaaatggcgataaggcgactgctgctgttcgatcggcatcaatgggcatcacaaagccgcctctgcttcgttcaattaactttgatcggatcatccctgccccttttcacgtctttaaaggcattggaaatgccattgttcgagaacttgagaggcaggagggatgtgcaaaggttgctcaaccagttcttcagcaaggatcggggcccgaangg

SEQ ID NO: 21116 - DNA, 1450 bp, Heterodera glycines
accgtggggaagcagcgcggattagcgaattgctcccccctattgcgcattggatcagatcacattctgattttgctgggcatcgtctcgttgtgttgaaaggggcattattcccccaccagcatttgccatggcaatgatagccatgtatcagctcttccgccggtagctcgtagttcacatccgtcgacttgggcacggtcgcccaacatccctcggcgcagcaaatctcgagcttgtttaattcccgcccactcacgattgtgaccccacgttttgcacattccatggtacatggcatttttgggccttcttgaaatggcaggttcgggtccattcccgatgatcgcattgacggctggcagccgaacgttccgacaatgctgatgagcatgatcagcagcgccattcccgttttgggcttaattaagcctcgctttcgtgaaacatgacgctccggggaccaaatctcccggtttctccgagtcctggccgacttcctttgttcagctccaggtactgcttgaacttctcggacgtcttttccgtcgtgtacttcctccacgggcttgttgggagtttgttcgagttcattttggtgctgttcgaccgctggtgcttcgggaaattcgcccccgatttcgcccgcctgaactgcttgaggtccgtctgcgccaaacctatctcctccttcagatctcgtcgaattcggctgaaacttggtaggaaccttgaggagacttggggccatcgaactatctcccaaatattttttctcatgtctctgagccgaatgcgggtgtgccaaagttcccgcttttccttgtgctgccgacggcacttctgctgctttttcggaaactgccgacttcagcggcgccgtgtcgccgccattttctccgtccgaatcgttgggggccttttctcgagaactgtcttccctgatttctcgatttactcttccgtcgggatgtacagcttcaacttctcgtcctcgcttttcggcactttcttcgcctttacttccttcattttctccgtcctttcttgctgccgagggtgtgttctgctccctcgcttcgctctgagtctcgactgtttgtacttcatgtcgtacatgtactgcttgatcggcttgatcatccatttcggccatttttggcggcgcttcttccaacgggcaaattttgttgattggccgtccccaaacccttccgttggccattttgatcatcacacttcggatgtgctcgttcgaccctttgatctcgacaatccgtccgatgggccataaattccttggatggaatttgtcctcgattagcacaacgtcgccgatctgcggagcgccgtgagcattcactcgtcgcgctgggtgcgcccagcctgctttatctctcaacaccaacaaatactctcgatgccatcgtttccaaaaatgctcgagccg

SEQ ID NO: 21117 - DNA, 2604 bp, Heterodera glycines
  misc_feature (2594)..(2594): n is a, c, g, or t
gcttgggttggttttcctgggttggtttggccttgcgatacattccgtcgctttctctgtccctcccctgtcatcgatcataatatcactaattatcttgacattaaagatgtgtcgaaaactctctcagcacggcccttcaaatcgtcgacttcccaacttttgccgtttttcggcgtggcgagcgtttccccgttttcgttgccgagtgattccctctttttctgtcactttccttttctttattttctttttttttatctttcggctccgtcgtgtgctgtttaacgagttcgagcagtttcttcgcaatgaaagcacaaatgcgccggtcgcagcacttccgcgcactttttcgcgtagaaagggaaacggcggaggagcggcgcaacggacggaaagtttttgcgagacgaaccccgaagagtgagcaattggtgtcccagtaggagcggggccaagcggggtacgtactgcaaaggtgtgaccgcaaatattgccatttggtccctccctgtggtacgtaccccttcctaatgccaatgggagggaaaaggaggaattaaccaattcatgtttaggtgcaagaagttatattttacatccgagttggacatgctgaaaagcgtgcgaatgggtgagctcagaaatgaatgaatgggtggtgggaaatgtttaaatatgtttataccgttcaattgaaccatttatcgcttttcaaaatttatagccctcttcaacgacctccaaatcgtcgaaggctctcatctcagcggttccaatcttagcgcccttttcaattttgtggatttattggccaaagtcaaacaaatgaccaattagcaaatgctaattaatgttttcttttctttagcattttccgtacagcacagaagaaggagaagaagcggacggaaatcgcactgaggtgaaagaaacgaatttggaggcgaatgccaacaatcgcttcagcgttttctgaacgcaagtggacgcgcccgcgttgtgttcagtcatttgagggattttgttgagagtgtcggattagacggatcggtcgctttggacgattggaaaagggaatttctgcgagcagaagtgagcaaagggaagagggattaatcgcaatcagcttaattaccaccgatcattccaatgagtgaaggccgatcaaggaagcccttttcccgtgacggaggaatgggaacactgcaaagggtgagaacgaaatggcaaggcaatggggggaggggcactatttgaacagtgatcagtttggtcggaaggtgatccttctgatcatcgcgatcggggagtggtccctctgatcactctgctccgagcgtttttctttcccatcaattttgagtttctgtccaatttttctgggccctccccccccctctcccctttgaaatgtgcgaccgttttgcagaagttcgcccattctccgcggcttcacctgcggcctttggatggttttccattcgctgacagtcaatgcttttcggcagaacagtaaatgatgaatgtgtgaagtgattgtgcattctctgtgctttcgcaggtgatcagcagaagcagttccatccggtcgccgttcttctcaccatcaaagattgggtgacgcatttcttcgcttgtgaacactgccgcgcccatttccatcggatgaccacaaaaacggccaaaattgaggcggcggtcagtcgttttcccaaaattcctctaacttttctttgctaaggttcgccaaaaggaggacgtctttctgtatttgtggaaggcgcacaatttggtcaatggtcggctgaggggccgcgagacggaggaccccaaattccccaaataccaattcccgccaaagttcctttgccccgagtgccgcaggggcgacaaattcgacgagggaaaagtgcgcgaatttctgctgaaatattacggccgagtgagaccaattgatggagagcagcgaacgacggagaacggtcgcggaaacggggaacacggcggaggaggggaggaaaaggaagaagaagcggataagcagcagcgaaacgaacggatgccaaaagtgatcgggggaacggcggaggaagaaaagtgatcaaaggtaaaagcagaggagaaaagtgatcagagaggaaaaacggaggagaaaagtgattggaggaacggaggaggaagaaaagtgatcaaaagaaaagcggaggagaaaagtgatcaaaggaaaagcggaggaaaaaagtgatcaaaggaaaagcggaggaaaaaagtgatcagataggaaaaacggaggagaaaagtgatcagagggaaaaaatgtgatctgaggaaaagcggaaaagaaaaagaaaaatgattagaggaacgatggaggaagaaaagtgatcaaaggaaaagcggaggagaaaagtgatcagataggaaaaacggaggagaaaagtgatcagagggaaaaaatgtgatctgaggaaaagcggaaaagaaaaagaaaaatgatagaggaacgatggaggaagaaaagtgatcaaaggaaaagcggagaagaagaaagatagcaacacatttgatttcatttgcactttcaccanaagcatcgtt

SEQ ID NO: 21118 - DNA, 1641 bp, Heterodera glycines
ttttccaatcagttttttatactgttataggtcgtatccaactgagaatcttttgaatagggtttttgggtgcgctgaccccgaattagatgccgccgttgttataggagcccaaataattttttaggaattttgttgtacctgtttcgaggtaggctttaaaatgaggctttttccaaattagctctagagactgtaaccagacggaagcagggcccagccgttcgtccagttgactttttacagaaggttggggtggtatttttaccaatcagttttttatcctgtttcgaggtaggctttaaaatgaggcttttgccaaattagctctcgagactgtagccagacggaagcagggcccagccgttcgtccagttgattttttatagaagtttggggtggtatttttaccaatcagttttttatactgttattgatcgtatccaactgagaatctgctgaatggggtttttggctgcgctgaacccgaatttgatgccgccgttgttataggagcccaaataattttttaggaattttattgtacctgtttcgaggtaggctttaaaatgaggcttttgccaaattagctctcgagactgtagccagacggaccagggcccagccgttcgtccagttgactttttacagaagtttggggtggtatttttaccaatcagttttgtatcctgtttcgaggtaggctttaaaatgaggcttttgccaaattagctctcgagactgtagccagacggaagcagggcccagccgttcgtccagttgattttttatagaagtttggggtggtattattaccaatcagttttttatactgttattgatcgtatccaactgagaatctgctgaatggggtttttggctgcgctgaacccgaatttgatgccgccgttgttataggagcccaaataattttttaggaattttattgtacctgtttcgaggtaggctttaaaatgaggcttttgccaaattagctctcgagactgtagccagacggaagcagggcccagccgttcgtccagttgattttttatagaagtttggggtggtatttttaccaatcagttttttatactgttattgatcgtatccaactgagaatctgctgaatggggtttttggctgcgctgaacccgaatttgatgccgccgttgttataggagcccaaataattttttaggaattttattgtacctgtttcgaggtaggctttaaaatgaggcttttgccaaattagctctcgagactgtagccagacggaagcagggcccagccgttcgtccagttgactttttacagaagtttagggtggtatttttaccaatcagttttttatcctgtttcgaggtaggctttaaaatgaggcttttgccaaattagctctcgagactgtagccagacagaagcagggcccagccgttcgtccagttgactttttacagaagtttggggtggtatttttaccaatcagttttttatcctgtttcgaggtaggctttaaaatcaggcttttgccaaattagctctcgagactgtagccaaagggaagcagagcccagccgttcgtccagtgctctttaaaggaatttgggtggtatttttagcaatcaattttttata

SEQ ID NO: 21119 - DNA, 2738 bp, Heterodera glycines
cagaagtccatgagtgcctaattgcttcgaaattaggttgatccattaattacccctttttcctctatcggatggtccattttttgaaaaatttagattttcaagtaaatttccagaaaacagaaataaaatccttttttccgaaaaaatttccagtttcgccttaagcgcctgatcacttattcattctaacactcagagatcacttatcaaatcagttgtcactctaaacaattagcatcggctttaatcacttagaagcagcccaattaggggcttttaacttagtcctccttacgtcgatcgtttggcagacgtcctctgatcagtgccacttggtttcgacgggcgccgatgttaacctcaagtttaaaaaaattattttttttgtcctaattagtgatcagtaaccaactacgaagcttttctaatccatcttttctgatcacttccaaatttattcgattatttttgcctgatcagtgatcactacttgattcaattttttaaatccatcttttttatcaatatcctttttaaatttgattgcttttttccaataatttaaatgcttttttcatttaccccttactaattcgtttgatcactttttttgtcactcctatcattttactcaactgatcacttccaaatccgatcaatctttgattgccatttttgaccttacctctccagcctgggaggcgaagccgtagtcgcccgattgttttggcaaaatgccttcgccctccttgtccaaaatggtctcccattcctttttgtattccaccaggggcacctaattaaatttaaatttttttgcgatttttttaaaattttctcctcgacttggtttcggtttgctccaatcgcggtttgcccggcttgtgatgcgtaaagatttgtgccgcattgaggccggagaacttcctaaattttcagggaaacaaaaaagtttttttaaacgaaatttctgaaaattccgacctcgccctttcggtccggttcaataaatctgaaaatttgaaggtataattatgggctatgcttataacgcgtggaatagaattcctttacgatcatatttatacattttgaaatcattttctcatgctttaaattctgattagttatcgaactattccttttctgatcagttaattgtctgatcagaagctattccgatcactcaacatcagacggaagatctgctgatcggaacccaaatttaggaaatgtcatttacacatttgttaccgtaaacgctattctaatcactatttttttcaaaaactgtttccgatatttaatcctgatcatatcaatcacttccttcatcggcacagggcatactgtactaatcacataaagccagcgtcaacgtacccaagtttcttgtccctggtgatgttccatcttggcatcccgcaggctaaacaatttgtgccgatcaggcttttctgatcaatcgataatccctctttttcgactcaccggtcatgcccctctgtgactcgaatttgttggtgcccgcctgcatggtcaaaaaggtgtcgcccgccttcagcttttcgaagttccatcgcttgcgcaccggcttcgagtcatcgtcgtagccgttctgaaaaaaatggttgctgaaatcagataccgtatacgcaagcaagaccgtatactttcgggtaacttttgatcacccatcaacatcattcaatgattgatatcaatcattacatcataccgtttttgcttctgctcgtctattaagacaatagggaaatttaatcgtctttacaataatcattagtgcaatggtgtcacaattgatcataaatgaactgatcgcttgcccaatgaattatcgtaatcagtgttacgatcagataattgaactcatgctcatcgcttatcactgatcgctgataaatcaccaaaatttaaaattccgactgacctcttcacccatagtgattgttgttcagtgcttgctgcttggctgatcggaaaaagatctgatcaatgaatgaaaacggcacgcacgaactttgcccaaatgttgctgcaaaagaaatgccgaaattaattctaactgtttctatgtggttaaaacaacaacactgatcactcttcctggcacactcctggcttttccttccctcccccggcatttcctctcctggagagagataaaggaagataaagccggctgtcaggaacgggagacacacacatcacaaaaatgaatggatgtgaatgaatgtgtgtgggaggtggtggtactgctggtgggttagctgaagaggcttctcggctcggcttttcctccgccccctctcggctttaacaaattattcaaaagccaagccttcctcctctcctcatttttgtgtttgtttgcgcattgcttttgctgccagccgctttttcccgccccattcgccgatcagatccgatcgctcctttagtatgcctagtacaacacatccgctgacacaagagagagtgggagggcgagagacagagagagagagagtgagagagagagagatgagagaaagtgagagagagaaaggtatagaaagagagtaagataaagaacagaagagatatagcaaatccggcgatgaacaccaaagtggcagtaagggctaaagctcttgcttgctctctgcctgcttctttcttctttgctgctgttccctccattctgatcagtcagatcggcttttacttatatc

SEQ ID NO: 21120 - DNA, 2612 bp, Heterodera glycines
tttatcaaatccaaggaaaaaaatgatttgaatcacatccacaatcaatcgccaaaagaaaccattttgggatcgggaaaataatcccagatcacttccaattttaatccgctttgtatgggcatttcttcacgcattttcccgactttttgttgcgaaataatcccggcaaacattcgcaagagcaattgcatttctttttcgtacatatctttgggttcggattgtcgcaactcggctcacatccgttgcatttcttttggccatagtgctcaattattgagcatggaagcttaaagttaaaaatgttttattatttttcatttttaaaataacataataattaattatttgtaaattcactttgcactttggcttatatgatgctgtaagaattggcacaatcagaagggaaaacaggcaaagaattttgaacattttataaaattaaattaatttttatttgctaaatgaaataacgcaaaaattgtaaaatgaaaaaaaataaacataaaaatgtcataataagataaaaaaaactttcaaaatttagccagaaaattaactgaatataaaaaaaataaaaatcttaattttaattttaattgctttttttatttttaactattgaaaaattttcatttataacaacaatacgtcttactaactttggtatatataataggacatattaaatttaattctatccaaacaacagaaaaacttttctcttactaattgcaagtataatcgatttaaattaattgattttgcatttgttaaacgaaaggaaaattatttttttgttatggataagcattattcaaataagggcttaaataataattttttttatttacacaaggattgatgaatgattcttattatttaggaactaaaatttgattactatttttgggccaaattaatttttgaatttgaatttgtatatttatttaacgatgagaaaattaaaattttttataaaactataattggaatgtgggcgaaagaatactttttgggaaatatgtgtaaacaaatggaccattaatgaaattaaattcgaaatagcatttcaaaattcattaattgtttatttgcgtgcacagttttgctttagggctaacaaaatactttgcttttttcgggtgttaaactgcgtgtaaaacatcattttaagtcatttttgtagcaataacaaattgtcaacgagtaaaaacaaaagtctcacccgtcagtttttgctaggaaaaatagattttagcaatattttaaataaaaaattttccttttttaataattataattttttaaaaattttttagactttttttttcaaatttttaaattgatttattgttttttttaacaaatatagcaaataatatttatacattggttctatgggtacttttccattaggctgccgcaccccaaaatgtagaaaaagggaagaaatgcgccagttttggcgccggcgggattatttagaaggaggcataaaagccgcaatttgaagtaaaatgtcatcgaatgtatcagcaccgcgccgtttgcagtcttcgcgccaaaggaattcgcataagcatgagtcaagcattttggggtgagcagtacgggaccaggaattttggccaaaaccgggacctgccgggacctgagaagccgggaccgggacctcggtttttgtccgggaccgggaccaaccggggaattttaaaaattcaaaaaaattcaaaaaattcaaatttttagtttatttcaaatgaaaaaattaaataattaattttttgtttttttttttataaaacccaaaagttaacgtaaaattaaactataatatatttaatcagtgtttcaaacaaaatttatttaaattattggcaaaccgggaccgggattttttttcaaaatccgggaccgggacatcggaggactgggaattcccgccccggtcccgacccaccctaatttattgtaaattgactaagttttatttaaaaaactttgatcaattttatggaaaatattttaataaaaagacttttttattcttaaattttgtaacttagtaaagacaaacaaacttacaactagttggccgtagaaacaacagtaaggaaagctttaaaggcataaattaaattaaaaatttcacttctcaaatttaaaattttcacgtctcaaattttaaatgacaatttccaacaatattatttgacaattatccattagcatatttacttaagcataaaactaattaatctggataataattgcaaaaaccttgaaatgttcgtcttttttttatcacattttgcaaagtcttcgtgttctccaattcacaaacatttcacctcaccgtcagtgttcttctcaatccaatcacagtaacgcgatactcgcgtgtacagtactgtatattaagatggatatggtaattagtacatttggacatttgaaaaaaccatgggactgggctggatttcttgtaaaaaaaatcagataatccaggtctaggaaaatttccaaagcccgttctcgggaggcctttaaaaagcgtgaccttaactatcgggcctttggtcggttttctgctttgtgatggc

SEQ ID NO: 21121 - DNA, 1027 bp, Heterodera glycines
cgcacggagcaaattgcccagctcaaaattggcgcaccaacgtcggacgcttcctgaagcagagaagagcctaaagcacgaaaagcgacaattgcccaaaagggacggaagaaatggcaccgttttgccgcgcaattccaacgtccgccaaacggagggccggcgcatctctcaacggatcgtcgccaacgaaagtgacggaatgcccgatcagttgcaattccttaaagggcggaattacggaagttgcgcaaagggcaaatgcctttataagggaaagtgtttgggacggagagagccgagggaaaagcgaaaagcgcggggcaccgaccaaaggcaaatggacgagcgcactttggacgaagtcacaatcagcagactctgagcttgttttgcttctattttcaacattttcttatttttaccccttttgtcttctcccattttcgtcgtattttcaatgtctccgcgttcggaggaatgataaccggaagaagaactgaacgaattgtttttgcgaatgcctttcgtcccaaaaatggtgccacggctgtcgaattgtaattccaatggcatctgagaaagaagggaaatgaaaagcggccgtggaaatggcattcgttgtgtcctcattgcctgaatggcactgattttgacgccctcgtcgccctttggccccacaactccgagctgttcggccattgcttcagcaacaattgggtgttcgtctgtgagcagcacaaactgaacaccgcctgcggtgagttcggccaattgggcagagcaattggcaccgatatgattggccaatgccaccatgcctagggcaatttgatggcattgaacttggccaaaacatacccaaaaaggaccatccgttcgaatttgagccgatggacgacgaccgttccgaaaacgactcacaatgaaaggccggcagaaagtcaaagtcatcgtcgagaatatccaaaatggcaaagccaacacaactcttggcctgagaagacagtgccaaaaaagcatccta

SEQ ID NO: 21122 - DNA, 1201 bp, Heterodera glycines
gatcgatcggtcgccgtttactttcgccagtgccctttccgtgggatgtccttccgttgcgcattctgcgtctttcctctcggcattgttcgtttccggctctctttatgctcagttcgatcgttcgtaacatttcgtcctccgccctttcgcttggcgttttgccatcgcccgccatttttgccgcgtttatcgttttgttttgagcagccaaccaaagatcagacaccgtcggacaatttgagcacaaaacgaagggcgaatggacctttgttttgtgacttggcaaagcagcgaatttggtggacagaccattaatagggaagtgcgcccgagggcatccgcaacccccgcctggcgcaggagcattccgccgcacttttgacgcagccgacgcgcgaccagcaaaagttgggcacccaaagtgagcggaagtgctgcaacacaacatattttaattatggcctcctaatgagtccgggccaaaacggcggagccgaaaaaggcaccgatgaaaaagtgaaatgaattggcaaatgtttaccctgaggcacggaggcaattaggaaaaggaggaaaacgtggacgaaagagtgaaaaggacgagcaaagtcagtgagcagcagagaaaggagcaaagcaccggtggaaaggccgagggaaagccaaacgacggcacggacgagggaacggtaacttcgccggagggcactctcgtgccgttgcctttggcattcgctgccgtcggttggtctctcgagcgaatgacaacgggggaaaaagcttttcagggagaggagccgcgaatagagctgaaaaaagagaaaaccaactaacaaaagcgaccaataaactacgtactgactttggacctaccgtattttttcccgttcggatgacgagtccgaggcactccccacttgtgcatgcgaactgggcgaaaagaatgttgcgcaccgtgaacaggtcggcgtgctgcggtgccgcgtgggcggtgaaccgcgtcggttcggcgttccccgtcagccaaacggtcgaagcacgaaaatcattgtgcaaccactgaatgaagtgccaaaatggtctttttgatgtaagaaagccgaaatcacaaaagaccaaaattcgaagccagccagagccgtgaagaggccgagtgagtacattcggtgcaggaaaagtatgtcattttaagactttt

SEQ ID NO: 21123 - DNA, 1316 bp, Heterodera glycines
  misc_feature (1216)..(1216): n is a, c, g, or t
tttcatttgattttattttaaattttttactgcatcgcaatccgaataccgctttcaatgtagttattcgaatgacttcggccatctggaaaatctggtccctctgtgatccgaagccctcataaattgtacgtaagagacagctaaacagagcactacttaatttataatcttattcatttaaatttacggcgctggaagagtgccacggaaaagctgttcgagccaaaaatgaaaatcagctagacgaaacgcgtcatcgagcatcgaattgtcgacaactaaacaaaatgttaaaatttataatttaataatcaaattagcaacaaaaattgtttgttagataaaaaaaggaattatacatacaatcatttattttcataacccaaaaattatggttccaattgcaaaaaaaaatggggagggggcaccatcggcgacagtatgaaggcaaatccaaggcccgaatccgaaaaccttggtccaattcgctgttccttcctttgtgaaggtattgaattgcgcaccccatccaaccttaaacatatcgtcgagttcgttctcattgatgaccgtcgcctggccatgtttgccaattgcattccgaattcgcatgcccaagtcggcggacaccattgaccggatgggcccaggggccgggcgggcttttaccgggccgcccaggcccggcgaattgtctaagcccttcggtttctcgtgcataactatcaatataattagggtgaatggtgtttctccagttaccgtatattaaagggtattcgttgtgaactttttttgaaaatattgatcagcctgtacgagaaggggggagagagagagtttggtggcagagagagaaagaaagtgagagagagaaagggtgaatgtgagagggagagtgagaaaaaatgagagagagagagaaagaaagaataattttgaacagtcgattttatagtattttatcttggaaaaatcaagcagtagaactactataatggagaaccaagaaaagccaaaaaaaaattttttcttgaatgaaaatgggtgctcattggaaagaatggaaggagtaattatggagtagaaaatgtgcgttttttcggttttaaaattttccattttcccaacactgccgctggttgacagatcactccctaacaatagcaaataaatgtttatttttcggtcataattatgctttttttgttcnaatatttacttcggcatttttcataaataaaattctgatcactggagatcaatcgcatcattcatcgcctctcatcagttctttcaaattctattcattc

SEQ ID NO: 21124 - DNA, 1390 bp, Heterodera glycines
ctttgttcactgtcaatcaaattaagaattgttggtgttgttcgatagctctatgtgtttattattaatttgcaaaatctcaaaaattttcgttaagtttcaaaaaagttatggccagaaggaactcaaaaacccagtaattcgaactttttttgctctgatttttttgtgcataaataaaaatttttgaaaatttgcaggctaatagcatttttcgaatgctttcgaataataccaagaatgtttaatttggttgagaaagaaaaaagttatggtcgaaaaattcgttcgacgacgtttcggctgacgacgttttgtcctactccgatcctctccagctcccctctgttcggatcatataggatcaattgtcgcctcaattgatacattaatctttatctctgggaagcttcttattctctatctcaaactcacggcagtcttgaaaatttaataattttttaattccaagttagtcctcatattcggagaacatctgattgaggaaactttataaatatttttaaggaatttttgatttttttttagtattttaacaccaatttataccatcattaattttaaactgttatcccttcttttctttcctttttaattattttttagctccaacggactgttcatatgcccgttcgtgttgcctttctggacaactttttcggaaacaacacatttttattcgccaatttcatcaaagagaatcgtggcgcacgaaatcgcatcaaaaaaatgtttggcccaaattttgaacatttctcaaaactggtcaaaaaacatcggacggaactcattgacccgcaaagtttgtggcaaagaaacaaatttgtttactatttaggaaaatatttttatctttacagtgtttcacatcgataagcttttgccattgtatttggatgcactttttggcgttgacattggcattttggttgttggcaaattgtccgttttcatcgccgttttggtccgttggatggacacggaacttttgtcgaaccattcgaacatgacggtcgggttacgacaagtcggcaacatggtttggaagctcagaacgaggccatattttgaggtgagccgacggaaaaaagtgatcggagataaaatgaccaaaaattaaatcgtttaaacattttattggtattttgaacataattgactttctctgttgctgatcaggacatgttcgacgagctgatcgatgacgattttgacgaattagagcgcaagagttacctgctgaaggagctgatcaaagggctgcttcaatttgttgaccaaaagcgtcacgagcgcgaccttggcaagttggacatgcgcagggccagcaaaccggacacccgaaagagaacatttgatgatcaaaatt

SEQ ID NO: 21125 - DNA, 1386 bp, Heterodera glycines
  misc_feature (24)..(24): n is a, c, g, or t
  misc_feature (266)..(266): n is a, c, g, or t
caaatggaggccgaagcattgccnagggcggcggagaggcgaaaaggagcggagacggaggaggagcaggaggagcagcagctgatcagctggctgcaccatgcccagtgggacaccatagccgaacttctggagaacgagtgggtccgcgaacagctcaaaatcggtgagtcagtcacaaaatcatgaaaagaaaaattcagtcccgactcgatgattcataccaaacagacagtatttcggggaggggggggggggggtaaggngcatgtgccctttccggaattcgaaaattttttaattgaaaaaaaatttaaaattttgcgggcttaatgggcatacgccgaagtttattcgggcaatttttcaactcattcttttgaaagctccaaaccttgtttaaaaaaatctgaatagcaatttctttaatcgaattattagaataattagtgaatataaataattaattttgtcggcataggtttcatttcgaatgacgaagcgaaagagcgactgacatatttggttagttttgaaatggccaacgaaatagtggcatttttaaatttggcaacagaaaaagaaaaaaaagaaaaaataaaagagatgaaaaagaaatatgaaaaaactaaagaggaaaaagagaaaaaagaagaaaaggagcaaagtgagcaaaaaaaattggcagataaaaacatgagagaaatgatcagagaagaagagaaaatgaaagagttaaaggtgagaagggaacaaatgcagagagaaaagcagaaaaagaaggcagaggaaagagagagagaaagggaaaggagagaaaaagaaacgagcgcaaaaatgaaaagagaggaaagtgaagagaaaagtagtcgggatagagaagaaaaagaaatgaaagagaccaaagaagaaaaagagggaaaagaaaagggagcagcaaagagaaaagaaaagggaaagaaaaaggggaaaacgcagacagaagagagagaagagagcgaaagaggaaaaatggagagagaaaaagaagcggaggaaaagagtttggagagtgaaatggcacaagtccaattagacggtaaaagaaatgtttaaaaaattcggactctgtcagttgggctccacgtttggccccaggaagttttttcactataacttttttatcgaaaaatcatagtatcaatagaaagctctttatatgtgctctatttggcttaaaaaagcaaaaagattttcaagcctggaaaaaattttattaagaaaaaacttcaaaatttcgattattcacaacatgtataacttttttggtaattgtctaatcgagaagcaatggcttagaaaaagtttctaaatctgttaatctttcgaatgatacctaagattgtt

SEQ ID NO: 21126 - DNA, 861 bp, Heterodera glycines
ataaattattgcataatacgtaaatgaaatgccgaacttttttggtcgaaaaatgcctcgggcacattcgagaaaattggaattaattaccataacccaagaaggagttgggcgagaaatgagtaataaatgtgtcaaaaaaatggctgagaaatgagtaataaatttgccatgaatttttaattgggggatataagcaatttgaataaatgattgggaccgaagtaattcgagaacgcctcgggggataaatttcttcaaattggcatagcgaaaattttggtcgagaatggcaaggtgaaatttcaaaaatggtggaataaatgaattagtgtaccgagaaattgccgggagttttttggtcagatgagtcattatctcataataattaggcaaaaagattggccgggcaagtcgagaacgccccccggggggttaattaaaatttgacttaaatggcacaatgaccacgaaggtgatccaaggaggggaaaacccaaggacgtggtgaaaaattggcattttgtcttacaattagcccacaatttctttggcactcaattttatggcattttcctccttaaaaatgccaattttgacatttttaatctcaataatccattggagagatggacaatgaaaattgactggatgagtgaaatgtcaattaaatttggttattaccttttcgaaaatgccaaaaatgtcaattgttggcaaagttattttctcgagttagctaagtttcctaaggtctaatcttcattgagtcgagactgttggtccattctcgagatggaggaattccggaaaaaagattggttatggtgatatgagaatcttgggaaagcacccatcata

SEQ ID NO: 21127 - DNA, 1069 bp, Heterodera glycines
atggagggaagagacggaagtaaaatttaaaaaaaaatcgtaaatgacggaatattaagcggcttaaattagacgatttaggaattattcttgaaaaatttaagttagaaaagtaagaaattttaagagatccgaaatttgaaattttttcagaaaaaaattccaaaaaaaatccaaaaatttacggcattaatgagagcttaaaatgttcaaatttgtgaattacctaattgccaaaatgcaacatgtgctatgccgaaagtaagaaaaacaccaattaaaatgtggcaaattaaggcaaagtgtccatttgtttggcatttaatttgcgcgttgaatgcaaaatgccaaagtgtacaaaaaaaaatgtaattggcaaagagcggagagaggataaagcaacaacaacaacaaaaatgtatgtgataacagtgccgaaatggtgcgcgcggcgtgccaaacaaaatgagagaaacatttaagtgccaaaagggggcggaaagactaagccacgacgaaagcatggggaaaagcggtggctggtggcggcgttcacacaagcgcacacaatgggaaatggcattttgccgccggaagagaaaaagcgtggaagagaatagtgtattgtgaatggcatttttggtgattaagagagaaaaagaggaaaaaatagtgtggagagcgagaaaggtgagagataatggagagaggagagagagaaagaggagagaaagagagagagaggagagagagagaggaagagagaagaaaaaagcggaagagagaaatgaatggaaaaaagaaaaaagggtgatagaaagatagaaatagtgaacagagatggagagggggggggggggataaaaaatgaactgagttagggaagtgcaacagggcagagagcacaattggcacgcaataaaatagcagcagcagcatcagacacataagtgttccctaatgatgatgatgatgatgatgatgataaactgctgctgatcagtgaactgaacactgatcagcatctattctcaacaacaatttccaccatctgtctgtctgattgtct

SEQ ID NO: 21128 - DNA, 2417 bp, Heterodera glycines
gtacaaattcgtcctgcccattacgtcgaagtttgagtccatactgaaaacattaattgtaaattatgctaattaaaatgataaattaacctgcttcgctccgccgctacaatactccacaatttcatgattggggtactcatcggggaactgtcccaagtgtggtccagtctgtagcggattcatgccgatcggatggacaaagatcagcgagtcggtgtctgtgtagagtagccgacatcctggcgttctcatcaccttctgcatcgctttcaacagcaaaaggcgggcctttgatgttgtccacagcgagattactgaaaattacaaatatttttaaaaaattctttaaaatctcaccaatattggagcactcgtgctcctccacccactccttttgcacatagctgatcagaatatggtccgcatccaactcgtcgatggaagtgacgtcaactgagcggttgtccaagtattccgccagcaccgaagggtcgtcggttatcagcgtctgggcaaggccaaagttgcgcaacgagaagcgcccccacaggttgttgagacacagcttttccaacgaccgcttgcccttgttgactttcatgttgttcttatcgattgaaatgccgaatttctctgcacactctgtgatgaactgctgctccaactctgtatttcccttaatgctggcgtcaaatccgctcgcttcaattttctgcgacatgaactcggcgatgtagggcctaaacagtttgtcgtcgccatgcttgtacttcaacagtcggaacactttggtcacacggtaaccctcctcaagcgcagcatccaattcaatggatgtacatgttgtgacccatccgcgttgttggtcgtcgtgttcacattggtagtcaaaattcacgcctccctttgggtagtcaagagcacactgcatacaaagcgggaagcatagccgctcgttgactttaaccggcaacactggcacatcgcacttgcgtggcgggatcacccacaccttgagcagagacaatttgtatgggttgtcgcgtacgcttgtccattccacattttcattcaagatgagcacttttgggtgttcaattgggtaagtggtggagaaactgaaacaaacaattagaaattgtgaataattgtataacaaaactcacttgacatacgggtagagggaagtaaaagcctccgaatccgcatttcatacattttatttcccttaaaattgaaaaattattcaaatttgaaaaatagtcaattattaccttgcgcaacatatccggattatatccgcgtttgaacagttcgcggaacaccaacaccatatcgaagcggccgccaaagtgagagaaggcataggtgtcgtaggccaaaggcaagtcgtttatcagccagctgacaaacgcttccaatgggctttccgccaccacttgcttgtcgactgttgtctcagtgaagtggcgctggcagaacgcaaccgtacgattgggtccacacacttcacaccctcccgatgcctctcgccagctctcattttcaatgcagtcggggcaggcgacccgtgctgcgatgaaattcggcaaatgctcacgcttttcgggcttttcagatggagtatgctgcatagtctccaagtcaaatgccacaatgcggtaggcgtcgctttccttgggctcaatgggttggatgtagcatccccgctcgatgttgtggtagttgttgcacatcttacagaagcgttcaccacaaacatgcccttttctgccattttgagtgttgttgacaacatcccaaacagcaccgcagtccttgcacttttttgaccttttgcagaagcctgactgtagatggtgctggtagcagccgttgtttgtgaattttttgttgcactctttacattttttgaagaagccggcggatgatggacatggaaaagctggtccaacacgtgagcacagcacacagcgcgccttacatgatttactgtgtgtcgacattcttcggtatggccgctcacactccaagcagtatggttgcagaccgccctgcttctgcacaccatcaaaatggtcctcattgaagtacaacagcagcggagtgtcgtaggtgttgtcaatgtatttgtagagcggcttgtactgtcccaacgagccaaagatgaacacagcaaagcggtgttgtcgctgcgcgttgttccagtagtcaacgacgtgaggcacgaaagtgtccgcgtcgtagccgtccaaatccattggtgcattgacctgtagcataagctgaactgcatcatgcttgagttgttcctgttgcccgtattggttgttcaagtaacgggaaaacttccatcggggccaattgcatgttttggcaaccattgttgcctgcaatgcgtagaacaggcagta

SEQ ID NO: 21129 - DNA, 1820 bp, Heterodera glycines
aggaggaataaatttattccgatcatcgtcatcatcatcaccactccaccggcggcagagcggcccattgtctcattgccttccccctcctctctcatcacacgccaaaaatttaaatgcggatgaaataggcaaattattctcaatcacacgtcaaacatttcggggggagggggaattaatgccgaatttgaatttgttatggcttttagaaatgatgcgcttataaacgtgcttggggttattgaaattttcattaattgtttaatccttaagaaaatttaaaaaatttattttttttaaattgaaaaaaataccaaatttcttattttattttttaaataaattaatcgaacttttcacaaattttattaacatgtcgccttttcaaatttgtttctttttattccttaaaattaagtaagttgaattaagaataaatttttgatatgattttaatttttatatttaaaattttttttttcaaaatttacttccattatttcatcctttttttcgtgttatattcgcgttggcacaccatattattacaacattataaattgtggcttttcacgacatccattggccccggcggtagcgagcggctcggcccgggcagcacacattagcctaattagtttttctcgttccttgccatccatcttcataacgtaaaaggtggaaaattttgggcatttcgcctttgaaaaatatttaaaaaagtaaaacaaaaaaaacaatgtttattattttcaaactagtaaatagaaaattttttgaagaaatgtagttttaggtagtttaagttttttaatgaaaaagttaagcaaaaatctaatcaaagaaaataaaaaataattttttgctatattttctgttaacttaaaaaatccttaagccatattgtattcctgtttctgtaatccaaaaattgttttttctagcccatttattctagtcctttctgtatttaattaattagcaaaacagaaaatcacattacataactttctttatctttgtttccttattagtaatttagcctattaaatttttatgtttgaaaattttagcttactgagagaagaagcttgctaaattgcaaaaaaaatgtgcattcattgatggggtggatcatccatcattcattcaccaaatgacatcacacacacacaaaggccacatcacaaacaatcctacgcccaccccctttcattttaacttttttttttcatttggtgattggcattcataataattattttttacataaaataattttagcaaatgtttcacgaaaaaaatctaagcaagaaaaaattggtcccatctgtgtataggtaggtatgtacatgcaatatttttttttaattaaattaatgagaaaataattttttcaattttttggtaaattaattaataaattttaacacataaaattctaaaatatttcatttcttttgtttccatagctttttccagaaaaaagaacttatccatctttgtcaatttctttcaaaatgccataaatagccttaataaaattttcttaatatatttttgggttaaaaataatttaattatttttttacccttttctaaccgttttattcaagttttttgccctttcccacaaaatacttcttcatcggcttttccgtccgtgttaattaagagcttttacaaccgttccctcccccctccgcttctgcccccccccgtcgttacacgttacggatcccaccgctgtgccgtcccgctctcacggcgtcgtccgaccgacgtcccggctccgtcgacggggtttttttcttcgg

SEQ ID NO: 21130 - DNA, 1373 bp, Heterodera glycines
taagggaaaaaagtgccaaagaattccaaaaataacttctataattagcggcaaaaaaaagtgcccaaatttattgacctaaaccaagcctcatcagatggagcgttggaggcttatgggttaaaaattgggaaattcaaaaaatttctgtatttaaagtgagaaaagactctaattaatgatggatgatgataataattagagttgattgtctgcagtcggttggcgctccgctgttaattgataagaaaaggcgataagcaaaaaactcagcgccccgtctcccgtcacatttaaaaaaaatgttgcgtatctttcagggatgggccaaatcggaaaataaaatgcgaaccgcgaaatttgcgaaagtaaaaaatgcgaaattccaaaaaacgcgaaattgcgaaattttttctacaactttttaatagtcaaaatcatacagtaaaaatcatttttgtaaaattttattccaaattttaaaaatcaataaaaagcttttttgaggcgcgctttttccaaaaaactttttgggaagagggggcaggcggcgccggtaggctccgccggtaaaaattttgaaaatcttttgctgttttgttttgtaatatttcggtacacctcagttgggccccggctcgtttcggccccagcatgtttttggctacaaattttttctattttaaccaaatccaacattgttggtatcattcgaaagcttaatctgtttagaagctttttttaagatattgcttcgcgagtagacaattgctaaaaaagttatccatgaaaattgtgaaaagtcgaaatttttgaagttttttttcataacttttttccaggcttgaaaatcttttcgctttttgtaaggctaatagagcatgtgaagagctttcgaatgataccaagattgttgcatttggatgacaaagaaaaaagctatagtggaaaaacatggtgggcccaaccgtgccggccaaatcgtgccgcggcccaaattctatcttatgcagcctgacctcggtaaattgtcatataccaccaccaagctcatggttttccgtgtaatttttaagtaaaatgtcacagaaacaggggggctttaaaatgttgattttaagagttgaaattttatgaaactcgagaacaggggggggggcaataattgacacagagagagagtcgagacagaaatgtaattcccggaattaaaaaaaaaactcgggccaatgggaggagcaggccccacccattcagaaatgtaccgagagccgagactgagaccaattgacactcaaaaagacgacaaaattctagactcgagaaatgagaacgggatatattcttgagcagcccaatgtcttctgtactct

SEQ ID NO: 21131 - DNA, 932 bp, Heterodera glycines
ataatgggactgtataaagtcgattgctgaaggaatcgtaagcgccaaaattgttttatgagttttttgatctgtctttatgatttttccttacacctctttttgattggcttatatcacacggtaggaaccaattaaactcgtacataactcgaaaatatttgtgtccctattggacgagggggggggcgagggagggggcacgggagacggagacggacaaatggaagggtttaggggggactgggggagggggtgcatgtgatgtgcagctgatggtggctgaggcggagcacgggacggggcgtgggcacattcctctcgagacaatttctggccaagaaactggaccccgggacaactgagtcccgaaaatttggtgcctaggaatgcatggacacattactctccatcccattcccaatggcattcggggggggggcaatttctggccccaaaactatccccgggacaactgagccccgaaaaaatcgtgcccaggcaaattggaccccgggggacaattgtaaccgcgacatttgcgacctttggcggcttgaaatgttttcatttgaaatgaaaaaattattgggcgaaacattcaaaactttgttagttctacaaaaaaacaaaactaataacgcttaagaataaacaaaaattgtaaaaaaaaatgcctcaattttatttccaccgcagacattccaagcccaccaaacccatccatttgtgtggattgtggggttctgctgaatgagtgggtgggtgtgttggacgcgccctctgtttttgagatgaatggcgcaggggaggggggatgggcacagggcgggggcacacactcacattatttaagggcatggaatgagggggcaaagttggtgtcggaaagaagggaaaaatcgaaaaaatagggagggagaggcacaaaa

SEQ ID NO: 21132 - DNA, 1415 bp, Heterodera glycines
caaaaaaaaattatagaaaaaactgcgggttttaatattttttgttcacaaaactcacctggtgaagaaatgaggagataaatggacaaaattgatggcacaaaaactgttgtcaacaaatgcattttaatccgaattttgaaattgaagaatttatttgatggtaacattttccaaaatgtgagcgatttaataatggttttgtgttgctgatgatgatgatgttagaagaagcatgaattgtaattggcttaaactttaaaaaaaattaaaaatttgcaccgaaaaattaaatttgcaccgattgtcgcaaattgtcagaatagcgcaaaataccgcgcgaatctcaaaatggaaattttatgctcctgactgactgtatgttgacaatttattttgatgttttaaggaaattttttaatgtttttatggatgccttctcttgtttcatatgatggattgaaattggaaattttaatgtgattatttgcttagcttaacgagtatatgtatgcttttgaacaaataaatgcgcccccccccccgcccttcaaaattttgaaaaaaaaataaaataataggagactcagaattttgaaaattttttataaaaactgatgacaagctaatgtgataaaacaggttaattcttttcctttcagtatccctgcaaagtttggggcgcttctgataagtttctgaaaaaaaagttaagcctaaactttttggcctgtttaaaaaggaattaaaaatttttaaaaatttattcagtgtccgtttggggtactcaaacatttatggggagcaaaaatccaacgcagaattaaagtacagactatagggaagctattcccgaaggattcggtctccccataaatctgggcgcatcggttcagggggactgccccgaaaacccaaaaaaaattttttggataaaaattatttaaatgaactgactagataatatttaaaataggttatttctcttcctttcagtattcctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaatttacaagaaaaaagttaagcctacattttttggcatatttaaaaa

SEQ ID NO: 21133 - DNA, 2838 bp, Heterodera glycines
  misc_feature (977)..(977): n is a, c, g, or t
  misc_feature (2824)..(2824): n is a, c, g, or t
aaagtggaatttgtgaggacgaaactgtctccgccaataccccaactggacccgataaaccgttggaattgctgtgcggcggttgttgttgtccgccaaatcccccaaaaagttgactgtgggtcagagaacgggacttgagtggccgcaacaacattcactggcgcagaaaacccgttgaaatttcttgcaggttgttgtccaccaaaagcggaactcggttcagggaatgaaacttgcgtgccaatgtcttttgtttcaagttgaggtccacgcacaataatgtccgaaaattcgaacaaatccacaagaggaggaggcgttccgagaaaaccagctttcggtgcttccagaggttgcactttgctcatcaactcctattttgatactttgttatggaatatttttcagaaaatagtaccttttctttttcctcaacagttaggatatcttcatccacagcaaacgaattcgtttttctgcctgtctccggctctcggtgtcgaaatggcttaatcggtccctgtcgcgctaacggcgtagcaataatgtcaacaagtgaaggctgcgtaatttccgtatcgatggatcttgctgatggcatcggacaacgcctgaaattgtgaaagtgtgtcaattataagtttaaggtcaaaaccttcgtcacaagttattcccagttaacaactataacaataccgaatttaaatagtaaaactaaccaatatggttttctcgtttcacgtcctcgctgtgccgacaataattgaagtcttgattgtgttaaaattgaacgacgaggcggtcccgaagtgtctgcctggtcagaatcgacccgtgggctaaaccaacgctcactttcgtaagcccttttcatgtgtagcgacgatgatgacttaaaagaaaaatgatttctatcagtatatcgccttgcaactagtgcttatatctaattagtgatctaattttggctaatntagtatgttattttgttgttgtttatggttaggtttgtaatggaaaagaaattaacctttgttggcgatgatccagcaattctttgcaactcattaaaaaactgcttggtttttgacataggcgcaggagttattttacttctcaggtcaataacccgtgaattggatggataaagaggatagagttctttcgacatatttttatctaaagagaaaaatgcataaaaagccatatgacaattaagtgtaaaaacgtcaaaattgaatagattatgcgaagtgacgaacaacattttgattaattaatgttttatcaaggtcaagtattaattaaacaagtcaaaacacaaataaaagtgaaagggacgtgaaaagcgacgcgtgaacgtttgttctttttcttcaacgattgctcattcccagaccaaacactacgattgcgtaaatgtaaacccaagccaaaagtacagtaatagcgcgtaaataatttatggcattttatttatttaaaatttaaaattcttcgctttaataaaacagaaaagaaacggaaaagtagtaaattgtccttccacgcttttccttgttttgtttgccctttccctttgcttttggccagtggccattgcctttagctttggcccattagcttccgcttcttctgctcccattgaaccgcttctcctttcttctctttttgttttcaatccattgtcattcattcttcattcgtccttctttgccctttctcttccatttgttttgcctttcattagcataattttactcgcggctaagaatggctatttaatgacgacttcctttgcaattttggcacaaataaaacgcgatattgtgagtaacagtcataaaatacttaattaaaaatatattttggctccttttttttagctcatttgtcatggcagcgcatttttcacatattttatttatgtttttgccattttcaatgcgtcattgcaacagataatcaggtacagtgattttcgacaggataattaggttaacaaattgaacccccaattaaagttgtttttctcatcatgatattacattattcgcacgttttattgctgatttttgccgtttacactgcgtcaaatggagctgttaaccatgtctagaaattttctataaaaaatttgtcatgattcaaattacaatcattttaaatttccagaacgaaactgattcgtcgagcgaatgggatgaaaatgaagcgctggaggatgaggaaaaagaggagtctcaaattattggtgcgccatcggagctgttggtcatggcgacccacgactcggttcaagtgtcatggttaccaccgcgggatgacaatgtgctgatcagaggatatttggttggtcggcgatttaacaatcatacagccatattttttttccaaagatcggttggggtattaacataccggacgtggaaaaggcgacggttgacccggaggctcggcattttactattcgagggctcaaaccgaaccgtgaatatgtgatttcgttgcgggcgttcaataaaattgggcacggattccctatctatgagactgtcaagtcggtggcgtttctttccttttatcatttcatggacacgtaaaataaataattattttgttgtgcttaaagaacgtcttcgtatggcgtccattcgtcgaagtcagcttcgatctctgatccaaagtccacttttgccggatttggtggacaacaacaacagccgccaagcaattccaacggtttatcggctccagttggcgtagttgcggagacagtttcgtcctcacaaattcgactttcatgggctgacccaaatgnagaatgcatttaac

SEQ ID NO: 21134 - DNA, 2836 bp, Heterodera glycines
cagtttttcatgagtcgtctccccgctgcccccccccttcccttggccccgtcgtcgtcgatggatttgctctcattttcttccttatttggcattccgcagggggagactcaaagggtttggcccctcaggccatgccaaaggtgccctcgggatatttgccccgtggcactttctgcccctccccctttcccctcatttttacgtcctaagactcacaacacaattcggacgaagggatgctaatgagcggcgctgacacaaaaactcctttttttgcccatgccgatttactggaaactttggctttccgtcatttcttaaaaacgctgctcctttgttttccccgttcttcccacgagttcttcaagtgccatgtgaatcggacggacattgagaggcttttccttctcaaatgccctcccctccccattctctccttctcgcgatcagtctcaattggcacggcattccaaggacagacgcacctgaacaagccaatggaaaagcttacactttcgtactttgtgcggttcatttattttcaattcgaattacaattgatgtagtcaataatttaaatgttgttttttatcttccataactttttggaaattcttttttggatttaagcaaaatgaatgacatttcttcaaattctggcggctatttgccggggccattcagtggcgatccgccaagttcgggaagttcggccgatcttccatatatggtcgaactcacttcttcaacttcaacaacaatgagaccattggtgcaaatttcgtctgcagcaacagcagtactgctcaacgacacttttccctggaattcgacgaaatgccaatacgaagatcgacaaaacaaaactcattagtccctttaattatatatcccaattagttttttaggaacctccactgacaactttgcgcttttgggtggtttccgtttttggtaataaaggacagaaaatggtatttaaagtttaaaattggcaatcattaaggaacaagcatcgcgttgtgcagcattgtggagaatttgtttttcttttatcttttctcgacaaggcaattaattattaatttcattttgcaatttacttaatttaacaaggaatatcaattgttgaatttattattatttatttatattataaaaatcaaattaaaaacagaaagcaccaccggaccacgttcaacatgtacatgatgttcatctcgttgttcgacattttcatcagcatttcctacatccttatccaatcaatgaacgttttgatggactttctccgatcactgacacttttcagaatatggtgggacaatttcaaatatataaaaataaaaataaattttatttttataaaataaatgaataatttaggcacatttacatggttccctttttgaccatctctcactgtgccatcacttctgcgtcttttctcatgtgagcttttttaattaattaaataatcaaccgccttaattgtcaaaataattaatttaatttttttttctatttttttagtctcgccgccaccattgagcgctatttgctcactgccaattcgaaacacattcgattggtgcagagaaatcgccgatacataatagcatttgccattctgatgggaatcatctccaaagtgaccatctgtttggagtttaaggtcaaatatttaattgcctctaaattttaacattaaaaaaaaatttgcaatttaatttttaaaatgtattaaaaatccaaattaaaatttattcagatttcgtatttggaagattgtgccaatactatgaatgaaattgaaataaactttgccgactttgtcttcgacacggattatcacttggtattcaaattaatagttacattatccatttaatctaacttaaatcagttatttttagtattggcgcttttattaccgcaattttgtaacaatatttttcccattcttcgcacttttaatgttcgtttaatcataatttattatttaattatttgctttataaataatttatacataaataataatgttttgattcaaaaaaatataaaataaattcgcagattgaatgccaaaatcatcagtgtgttggccaaggtcgaaaaagagaattacaaattccaaatgcttcattcgtccaccgcaacggccaaacaaatgaaacggaaggtaaaagaaaaattaaatataaaaatgaaaattttaatttaaaattaatttttcctcaaaagaaagtcactcgggcagcgaccatcaccaccattctgttggtgtgctcctatttggtgtccaacatcatcagtgtggcactgaccacttgggaacacattgacaaaccgtccctcgtcggcgagtacatacagtaagcctcagtaccgtcttcgttattcgtgccatcgtcctcccccctccctccaaatcagactctatctgatctccattgatatgtcctcgctgctcaccgtttgctcctgcgcttttcggcccctcatttatttgatctgccagccggcactgcgcaaggaagtgttctgtctgatgaagggaatttacctggcgagcgacgagtcgggcgacacggccaaacgcacgcaaatcaccaccacggcctttgaacgcatgtataactcggtgagcaagtttgattgtcgatcagaggagggaattccgaaattgtctcatcaaaaaaaacccagtgcgacactggtgctgatcactctcatcagagaccagggacggaggagggcggcacgcggagtacgtaccccttcccacgaataagccctacgctccaaatttaagggaaaaatagtatta

SEQ ID NO: 21135 - DNA, 991 bp, Heterodera glycines
  misc_feature (893)..(893): n is a, c, g, or t
tattccggaaggattcggtctccccataaatctgggcgcttcggttcggggggactgccccgaaaacaaaaaaatcgattttttcaagtgtccgtttggggtactcaaacaattatgggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattccggaaggattcggtctccccataaatctgggcgcatcggttcggggggactgccccgaaaacaaaaaaatcgattttttcaagtgagtgtccgtttggggtactcaaacaattatggggagcaaaaatccaacgcagaattaaagtacaggctatagggaagctattccggaaggattcggtctccccatatatctgcgcgcatcggttcggagagactgccccgaaacanaaaaatcgattgattcaagtgtccgtctgcggtactcacacaatttatggggagcaaaaatccaacgcagaattaaagtacaggctatagggaagcta

SEQ ID NO: 21136 - DNA, 1543 bp, Heterodera glycines
ctttcactatcaaaaagggagatgaataaaaaatctaaaaatttttaattgctttttaaatttgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggaggccgaatccttcgggaatagcttccctatagcctgtactttaattctgctttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaaggacacttgaaaaaatcgattttttgttttcggggcattccccccgaaccgattttatttgcaagttattttaggcactcagatgctttcactatcaaaaagggagatgaataaaaaatctaaaaatttttaattgctttttaaatatgcgaaaaattttaggcttaactttttttttataaactggtcagaagcgaaccagattttgcgagagcatcaaaaagacaaggaaaagcactgctatgatgctaactccagtaattctgaatttaaaattttttattaatttttaaagcttcactattttatttttttagcaaaatcaattcataaatattttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatcgaacctagcgcactaaaatggatataatctctccaaattttgcagtccttctccgattgtaaaggactaacttaacctgaaaaaatgccaacgcttgttgtttttaaaatttatcgaaattctgactttttcattaattatttattattttgcagacgctgcaggc

SEQ ID NO: 21137 - DNA, 1524 bp, Heterodera glycines
  misc_feature (6)..(6): n is a, c, g, or t
cttttntggcgcgaaatgcgacttttacacccctaagaattggattaaattcccataaaatttttcaaaattttacctataaattgtcaatgaaaaactgtttataaatgatcaaaatttccaattttttccccggcggcgcctatcggcaccgccgcgcccccaaaactcctattttttcttagaaaatggcccaaaatcgcaaaatttggtaatttgatgaaaaactgttctcagcggcgcgccaaaactcttatttctcattagaaaaatcatacaaaaatcacaaaatttgatgattttttggtgaaaattgtcaacaaattttaatcaaattttcaaaaattttcccggcggcgcctgccccctcttcccaaagtttttttggaaaaagcacgcctcaaaaaagcgttttattgatttttaaatttggaataaaatttaaaaaaatgatttttgctttatgattttaactattaaaaagttgtagaaaaaatttcgcttttcgcatttcgcttttcgcattttcgcatattttggcttttcgcatttcgcttttttttcatttcgcatttttcagtttcgcaaatttcgcttttcgcatttcgctttttatttttcaatttggcccatccctgctttacatcccttcacaattcaaattcttttctcatcggcctggctcatcttcggccaactttgtgctaagcaaatttccttcacaatttctcactttccacatctgccaatttacattttattttttgtgcgccattttcctttgtgctcacttttcacttcacaattttctgcccgatttgttgtcccattttccatttcattcacgtgccgtctgtcactccgcccattttcaaaattgtctatttaagcggccccgaccaaggggtcgctctcttctcttccttccagcccgagggggcctcttccttcggttcattccctttcggatcattcattttgctggacttttcgatcaatttcgtcgttacacatttttaattcgtcgatcgcttcgttaataaattttgttcggaattcgcttgggggaaacacggaaaggagggaaaagaccctcctcacttcatcaaattcggcaaagtctcgtgcgaggccaaacgaaggcgcccactgtcgcgacaacgcgaaatcctaagataaaactaaaaataaaaaagggaaaaataaaaacaatagaaaataaaatggggaaaaataaaacataaataaataaaaatatttttttatttttattttggaaaaataatattataaaaatctatcgaaaatataattacataaaaatgggaaaaacttttgaaatgaataacggaaaaatgtttgaaaaaggaaagtgcatttcctcaggaatgaaaggaacgaaaattaaataatattaaatgattaaaatgaaatggcgaattctgttaaggattgggttcgaaaaacaattattaataaattaattaaatatattaaagggaattggaaattgtaaaggaaaaa

SEQ ID NO: 21138 - DNA, 1252 bp, Heterodera glycines
aattataaattatagcgtactttggtgcaaaaaagcggtatttaaggggtgggcttctccggaaatttcagattcaactcgaacgattccctccgaagtttccacagcacccgcctgctgccattcagcgcacccggcccgcactgctccttttccatgccatgccattgcccgagtgccctcccctccccgtgccattgtttgggccccattggatttgccgctgcccgagttgccctccttgttgcgttgcttttgcctctttgatttggccgcatttcccatttgtttgttaatttgatttcaccatattttgcccttttgtcgttccgatttttgtgtgttcccaatattttgtatttccctcaccgtcccgattgggacggtttaattacccaagtttgagggtacaaaataaagtgattttcggcgtctttggtctttaattttcgtcaactcgctctgaatacgtccgcccagcccattcaaacttttttgccgtcgtcagaacgacacccactccggtcttgaccccttcctttcccggcagcctccgtcgtctcccctaaccatcccgatcccaatttccttcctgtcggcaattagggaacatttgggagggggccgaagcagcaacaaattcgagcagttcggtctcccgccagccggagcaaccgaagagacgagtgtgacctcccgtcgtcgtcaagtccaagcagagcagtgaaggaaggaagagccgagcggtgccaaaatcgtccaaagcgggacagggccgctcgtcgccgctaatccctccagccggagaagcgcgcatcgatcaaagcggactcccgccagctggagtatccgccgcagtaaacgggaatcgaaacccgtggtcgtcgagtcgagaacgaagcttcagttcaaaggggtccgacaagcccttccccaaaaccttgtcggtggtgccgtaaagcaagcagcaaatcgctgcacaattccatcaagcaccagtccaactttgtcacccctcccccctcccattctcgtccccctttgacgctgatcggatcggtcagcagcatcagacccatcagagcgaacggcaaaaagtgcgcaattccctttgcggcacagcgagcggagtgagcagagaaaaaagggacgagagcggtgaagaggagcgggaaccaatcccgcctcagctgggccaagccgcatttggccaaaccccgcccgagtaaaagattggcgacaaaatccatgt

SEQ ID NO: 21139 - DNA, 1380 bp, Heterodera glycines
ctaaaataccccttaggacatgtttttgaaagatttttggtgaaaaaatttttccactcaaaaaccatgtactcccccctttggtcgcaaattgcgaaatcacttttaattttataacttttttcgaaaaagtgataaaaatatgatataaaatttataaaatagagaaaaaaatcgcggattttttcattattttaatttgtgaaaatacgttttcagaaccgagttctgaatttttttctgaaaattcgaaaatttccagaatttctggaataccttttttcattttacagatagaaattccaaataaagtccataaaatcgtccttatttttctcaatttttcttgctttattctatgaaaattggacaagcctaagtttagttatgaattttcaaaaattacctcaaattctcgaagcccaaaaaaatgaaaaattttcaaaattttttaaaaaattccaaaaattccgaaacaaaaaacaaaggtcatattcgtgctcagcacctcaaaataccccagaaaaatatttttcactccattcttcaacccaaaaaaaattttcaaaaatttctagggggcctagctcgaaaatttgtgaaaatttttcgacatatagtacaccgttcgatagagcttaaaaagctctacaattttgctctaaggcaatttttcgctaaaaccaacccccgacgagttatgggcccgggactcaaatgtcccgctcaggccaaaaattttttctatttccggaaaaaaatcgaaaattttctaaaaatgtcaccaatcgatagagctcgaaaaacggttgcttgaaagtggtctccgtttttctgggaaaattcgttaaaaaatcataaaattcaaaaaccaaaaaatcgttttttaggcctagctcgaaaatttttgaaaattttcgaaatttttaaacatggatagatagagctttaaaagctctacaaaaagtccgctggcgaccccccgctccgagcaaaccctggcgcggcattcagctggtactgaagtgtccaaaaaaagtagttcttacgttgcctaacctacaggtcaggggtttgatctgatcaaaaaaagtttgctggcaaagttgtagcccatagtttgggcattgatcttttggggttcactaagccttaaaggcaaatgcaaaaaatttcgtaacagtgagactgtcagcaaagtcagtttttgcgcccctggtactcagttgggcgtcgagaatttttttctatagttttcccagatgcgccgtctcgagctaaaaatgcattcgatttttaatattcaataaaaaatttccttatttattacattttaaatcatgtcgacctctttcgcgttgatgaacctcttctagtcac

SEQ ID NO: 21140 - DNA, 2080 bp, Heterodera glycines
atttttcatttttccaactttctcgagtctgggaaattatgtgccatcctctacaaatgcttgtttgtctgtccttcaatcgacttttgcccaaacctttgccatttcccacccattgacctccgtccaatccgctgaccaaataaactcgcattttgagtgcccatcccccagaaaatgcattcacatcactgacacataaatggccaatttcgcgcattgatcagcaaagaacggtcagtggtcacttccgctgctccaattatttcttttgggcagtgtttgcacacgcattacgccccccccccccggcggaacacttgcggatcatctcctgctcataagccgagacccggacgggacgaacctcgagaaagaaaggggagggagaggaaaactaattagcatgattacaaaaataaatgaattgcagcaaggccattaaaaactgatgagagatgggtgatgggggggaaggtcattcatgccattaatttgtcacattctttggccattaattcgcctctcattcatttgttggccaatactttccgtccgttccactcaaaaacaacaacagcacaacaacaacaacaacaacaagtgcacagtgttgtgctggggtggaaatggtcaagtgaaaacggacggaaggaaagagggcaaatgaaaggcaaacaaagtgaaaaatgaatgggggaaaaggggggaaaggggggggggggggaaaattgttgtttgaccccgggggagaaaagaaagaaacggcgggagagaatgccaatggtaaataacagcagcaacaaagacgaacacgagaaatggggggggggggagaagaagctcattcattcgccatttacagtaattggggggaaatgaaacgatcgataggaaaatgtgagaagggacagtcggcgaaattggcaaagtttggaaacaatggcactttacggacaaccaattaatgggttagcggcaacactttttagccttgtgttccaaggaatgtttcggcaccgttcagtcctccgctccctgccccgttggacactccgaaaatagcgccgactcgcagcagcaatgccctgaggcgatgcaactccgcacgtgcgtccgccaactcgcgcgcgcattgcgtcacgcggcgccgttccaattcgcaattggcacaaacagacggaaagaaaaaatgggccgaagagggcacatcgaatgggttggcggaaaatgggggcgacgccttttgagggcttaatgacagcgattaattaataatttaataatgggcgaaggatgcctcgaggcacaagaagtgtcggagtggtgcaaaatgtgcccggcggtgtcctccttcggcaccatttgctgctgctgtgccggcactgtccccccgcgcatatgcgaggcgccccaatgcaaaaggtaagcggcctaaagttgccctttctcgaaaatttactttgtctttttgacctgcgtataaaatctttggggacagagaaggcacgggaaaaagtgatcagaggaagtggcgatcggttgacgagtggccaaaagttggccaaaaaggcggccaatggccaattgttgctgctgttgttgctggagatggtcgaatggcgtcgggggacaaagcgaattcggcggaggagcgacgggcaaagactaacgaattgggaaacgaatttaaagacaattcgcaacaaatcaccacgcttttgctgggcataagctcttcctcgtcccgctcaactttctccccttcgttttgcgcttcattttcacttggaaaagtgcttttggaagcggtcgtctgctcattgtcagcggtcggcccaaaaacggacgacgacgacgaagaagaagaagagccccgccttttcgctcctctaaattcaaattcaaatgccaattggccaaatgtctgtcatccctcccccgccgtttttgcgctttgcccaccctttcgccgccgcttttcccccgccgcactttccgtccctcgtccggtgttcctccagcgccgtctgttccccaaaacattttccgcatttttgcatgcaaatttgcgttcctg

SEQ ID NO: 21141 - DNA, 1114 bp, Heterodera glycines
  misc_feature (34)..(34): n is a, c, g, or t
ccaaaaatgtacacaaataaataaaaggcatttnttcttcttcccctcccgcatcaatcccgaacgaatatttcccctccgggggagggggttacacgcgagacggcgactgattggatttttggattggattgaattcaattggagaaaaggggcggggggacacaattcgtggcaagaattagtcccaccagcagagcacaatcaaaaaggaatttttgattaaagtttaaaataaatatgacttacaccgcccctctccccccccacacaaaaaatgtttttatttgttacatttcataatttaattatattttaaataaaaaatcaaccatttttattttcctgaataaaatttaaaataattttggtcaaatgttcgactctgtaaatgagttttacttcattctcaacttgttcgaataaactttcgttctcgagcttatcaaattttcatcagtccactcgagagtctcggccaaaatttggcaagaaattatcccacattggttcattgaatgggaatgttaagcggtcgagagcgggctctcgcatttataaaagccccccccccccaccatcaaatcccttctcagtcctctcattttctgccctccgatcaaatccttcgcgatgcccaaaaagcaacgaaaatccgtccatcccctccaccccgctaaacatcgccaaatcgatggcgtaaaatatggaggggtatggtgtacaattggcaaaatgtcacacagatttaatggccccgccggaaacggacggcggcggatgggcgaaaccgatttatttattttttgtacagtccgaaaaatcttttgagcatcgcatagtgaaaatgatgatttgcaaaacgaagtcacaaaatatgtacctggcctaaatttaaataatcctttcaaaagttcattcttggcaaagtgtcccttttccgctgcgtttcagttcctccttaatcatcctttactaatagtcctcaacttttcaccttctccccccacccgccaatccatcgctttgcttaccaaacatcacaaaacgattttccggtgcgatttccttcaggcaattttatcgcacggattgcggcgggggaggggggggg

SEQ ID NO: 21142 - DNA, 1264 bp, Heterodera glycines
agcagttttatttgaataataccaatccaattgatgagtgatgatatgtgtaaaatgtattctttaagctttttctctctctttttggtatgtatttattttttggttcaaattttttcagaattgaagcacttttttaaataaaaatgaaacaaaggcacgcatttttaagggtaagaaatcaaaaaatagaggcgaaaatggcaaaatttaaaaaaccatccctggttttcaatgaaaaaaaattttttgaacaattttaccttttgatgcgattgaaaaaattcaaatttattgaatttttaatttttataataattttacggagctaaaaattttttttttaatttctatttgatttaaacaaaaattacatgatatatttgaatttttcgaagatgattattataaaaaaaatttttcaggaaaaaattaaaatataggaatgattttttaaaaaatccatttaaaaacggcattttcattatttatcccacacataggaattgatgtactagggccgggccggaacctgataccggctttggtacttcatagctttttggacggaaattcagaaatttatttttgtactccttttaattccaaatcgaatctattcaatcgatcatttttgcctcaaactcattccgatatccttcctctctctctcttacaaaataattttttaatttaatccttaattgtacaaatatttgttaattcatcctcaaatttaaattctccttgtctctttttgccccctttttatgatcaggagattttccctaggcaaaatgttgacaaaattcacatattttcttacaaatcgtcacggacatccaaaacggattaaatgtgtacatgtgtataatatcccatcgtctcgcctaatccacgcaaatttcagtcgcccaattttttgaaattttctctcatttttatcccaccaaatcaatgctgcatttaaatcatatttgttcacattagcatataattagatcacatatttttttaaacatcttattttttgttggccttttccgtgatcatttttgtctctgacaaaaaaaaaccaccgccaaattttttttaaactttttccccctttttttagtccaacacttttgttgttccacttaatcgctttctttttcttccttgtcctcccttttggccgccgattggtggaacagaaatcgttggatgcgccgccgcttccgaaaatgctttatccccaagggcacccactgctgcttctgct

SEQ ID NO: 21143 - DNA, 2399 bp, Heterodera glycines
taattaataatacaggtctcaactgctgtcaagtgttctacaatgttgacacgaatgtgtcgctggaatcgtcatgcagcagcacgtgcagaaacgggatgacaaacccgggactgagctgcccggacttgctcgcccaatgacggacccaaaatccgccaaaaagggccaaattcggatttgggttaaaggattcgttgttccgccattggaggcctggccattggaggaccggccattgaaggacccgcctttggaggacccgccattggaggattggccattggaggacccgccatttgcggatattcccgacattgagggaccgactttttgaggacccgacatttgaggatatacacaattcaaaaaaaaatgaatgaaaattttatttatatcattataaaaaaagagaaaaagctattcccgagggccggggaagcaaaaaataaattgtaccaaatgctggcaagcccttatcaatctttgattattttggaaagtttcatattcaaaaacaatttaagattaactacttcattaaatagtacttgtgttttggtaattcatgaagatccccttttttctattaacatgtggaatcattgttaggaccacaagtcaaaacaagaatgaatttataatactttttaatatcagagtcattaatgattgttctgaagaaaggagagcggattgaatgagttgaaccaactcagaggatagtattcgagaaagaaaaaaacataaagagacaagatttgtttttagaacagagcccggaattttaaatcatatttttctatgcgttattatggcgagagaagcccaaaatattttctcagaacatttttatttagggctacttataaaaaaataaaaaccgcccgaccctaaaaatgcatattttcttgaaaaaatttgctcaaaatctgttaacaaatcgcatttgaataatttcatgaaaatcaatgaattattaaaattttattacatttttattttttcaaaaattttcaatttataaagacttccagtttccagcagggtttgatttcgctttcacccttttggagtgaaagattttccgggaaccgggaccaaccgggaatttttaaaaattcaaaaaaattcaaaaatttttaaaaaaattcaaattttaatttttttcaactgaaaatgatacaaaattaaatttttattttgttttttatttaataaaatccaaaggttaaagctaaattaaattaatgaaaattttcaaacaaatttctttaattatttcaaacaattaatcatttttggactaaatgatcgaatattatagaaattcagatctccagaattaaacttgaaagcattatttgtgctgtaaatatttaaattattcggttgtccttaatgctttttgatacattgcacccgttggcccttgggaaaggccttttctcttttttataatgatttaatttcatttttttttgaaattgtgtatatcctcaaatgtcgggtcctcaaaaatcgggtcctcaaatgtcgggaatatccgcaaaagtcgggtcctcaaatgtcaagtcctcaaaagtcaagtcctcaaaagtcgggtcctcaaaagtcgggtcctcaaatgtcgggtcctcaaaagtcgggtcctcaaatgtcgggtcctcaaaagtcaaatcctcaaaagtcgggtcctcaaaagtcgggtcctcaaaagtcgggtcctcaaatgtcgggtcctcaaaagtcaaatcctcaaaagtcgggtcctcaaaagtcgggtcctcaaatgtcgggtcctcaaaagtcaaatcctcaaaagtcgggtcctcaaaagtcgggtcctcaaatgtcgggtcctcaaaagtcaggtcctcagatgtcgggtagccgaaatttttagtttacgtagcaattcagaaaatattaagaaaagggaaccgatattttatgaatttttttcaaaattggggtattcatttaatataaggacactttggaaaactgagcaaaatcggtgttggttggttcagtttgattcagttggtcacaggtttgagctgattaaaaccttatggcccttaatttctcacggaaaacttggaaaagccaacacaactctgcctaaaagacagcttaaaaattgataacccataatttcgaaatttcccactgagacgcctaccgataaaattccttatcagaaaaatttctgaaaattaataaatgcctgggccttccgagtcgggccaaactcaagaaagtgccgggatgaaattctcaggccgtaatgggaaaaggggcaatttaaatttactgtattgtggtgatttcgatcatcagccctaacagtgagcccacaaacggttgtgataggcagaaggtaatgtaagcgg

SEQ ID NO: 21144 - DNA, 949 bp, Heterodera glycines
agttgcgcaacgagaaaattcgcatgatgaaactgatggaggaggacgacgtcggctaccgtcagctgctggacgagaagaaggacaagcggctggtctacctgctcaagcaggttgaggaccaatttaaaaaattttttttacaaaaaatggaagatttaaaaaatggtttacccaatacaaattaaatttggcaaaaagatggaaacgtataacaatactaccattaacccttattttcttgaaattttcttaataagaaatttcctaagaattttttaatgaaaatgtctaggtttgaaaaaattaaaaaaaattttttttcgggggggggaaatgaagtgcacccctaaatccaggcatttggattgaaaaatatatccattaaatgttttaaatttgagcagattgtggaggggcaaagtctcgtaaacaaaccatttttaatgaactcagaaattattagtagacctgatgtgataataagagagattagtcttgagaaaatttacaaaggtttttcattgaaattttttgtttttttgaagtagacagaaggtcccttcccgactcatattcagtaccgaaatccggttccgggctctaaaagaaacccatcaaaacgtcggataactccccccgattttttccatttttattccttatatttctatttccaatacagacggatgagtatgtggagagtttgactggcctggtgcgacagcatcagcagacggagaagaagcggaagcgggacgagcgcaaggaggccaagctggcggcgctcaggcagcaactgcaacagcagcacaacgccggcggagacggcggcgccaacggaggcggcgatgattcattggacatcattggtcggaacagtgccaccggcgaaacgctcaaagggatgtgccgggataaacggggcgggggaggccagggacaaatg

SEQ ID NO: 21145 - DNA, 2117 bp, Heterodera glycines
  misc_feature (13)..(14): n is a, c, g, or t
  misc_feature (51)..(51): n is a, c, g, or t
  misc_feature (90)..(90): n is a, c, g, or t
  misc_feature (101)..(101): n is a, c, g, or t
  misc_feature (145)..(145): n is a, c, g, or t
cgcgtgacatacnnccttgcccatgtatgtttcggttatcaaaggccctantctagaagaattcgggagcggcgcggaccttagaatttnttaaccgttcnccttattgtacagtaaatttcaatttttcaggggatgaggcgcncaaggcggagctgctggacgagtggttggaccagcacccgggctacgagttggtgtcccgcgactcgggcgccaccgactcagaggaggaagaggaggacgtacagacggaggaggaggaagaagaggaggaagtccatgacgacaacaaaatggacggcacagagcagaagaatgaggaggaggaggacttggaaggcgagaaaaggggggaaagatgggacggacggaccccccgggaagggaggggaaagagttaccgaccgattcgagaaaaagtcgaactttacacctcccagtaaaatgctttaaaaaaatacggacaacaaataaataaatttgcttttttgcactctcacagatttggacgaggagcaacggaatcggcgcatcattgagaaggcgcgcaacgaggaggacgaatacgacaacaaaaatgcacgggcacaaatggagtcgtattacgcgacggcacacagagtcaaagaaaaggtagggcaaaaattgagggttcattccaattttcaatatttttttttgaaattttcgcgggaggggggttggaaacgacatactccaaaaaattgaattcaaaatttaaaacttacaaattttgtcaggtggtcaagcagcacagcacacttggcggtggcgacgatacgctgcaactgaaaccgtaccaggtaaacacactggacaaacatacaaatgaaaaaggccaaggagtaacggaacgttttgcgaagcggtcgagataggcgtgccatccaattcccccccccccccccgggatcgtgtccatgttccaaaacgattttttctctttagttgaaaggtctccaatggatggtgtcgctgtacaacaacaatctgaatggcattttggccgacgaaatgggccttggcaaaaccatacaaacggtgggttttttggaaccctcatttttgaattatttttccgttacttattttttgtcccattttgcacggtttttgtctgcctttttcccatggctttttctccacaggttgcactgatcacttatctgatggaggtgaagaaagtgaacggcccctatctgatcattgtgccgttgtcgaccatttccaattggaaaattgagttggacaaatggtcaccgcacgtggtcaaaatcatctacaagggggacaaggaccagcgcaaacggcttgaaccgtacggattttttttggatttcactaaatttttatgtttttgaaatttaaattttttttttagtttggtccgtaagggcgctttcaatgtgctgttgaccacctatgactatgtgctgaaggagcgctcattgctgggcaaagtggttttttttgacaaaaacggaatgccaaaatggcaacccatcacaaataatagttgagaatggcataaatttcctggaaattatccaaatttcacgccaaaatgacaaaaatatcatgaaaaatgtggtgacaaaatagccaaaaatggaaatttctgggaaatgtgccaccttcatggactttatccttccacaaattgtttttcaatttaaatttcaaaatttttttcaattaaaatgcattttcaaaacttgcattacgaaacgacacattcatgccgaatgaatcaaataaattacactttcttttctgttatgacgtgtaaattgaatccatccaccaatcacccgacacagatccgctggaagtacatgatcatcgacgagggccatcgcatgaagaaccacaactgcaagttgaccctgacgctgaacgcctacttcacggcacagcatcggctgctgctcaccggcacaccgctgcagaacaaactgcccgagctgtgggcactgctcaactttctgctgccctccatcttcagctcgtgcgacagttttgagcaatggtccgtccgtaaaaatgggggagagggaggtttaacatttcgttttgggaaaaagtgcccattt

SEQ ID NO: 21146 - DNA, 2403 bp, Heterodera glycines
ttccttcattgctgcgagcgccgattgggcggccctcatgcatttgactggtgccgcgactgcttttgggactccctcaccgtccatttcgctcccatcatgctctcccgaatcctcagctcagtcaggatgctcactgggagtttggcttccaacagcggaccgaatgactcgtcgtccacgttggctcccagctgctcgagttggcacactcccctctcgaactcgtcgatcattgccgtcagactggccacgttgtctttagctggtggcaaatgtagcagctgagcacgaattgctcgttgcaaatcgttggtgtcgccgaatcgctccttcagcagttgtaccacaactgggtaatttccatccgacggtgggtacacctccaccgctcttcgcgccggcgatccttcttttaggcaccgcagcagatgaagctgcttttcgaatcccgggattggtttgtcgtccaccgcccgttggaagtaggcccaaaaggtggtccaatcctccggtttcccggaaaacgtcggtggctgcaatcgaaccgtttcgaaagtcgtcaatgtgtctgctcgagtttccgaatgatggtgatgtgagggagctgctccctgagttcggaggcgttcccgactgggatgctcctccttccgaatacgggcatgatgggatgcccgagggaatgcttgtccctggtcattgagcgtaagtcgctcaaatcgttgctgttcggcttgcagcggttgctgagcttgtggctgctgttgcgccgggggttcgttctctccccctcggttccttgccatccattccctgaccgggttgttcacccgaacactggccactgatggggcatttgagcggcgttggatgagcgcagccatgtttggcatgacgggtggggccacccggttggcttgttcgaatctttgtggcgcttggccaacttgtccagcctggaaccgcgccaaggcatccctgaacgatgtctcccactctggcatgcttcgtcttgccatggtgcgtgggagctccttcgatgggtgactgtcctcggtgtcgactgatctgctcgatcgggagatgctctgctccctttcttcgtcctcaaatgtttgcctcatcgcctgcatatcaccgagatgctcagccgcaatttggagcagttcggcaggagttggatgctcccgcagttgcagatacttcgtcgaggctggcaagggggcggccacgaaatcatacaagaaatcctgccgctcctcgggtgctgcacccgcttctgcgattcccttatcgaaatgtccttcgaaaatccgagtgacctgtccaagtccccgttccattgccatcagccgcgcggcgtgctcgggcgcttcgcccctcgtgaaatccgagtccatcagctcccgcgcttctgcgattcgcgacgagagtgtttcagccgctctctcaatccgatctcgggccgacctcaccgtaattgctccgctgcgcaaattcttcgatgccgcgggtgtaacacccgtttggcttgtccccaggccttgcgcgtccatccctttctttgttttggtctgctgcgccgcattcgctcgttccccgtcctgtcggtcggaggggagatccccctgatttccattcccgtttgccgcttcctcatcgagcggttcgctgttccgttccattttcgtttcgctctggttagtccgaggtgtagcgggaggtgctcccggttgctggtccttgtttgtggcaggacccccgctaacggcaccaactttgtttgccgttagcacaaatcgatgtgcttgttggtcctcggcgaccacaactcgttgctgttccttaatgtgcagtgggaggtgccccctgctaacggcaccaactttgtttgccgttagcacaattcgtttgttgtgttggtcctcggcgaccgattgtgttgttggtcctcggcgaccgaagtgttgttgcttggttccccctgttagcggcaccaactttgtttgccgttagcacaattcgtttgttgtgttggtcctcggcgaccgcttgtgttgttgcttggttccccctgctaacggcaccaactttgtttgccgttagcacaattcgtttgttgtgttggtcctcggcgaccgcttgtgttgttgcttggttccccctgctaacggcaccaactttgtttgccgttagcacaattcgtttgttgtgttggtcctcggcgaccgcttgtgttgttgcttggttccccctgctaacggcaccaactttgtttgtggcaaaaactctctgccgatttgggcgggagtttctcccttccttctgctccaatccactcctcaaaattcggtctcttttctctctctctctctctcttcgctgccgttcggtcccttc

SEQ ID NO: 21147 - DNA, 2348 bp, Heterodera glycines
  misc_feature (2253)..(2253): n is a, c, g, or t
  misc_feature (2258)..(2258): n is a, c, g, or t
gattattaaaactttttcataattataaaattaaaaactttttattatcattttctcgtttacatatttttcgcctttcacattttgactttttgcatctttctcatttgacatttttgaataattttggttttgcaacatctctgataaacttcccaagcaagcatggatttccgaccggggacgggcgaaatttcgagatttatgtttctaacaacggaacagcgtatgacacttttttgtatttttcaaaaatgtttgcagaaaatctgttaataaatcacaacccggcggcacctatcggcaccgccgtgtccctctttttccgcagaaattttttaaaaagagcgtgccgaaagaaaatttgcctagctaatcgttcaacgtgtttaaatttcgatctaaaaggacaaagttggcaattttggtgaaacccttttaagaaattgggccaaactttctaatttcccctggcggcacctatccgcaccgccggcgaccctttaatttcttaaattgtctcaaagactggaaagctgcgagcttcgaaaaaaaaattcagtctatgtatccctgataggcttcctaataatttggaattatttttatttatttgcaagaaatcatttattagatagacgaccgaccgaattttatactccaaaaataaatttatgcttttcatttgctcattaacaaattaaatgattaataaaatgataaaacataatggaaatctaagagagcagcgaggggaaagagggcataacgaaataacacagtgtcggccccgcgtttctcgcccccgtcacatctcatcacaaataacgctcgtaaatttcattcttttatataagcagtcgctttaaccctccactcgtcatcgttcgtctgaccagtgttgtctcactcgctgcccgggagagagttgcggctgaggggcgcgtgcgccgggtgccgagtcattgacgcgctgcgcgcgtgctgtccgattccgcgtgcacgggcgccgcaactccgccggggccacgccggcggggtcgcggcgtcgcccgcgatgcgcctccctcgtcgggcggccgactgttggcagtgcgccaacagcggcggacagttgggagcctagcggtcgggtcctccactggcctggactgtcccgaccggtgggcacgcactgcgcggctacggccgcggaagtgtccggctctcagtgtgacttggaacgcgcgtttcgcccataaagaagcgcttccgcgcctcgatgaagctggcggtcgatgcatattttttaattttatgaactgattgatttaaattaaataatttttaaaaggaagtaaaataaatcaaattttattaaattaattcttgcttattgggtattttttaattaaaaaaataaaattttacaaattctgcacaaatgtacttatgttaaagtggtaaataattattttagaagaaaatttgaattaagatttaaatggactaaaaagaaataataaaattgaaatataaaatttcatatgtatatagaattaattaaatatttagaaaacaagaatattttttattaaacatataaaataagcatttcaattcaatcaaaactcttccaacagaaagtgcttgttcagtcataaaaggaataaattttcaaaaacaaattaataaaaatgattacaattattcatttaattaatcagctgtcacacagaccatgggatggatttaagcatttaaaaaattcaatttaccagttgaaaaaaggctaaataaacattcacaaatttcaatttgggtggtctctgtggtgaaatggcagcatataaattaagcaaaattaacccaaattaattaattgcccaattaaatcctcaattgtcaaaatgcgtcttctgttgctcctcctaattgttcttgtgtctttcgtcggtgcctttggcaataaagcggcgaaagactttatgaagaagaaaaatggcacaatccatatcggctatcaactttttgcgctaccggaggattatgggagaaagcgaaagtgatcggccactaatgggaggagggaaaaagcgaagggacggcactttgccacattcgagagactaattgataaagtgatacaaacagaaaatattaagcatcttttcaaatgatgttagttgcagttttgggacaaataaatgttgggaaacaaatattttttaaattaataataacggcttttactgaattttgtaattttttggnctggnctaatattacaagtcatttcgttcatcttattagcgtgtaatatcacttaggaagatgacgaaaaaagcaaaataaaaaattcaagggca

SEQ ID NO: 21148 - DNA, 1398 bp, Heterodera glycines
  misc_feature (1258)..(1258): n is a, c, g, or t
  misc_feature (1299)..(1299): n is a, c, g, or t
  misc_feature (1323)..(1323): n is a, c, g, or t
taattgttagagctgggaaatttaggtaagaaaaatcgcgaaataggtatttaaataggtacaaaaaaagctcaaaatagttattaaataggtacaagaatcccaaaatagtagaaaaataggtaaataaaattttttaaacgattttttagtgacaaaaagggaaaattttggttctattttttgtaaacgaataattcaaatattttgaatattttcttagaaaatattgacattaaaattaaaaattttgtcaataaaaaaataaataagttttgggggacaaattttaagaaaatttttcagctttaaggggtgtatttctaaaaaaaaatttttgctcgattcataggggtatattttttgattttattgcatttttattaaaaaatttttgaaaatctttacataggtaacaaaacacctcaaatcaagtggaaaaggctttaataaatagatgatatgaataggtattataaaagtcattgtagacaccccaaatcaatggtaaatgcttttttcgtgcttatctgtgcgtattatgtgcgcaaaaattttaggtattatttacctaaatttcccagccctattaatgatatttcaattaaaatgataaattttgctacttaaaagtacttgcaatgttgcgattccaaagtgtcttgcgcagagacatacgatgatgggtaatttgtataggtgcgtatgccttttttgaggcgttcaatgcaaaaacggtcggtgagtaccgatgcagcaaaaaccgatgcgcatgaaccacaatcacctttattattgacaactacattataacgcagatttttgaaaaacagttttaatacttctttttgtctataatttgtttcaagcgataaatttttttaattgcacgccatagcgaagatttaagctatcgaattctacctgaattatcaacattgagttaaccggatcaagaatttctataaaatggcagcctaacaggtttaaagtataaaatattttgccaatttatattacagcgccactgcaccgtataatttttgccaaaaccgatgacttgccgcgacctgagaagccgggaccgtgacctctattttttttcgttaccgacaccgcagaaaaaccgggaaccgggaccaaccgggaaatgttaaaaattcaaaaaaattttaaaaatttaaaaaaaaattcaaattttaatttatatcaagtgaaaagaatacaaaattatttggttttttatttaataaattanattaatgaaaattttcaaacaaattttcttcaattatttcnaacaattaatcatttttggactanatcatcgaatattaatagaaattcagatttgattttcacatcacttttttttcgagcgctttttcaaaaaacttt

SEQ ID NO: 21149 - DNA, 1027 bp, Heterodera glycines
attattaagctcaattgttaggattttcatttaaaaaatgataaaatatgtatcaatttaaaaaaaaactatgagtaatcatattttctttataggaaacccacgagtatacaaaacaagaaattgaaaataatctaattcctgtagagggattgaaccaggggaaagaagaagggaaagtcaaggagactagccattaggccatttgcacacttgggcagtgttacttttaaagaatatattaattattattttttatttttccctttgactccaattttcttcactaatttttcactcagaccccattcttaccagtgcttgtttttccctgttcccggttgccctaccgggaccgggacctgagcttttcaaaacccgggaccgggaactgggacctcggatgaccgggaattcccggcccggtcccggtcctgtggcactctaatttatagtcaatagatttcttttccttaccttggtcagttaccattccgatgaaatccgcacattccggccactttttgcgcgcgtcaaattcttttggcaatttgacctcattaggaatggggcgctaaaaactaacttttttatactcctaatgcataagcgtatataaaaatcatcaaaagtgatgttatataaaaaaccagcaaatgaaatttacaaaaaattagccatttgcctaaagacaacaaagattttaattcatgatatcattggatagcgttaagttttttattatagagcataataagtaggttgcttttgagcaaagttatggataatttttgttagaaaatttcatttgatggtttttaatatggctggcactcataaaacatggaccgtcccaaaatccctttcagatttcggcacccaatttaatatttaaaatattaatgaattatttaactgttgatttatcaaataaaataactcatcaaacctttggtccgcgattggttttctaaaagtttattaataaaaacatttgaatttgggctatttcatgcgtgattaatct

SEQ ID NO: 21150 - DNA, 1690 bp, Heterodera glycines
tttaaaaaagtttcaacttaaattgtgtattcataactaaataaaaatatgctctactaattcaattatttacctacccattatttttttaccttaaatgaaatattaaggaaagaatcatgaaaaattaagtgcaataaaacgaataaaggtaaattgaatttaatatgccgctttttgcaatttcatcctttcaattagtgtagaaaagagaaatagaaagacaaaatcgaataatttatccataacataaacattatattgtaaataaatattattaaattaaaattggacaaaaattaacactaaaaaaacataaccacccttgtggcgaattgtaaagatcaaatgagaaagaagtaaaaattataattttctatcaaaattattaaatgtattaattatatcatcgatataaaataataaattcatttttttaacgaaaagaatttaaattttcaattcaagaattagttaataatttatttatataatttcgttttaattttatttttaatgaattttttaacgatcttcatttgtatattatatttattttttttaccaattaaaaattatatattttgaattcaaagatttaatgattattttaattcattttaacttttatcaattatttatttttgttcctttaatgggaagtaattttgaaataatcacgcaatcatttttttaaatttatttcaacttcttgcgctgtacttattttagtcaattcccacacatcattagcgtcgattttataatttattcatttatttattttcacttgaatataaaattaaatcacattttgtaatatttcaacataaatattctctgctaaaatttatttacatttaattgcactaataagataaacgttttcttttttagattttttattttatagtttattaattaatctatatataatatcattttaccaagtgtttattaaagctaattgttttattaatttaaccttttaaattaatttcttgtaatgttctatgtcagtgagcaattttgggctggtaaatctctgattaaagatgaattttacttcattctcaataaagcaaattaaatgaaaaaaatcatttaataatattttatagtctattttctattaactttttcctccttttcacaattaattgtcatgattatttttaagcctgaagagacattttaagattgtattttttaaaatttattttcttatatttttatagttttaatttaacattttatttaaatttatctcgttttctcaagattttttattttagcgtacgacttgttcaaaaatggaattgttaaagattattgtttaatactcacataataaataatttattaagtgcatttctattaataaattaaataatttaattttttgaaaatcaaattttatttcgttattttgattacttatttaaaataataattcaatcttcagtgggtggctaggtcgtttcttaaaaactgccaccatgggcgtttcttaaatactgccaagatgtagtaaaataaaaaatgtaagacatataaattcgaatctaggcctcatccaaattaataattattggtattattcaatagcattaagtgttgtctatcaaaatagaaattttgaaattttttttaccaaaatttaaaaacagtttatgggcataaattttca

SEQ ID NO: 21151 - DNA, 1145 bp, Heterodera glycines
tcagaaaatggctatctctttttcggccaattttgtaccgatcaaagggaaaatggcttaattcaggccccaatgtgcgcctttttcggccaatttggttggcatcaaaggaaaaatggcttaattcaggccccaatgtgcgctgaatcgctaattagctttgcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcgggcctcagaaaatggctatctctttttcggccaattttgtaccgatcaaagggaaaatggcttaattcaggccccaatgtgcgcctgaatcgctaattagcttggcactttcgaatattacatataaattagccctctcaaattttccttcggcctcagaaaatggctatctctt

SEQ ID NO: 21152 - DNA, 2278 bp, Heterodera glycines
accaattttctataatttgactgaatttccccaccgctgttttaagagcaattccagagattaatttgtaaccccttattacaaatactaattaattgacttatttaaaaaaagatttggatgaaatcagttaaaaatagacgaaatattgttgtattctaaatcgaaatgtatcatacaagtacgatgaatgtggacgacacaccggccatccgttgcactgatcggcgcgtcgaattcagcatcaacacgcgcaatccgttccggtaggctgcctagtcaattaaggtattttcgcctaattgctaggctcgggttttgaaagttcccgaatttcggaatcaatatttactgaatttgaacaccttggggatttatttttcaacctcctcgaaggggggttttatttcagagggtgaggtgtcaaatttagggaggggggaattcagtaaatacgacttctcggtttcattctttattgtcaaaattaaatttgttgattacgggttttagttcggttccgagtcttgacccaaagttgaaaactctctctatcctattgttagacccattcccatacttttaatcaattttaatttacatggcaattccgtcccgagttttaactcggcatgccatttccgagcagttccgagttccgttacctaatcaagttcaaattctcaaatctcatttaaataattgctggccaggcaccacattatttcgtctggtacgcctcccccccccccccctcattaaagaattttagaattttttgaaaatcttttttatccatcggcgagttttagttttcttttccagtggcaacctctacgtgcagggcgagttcggcttgacggagtgccgtcgcgagttctacaacaacgaggcaccgtttgcctcgcttgaggtgcggctgggcgactgtggcatgatccgcgagaagagaccgcatgggatgagtgagtgccgggaatttgattacatactaatcaatacaacgcccgacggtgaccagaaccaacattttaccatatgaaattaataagggggagggtatttagataccactaatcaattttaatagcaattgataatgatgacatgccatttttgtataggctattctctgatcctgatcaccaactttcatccccgcttcgtcacccgggttgaccgtgcctacaaaatcttttgtgcttatcagcaagcggaacgcccggttggtgtcgatcttgaagttgggtgagttgttagaaaatcttcaggattatgtaatcatttcaaaacattcggatattgataaggatacgattaaaaactaacgcgccgaatagcatttatcttgatcacttttgcattttttcgcgattgatcactcactgatcataatcaaaaactggttgatccgttatccgttctcccatccgtttgttaggtctgtcccggaagagtcggtgagttcggatgcgcttatggtgcccgaatgtgagtacacaatgcgtatcggtgatctgaatgggccactggcgacaggaacaggtgaatcctgatcactcaaattgtcgagactcaaaagtctcgacgaattaccgctctcgacacatgtttccagacttttgggactcaagagactcgggattttcttaatgaattttcctagacttaagattctcgaaagttaagggagaccaaagttgatatcccaagattgttgacaacattctaaggctctctaaaattattaccagaacacccactacttttatgtaggaaatcttggcatcatagttttattgacttttgaaaaaatagtgaaaaaaattttcaaaattttttttcatgaaattttcttctataattctgtggtttaaaatttttaaaaaacgggggggacgaactgcttccatgtcagagatcacattccgagacccatgaccatttaatgaaattgttattttaaacacaaatactttaaaattccgagaatgtcttaaataatttttttggcttttttttgcagtgaaagttggcgatctgatctatcaccgatgggagtgccaacggtcggatgcgcatggaatgttggtgaaaaactgtcgggtgtttgacgggggcaacgacaatgtgacactgctggacgaacgggggttgggattaagcgaaaaatgaattcataaaacaaattcagaggccataaaaaggtctaaaaattaagtacataaaattagagatcaagtctttcaaaatttaaatttaatttacaaatgacaaa

SEQ ID NO: 21153 - DNA, 1807 bp, Heterodera glycines
  misc_feature (90)..(90): n is a, c, g, or t
tgcaaattctctgggggactaaggaagaacactttccccctaatcatcctctttgcttcactttgtggcgcccattgtattgtgttcctntaccaccatgtcgctaggacattcatttgaccgatttcttaatttgcttaataccagtacgtgtcccgatatgtacgcgatgctcatatttaataaaataattaataaataaacaaaattttataagttttaaatcgtttattcaattacaaaaaacacttattcgattgaaaaattaaaatagtacgaaccagggtgttgagacgtttcaataataatcaattgaccaacatctcctttgtggtgcggattcatcagccggtacatttccatcccatcggagcggaccagttgaccaatgccacctgatgccatttctgttgccgagagttggagaagccgcggaaagtgttgacgcagcaaataaccgcctgcagtccgcttcttcatggtcagcggatttgcgcttcccaacacatgcgtcagaatggcgccgaatagctctccaattttaatcggctaaataatattaatattattattatattttttttttcttaccgccgagtaagtcacgactctcgtcgtaacggtagggccagatcgtccataatataggtacaccaaaaagtcggcgaaacacttggcgtcctccagttcattttcgaatccaaattgaatgaagccgaactgtatgaacaattctccgcacggtaacttcctcagtgcacagagcctctcgaaatttcgagcaagatcgatctaaaaattcagatttattgttattttaaatattaccaactatttttaagaagtaaaaatgccgcttggcacgaaaaatttcgaacgtccggctgacaacggtgatgccggatggtggacgcgtacctcctttatttttaaattgtttaataatacttttgaaaaattacctggcttctttgcaactcctccgaaaaggtacattatcggaattgcagcaacaatttcccaaataagctcattcggcaagcgcttgttcattttgggaatttttagtgtgtaggaaatgaatgtgaacgaatgaatgcttttagggattgcttatagacggagaaaggaatgatataccctattaaggaaattttgaaaaggcgtcgaaaattatcgattgattacaaacatctgttaccatatgcaatcccgaaggaattgcgcattgtttcgccgaatattatcgattgatgggcggagacaacagctttaaaagcgcgtacagacacagaatttttcatttgttccttattctcctatctatgttttaactatttttttaattttgctgttaaccggggcggtagttcgacatacagagctccgtttatcctggcagcacaattttttaaatttgttttttaggtcttgaggtgatgctttagacatatctaatttcctgagccgtttagatgccctgtcgtcttgtgcttcatgggtggcagtgcgctgctcatcaggccaagatgggttgacattgtctttcttttaaaaataaattattctaattgtgcatttttctcatatatttttcatgaccaattgtattttttgatgtgcattgctcatataaataccccttttcacaacaaagttatcaatttaaaaataaaaattaatcatttttattagatttaaaaatggaaaatcgcaaccttcagtgcccctaagaattttcaattgattacattttgtccattcctgcgataaaaggacgtcatggcattcaagcgggagctggaac

SEQ ID NO: 21154 - DNA, 1751 bp, Heterodera glycines
tctcctcaaaatacttttttcatcttttccttggcttgggaattcactgcccactcgtcactatatattttcatcgggataattttagacttttcgaacacccgatcaaaagcctcgatcacgtcctcactcttctttgacttggccggtgcactgaagatcattcgactcagcacgtcgatgcagaccaataaatatttataaccgtcgttatgctttttcaactggtcaaatatgcacaaatcgcactgccaatcggtatggaagccacttggtatcgtctttagtctcgggaatcttttcctgatgggcttgtgaatcgtgtatgttttctgcttttctaggaatttattaacgtcatcggtcgtaattttcgggtcaatctttttggcctcatttaaaattttttgaattccagcaaaacttgccggagattttaaattaaaataaattttcgataaaattttctctacagtcttgcccatattagtggtttaaagggtttcttctctcgcactatgccgggtgtttttatagattttattgccttttttcttccacgtccccacatgacctttgatttatcaaccatgtcttttactgttggatccttcagtaaccgatctttgagaaattttgcaccgcgcggcgtttcatctttcttccctgcgagatacaacaaaacatctctataattactgttttcaatcggcaaattcatgttcgactgtacctttccggccgccgtaattttaaataaatctttgttttccttcacgtacctaaaaagaccgtttaaaagggtcgggtgtataatagttttgatcggaatgggtgtttttaatgtggatgttgtttggggctccggagttaactcatttattgtatcattatctgattcaggatcaggagtttgctcttcaagtcttttcctaggaataattattttccggggttcatcggtctcctgtggtttggattgagtgttgaggcctagatatggtgcaacattcggaccgggtacatgattctcaatcactaccttctgtggtctattttcaagtatcccctttaccgtacgcctttctttatagagccaatcgtgtctcttcgccttgaggtcctcgcttatgccggggtcttgtaaattctgagaaatttttgcgtctaaactcgctttttcattttggagataatcaccactattcatcgcactccgtagagccaaatattccgcctcgggaatcattaacattttctttgcaaatttcatgatgttattttttctaataaatgttgggctaaaacactcaggacaggtatcaagacagctcccagggctataccactcccctgttgtatcctttttcttgccgttttctctgaacgagatttggcaatttctctataaaaatcggcgtattgtgccaaccttcttttttgtttgttcgttagtttaaaactaaaactcaatatatttgcacaaatttcaacgattgccaaaatttggtcagctgtagcgttttcgattaattcgttcttcttttgttctgatctggtggaggcaagcttctttaggaatgctgtattctccttcacttcggagctaaatttatacatttttaatttaatttaaattcatattcttatatactattcaattggtaaataaattttccagagtctcatctggaaaaattttgctacataatctgaattcctcatcagaatttgggtgcatgttaatcatg

SEQ ID NO: 21155 - DNA, 1259 bp, Heterodera glycines
aatttagtgcccaaacttcccggtgcccaaatttctcgctgtccaaacttcctggtgcccaaacttcccggtgcccaaacttccgccccccatttaaatggtgtctttccaatcctttccccacactcttcattcatttatattatttattgtttttattaccacatgaatgctcatgtgcaggcgcaaattggctttaatgttggaatatttaacgcggtaagtgttttaggagttacgtaattcttgaaatattcgattgaatatttgtaaagagatgcttttcccaatgtttcattttttagaacctgggaggttccctccgttggaaccaagctgaagcacagagtttggcaagggacgcgcgggctgatcggtgccatcgacaacgcgatgaacgaaacgcggcagttcaaaatgctcgtgggaggactgatcagaatgcagcagcacgacgaattgacttgcgttttgcacgcgaagaagtacagcgttatgtggttgaagctgaaaccatcgcagaacaagcgagggacagacggcggcacgcggagaggcgtggaaagcagagaaacgaattgatgatttccgtcgtcggatcaacgatttgcgacgggttgaaaagcgagcaattgcacaagcagcggaagcgcggcgtcgctttgaccgaatcgctcgtgttcgtgagctctaaccttgttcatttaaagtacataatttcagcagagacagcattgagttggaagaaagatgggagccatttactccgcctccgttcacttcgtttcccaccgcttcgcccactcgaattgcgccttttgtggtgccaacaacggactttggcacggacaccgtacgacctccgccacacgtcactccgccgtcggatttgacatcgctgttcacttccacagtcatttcgccacggactcggcccaagccgtacactcggcacagcgcaactgttccatgggagaccggcattccgaagtgagtcttgccatcaaattatttaattgattaattattagataattaattagtccttccaatttagcattttggtccattcttcctccaccacaacagtgcagccgttgccctcttttgagcttctgatcgtcggcagcaaaacgcgtcccttcttcgatcggcgccttggccgaatcactgaacaaaacgacgatttgctgtgcgatttcacccacacttttccgtgcctttggggggccgagtcggggcgatgggcaattgtgcac

SEQ ID NO: 21156 - DNA, 1044 bp, Heterodera glycines
cgtgtaattcacaggctgatcggctgattgaacaagccacgctgaatgataatctgtgccagtgttatgtcgggtggtgcccgttttggtgacagaacctgcacatctatcacatttctatttcgccttgtttgaattctattgtcacattgcatccttttccaatttgcacttttgataaagaaatattatgaagggttcgttctgatcttgttggtccaaatcgtcttctgatttattggaataggcatttatatcaacaatatgtggacggatggaaattgtcaatgtctcgtggtcgaataaaacaatcgcaaatcatttgtcgtcgtcgtcgttcacgcctcgctgctgccactcttctgttcctcgttcgtcccttccttctccccgccatttccgtcgttgtcgccctcccgtcctccgtcgtcctctttgccaacgccgtcactggcactttcctttttgtcgctgtttttgcccttttcgccatcattcgctttgaacatgcgacggcctttgcgagtgacgccggacagagagagcggcggaccatttgcactgtcgtcgccggcactgaccaccgcgggcaccgaagcgacggccgacttggctttgttgttcggctgatgggaaaaaacaaatttgacggggaatcagccgaaggcaggacacttttggacagacataacaagtccatcagaagtcaattttaatagccagcaaaatgatttgtaagagtggggacccattttaacactgaacaaaaccgcgccaacggggcgccgaaatctgccggcgatgaacatccgtccggcggaattgttggcattggccggcaacggctgactgcgcgcagtgttgttgtgttggatggcggtgcccacgcgaattccaccgggccccgacacagcggccgcttccctgcccttctcaccatcgatgacgtcgaattctacctgaattcggggatcgttgtactcccctgattctccgtgtcccaatccctcggtcgactcaaaatcagtccgactcacccgctgg

SEQ ID NO: 21157 - DNA, 1286 bp, Heterodera glycines
aaaaagagataaccctttttttgaggcccggagggaaatttgagagggcttattttatttttaatttttgaaagtccccaagttattaggattcaggccccccatggggcctgaattaacccattttcccctttgatcggttcaaaattggccggaaaaagagatacccattttttgaggcccgaaggaaatttgagagggttaatttatatgtaatattgaaaagttaagctaattagcgattcaggcgcacattggggcctgaattaagccattttcccttggatcggtacaaaattggccgaaaaagagatagccattttctgaggcccgaaggaaaattggagagggctaatttatatgtaatattcgaaagtgccaagctaattagcgattggtaactagcgtcaggcgcacattggggcctgaattaagccattttccctttgatcggtactaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtactaaattggccgaaaaagtgatagccattttctgaggcccgaaggaaaatttgagagggctaatttatat

SEQ ID NO: 21158 - DNA, 2718 bp, Heterodera glycines
atttcgttcaacatttcttttaagtctgtcatccccgcccccattatttaatttactatcaaaaaccacaaaacggccacatttttctctattttttctgttatcaatttaatcaatgtttttgggctgatattccactaattaattcactttactaacatttttttcttctcctctattttttcgtcaaaaaacattgccgccaaaagttcaattctctatcgaaactaatacagtacaacaatgcgcggtgcggaaaacattgcactaatgggaaaattgtcgctattaacaatctccacttttcactaaaaagcatttcccactcattcatcaattcattcttcatccaaagcacatagtgctctcatctcaatcgtcaaacgctccgcaattcagagccttaagcttaagcaaacaaccgcgcgaaccctatcgcctattccctcatttgtttccaaatttaattgttacatctaattattctaattttatttccccgtttcattttgcttattatttgcgctcatatttgaattttttaactcgcgctctcatttcaatcaatagaatagtcgtaagactaagagcaaagcaaaattttttttttttcaaattgtccaccccaattttcaactgaactatcatcctttggatagaaagaaacgaaaccaatggaagagcaacaagtcacaataacgggtgtagacaggacattatttcaaaatctcagtccccctcctaaaaaatgaatataattttaagaaaattaattaaatagtttctaaaatttaattaaaataaataatccattttctcttgctaagtcctgtcgaagttttactcaacattttcttccatcgaatgataggtcagaaataaataataatcagattttcggcattttatgtcttgtttgaattcgttaagttgagatcgactttatataataagttcatttgatttaatcaattgattttttctaaaattcatttttaaaatatttatcttccatttccttatgttttatttgtttatgaaaatatttaaaaaaacgctttttaattatgtatgcctttaaaactaattatttcgccattataatattattttcagagcatttaaattcactggaggaaaaagttttgtttctaggttattagttataacaattaaatttttagagaatttttttttgaattcgcagtgcttcgccctttttcaaccatccttataggtccatttaactttctatttttccgcattccttctttttttgcacaccattgttgactatattcactttttttatcgttttcctgttctgcataatgccacgaattcagttgggcaatgcacccatcactgggctttcgctgtgtgggtccttgcgaggatatttctaaattatatagttttatatcttttttaattgataacttatcaacccatcattgtgttaccctatatcaattcactttgccagtttaaattaatcgaattttaaacattaaaaaaaaaattttggctttttaatgctcttctcttatttaaatatttattatattttcactcatattcttccagttaaataaatatttatcagaatcagtcccaaacttgacttaaacattattgaatgaagagtttttttcttttgaattatattaatttcatgtatataattcaaaattatttattgtcatgaagaattttgattaaacttttttaaaattgttttattgaaagaattaagcatatcatccatattcttttttgactaatcttggtgcataagaccggttttttttattcagtattgattctttagattattttattttaataattttacataatatatttatttaaaagatacatggagttaaaaaatatataattttatccttattttaagaagaaatttaaattcttatttcgattttataaacttaaaagcatttgttggtgtcccggggctctgtgctcgtaaaccagaaatttcgtcattattttaattttttctaaataattataaagtaaagcatttaatttattttcattaataaaaataacaatgaaaaattaaacaggcggcataaaattcacaaattcatcaactccagaatttatagttctgttggcattatctaagctgcaaatagaattttttgtaaatttagccttttcaatttaaaaggtttctttttattgtaaaaatataaatgaaaaatgccgttcctcttcttcttctctttcaattcaagtcaagcttttttattttttagtttctttaacataaaagcaggcgtttgttatattatttattatattggattattaagaataattttttttcgacttcaaattgttaaaatttaatttgagcatcctttttggtagcttatttaagtgattttatttaaaaaatttgaaaaatttcagtgattgaattttgattgttgaaagtagcattttcaaattattttgaattatttaatcattaattgattaaagttgtaatatataatccaaatacatattttctttttttggaaatcaatgcattttcctttttcttcgttgcctccccccttccctcctccgcttcttttcttaaggcgtccttttcgttgttttgtgcgctgaagggcatgtcagtggtcaacaaaaaagaagaaacaaaattgattgcccatcccatttgtctttatatta

SEQ ID NO: 21159 - DNA, 2501 bp, Heterodera glycines
tcagtgaatattcatcgcacaaatttgaagcacaccttggcattgtgcattttaacataaagaatttgcaatgtgacaaaatttcggagaaatttgaagaatatgagcggggagaatgccaaaaatatcaaaaatatttgaacattttgtacgaatatttgttcagagaatacgtcggcgaagtgccaacagtggagccaaaatttgtgttacaaaagaacaaattggaaattgaaggcccaataatttatgcggtgaattgcctgaccaaaatttcgcaattgtattttgataaatacagtgcgtggaattataaaagaaaattaaacaagctcttcacttatcattttgaaccaaaattgttaaatgagcatagattgaattataatgtaaaattggtcaacgaaaaaccaaaagtgccaattaacgaaatgattttacaattggcaattgacacagcttatgggtgccaaacaaatgaaagtgtcgacggaatattccggcagaattttaacgaaattttaggggaaatgtttaaaaaagcggaacaacgggcaaaaagggaagataattatggaattttcgttacgtatgacataattgtccgatcgatttttgatgattattgtttatgggtgagtcttttaaaaacaaattgttttaattaatgccaaaattaagactgatgatgcaatttttactgaatttgtgaaaggtcaagagacaaattttgagaaattttataggatgcttaaagaatattattcaaactctgtgaaatcaaaggaattttatttacaaaaatatggggcctattttggtcttgtgtatttaatgagaaaaaattggcaatgtgccaaagttggagaggatttaaaagaaaagtgccaaaaatacaaaaaatatttgcatattttgtatgaatatttcttcagaatatctgccgaaggtttttgctttccatttaatgatcatttaattaattaataaaataattaagcaaaaaacccaaatatgacaaatcaattgccagcggtaaagcctgtttttgaatgcagtaataaatattggtattcaataatttttattattcaaattctgaatgatttttcgatatgtttttggaaaaatggcgaaaaagaatgtgagaacgcctatggaaattatgagatggaattgcaaaatgagaaagaaacaaatcatgcaattgaagaggaagaaaaaaatgggcaaaatttggagagaaaaagcaaaaaacaatcgacggaaattggcaaacttcggacagaatttgaccaaaaaatggaagaaatatatgaaaatacaaaagaaaaagaagcagaagaaaaggccaaattggaaaaagcattggccaaagtaccaaatgatttggaaattaaaaagatggaaaagaaatatgaacaaatattagccgcaagagaaattgctgcggaagaaaagtcgaaattggtaaaaaaaatggccaaattagcaattaatcgtgaaagaaaaatgatggaagatgaatttgaagaaaaatttggcgctttcaattcgtcaccatttgcataagcaaattctcgtcttattctaatccaaaaggaatttgaaacttgaaagtgattatttgagctatataattaatttacacaactccttattctaacagaacacaaacactaagtcgatatttaatttttctcttcaattaaggtctaaattttacggaggtttgttatgggctgctttctgagaataattctagcatgcttaaattatttaaaaattatttatttaatttgatttaattttgttgctttttggataattttacgattttacactccactaaatttggactttatgacacctattttcccatttttagcacctattttgggggttttttataaccaaaaactaactaagcaaaaatttaattacaccaaaattgatttttgcaaaaattactacgcagttggtggccctttaataagttattttaagagtttcttataactttttaactcccttaattacccccccccccccagttcactacgcaataaaacggaagacaaaaaatttgagaaaattcatttgattactttgatcattctgatcaaaataaattcattcatattcattgattttgtcttttattaaaaggtttaaaaaagataaacgtgataaacaattaaaaataacgaaaaatacgagatttttcaaaaaatttatgggggacaaaccataatagagcccaggagaattatttttgtacgagttgcctattgcgagagttatcaaggcacaaaaattctactaagttccctcttttctaagctaaaatggtaattacacgtaaaatcagaatgattttaatttctatttaagttaatatgtaattagcgtaacaaaaatgacaaatatacatacaatacaatttgctcgagaagaagccaagggatactgtataaaaatagtttgtatactgtacacaa

SEQ ID NO: 21160 - DNA, 1008 bp, Heterodera glycines
ctgctgcggtttaggcttctgatgagacttgaattttttaaaaattttaattatttaaacattttaccggccgagttcggtccatttttcggctttcattattcattggcactgattttgaagacatttgaataacagaaaaaagggcttttcaaaaaagtttaaaaatattttattaaaattaatttttttaaataaatattttttaataattttcatttcttaattttatattttttatactttgatcagtgtttgattcagaataattgtgctaaattcttaagattataatgaaatgcttcacaattttcaatttttaattccgttaaattttttaaaaatgaatttatttccacgaattctccgcaaaatgaaattttcttggcatgacgaagagtcccccccccgtgtgccgttcttctgccgcttttcctcgtgctgaggtgtcacggacattcggcaaattaaatttgcggcttctgcagcagctgatgagtgcccggcgggaggagaagccgcccgcgaagaatctttcagcctaatgaagttgagctgaactacggacaacttcccgttcgccgcgtgcccccgggggatgccaaaatcggccgcaccgacgacgacgacaatggcacggcacggcgaaggaggaagagggacacaacaccaacaaaacatggaaccaaaaaaaagccaaaattggaatttgaaattagcgaaaatggcgcaaaaagttggaattataagggattattaaattgaaagaaattttggagaaaaaaattaaaagtaagggaaaaaggtaaatttacaaaaagtaatttagaaaaaaagaaaacttcggattagtaaataaaattggctttttatattttgaaaaagttaaaacatttcgaaattcccaacaaattttgcgtttgaaatttgccaaaagcataaaacttttggtatttttctctcgtggattagcaactcaaaaattctcacttttgagatttgtttatt

SEQ ID NO: 21161 - DNA, 871 bp, Heterodera glycines
taatgtgagaagggcccataggtttgcaaatgggcttttcatggattgccctcggtgagaggggggggggggggggagaggcattagggcgctctcgagtctcggtcttgagagacggggtcaaccatcggtgctagaaaatttgactctcgagcagagaggcacatgcatggaagcataatgccgaaatagttcattcaaatttcaattgagcatttctgcattagcggctattttggccaaaactgtatgctgccgatttggataatttgatttaagacagcaacctaaaccggtgatcgattaccaagctcaagagtgatgccataaccgttcacgacctaaacaaacccaaatttaaagattttgagatctttttttttcaaaattagaatgccaaagacaattccgctgatgaatgatcatcgcctattcaatcacaaccatgtgatcgatcaatcgatagatcagctcttctggactttggtcgggatcagtccggcgccaattttgacccccacacctacgtatctttgcgccgtccaccaccagaatggcgggcatgccgcgcaccatatcgccccacagctaagtccaccgaacatttggggccgtcccgcgcatagtgaccacccgaaatgcgagcagtccctggccatgtagacagtgctcgaccaaatgacgcactgtgcaataacatggaaaaaataaacaaaacgacacgaaattgttcccaaaaaagcgtgatttaaattacatttgacatgaagtgatcataatttcagatcaacacatttcaataagtgaccgccacaaaatactgtagaacaaaatatagtcaaataatttttgcttttttgaaatttaaaaa

SEQ ID NO: 21162 - DNA, 1443 bp, Heterodera glycines
tgaccaaaagcgaagtgagttatgaatttcaaaattttcactggattttccggggctcaaattttgacgatttttcaaaatttttttaccaccctccgaaaaatccaaaacgcaatataaagtgcatattcgtgttcagcacctcaaattatgccataaaaatgcattttggctaatttaagagtaaaaaattttttcatgaaatgcaaaaccatggggtcccccctatggttttgagtttcaaaatcacaattaattttataactttttttaaactcatggtaaaaacatgagataaagcatattatattgggcttaaaattctctacaaaaatgctctaagacaaatttccgctaaaatcaacgcctgacgagttataagccttgaacggaaatggggagctcaattccggaaaatttttctatttccggaaaattttgaaattttttcaaaaatgccaccaatcgatagagctcgaaaaacggttgcttgaaagtggtctccgttttcctgggaaaaatcggcaaaaaataataaaattcaaaggcgcgaacccgctccgcttaacccccagcgagttattcacgaaaagccaaaaccggcattttgagcgccgttcagtcgccaatttctacaggctcggcatttgatctgatcaaaaagtgatcagtgacaaagttgtagccaacatgtctggggtgtgccctctcagcggactttttccgctcccggttccctgagaaaagttacagcccgaaaaccgcgacgattttttttagttggccgtttcagcgccgctggcgctcagttggcctccggactggaatttccttatttttcccagatgcgcaatcaaaagttacccctgcctgcaaaatttcagccccctccgggcaaaccacggggacttataattttttctacgagttgcaccttttctctatatatagtagaaactagcgggtgcgtgaaccgtcggctatttagctgggaaaaagcgcttcgcgcttcttgagcttcgctacctagatttgatcgaattggttggagagatttttttgaatttttaaaaaattattaggggtttttagtccacatcgaggctcaagacgggcgtttcgcgcccgtttttaaatttgttggccttggacgggcgcttcgcgcccgttatttaaagtttgttgattcatacgggcgcttcgcgcccgttattcaaattttgttggccttacagagattagaagaggtacaacagtgactaaaagaggtacaacggtaattagaagaggtacaacagtgattagaagaggtgcaacagtgattaaaagaggtacaacagagattaagaaaggtaaaacagtgattagaagagatacaacagtgattagaagaggtacaacagtaagagaagaggtacaagagtgatagaagaggtgcaacag

SEQ ID NO: 21163 - DNA, 2225 bp, Heterodera glycines
  misc_feature (138)..(138): n is a, c, g, or t
attgcccatatgcaggaagaaatgcggcgccttgtgccgaaattccagtgacgaagaaagttttggtcatcccattacggtcgtgtagggtggtgcgcactttgcgtccaatgatgtgtttcagcacaagcggcgatncctctgggtgttgagccggtcgcgcaatgactggactgatttttggataattataatgtattcaaactactatatataattcaaattgttgtatcactttggtaaatccaataatatttttctttgggttttttaattagtcatattttttttaatttgtcaaatattttttgaattaaatttaatctaaatttctaaattcattgtttaactgctaaaaatttgaaaatttttaggacctaaattgcttaattgtcaggattaggatttatataagatttgcggcttaaattgggaatattttggttggctgattttgatagattaataaatatttgatgatctaattagaaaaataggcattgcatatatttgtgtaaatttccttttttgtgatacttttatttaatttattaataaataattactagggatgtcaaaaatatgtataaaaagtggtcaaaatatgtaaataaatatgtttaaaaaaatacgaaatattgtagaaatagtcaaaaatgtaccagatatgtaaataaaatttttttttaaatgtttatttggtttttgtatctcttttttttggaaaagaaccgatttttagtggtatattttcaatatattatttaaagaaggaatttccctaaatttcaaaacatgtaaaaaatgaataagtagttatggcccggggcccgtctgaggggttggggtggtgtgaaaacatgtgttttcacacctttgagagggtgtgaaaacatctgttaccggtaggtgtccgggaccgttttcgcgcaaaattttcgcgcattttttcggtgtactgcatttaatttttttttaaacctaaaggtgtggggcgtttattttaccgcacttttcctcatactttatttttttaataaattttttttcgtcattatactgtaattttttgttaataaatatttctccatttcggtggcgttggctgttggtcagtgaacaaaggggggggggggtggtggtgatggtgccaagcgaaaacttttccctattcttctgccatctgtgcgccgatgggtgtggaaagcgaaatggtgaagtggacggagtctgtgtatgagttctctccgtccttctctctttctttttctctcattcgtctcgaaacaaatttgccgtctcttcgttttgcatttctctgcgttgaataagcggacggatcggcgctttgccggaggtgggcaattgacaaaagttgtgaataaaattatggctgacaaaaggcggcaatgtctgacacaaagatggaaattgtaaaaaaagggggggggggggcggaatggccagaggggatggactgatcatctgcatctcctttcattatttgaccatccgacaatcatttctccatagcatttttgtgggaatggccaaggggttgaaatcgctaggaattttcctttttttttgaatttcctcaccatttttttttggcaatctgatcaacaatgagctccattcgccgtcccacgaacatgacgtggatcgtcgaggagcggtgttcctgcctccgggcggatgcggtctgcatccgtccggaggagttcactaaaccgatagagtgtttgaacaccgctcatttgggctcattctccgaacacttgttggcggcgccctgcaacgccaacgtctcgatcaatctcaccgacgtggtgcaccagtttaacaatgccaacattgccagagcgacgggatgtgtgaacagcatggtcttcatcttctttctcttcatcttcctcgcccaggtggatttaattttgaattttaatttaataaacgaagcagtacaggaagaggaactcggctcgattgccgggacagaggccgaagaagttctgcctggggagaacaacaatgctccccgaggcttgagcggaaatgagggagaaaaaagattgggagctgaagaagtcgcgcaagacgaagcagaggaagtggcgcttccaccgagttcagttcaagacgaagtcgggagcacctctcccgagtcgcagtcaaatgaccagatattggaaactagagaccggacgggcccgggggtccgg

SEQ ID NO: 21164 - DNA, 1516 bp, Heterodera glycines
  misc_feature (1459)..(1459): n is a, c, g, or t
ccctcaaaaggggggctttatttcagaggggggtctaattcagggggggggggcttaccctcaaaaggggggctttatttcagaggggggtctaattcaggggggggcttaccctcaaaaggggggctttatttcagagagtggctctaattcagggggggggcttaccctcaaaaggggggctttatttcagaggggggctctaattcaggggggggctttattattcaacccccctcaagagggaggctttagttcagaggggggtctaattctagggggggggattgatttttcaacccctctcaaaaagggggctttatttcataggggggtctaattctggggggggggcttaccctcttcaggccggattaatacccgagggggattcgaatacagggggggcggatgccccccggaggggcccctacattacaaaggcaggatttaaagcaaagctcgggaggtttaattcaaaaaattagtccttaatgattttgaaatagatttatatgtagttgtcctatgtagactggtcgaatgactgagaaaagatattgtaaaaaagaaaaattataaccattaaacattcaaaaatgcaaaagtaatctaagaccattaaaaaatttcattcaaataaaataaaagaattaaataaaaaattgaaaaaatataataaataattcaaatttatttatcaaagcaaataatttgtaaatgaaatatataataccaacccgtaaagtggtcagtacgataaacttcattttccaagaagaaataaatctaaaaataaatcctggcagccaaaaagcttgaaaattaatggatattttaattgaaaaaaggattactaatattttaaatattttaccttaaaaagaaattttatatgatttccaataaatacgaaattattttttcttagcttaaatttgaagaaacaatttaatttatgctgaaattagaagattaaataacttttaaataaaatacctaaatattaataaatatgctttaaatatgaaatgattatcaagataatttctaaagtattaaatcataattgattttacataatgattgctagcactcatattattagaaaaagcgacataaaaaaatgccataaaacagccgaaatatgccttttaaaaacaaataaaccaagaatacacctcctaataatctaggtttcaaattttcaaaaatgcatatatgaaaaattacctttttcataaaaattgttaaaatataaattcaccccccccccaatttcttaaatttattttagaggatgtgcaaggctttgaaatgaccaaaatgatttttcaagcaaaactaattgtatagaataaaagaaaggaaaagtaaaataattataaaattagacaaagtaatatactaaaataatataaagaatattaaattctaaattgttaaaatgagaaataanccaacttctatttccactacggaaataaaaatgaacaattaatcatagaatatatga

SEQ ID NO: 21165 - DNA, 2983 bp, Heterodera glycines
tcattttttcacttgaaatttctttgtaaacgctattttttaatttttgttagtggagtaaattgattttgtccccaaaattttgggtgtaaaaccgtgcctgaaattcagcagtgccatgtgcgtgttgcccaatttgcggttgacccggcccagcaggaagaacacgtgcgcctcgtcgggcgacaaaacgcggagctcctccaactcggccctggccgcctcgtacttgccaatgtcaaagagtagcctggcctaatgtgaaggcatttaaaaaagaattgaaactggcacgacaaaagcggtgggggtcgattgggccccgccggttgggccccggtacgattgggcccgccagttgggccccatgggcagtcaccttttcttcgttccagtgtttaaaaaattgaaattgttcctaatttattaagtattaaattcaacctatttatctgataatttcgagaacatcgataaaattcataatgttaaaccggtgggggtcgactgggcgccgccgactaggcgacgccaactgggcgacgccgactgggcgccagcccaactgggcgccaatcccatacaaattatttccatttatattatcaaattttttagatttatacaacaggcacattgcatttaattttgtttaattcattatatttatttttgatgtattactaattactagggaagcaacttttagtgacgaaaaatcccgaaacagttaactaaaatagtgagtaaaaatgccaaaatagtgaaaaaagtccaaacgtctgcactgcagacgagagaattttgagactgacacggaattttaacccactgaacattaggaatttttgactggtgtttctcgaaattaccatatgcatgcttagaattttatgaataaatttttggggatgataaatttttcattacatatgaaaaaattcactctgagtcagcagcttcaaaattttttggtctgcacctaaatacttcttacattcagcggtggggattaatggtaattcttacaatgacagttcgttcagtattttttttttgtagctcaattggttaaattcatattttggaggcccgggttcgaacccaacatgaaaataaatacattttaattaatgtgtaaccaaagttaacgattaaaaaccacgttttatttttaaaaataatttttctttagtgaaagtaaatcaaaagccgaccaaaaaagtgactgccccatggggcccaactggcggggcccaatcgacccggtccgcgacaaaagacataaatggtatacataaaaaaaaagttacgaaattttttccattgaccccaaaatggccaaagccatttttagcgaaaatgactacaaatgtgccagttttcccggattctgagagacaacaaatggttgtggccacgaattgggaacgcactttgtgaaagcggcacggcacattgttgggcgaatgtttgagcgcactctcgagatattgcatggcctgaaaaatcaaatggttatggtgtcaattaagtttttcaaattttgttcgggaccgcgtccgtgttgtgcagcgcctgttcaatgacggccaattggcacagcagcacgttgttgttcgggttgatgcccaccgcacgtaacaaattcatccgagccatttgcaactgttcttcctaaacatttaattgtcaaaaagtggtggcatttggtatgaacatacagtatttgtagtactgctgctaatacacagtaagaaacccagaaaaaatggaggaaaacaaaggaaatttttttaaacccctcccaggggcgacggtggggggggggaagcagttcactcattctcctcagaaattgtaaaattttaaataaaatttgggaatcaagcggaaaagatactaaaattcgtaactttttttctgattcaccttgaaattgaccaggccgagtccgtaccaagccctgtagtcgttgggcgagaattggaccgcctttcgaaatgcttgcgccgcacggccaaagtcgttcatgtcgatgagctcgtggcccagcagagagtaggcataggcaaaacggtggtcaagacggattgatcgctccagacactcttttaacggcggaatttttacaaaaaggcaaaatgtgcatttttggagggaaagtttaacgactgccgccatcaacaattttaaaaaataattcaaaaatagtacctaatcacttctacgtaatcccggaccttttaaatggattgtaccgattccgagtttaaaacactggaacccatttcgtaggccaaacattttttcgggattgggaattaaattaaagtggaaaatgtccccattggaaaggggtctatcgaaatatggcgggtaatgtctgcaaaacaaccaaccaattgctgtctcgtgctgtttctcgacactgaaattggggaagggcaaatgccgaattaattttcatttaatttgttgttttgcgtgtgcccacctgaagcagttggccgcgatgcaccacgtttgcggttggttgcgcgcaatttcggccatttttgacgccagggcggacaactttttggagtcgtgcagttgccacagcgcggtgctgtaaatttccatgccattcaaatggcgggggtaaagacgacgaatttcctcgaacacctaaaaagtgaacaattatataatttcattattttcaatttcggaaaattttgtccttgcgggcttttcatattttttttaatggtaaaattgaaaaattattacaaaaattatttcaatgaatccttcttctcccccgcggcaaaagttaaaaaaagggagggtggttggtttttgtccaaaacgagccgaatttaatggttttgagcaattttttttataaaatttaatttttaaagattggcggtgcctgtaagcgcggtccagtggaatttgaataaattttcataaaaaaccctaaagacctgccagc

SEQ ID NO: 21166 - DNA, 1370 bp, Heterodera glycines
agtaaaagggcacttattcatgcgagttaccctgtgcgcaaaaaatatgaattcgaattcgagggaattattggtggaaataattattagacgttgacaatttttgcggcattatactataataaaaaagataagcagtttaatatgcttttcagattgaacgcaaaaggggccaccccgccgctttgcactcggacatcggattcaacgagcccggccaactcaacgatggtccgttgtgcaagtgctcctgggcttcaaaacagtcgggcataagacacgacaaattcgtgggggagcaatttgtggccaaatgtcagcagaattcgaggtccttttttcttaatttcaattttcttcatctgattgtgagacgattgtttcagttccatcgaaacgctttaccattacgttttggtcgtcgacccgtcgccctgcgctttttcgagacggccgaccgccattcaatacgacggacattcctacgaattcgaagggttctccattttctttcaccggcctttgccccgaacactttccccagacaccaattaatcagtggacgaatgactttcagttgaggctggtcaaagagaatatgcctgaagtgaacttctacccattaataatattaaactaattccttttttcttttaatttattgcttttcaaaggcgaaagcaaaaaaaaaaacttaaatttcagagtttcacagtcgatgatctcgagcttttctacgagtttttatttgaagaagtattggaactgtacgatctcaaccgtttttcaactgacaaacattctgtcgatgacccaaagaaagaagagaatgaaaacttgggctgtcctttttatcactgtatgcccagatttgcccgaaaattgccaggtttgaatttactcttaccattagaaaatgtcacaattcctttggtcagatgatggcaaagaattgcttccgatgtccgccgttctcacccattttactcgcgaattttcacctttggtcgatgacaatatggccaattacttttgcagagacaaaacggcattcatcgaatttgcattgcaaaagaagggccaaatttgtctaaacccatctaaggttgaagtgtttgttggtggaactttacgtgggaatttgctctcttcagcgtccaatggcgctcagagtggacatgatcgacgggtacaattcggacccgacaaaccgcgacttttacccaattttggtccatttcggcgtcaaaccgactgcttatgcctttatgaagcggccacagtggggcaaaaagaaaatgaaacttttttaagctcaaattgtacattttcgcagataccaagaggcactgaaaaaacacatcaaattt

SEQ ID NO: 21167 - DNA, 1605 bp, Heterodera glycines
  misc_feature (16)..(16): n is a, c, g, or t
  misc_feature (34)..(34): n is a, c, g, or t
aaggtggcactccctntacggcattttggcgttntatgcttccaatggcaaattcatttcagactcgagtttctcggtgatgccgttgtggagtttttgaccactattcacttgttcttcctcttcagcgatctcgacgaaggcgggattggccacttttcgttcggcattggtaaaggaaataattttcaaaggaattgtggctagcaaaaaatttgatttaatgttaggttcaaaatcgacacttggccactttggctgatcgttttgagcttcacaaattcatggtctattcacatggccccgatctttgtcatgaggccgatttgcgacacgcaatggcaaatgccttcgaagcgctaatggctgcaatgtttttggattcaaatttggaggaatgtgacaggtaaaattaacgaaaaataacgagaatgttgatgatttcatatttttaaattctcatttaagtgatttctaatactatatataaataaattgctaagtttagggtcttttcaaatgttttgttcaaagatgataaattattgagaaacatttgggtcgctcttcctgaacatccgcttaaagtcagtttgatcactcattttaaattgaaatgtttttagcgtaacaatcccttcggtgatcgtcatttgattgaaaaagtacaatgtctgcaactgcttgccaactttgaggaatcaattggcgttcgttttaaacatatccgtcttctagcgaaggcattcactaggcgcaatgtgccgtacaactatttgactctgtaaatggcgttttaatttttcgggtttctaccttaacattgttctaattaatttcagtggaaacaaccaacgccttgaatttctcggtgacaccgttttgcaggttttctgtccattttcgttggttttactcgttccctccgttgtcattagctgctgaccaccgaatatctctacaaacacttcccgcttcaccaggaggggcacctctctctgctcaggacttgtttggtcagcaacaaaacgcagtctttggtttgcgacgagttggacatgacgcgcttcttagtcatccccgaggtgctttttatacaaaatttgtactgtacaacaaataatttcaatttaggcactactcagaaagggcactctcgcgcagctgagactcaaggacaaagcggacttggtaagatttaataaaattcaaaaatagccatttaaacgattttcccgcagaatgaagcatttgtcggtgccctttacgtcgatcgtggcctgatttattgtcgccaattctgtcgtagctgttttttcccccgactcaaagtatggaaaaggaactgaaaaatcactactcgcgatcattcgaacattttttaatcacaaaattctaattgcgcctccttcccacgcagtatttcatcatgacccaacgatggaatgaccccaagtcgcagctgcagcagtgctgtctcgcactcagagagtgcggcagtggcgacccggacattccggaatacaaaacgattggtgtcgaagggcccacaaacacacggatttaccgagttgctgtgtatttcaggttaacactggaaaaaat

SEQ ID NO: 21168 - DNA, 1297 bp, Heterodera glycines
  misc_feature (1285)..(1286): n is a, c, g, or t
ttaacccttgttaaaatatttttttagaaaaacaaaggcaaagaatgacgcccgatggtaaacccacctttaaatttttagaaatttttaaaaagatgtggaaattttttttaaggggtttaagggatcgctgaacacgaatgcagtacctatttcatccgccaattcaatcccaggtccgaatttgaacaaagggggtagaatctttaatttttcaaataacacatttgtggttcaagcgcgcttaggtaaatacagggaatcagactgaaagtcagcgacggagttcgaataggtcgaaatggaagccggattgtggtcagagaccctggaagcatgttttcatgactttggaagcaaatacaatttttcagaaaaagggggcaactatcggcagtattaccattacccctcatccccatcttttttttcaaaaaataaattatataaaattaaggaccacttgtgcacaaaattaagttggctcagttggagactttggtggactcactttgtgccaatatggtgagccaaaatgagcaattgcgcgacgtcagctccatcgctctgaagacggtgctcaatgaacttccaagtggatccataaccactcaaatgtttctttgtgtgagacgggtcattccgaagctcatcgaaacactcagtaagtaattacaaatgtcatttaaaagaatctatgttaagacgtgtctttttgaataattaaaatgttttttatgccaagtttattaacaattacgagaaaagcgctacttgtaaattcgtgtcttaaattttattaaacccaaggggagtgattttacgtgaaaacttattccctggcttatcgtggtcgcagatctcgaacctaacatcatttttgtaccaaatcctaatcactataagccgaactcgaacaaaaagtcgaaattcaaatttttagaacttgaatttttgctcaaatttaggttagggatttggaattgtgaacttgatgctgggtttgtgatcattgatcccgaaaaactccaggatcaagttttcatgacaaaattttccaaccaccctttgattttaataaaattcaaaaagtaccaatttgcaatcagcgcccaataaaatttatatattaagaaactgactacaaaggcagctcttctgttaaacttgaagttttggacattcttggctctcttattttgcgttacgggcggacatttaatttaatgtttgacgaggtatattttttgctctttgaaaaatacgattaattaccatgccatannataataattgc

SEQ ID NO: 21169 - DNA, 617 bp, Heterodera glycines
  misc_feature (31)..(32): n is a, c, g, or t
  misc_feature (517)..(517): n is a, c, g, or t
  misc_feature (524)..(524): n is a, c, g, or t
tttgagcaaaattcgtaaagacgaattagcnnaagagcaaaaagcagtctttgcgaagctacaaaaacaagataagcatcacaaaaagcacatttgagaatgaatgacggttttatcaaaatcattgtaattatatttaactaaaatgattcaatgttctgaaaataccttctcccatttcacttccgtcgctaatgcgcgcgcttcaaaaacatttgacgatcaaaaacatgagaacacgcattagtgccttcactgttctctcgcaccttgtcaggtatttactgattgatcaatgagataatgattgcttgtttcagaactttcccaggaattatgaacgattacttgggcaccattactacaaacatcacaaaaactttgactgacagtgcggcggacggaactatgaaaattgaaattttgcgtttcatttcgctgttgttgaacacccacgaacctgaggtagaaagccattcggtggttggcataaattgatagaggggtcttagtttcnctaaatnccctcccaagctttttagtgtttcattttcttcaataatttctacccgtgaaggtaaggtcccaggactactctgctatcgtttattttgggg

SEQ ID NO: 21170 - DNA, 1022 bp, Heterodera glycines
aaacatataatacagggaagaaaggataaaaaggaaaattaatggttaaatgaagtttaaataaaaattatcaaaaaaatttccaaatttatccccaatttttatcatcttctttggctcgttcctgaagaagtgtctggcacatctggtatgcgacttcttcgtcgttcctcgggtcggtgatgtcccaggtgagatgttggccacaaaatctgtcgaagtttcctctgttgatgtgttgcatgacctgtctgtaggcgagccgtggccgcatcggtcgacggatgactgctccgtttctgtcgtgttcaggttgaagaagctgctcgtagtgccgcctagaaaaccgataaatttttatcgattctgacgaattcataccaagccctggccacaaaatcgtcgtcctgccgttgtgtcgagatcggctggttgttcaagccctcagcgtactcgttgaatgcccgcaggtgatcatccgtttggtcccttaagttcttgatttgtaacagtttatgagtcgtctcatacatcaaaggacggattcgaacatcccgcctgcagactgggcacgtgcgatttgtcgccagccacctcctgatgcatatcgtgtggaaggtgtggctgacggacctttcacaaggcagaacgctgatcagctgtccacgcagaagctgcaggtggcaaatgaggcacacgctgtccgttctctggtgtcttccttcctcccttcttcccaaaatacgcatgttcacagaggtgaagtgcggatgtgaaccgggtccttatgaagacaaatcttacaaaatttttcactttcggctacctctgttgtcgtcgcctttgttagctggcgtcatctcaccaacatagtcggcctcttggaagttcaagcgccgatctatgacctctctcgcgcgaattgcctctgacggcatctgcgccactcccacttcttgcatgatgggcattctgtcggcttgacgacattgtagaacaggtcttcatccgaccacccctct

SEQ ID NO: 21171 - DNA, 944 bp, Heterodera glycines
accccgcgatgtgctaagcaatagatgtctctgccgctcctcatccaaggcacgctttcgccgctcgagaatctgctgatgttcctttattgctttttgcacatcaagttcagcgtgatgattagcatagcgaatgatgtcagcgcaatatgcttcaacagcttggcgagttggcagaactaaattttttgcactatttgaccttaatgttttttttacaaacataggttaatttctgtgaagtttatcgactcgcgtgcagatttccgtagagcgttgacgtcagccttgagcttctccaaccgctcattgatgtatcgctcgtatgcggcgtgcctgccccagaccagattccgctgcttaagcctcttctgctggtcaaggtgctgcttgaggaattggtcggcttggcgcaatcgatcttgtactcggcgatctgctgccatgcgcttctgggcctcgattctctccgcctccaacgcctttgcttgttcagccgtcatcagaatcgggcgttgcattcgttgttctgctgcctgagcggccttagcccgtcgcttccgcttgtctcacacgtcgccgatttgtcctcatttcgtcgttttttgccgatggaattggcccgcggtctttgttcttcgtctgttgtcttttgagcttcttcctgcgttcgtatgactgcttccaactggaaatgtttttgacgcaggtcttcaaaaacatggtcgagcagggggtgccgttcaacccgtacagccttcttttttgacctcttacgcacaagccttaatagttaaataatttttttttgtagcacattaatatctctactttagctttgcttggaggaggtctgttagttggccaacggacataaagctctttgtcatcttcgccttattgcacttcttcacacaacttttgatgttttcgttgatgagggc

SEQ ID NO: 21172 - DNA, 2035 bp, Heterodera glycines
  misc_feature (2013)..(2013): n is a, c, g, or t
aaagtccaaccatttctcattgcttttatttttcgttctgatttatgcccatattttccatggcattccctttacgtataaaatttcacttttgcgttcgctcccatgaacttttcgtgcaaattccgacaattcttatctgatcagcagacgaaacattctgatcaacttgctcatcaaactcattcattttcttcgcttaattgttccaattcaatttttggcacctttaattttgtcactaaattattatttgttcctccaaagttttttctttttttaatattttgcgacaagtttgactttgtgtcttccatttcgtctttattggccttttaaaattgattccaaatttaattatttttttcttgataaaattttttgggtttaaaaattttccttattcaaaaaaaactttaacaattgaaaaataaccaaaataagtgtggattaagtttttatgtgttttgctacttaaaaacgttaataaaaaattttatttgcctatttttgtgcctaaaaaatgaagcgcattgattacagttgcaaataattgtatatattcgaaatttttgaatacatttttccaaaataaataaatttcaaatcaaaattttggtcaagaaaaaaaacaaatttagtggaaaaatttttgaaaatttttgaataagtcgccaaatgtgatcgcgtaaaaaaagtttttttcattgcatttttgttaaagaatttgtgaattttacatgaaaaaatttaaaaatctagaaataagggcgaaaataaggacgaaatgccaaaatatgggcaaacacttattttaagggcgaacatctaaaataaggatttcaaagggcgaataagggcgataaaacgcaaaattttcgaacaaaaaatgcaggccaggtcgttttcgcgccagccagtttttgaactataatttttttaatttaaacgtagttatactttttctgtctgccttttggctttgaatactgcggaaaaataggaattttctcttttcactaatagaggacaatttttggcctttcttgattagctaataattttgaaaattactcaccaattaaaatatacttgcatttttcaaaagaggtattcataattttaaaataagcacatatttatagtgagactgttttcaactcgcttctattattaaagggttaaaagatgcgcataaaggccttaattaaacacaagaacatattcacatattttgtgtaattctatctcggactccctcctgctcaaaataatgagtttaatgtaaaatagatttgactagcggatactactaaattattttaaaattttcatctcttaattattttcatttaaaagtagttatactttttctgtctgcagctgtttgactttgaatactgcggagtaaaaataggaattttttcttttcactaattgaggacaatttttgtcctttcttgattagctaataattttgaaaattactcaccaattacaatatacttgcatttttcaaaagacgtattcataattttaaaataagcacatatttatagtgagactgttttcaactcgcttctattattaaagggttaaaagatgcgcataaaggccttaattaaacacaagaacatattcacatattttgtgtaattctatctcggactccctcctgctcaaaataatgagtttattgtaaaatagatttgactagcggatactactaaattattttaaaattttcatctcttaattattttcatttaaaagtagttatactttttctgtctgcagctgtttgactttgaatactgcggagtaaaaataggaattttttcttttcactaattgaggacaatttttgtcctttcttgattagctaataattttgaaaattactcaccaattacaatatacttgcatttttcaaaagacgtattcataattttaaaataagcacatatttatagtgagactgtctttcactcgcttctattattttaagggtanagatgcgcataaaggccttaat

SEQ ID NO: 21173 - DNA, 1111 bp, Heterodera glycines
attttcagcgtccttaaattattgtctctgccgctgttttcgtttcgattggtttcatttggagactctttttggcactttccgtctgcacatcttttgtcgtcattgtggtggaccttggccttatagttgcccgttttcgaagccatttgcgacaaaattctttccgaaacaccgggcttaattaattaactaattagtataatcaaaccaaaatgattaaatggttgtacaattaccttatcattgagtaaaggatgaaattgagcgcaaaattggcacagaataaaaagtaactgccgacaacgaaccaatagtgatgctcgagaaaaatattctgacttttgttcgtttggaagaatttgagaaagtttttgaggttgtacatgaaattgaaaaggacgtaaacgaaagggacgacggccaacaaaacattggtggcacgcatttcgccggggcccgtctcgccttaaagttttgttgtaattaaaatttgaaaattggaatttttagttaatttgtttactaaatgtatcaattagcgttttcacagtgcgtcactggaaaatgggtcagtgaatcagaatatcttggaaaaaacgagacccggtagtataatacttatatcttgattggtatgtaaacaagcttacaacaacctatttacagtataatttttttagggattgggtaaatttcaaatttctttagactttaaagaaacttaattgaaaaaattcagaacgaagtttttaaacaatttcgaccttttataaatgctacagtactttaatttagaaatactgtattattgacttatttttccggtaacttacaataatttctatgtcattaaaatgtgtttaagataagttttcaagtccatttacacttacaaatttgcatttttattttttgtctgtttatttttcaaaatttgcttctgcccaccgattatcacataacgcgagcggagtttgataattatgaaatggtaacgacaattactacgacgaaagggaaaataaattgggacaaaagccttggaaaaaggaaaatccccttaacttgaaatttgaaaaataaaataaatttattttttttaaatttt

SEQ ID NO: 21174 - DNA, 625 bp, Heterodera glycines
agagctctttttacggcgcgcttgtcggcaccaccaattaattggcctaaaaccgcgaatttggaaaaaaatagtaaacaaattttcaaaaattcaccaatttttattaattaaacaatttctttgaaaatcccccaatacgctcgtccctctctttttttttaaatcacagccaacagagatcccatcaattaccatttataatacttttctacacccgaaatttttaatgaaaaaatggtatttttgcttaataaattttttttaaatgggtcgttgccggcccgggttcatgcggaacccctgaaatcgtccctgcattcgtgctaaaattttagtaaataggcttaaaaaaattatattttttttatgaataggcctaattttgaaaaattaactgaaaattattgactctaaagaaagagcaaaaaaaaaagaatgcaaagtcattaacaatctggcgaaaaaatataaattttcaaaaaagttttatgggtgatccctatttttgaaaaattttcaacgtttttttccaaaatattatgatgattagtagaaagcataaaaaaatttgggggaaacgacctgctccgatattttattgcttaattcctaacaaagattg

SEQ ID NO: 21175 - DNA, 1091 bp, Heterodera glycines
  misc_feature (13)..(13): n is a, c, g, or t
aacatcctaaaanatatctttttataaaaatattcctttgcaaagaattcaaaaccgactcccttttgccatttgattgataattttattgcaatatttacaaattaattttctccttttcgtactaattcgaattttaaaattttgttgccgtaataaccgactaccacgacgcgtcaccaatttattttagaatctgatgataaaatcaatgcgatataaatgattgggttttaactctaagccgttcgattaaatgcctacttcgaatatttgactgttataggcaaaggatttctaagaaaagaatattgtacggttcccaaagagcatgtattaatgacggaaaatcctcagaaaattactgagtcgcttcaatgtccaaacatcctaaaaatatctttttataaaaatattcattagcaaagaattcaaaaccgactcccttttgccatttgattgataattttattgcaatatttacaaattaattttctccttttcgtactaattcgaattttaaaattttgttgccgtaataaccgactaccacgacgcgtcaccaatttattttagaatctgatgataaaatcaatgcgatataaatgattgggttttaactctaagccgttcgattaaatgcctacttcgaatatttgactgttataggcaaaggatttctaagaaaagaatattgtacggttcccaaagagcatgtattaatgacggaaaatcctcagaaaattactgagtcgcttcaatgtccaaacatcctaaaaatatctttttataaaaatattcattagcaaagaattcaaaaccgactcccttttgccatttgattgataattttattgcaatatttacaaattaattttctccttttcgtactaattcgaattttaaaattttgttgccgtaataaccgactaccacgacgcgtcaccaatttattttagaatctgatgataaaatcaatgcgatataaatgattgggttttaactctaagccgttcgattaaatgcctacttcgaatatttgactgttataggcaaaggatttctaagaaaataatattgtacggtcccaa

SEQ ID NO: 21176 - DNA, 1505 bp, Heterodera glycines
tgtaaaaaatattacgcaagaaattatttttagatcctttttagaaatgctgcataaatttttatgttaaatagtcacaaaaaaaacttttttttactcccaatatctaccagttatcatacaaaaaggcaatagttaagctttgagatataaaaaaatcgtctagaataattatctcaacaatttgtcgggaaagttgaataaatttcagttgcaataggcatattggcacaatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaaattcacaaaaatttggcaccggaaaaactccatttttttatgggccagcataataaagtaaacccaaaatgtaagtgaatttaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcaagaaattatttttacatcctttttagaaatgctgcataaatttttattgtaaatagtcacaaacaaactttttttcactcccaatatctaccagttatcatacaaaaaggcaatagttaagcactgagatataaaaaaatcgtctagaataattatctaaacaatttgtcgggaaagctgtataaattctgggaaaaaacttttcaagaaaagctgaaaaattttcaatcgcatcagaagcagcctcaaattcttcaacaacataatgtaaaaaatattacgcaagaaattatttttagatcctttttagaaatgctgcataaatttttattgtaaatagtcacaaaaaaacttttttttactcccaatatctaccagttatcatacaaaaaggcaatagttaagctttgagatataaaaaaatcgtctagaataattatctcaacaatttgtcgggaaagttgaataaatttcagttgcaataggcatattggcacaatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaataacacaaaatttggtttcatttgcccccaaacagatccgcttatgacgggccgaaagaaaattcacaaaaatttggtaccggaaaaactccatttttttatgggccagcataataaagttaacccataatgtaagggaatgtaaattggtcatgcgagatgt

SEQ ID NO: 21177 - DNA, 1115 bp, Heterodera glycines
  misc_feature (17)..(17): n is a, c, g, or t
aaaacttttaaaaattntggcaaaaccgacaatgacatagaatttgtttaacattatggacggaaaagaattcatgtcacaattcaatttaatatggaggaatccatggtcagaatcaaacaaagttcatttgattagaaagaaaataggtaataaaaaataataattaataaatttaaattattgaagggaataaatcattcatttcaattttttttcaccaaagttgtaattttttttgttttctaaccattccaaatgtgctagaaaattttaaactgcaaaattgaaattttagatgtaacttccatctttaatcattaaattttgatttaattataccaatgctataaaagaattattatactttttattaaaggaaaaaatgccagctcatattgtgtcaataaccttggcataatttttgatgaacaaatgaaaaaactcaaaaacggcacacctatctctttggaaccaaaatgtaaccgacgattacatctacaagttttttggcaattgcgttggacattggaaaaaatgccagagtttacttcgatttcagcccaaaaaaagaatgcgatcgcttttctggacggatgtataaaagttcttcgttacacagaatgaatttttcacaacaattggaaaattcaaaaaaaaaactcactgaacataataactaaaactcggaaatatttggatataaaggccctttaataagctgggggctgtttaaattgggaatttttttttgcaaaatgcctaaatatggacatattataaaatttgaacaatgccaaaatatggaaaacatttaaaatatggacataaatcgcgaaatatggaaaagatggatatgaaacataacccctaaagcttcaaaccaagctaaaaatatgttttcatgcatttctggccacttagtccaggatattgaatttccatataattccgagccctatttataaacaaaaaaggatcaattaaaaattattggtatatttgattaatttatctcctgggctatttcatgaaccatagaaagttttcataatttaaacgcttctttgacgaacattcatattaaaaaattttgattttttgacttctaagag

SEQ ID NO: 21178 - DNA, 1442 bp, Heterodera glycines
ctctagagtcaatatatttttttcaataaaaaatatttttttttatctatcaatttcgggaggatcagttgaagaaacaggctcaaaaattgaaaacaaatttctaaatttttaaggagcctccatcaactgaaccaccgcctccgccgacaacattccaaccgccgccgaaacagacagcgacagtaaaacttaatttttaattaatgtaaatagcatacaaattggcaattatttaaaataaagtctggacttggatttgcatattctggagaaaatccaggaaaatccaaattgccgaaaaattgcatggacaaatttccaggaaaaacctaggcatatagattcatgtccagatcggtctctaataattaattaatttggattaatttgtaaaatttaatttaaaaaaaacattgacatttttattgccaattttttaaattaaattttaaatttttcatttgtttgttttgccaaggttgcctgcttcaatgagcacgaatgttgctcggtgtgggccgggaaaggcgagtgcgagcgaaaccaagcttacatgagttcatggtgtaaagcaagttgcagacaagtaagccgaaaaacaaaataattatataaatataatttaattataaagggtttatctaaaaattaatttttttttttataaaacattcaaaaattttattttaaattaattgttaactaaatgaaattccaataataaaattctaattattgaaaaaatcaaaatttattattcatttattttacacaaaggacaaaagaaaaaattatttagaaaaaaattttgtgaaaaatttactatttttcaatgttttaatttaatgcgtttaatttaatatattgaatttaattaattaattattttggatttagtgcgattttgactatgacattgacaaaggttggttatattacaaaaatttattgtaataagctgcataatttaattgcagaatgtggaaatcgtcacccgaactgttggcaatgggcaaacgaaggccaatgccaacggaaccttttttggatggtaatttacaaggccccggatttttaggtgctaaaaatcacggaataggtatctaaatagttgctaaaaaactgccaaaaactaaaaaatgccaaaataattgccaaaaaattggaacataattgctcaaaaatgcgaaaatttctcaaaatcttatatgaacttttggggaaacatgtggatccggcggtgccgaataggagacgtaggtgaaaattttgaaaattgaattaagatttgtgccaatattcggttacatatgccaaaaatttacaaaaaattgtttttttattttttcataaattttttgtttagaagcaaaaatagttttttaaaaatttcacaagtcaaaatagttgttaaatagtttcataagcgaaaatagttg

SEQ ID NO: 21179 - DNA, 1776 bp, Heterodera glycines
attataaaagtcatcgtagactccccaaactaaagcggaaaacgcgtttttggtggttagttacgcgtattaaatgcgcaaaattttttaggcattttgcctaaaaaacgaattcctcgtaatcacagacccataaccagaaaaaaaaaatttcgggaggggcaaccgaagaacttttttgctcgtcgggccaaaaatttttttctctccagcgtaattttagtatctttaacattgtcggcgccggagggcaaaagataggaatttatggccgcctttcgctaaaaaggactaatttttgcaatctttagggtttaaatttcaaaaaatacggtaaaatggaggtgcggcggtgccaataggcagcgccgggaaaaaattttaatccattttgttaagaaaattgggtaaaaatttttttaaattgcaaattgaaaaaatatttatttttaatttcaaggggggcagctgaccccccccctggttacgtgcctgaatcattaaaaaattttttgtttaaggtgtataatatcaagaaatacaaattgaatttagctgtggggtttggctggcgaatgtcgccgtaatccgacatggatgaactgtttctgcaaagtcagctgtggaaaatgcataccacaagactatgtgttcggatgtaagttatatttaatgattaattgcgttgacagaattaataaatatactaattaattccagtctaaaatattaatttaaattgtaaatgtttgcgatttaacacgctaattatagcacttttgataaaatatgatttggagcaatttttggaaaaatcccagaaaaatgaaaaatttagcatgtagccaaaataaaaaatagaaaattacatttccaaaaattcggctaatccatgttagcatgcactgactaccatccgcgatgttgggaatgggccgaggaaggcgaatgccgcaacaatgcatggatgtcggagaattgtaaacaaagctgtggcacatgtgtcagccaatatgaactcaaacaggtactgtattatttactacgtgttttaccgtaaaaattaccgtaatgttgtatacaccaaattttaatcggttcaatttttaccctccatttttcacaaattctctttagaaattgttggaaaatttcttatgaaaatttaataaaataaataattggtaaggtatcaaaacttcacattttctttaagctcaagacaactacaaaaaataagcttcaaaataaaaatttcgaaaaaaatcaatttgtttgtctttgatttaaaatttgataacccattaaaaaatagaaaaatagaatgaagctaaaccaaaatggcgcaaattaaatcgaaattaaaaaaaaaatcaaaaaattttaaaaataatccctgttttctttttttttaagatgtgccgtcggggaggccgtggtaagcgtcagattagcatgctgttggaaggagctgctggttctccgcccggaggacattcagaagaccagaaaggtgatattttcatcaattaattttcaaaattttatttttaatataaatttaataatttatttttgacattttttaaaatgaattccatcaaagattcacttggaccgcccaaaactgctgcttcgggagcgaaagaatttatttcaggacaaaaatcaatgccggaaagcaacggaatgccaacataaaaaccacttaaatttgaattctgtttcccttctgacccaataccaaaatcaaataaatcaatcatccaatgtttc

SEQ ID NO: 21180 - DNA, 1277 bp, Heterodera glycines
tgccgaaattcaccagtttgttcagtaccgtctgcgccctgacggcattttgttgctgcactttttgcgccagcacatcggcggtcgtgtcacatatgaactgctcaatgaactgttgcgtctccattggatgtcctcccatcagatgagcgtaaaatttaattaaataatttgttaaattatttttggaaaattatttaactaatttcttaaatgcgaaaaaaattaaagcaaattccttaacagtaaattgaatattaattataatttcgcaatgagaatctttttgcagctgggttcctcaattagtttcttctgaatttaccttaaaaaactcaaaaaatgcaactccaagtttaatttttcaatttacgaaaagattttttcagaaatttaattttctgctttaaaataaaagtatttaaaaagcgaacaattttaatttaaaattaaaataattttctttttatttttttacgaggcagtgaatatatttgaaattttaaaaattatttttatcttcattcattagaatcttgtaaaaatataattaaaaaaatcgcattttttattacgataattataagtatttaaaagaagtaattttaattaaattaaaaatgtttttcatttttccagggcagcacactgaccacttcaaagggcaccgccgccaacacgggcacaaccaacagcaaactgagcaatgccagcacatcaccaccatcttctgaacatgcactgttgttggcccgtcgtaaaacttttgatgcaaaatgcggtgacaaaatgccatcgacggaggaatcattttcaagacaggccacttacaaggcacggcaattaattaattgctttttattatattaactaacaggactctgtaaagacagggaggtgcgagttgtgcgcgatggccaaaaaaattttcgactattttttgaaaatatatttaaattgaatttcttccgcttggcagcagcgtcaggcacaaaattctcataaaattttgattattcagcttaaaaaatcacaaattgaaccatttttgatgcaaaattttcaacaaattctactcaaattttcaaaataatattcaaaaattatttcaattaaatagaataatggagtctaaaagtaaattttttggtaaaaaattacgttttcccttaaaaaattaccagaatttctttcattgactgggaatattttcatttttgggactaaaaaagaattagattcatttatatatttttttgatttagccaactgcctac

SEQ ID NO: 21181 - DNA, 1762 bp, Heterodera glycines
atccaggaattgccggaaatgcctattcaatgccaccatcgctggaatacattgatggagcagcagcagcaacgcctccacccaaatgatgagaatgccaacaaacagttgaacgcaactccgctgtgccaatcgcggcgtgccaagtcgccattggtaactttttaaaatatatttacggtttttgtaaattttaattcctctaaaattttttaagaaaatttactgccatttttttagattagaaaccaaaaatgcatctcatcaacattttaatttaacaaaaataaagaattaaaaagtgccgaaattgttcgtaaacaaaaattaattccttatttaattaattatttttatttttatgttttttttttgggataactttattatattaaaaatttatgaaatttttacagaatttaacaaattataaataaaactaaaaataaataaaatattttatttctttgaaggttcaattcctttaaattaaaacaatctgagatttatattaacttaaaaattaaatttaaaaaataattaaattatttagattaatgaaattatttggatttttctgctttaatcaaaaaaattttttttatgaattttgtgaattttaacaaattttattctaaacataaaatcataaaatgaatatttattttctatttgaaacttcaattcttcaaatgtgaacggctttagatccttgattaaattaacttaaaaatgaaaaaataaaaataaatttatttattcaatttgtcaggtgaccggtctcggcacaattggaaaacgccatcatcagtttggaaatggaatgccaaacaattcaaatagctctcaggaaaacaatgccaattcgccttgccaacttagcaccgattcggaagtgtaagaagaacaaattcgatacacaaatttttgaattttcaaaattgcccattataattgatcatttaccataattaattgattcttaactaacacgaattgatgactaattaatgcacgcggacaaaatttttcacctacgaaattatggtggtttttttatttttttatttttcgaaatatttctttcaggctaaatataaaacttaaaaacgaagttatgaattaaatttcttttaaattatatccgaagaatttaaaatttataaaatattttcattattaaatggtgaaaataatttggagttttgtccgaaaaaatttaatcattaatttaattaacgcaagattttaattatacattcgctacttaatgctgctttgatcattaattgaaaagttttgctttttgaaaaataacttggccattattacaattatttattcaatattccaaattaacttttggtactttcgtttgaattatttttcactttcaattaactcttcccatctcagggatttggtttcgttataattgtattttcttcttatttattttttaatttaaacttttttcatatttaacttccatttttcatggcttgaataaattcatttgtattaaaataaggagcaaaattttgccggaccgggtaattttcgcgcggacccgattttttagactatgacttttttctagagaccggacgggatcgggatcccgcgggattttttcgggatcccgcgtgatttcatcgggatcccgactcgggatctgtcccgatcgtttttccaaaatgttcgggattcggtcgggatcccgactcgggatccctccgacccctgttgtccggtctctact

SEQ ID NO: 21182 - DNA, 3101 bp, Heterodera glycines
aaaaatatttttgccatgttttctctgctgctctccatcttcccaatggtcttcttggtctattgcaatgcaatgccaagtcaatttaaataaatataaaaaacattgcattttaaaaacatttaataaaaaggttacatattttattaattatccatttaatttgcaaatttataaatttaaattccataggttttccgtgctgtccgggcagtcagcaagtggttgctgtgatgtccaattacattaacactttctctgctgctgaccaatctacagtatgctcaaccgcgaaaaatactgtggatggaataaaaagtgaactttcatatcgcgtgggatgcccaagcggaggagaagcacaaattgtggatgaaatcgatcgacagctgaagagttaaacaaattagaaaataattaaatgaattttgagagaatggtacattttaaaaaagagtaattaatttaaaaatattgaccaacttatctcattaagacattgcgaaaatggcgatcaattatgaggacgagtgcccgtacaatttgggctttgcccgtgccatgttcgacttggccgctgctgctgctggccatgcgggcaacggcacagaatggcaaaacatgaaaggacaatttgaacaggaaagccaagcaatcaaagcaattggccaagaattgaacattgaagttactgatgtgcattttggacatccaagcaaaggcaaataaaactaattagtggctaattaagtaattaaataattttctaggattttcagcgcaccaaaatgtgccaagtccgagccatgtgattgccaaccctggccaacagagttcagttgaccatggaaaggatgttgaaccgttgtcatccgatttcgacttctgagggcatagaaaagcggaatatattaggaggaaaattcatagtgcagaaaaacattttgttggccttcttgtgatgaacatttgttttggtaataaagtctgtcttccgtaattaccaaaaatatttttttatatttattgatagtaacgtaaaagcatagaacttccataattattatatatattataattcttccctagtcattaaaagcgaattaccccgattattgtcttgtaaaatgaaaatttattaagctacgctattcatcatcttcttattgttggaagttcaaattgtgaacgggaaaactaagaagaaaaacaaaaaaaatagttcggaaaatgattcttcgccctctaaattttcaaaagcttcatcttctaaatctgggtcctcagttagccgtggtcaattgaaagaggaaacgcgcactttggacgagatttacatggccgcgctgaaggaaggcgacaaatttattctttatgccggcggcgattttccaggcgatattgatggcattaaaggagcattcgaagcgcgcttaccgatggaagttattgtggactactccaaattccatggccctcgaattgacattcaggttgcgcttgttttcaaatagcccattttattggtcaattaaccgtgatcggtttaaaagctggtctcaaaatatcgtatatccgccaatatgcaaaaaatctcattcggcgtgtgacccgatccaacctagtcttcaatccagaccaacactacatatttttcagcttgagaacaactcactggtgccagatgttgttcagctccagactctccatgattttcctcgctggaaaaaacggggcatgctgatgcagtacaagcccaagggatggaatgccatttacgagggctaccgcgaccgggacggttatttcacaggaattatgattgccgtgttcagcaacaatgtcaacacccatatggtatccaatgagagtgattggctacgcaatgccaccgactgtctaaaaccgatatttgccaatggaagaattattcagacctacccaaacgatgatgatgcagtacttttttggtttaaacaagtaaattataatactaaagtaataatatcggtaaaatactttaaggtagtagacaaatatggatgggattatatgacaaattggctgctcgaaagccagtgatggtccgcggcaccggtgttgtatgagcacgtcttacgctacgctaactagcatgggtccagcagttctcagcaattcttcatattattttaaataaatatttattgattaattttactcttttgtatcatacgatagtccttgaattgcgttattagtttaataaatttcaaaaaaaaaatttttattaagagcaccggggaaatacgaatgaaatgggtcagacacagtcaataaagaaggggtagagaaatgtaataaaacaaagaatggaatgagaatggactttggtcatatccaacaatggtcaacaaagtgtttttctgtattatgaattttcttgctaatatattccgctttttggcggaaaatccttgaaaattatttggaaatataaataaatatttatttaaaattaatttatttgcctttgcttgtggctccaaaatgcacatccgtaactttaatgttcaaatcttggccaattgctttgattgcttggctttcctgtacaaatttgcttttcatgttttgccattctgtgccgttgcccgcatggccagcagcagcagcggccaagtcgaacatggcacgagcaaagcccaaattgtagggacactcgtcctcataattgatctccattttcgcaatgtcttaatgaggtaatttgaaacaataatttcattttaattatttatatcttccaatgatctgctgttagtattgtaattactcttcagctgtcggtcgatttcgttcacaatttgtgcttctcctccgcttgggcatcccccgcgataggacagttcattttttattccatccacagtaattttcgcggttgagcatactgtagatttgtccacaccagtgaaagtgttgatgtatttggacatcacagcaggtaactcttcgatatttcgcgcaaaaaattctcgaataatccctttttatcaaaaatttattactttaaataagtgtaggacatgtcacaaaatggttttcggtgctatgaattt

SEQ ID NO: 21183 - DNA, 2551 bp, Heterodera glycines
  misc_feature (227)..(227): n is a, c, g, or t
  misc_feature (1690)..(1690): n is a, c, g, or t
tgctggagaacgtttgtgcggtataaaattgttcacaaaaatagatagacatttttgctggaattggtatttgtagccataaattctctgggaaatataatattcggcggacaaggctctccctgtgatggttgagatcatatttgcggtataaggatatacagaaaaagatagccatttgtctgaagttcctcatagaagtcaaaaattatttccccccccccccncccccgaattttgggaatggtaattaaagccaaaggcattggccatctgttgcgcgtcccctcggggcttagcgaatgaatggcatttccaacggtgccgtattggccaagtcattctcaagaaaatatcaaaaagccgaggattgacaatgccgaggccaatttagacatgcaatggtaaaacccaatcacaaatcatcaatcaatgcccccagccatttctcgacatttaattactttgctaattgcctccataattactttgtccgctccttttgcggtccttcccctttaatttcattcaccagcccatttccatcaaaaaacaaaagtgtgcccgccagggacagaatcgcgcgacttccaaccgagcgaaaatgagaagagacaaaaatgagaggagacacgagccaagcgacggctggcagcaattagccatcacaaagaaagaaagcattgagtgattgatcagcagaaattgtggagaacggtcccaaattcagaaacaaacaaagaaagaagccaagggcatggcatttacgcaacagcaaatgttataatcaccctttttggactaattcagtctatttcagtacaatatccccccccccccctcactccgtgccgtccgttcccttcccatggattgctctgtcggcatgtgaaagggatgtgccgctgctgcccctaaatcgtcaccatttgtcatcaaagtgtcccaaattccttcttccccaccccctcacagtgtgccattttcaacggtctctcccccgagggcattgtggcggaaattaatttgccatcgccgccacctttcattcaatctttcctctcctttggcatctacaaagtccttttattttttgctccactccaaccagttttacaatgatgaaacagaacaaatgggccattattcaaagaaaaattggcacaaattgccgaagacgaagggggaaagtcaaaaaaaagaacgatcgtcaaattcgctgagtaatccaaattgccgtcttgcaccccgtctgaatgatcgttttcagagctgaaaatttgggagcaatggcatttggtgcgtaattgtgcccactaccatcgtagaagggtgcctccaggccctggtgctgcactcccgtgtcgtggtgttccaattcctcgtcccgaaactgggccaatttctccattaattcgcggttggcattggcatcatccgccatcaattctttgatctggtcattgtaatgcttaaaaaaagaaactttataatgaattaaatttcacttttatttttattaatgaaattatatctattttgatggatattttaacctccttccccctcggacaaagaaatggacaaaaccttttttcactattaaaagtccaaagtgcggccaaatttaattttaggaataataaaatcaatgaaaggacgggaaatggtaagagacaatgacaattanatgattgacagattaagcaccctccctcccgcttcagtaaaagtgcccacttggccaatgacttcctccacggcaattgtgcatgccatcgctgcctttcgccaagcaaagcggtgccaacaccttaagaaaaaaggaaaaataagccaattatttgttaaattgtggtcctataaatccatttcttttgctccgtccccactcacccaacataaaaccggccaccgaacaaatcggagccaacgcagtcgacctcactccgtatttgactatcaatcgctccatctcgtccaaatgatgtctttcttcgcgtcgcatttgttcaattatcggaacgagacgatgggttttcggaagaacggcgagttgaccggcataaatctgaggaactcacaaatttatttgttgtttttcttaaatttcactctgtcagccgccaattcgcccgcgtggtcgacacgaacaattggatggacaattgccttccggtaagagggaagaagggacgaagaagaggcggaagaggaggaggaaaagcggagggagagaaaggcaaagggacggaaattcattgaaaacggacgaacggatggaagaaacgttcactcgaattgatgtgcttaattgaacgtaaatacacggtaaaataccttcattaatttaggaaaaaaagcatcgagcgacagttttcttcagagacacagaaactaatcaaaaaagaaaatgagatgggtcttagatttttatgcgcagttcgctttgtttttgcttacaatgccatcccttaattgacctcatcaggcaggggactaatcacttgcgcaattcattttccaaccaccccgaaactcaccccccccc

SEQ ID NO: 21184 - DNA, 1067 bp, Heterodera glycines
tgagcagaaaagtgataggcattttccaatttttcccaaacaatcgcgccgagaaacaaattccagaacaattagtatcggcctaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaagagatagccaattttccaaatttttcccaaacaaacgcgccgagaaacaaattccagaacaattagtatcggcgtaattattctgagaatgcggttggaattcctattactgttgagcagaaaagagatagccaattttccaaatttttcccaaacaaacgcgccgagaaacaaattccagaac

SEQ ID NO: 21185 - DNA, 2370 bp, Heterodera glycines
agaaattttgtcccatacaaatgttcccagcatgggcagaggggcgcggagagcaatggccattctattctacagggaatttttaaatttattctctatgccagaaaaatggttatctcttttttgcgagaaattttgtatcatacaaatgttcccagcatgggcagaggggcgcggagagcaatggccattctattatacagggaatttttaaatttattctctatgccagaaaaatggttatctcttttttgcgagaaattttataccatacaaatgttcccagcatgggcagaggggcgcggagagcaatggccattctattcttcagggaatctcagaatttgttctcttcgcagcaaaaatggtcatttgttttagtgtagtaagggttgtccacaacaaatggtgcacagcattgttcagcgtataggcaacagcaagtgacgctctcggtaccgttagattcgccacatcatgctgagtctccggacaccgaccgcgtcccgttccgttgcctattcgcggcacagcgactgctttcgtcggttcactttttaccaatccactagtgttgtaaggattttcaccaaacttcgtgcacacattgtttagcgtataggcaacggaacgtgacgcgctcggtaccgttagattcgccacatcatgctgagtctacggacaccgaccgcgtcccgttccgttgcctattcgcggcacagcgactgctttcgtcggttcactttttaccaatccactagtgttgtaaggattttcaccaaacttcgtgcacacattgtttagcgtatgggcaacggaacgtgacgcgctcggtaccgttagattcgccacatcatgctgagtctacggacaccgaccgcgtcccgttccgttgcctattcgcggcacagcgactgctttcgtcggttcactttttaccaatcgactagtgctgtaagggttttcactttgactttgctttatttttcattttttccaatcgcctagtgctttaaggttttcactttgactttgctttatttttcatttattccaatcgactttgctttattttccaatttgggatttttttgtaatttcgctcttttggtcatgaccgtcgggggcaagtgctggctagcgctttgttccttgcggtatgctacggctgctgctggggtgccacgttagtcgtggtctcagtttctccagcgttcggcagtcggtccccgcctcgggactctaaagatgcaggtggccagccgtgccggtccccgcctcgggactcaaaagatgcaggtggctagcaagagccggtccccgcctcaggactcaaaactctgagcacattgaacggtgatggctgctgctggggtgccgcttttggtggccttagtttctccagcgttcggcagccgtcgaaacactaaacaagcagctttgctgtttgtcaaaacaatttggcgagttaattgacttgtgtaaatgtggcctaaggcacaaatactgtggaggaactcagcacttgggatgctgattaaggacagaactggctgtcttttgagtagcaagatgcacaagacgctcgggtggacacgtgtgcgcgtgtgcaaagcccctgccgacgagcaagttggagatgccggtcaagcatatgcagtatacggtcacgcttgtgtcttggttgtgttcttgtaaagatccttcgaaagaatgtacatgatagatcaacgcattctgtgggagaataaatgtgattgcagcagccgcggtaattccaactctaaccacccggtggttcggtgactagcgccgatgacagtgtcaggcggggagtttgactggggcggtacggaaaggttatcacagggatcgtgtctgattttgcccagtgttctgaatgttaagccaatgaatagggaacgtgagctaggcttaaaccgtcgcgagactggttaattttaccctaccaaagacctgatgctatgatagtaatcctgctaagtacgagaggaaccgcaggttcaggtatttggttcatgtgtttggtcgatagaccaatgatgtgaagctattgaaatcccgctcaagcgagattgcaatattcttgctccccggtgtcgggaggcactacttatgcgccgcttgcggtgcagcccaaatgccccagcatctggcccgatgtgcgtgcttaattgctcgcacattgccaaagccgtagcactcgtgtgccatggtggaacgtcggggcgcaaaatcacttttatacgacttgactactggtcagggagttgttagcagtagagcagcttttacactgcgatctgggggaagttagcccttgatcggatgatttgtattctttttccc

SEQ ID NO: 21186 - DNA, 2666 bp, Heterodera glycines
  misc_feature (33)..(33): n is a, c, g, or t
tgactgtatgtcctgaatttgaaaaaaaaaacnttgtcaccctgaatatacatatacttctgaccaattctaatgctaaaaaacaggtactcacgcgaaaactgaataaaaattttgtatttggaaaattttgtccaaaaatttttatgttctaaaattaccggtttttaccggtaccggtaccggtaccggttgaaaaagttggtaccggtaccggtaccggtttttgcagtaccggtcagtaccggtaccggtttttttgcaattaccgattaccgctcaactctactgcaaatgaatggcacaaggttttgggattattggacaaaaaaggtcgccaattatgacgacaaaacaattacagtgctggtcagaaaattggcaccccaagcaaatttgttcaaaaaaaaagttatgaaatggcaccgaatgggacatttaatgccaaacaaaacaaaaaagcagcgcaattccatttttggaatatttaggcacaatttgacgagaaattaacagaaaatgccaatttgtacagcaaagaatgaatcagcaaaaaggggacgaggaaaaacaaatgggaaaatgaggtgaggaggaaagggaagcaaaaggaaacataaaataattaaaataaaataattaaaaatttcctttggtttcgccgacttttgggggattcactgcacttttgggttcatttattaattttaaatgcctttattagtcggacggagaattgtgacgtccctttttgtacttttattggcaaaccgttgggctaattccgccgcttttttgtgggagaaaaattggaaatgaaaaattctaatttattgaattctgttaagaaatttctcaaaaaaacccaaaatgtcaaattattggccgcttaaaagtctattggacgaataagtaagtgctcttgacccgaatatttatatgtaatttatctcggcacattaaatctttgccaaaattaaagtttgataatttttttaaacccatattcagagatcactttttgcccgtttttctcaagtaatttctcatttaagaccttagatttttccgcacggttggaccgctaaatcaaatggatttttcgaaaaattttccgattttattggccgagagggcccaatttaaagaattaaatccgttttcgcaacaaaaaacatttcaattcgaacaactgtaaagtcaaaagtcagagttgacttaattgtctgccataaatttaataatgtgatcgaagttcataaaatgagataaaataaagaaagaataaatgtaaacatttgtcgttaacttttgtctttcgcttctgcgtttaaatttgcgtgtggaagtgcctaaacatttaaattattttaattttcattttaatttttgagaatgaaaatgcctaaacatttaaaattattttttaattatttttcaattttcgttttaatttttaccattttcgcagattttctttctctgcaaattccgatttcagctgcacattgtgaaagctgcccttctcaaagtcctccttgatcttcacgtccaacttcttcctcagattgtccctcaatttgcgcttaaatgcgctgtttgccttttgttctgccgccatttgaatgcccaccagccaatgcctcaggccaattgagtttctgtccaaatttgaatttcgaatttaaattagtatttttttacccatttttctccaagtcggcagaagggcattccgttgggccgatcatttttgggcggacgtggcaaaagtccacccaaatggccaaggggttctccacaaattcaagcagttcgtagcgcagcctttttccgacaaaatcgcagaatttgtccacgttgtgacttgagcctttgcattcgatgacaataaaatgttcgtactcaaacaataaaaaataataaatatatttaaaacatttgttttattactttctcagtgaatgctatcgcttcatcttttgtttccattttgcttctcaatttgtcacatgcttaaaataacaattaaatctcaaaataatttccattataatttttataataaattgccattttccaattccacgggcatagaatttactggttaaattggtcatttttgagcagtacaaaaacgcaagtggtaaaaataggtcagatttaagtccatattcggaccttacggccctaattgttaaaacacaaaatttttatttcgtttttcccatttttataattattaatcttttttattattttcccattttgcctcgcttcagctcattcttcaccacttttgcgctcgaaatgttcactttttcggccaaatttcgtcccccaattgtcggcattatcactgccattgccaattccttccgaatgcttttcattgccttttcaatttcaatttgctgctcttttttcgtgcgatgctttctccgcgctttttcccatgccaaatctctgcggccgatccaatcgccgaacggagaccaactcaaaaaagtgccgaagaatttgtgatcaattggtgtcaattggacgggcattggccatttcctggaaaattggcaaaaagccaagaaaaaaaacaaattcgaaattaccatttggagaaaatgagaaagaatttgtggaccagaaaaggcattgacgaatttggg

SEQ ID NO: 21187 - DNA, 1409 bp, Heterodera glycines
  misc_feature (25)..(25): n is a, c, g, or t
  misc_feature (162)..(162): n is a, c, g, or t
tcctcgtcaatgtcgcgcagaaatnggtgaacagtgatggcttgtttcagttttcgcgacgcacatcagtcgagtcctgaaagaagcaacaattggtaataaacaatataagaaatgcgaattattgaaggtggacagaaattattcgaatcccgcttcatntaaggggagtctcaaaattaagaagtctcgaataaatagaagttgtcattcaaacaattagatgccatgtctctgaatccaataatgccggattatattaatgactgatcagtcttcatgcaaaaatttaaaataatcagaaaaatttccaccatttcgagagtattgaaaaagtcaatattattagacagactttcagtcttcttgagaaaccagtcaacaacgagtcaattatctacctgcatgtacgcgttgttgtcgcgcaacttttgcaatcgttggacggccaattctttgatcaggatcaaatgcttgagtaattgttccgtgcgcgtgccgatgttctttgcgtggtgattgccagaattgatgagctgtaattatcaattaataattataattaacaaaattaaaggaatttaatgttagtaaaatacagtagctgatcttttttctgagattttcgttttgagaaattttttcgacagtgtttataaagtcacccaaggaaacaaatatgttagcttctttaaaattattaattttgaataaaaatattttaatctgtccctttttaagacaaattttggctttattatgcgtcaatttcgccctcccccgcgtgtgccatgccattctgtctcccacctgttcgccttggcgctgcagttcgtcaatgcgctgctggtgcatctgcaggtccacctcgaacgtgtcgtgcttcttcaacagtccctgcactgcagccatgttctcaccgacgttgggcgagctgagtatctgttgcttctcgttcagccaggcttcctcctcctcaacacggccgatgaaattttggaactcttttttcttctttatccacgattcctcctcgtcaatgtcgcgcagaaattggtgaacagtgatggctttgttcagtttttcgcgacgcacatcagtcgagtcctgaaagaagcaacaattggtaataaacaatataagaaatgcgaattattgaaggtggacagaaattattcgaatcccgcttcatttaaggggagtcaaaattaagaagtctcgaataaatagaagttgtcattcaaacaattagatgtcatgtctctgaatccaataatgccggattatattaatgactgatcagtcttcatgcaaaaatttaaaataatcagaaaaatttccaccatttcgagagtatgaaaaagtcaatattattagacagactttcagtcttcttgagaaaccagtca

SEQ ID NO: 21188 - DNA, 2321 bp, Heterodera glycines
  misc_feature (13)..(14): n is a, c, g, or t
aggccaaaaaatnnttttctatttccgaaaaaaaatcgaaaattttccgaaaaaattaccaatcgatagagctcgaaaaactatgttttggaagtggtctccgtttctctgggaaaattcgttaaaaaatcctaaaattcaaaaacccgaaaacagttttttaggcctagctcgaaaaattttgaaaattttcgaaattttaaaatttggaaaaatcgggcttttaaagctctacaataagtctgctggccaccctgcgctcaggtcaaagcctaatgagttattcaacggggactgaactggacaaagttggtactgaatttttagccaaggctacagcctcgggagcccaacgtagggcttagggttcgctggcaaagttgtcgaggacactccaacttgggtccctcccagcgggcactttttgattcgggtttttgaaaaaaagttaggggccctaaagtgcaagaaaaagtgagaaatcggtccccgggactcagtcgtccgcgctgaatttttctctatagttttcccagatgctcctcaaaaagttgtaagacccttccaccactttcagggcgctcccggccttcggccgggagaaaatggttttatcaacgaaactccttgtcaatataacgtatatattaactagcgggtgcgtgaaccgtcggctatttagctggaaaaaagcgcttcgcgctttgggagcttcgctacctagattagctctggttgtggagataaggggttgtaggagttagccccaaaaaaaggagggggcgttttcacgccctttttcaaatttttggggggttcggaagaacacttcgtggcctcggtgcttcgcgcccgcttctaaatttgttacatgttacatgaaaacggagggagttcatgaatttcctctctgagcatgtaacatgtaacatgtattaacataatgaaatgcaaagaattttggaaaagttgttaaggtgtttaggccgcttcgcggcctaagatgggttcttcgcgtattaactaatgaaagcaatgaatttttgaaattttattaatgggttgtaggcaggtttacgccctaagatgggcgcttcgcgcccatttctaaatttgtggggctcgtaagaacacttcgtggcctcggtgcttcgcgcccgcttcaaaatatgttacatgttacatgaaaacggagggagttcatgaatttcctctcttagcatgtaacatgtaacatgtattaacataatgaaagcaatgaatttttgaaaagttattaaggggttgtaggcagctttacgcctaagatgggcgcttcgcgcccatttctaaatttgtggggctcgtaagaacacttcgtagcctcggtgcttcgcgcccgcttcaaaatatgttacatgttacatgaaaacggagggagttcatgaatttcctctctgagcatgtaacatgtaacatgtattaacataatgaaagcaatgaatttttgaaaagttattaaggggttgtaggcagctttacgccctaagataggcgcttcgcgcccatttctaaatttgtggggctaagagaaattaaaaaataagtgtagtaacatgtaacatatacaatgaactccctccgtttacatgtaacatgtaaaaaattggcttaatgaacaaaaataaaagttaatcggaattaacataagatcggaaataattaattgatcggaatttcaccgatttttcttataagttttatcttatatgtaacgtgtttcgtgttaagcttgaaattgtgttagggtctttgcgtcagccgacatgcacttggtttcgctcgtgaaatgagcagacacattgcatatttcaatgcaatggaaaccggaagtgccctaactcgcacgtcatccctcctccctccctttagtccaggtggcagcacttttgtgtttgtgcattctttttaaagtgcagatgggaacggggcgacatctgtaaagtgccacacacgctggactataactcgtttgctttattgcaatttgagcatgtttttggccacaatgttcagcactttggctttaccttggtcatcggtctcccttttgggagcgtatactcggacgttgttaccgtccgttgcccttgaaaaggccgtatacaattgaccatgggaaaacacatccctttcaaggtcaattccgaccgtgctgattgattggccttgacctttgagaatggtcatggcgaaggcagggttgatgggaaactgcaaacgctcatattttatgccgccagccattttgtcctcgtagacattgcgtgttctttcgatga

SEQ ID NO: 21189 - DNA, 891 bp, Heterodera glycines
  misc_feature (846)..(846): n is a, c, g, or t
agggaaggaaaaggcagacagagaagcagacagtggtcataagcagaaagtcacgggagcagcttctccgggaagcgacagatgtgcaggcacttcacggagagatcacgagactaattagagttggcaaacattgccccgggggaagattaagggtaattaaatttaggaccttagaaagacggaggaagagctgaacttgctgaggaagcagtacaacgaaagagggacgcttttgaaggaggaaagggaggcaaaggcgaaggcacggagggagacggacagactgagggagttgttgctgttcaacggtggagacgaggaggccaaagacccattggacaaattggaagaatttgaggggggaaacgtcggagaaattactgatcagacaaaagccgaagaaagtgatcaggcggaggagggaaaagccgagcaaagaggccaagtcgaccctttcactgaagtgaaaccccaatttttcaatgagacaaaagcgttgtttaaaagttccgcgacagagagagaatggagtcgctggagttggagaacgcggaattgcgtcgctttgtggaaaacgtggcggagaacggaagggacgaaagggagcggagaatggcggaagggacgcggcgattggtgtttttggcggtgaaagaggccaaatcggagcggcgactgcaaatcagcaaacgattgcgcatggcaatgagcacaggtaaaagagaatttgggagaaatgggacaaatgggggaaaatttgggataattgggacaattaggggtaaatttgggaggaggatgagggtgattttgatttttgttttggtgtgccattctctcatncgcaccaaaggggaccctcctttacccgctttcttcttttgattc

SEQ ID NO: 21190 - DNA, 1997 bp, Heterodera glycines
aaaatgcgctgcttcattccgtgcccgtgcacgaatacaaccgacttctcagacagcacaaacgccttctgcgcgacagatttttgagctcgccgtccgacatgggttaccattcggaaacagagcaaccgacggataacgacgattttgtggacaaaatgtacacggagcagcacttgaacatcggacgaacgatcggaggtccgtcggactttgaaaatttggccgaaatgcgttggctttagactcggcccattggcacaacgaatggggccaattgagggaaatgaacgacgtattaagaggacaaaacgacgcactgaacagggagagggagaagctgaaggcggaactggacgagctgaacgcatttctggacgacatcgaagcagaaacggaacttaagtcgatgtgtgagtggacaatttggggggggggtcccgagagttggcccagtggtcgagaccgacactatcgagtagcggagttaagaaatttttcattggtgctagtcttgcgagaacgaatacatttagtggccaacatcgaacgacgttttctccaagctttgagagaacagtctgagtgcgcggaagagagagaggcgttggggtgcgaattgcgaaggagcgaacgcaatttcaggtgattagtcagaagcagtaattggcagcttcaagatggcactaattgatgttaattgggctgaattagtgccgtcgtccctttcagtgagacgcgtgatcgttggctgagtgaacggcgtcgactcgtggacacaattggccacctcaactcggctctgcaacggcttcaccgtgaccaattgctggccatccccggctcggtccatgtgactacttcacaattagaagcattggccacccatttgagaagggcatatcagaaggagagagaagcgagtgggagagagaatgagttggaggagagggcggaagagatgcagagggcggagagtgcactcatggcgaagagagcggcgctggagacgattttggacagagacggagagttgagggcagtgcatgccgtgctgcaggggtacgcactgaacgaagtgacacttagcgcggaattgcaacggacacgcaaaaaggtggatagatttgggaaaactagagagagaaagggagagagagagaagacaatgccaaagtttgaaaacaaatgaaaaaaaaatttaaattttaagctggaaaaagtggaaaaggaaatgaacgaacggactgaagaattggaagaaatgagagaaatgctgacgcactttcaacatgtaaaggaagttgatttaaaacaattggaacaacaaattgagcaaagacaaaagagaggggaagaaagaatggacaaaaaggaagaaaaacaaagggaggaaaaggaaaagcaaagggaggaaaaggaaacgaaaggcgacagagaggagaaacaagcgcaaaagagaggggacagcagcagaagaacagtgctaatggtggacaattcgagcgaatgggccgaacagctgcagaaagtgcgggaacgggccaaactctgtgtggacacttacaaggtaaaaggagaaaagagagggagagaataaaaaggaaatgcgaaggaacaattggaaagtcgggacaaaacattggacgaatatcgccaattggtggaacaactccgaaccgaactcaccgaagtacggaacggaagaagagaagcggaggaacagaggaagagagacggagcggaaacggaagaggagacgagcaaaagcggagaaaggaagcggacggacgaatgggaagcggaagaagcggaggagcggtgggagaggcggacgagggcattggagaggcagctgaagaggatggtggaggagcaggcggagatggagagggagcggacgaagctcagagagaccatcagagccaaggaagagagcgagagacggcacagagagggagagggcacgagggatgtgaaagtgcaggtgatcagag

SEQ ID NO: 21191 - DNA, 1664 bp, Heterodera glycines
tgcccggtaccaattgcaattcatttccaacatcgctcactaagtccaaacctagagaatttgcatagaaaatatcgagttttcacaaactttcaatgagtgtgagattgcgtgattctaatttttcaattgctccaggtaaaatgtcaaaatgtgattttataaaggccaaatctccacgaatgcctgaacagtcaaaggcaatttgtgattggcgaatagcatcagaatcggatgggttgaagtcccgaataatcgcaccaatttggttaagattttgacagtaataatccgctgcattgagccaagtcccccaacgtgtgatgattgggcgcggtgggagagggagatcacaacgttcgcggaatttggccaagcgggatggcgcttttgaagaagtctttttggtacttgcaatcaatttgtcaacatttggaaagaggccacgaatttcctcgcacacacgatggagcccatggcacaaacatgtgagatgaatgagatttggatagaaaattttgaggcccttaaaattggtttacatagatagcactttttataaatttttcattgttaacctgtgctgccttaaccatgtaacgtgccgcgtcagtgacaagtaacaaaaggtcgtcagctgaaattagctccctcaaattgtcgttgataaagcgagcgattgtttcatggttggttttgtccagaaatttggccgcaaccaaatgcggtttgtgcaatttcccatccaaaatgccaatgatcaaatttgcgacatatctgccacgagaatcagtcgtctcatcaaccgatgcccaaattttttggtgtttgaattcatttttaatctcagtcattttctaaattttaccatctctttgaatggaaagggggataacctgctcataacatgcaggcaaataatttttatgcaaggcatcattatgcggaaccactcgcttgcaatatttttccagaaaatctgtaagaaaatttccgctaggtattcccagaaaatactaacctctaaaaccctgattttccaatttaaaaaatggaatgttcgccgaggtgagagcggtacacaaatccattgagaattcatccagttttttcgtcgtttgagtggtcaaaaattgttgttttttgcttccacatggccgcataaaaagttcaacatttgctttgtgtttagcagtttcgttgtgttgtttcagttgataaaacattttagaagggacctgaaaatgcttttcgttgtttatgttgttgtagtcgtgttgtttgtagatgaaaagtgatgctttaacctgctgttgacatgcctgacaataaatgaccttcccatcagttgtgtagatcgcttttccgtcgactctgctgatccagtcgttcaaccaagctgattttgattttattttgggcattttcagttacttttatgataattttttgaaaaaacttggaaatatgtacgaaaaagtgcgaaatatgtaagaaaatatgtacatatgtaatatgtagaaaaaccccgaaatatgtaaaaatatgtattataaaccaggctctagaagcttcaaatcaagctaaaaacatgtttttcatgcgtttcaggcctcccacagtccaagaaaaaaatatgtatttacatataaatctaagcccta

SEQ ID NO: 21192 - DNA, 1110 bp, Heterodera glycines
  misc_feature (29)..(29): n is a, c, g, or t
  misc_feature (39)..(39): n is a, c, g, or t
aaaggatgacgcgtttcttccgtttcatntttgccactntaatttgccaaagtcgtcgaattgggcgcggtcagacaggccaaaaggtggcgcagactgacggggaattccaagcgcacctttaaccgattggtttttgttccttttgcatttgaaatgtctctgctttaccttgtgtttgtccatgtcgtaaacctgcgaatgtttaatttttaattttcgcaattcctttctttcttttccgccctccgtccctcccgcgttccttccgccctcattcctcccccccattttttgctgccaatttcatttccacctgtaatttgccttcctccgttatcattaaatacgcatctttgccgtgctttgccacgccgaccattcgtttatccaaatttggaaagtattcattggctttgtccgaggaaaaagtgaccatattccaaaaggggtcgaaggagacgaactttttggtctaaaaaacaaattgcgaaattttgtgacgattggccgaacatttgacagaatcaaatggccatccctccactgaaagccttttttgggcaaaaagtcaatttgactgggcaattggcgaggactgtgccgcgccatctgaaattcagtaaagatttacagatcctaagtaagtaacctacataaaaacgtttgtagcgtttgtcccatcggaaacggtagactgtacggtagtccaacagtacggtaacgccacttttacggtttgtgaatgcggcgttcacacgccggggaccgttcgggaaaagctcggaaagagcaaaggcacgtctaaaaaggaaggcattgacggcgaaggcatttgggggccgacttttgctgaaggccctgagaatcgcgccacacttcgtaaaccatcccagcggagaacagatagagatgcctgttgaaagctgagcaggggtttaaaaggaaaggattgaagtgaagcgaccgttggccaaaccttcggtgaccgcgtccaatttgcttgggcattctcccgcgttccgcgcctgaaggcgaccgtttgtgcgcggtttgtgctggcgacggacgacgtgttggacgattcgacgtgctcggttgtccgactgt

SEQ ID NO: 21193 - DNA, 2215 bp, Heterodera glycines
ttgaaaaaaaacttatggagctatatgcaaagtgacttggccaatttcgatttcctaattaccgtgtgttggtcgtgtgaattggtcccgtccagttaaaaatggacgggattaacgagagcgtttcccgttcgggacttccgtcccggaaaattttgaattccccatcccgctcccggaaatttttttaccgggctctagtatctagaatgtgagaagcggcaccaatttctatcgcatccttccaatgttggtacccgtcctttggcactataaacaactaattaaattaattattattttacaaattgacagacattttgccacagttcgaatataatcagtagggctataaattatatgctctaaaaaatgccaaatatgtgcataaaatatgcactaaaatctctcaaatatgccctaaaaccccgaaaaatgcccaaatatgaactaaaatatgccttaaaaactgccaaaaatggctttgaactctcaaaaaatgccaaaaattgtgtaaaaattcagaattgactttcaaaactccaaaacaatgtctaaggagttttttttaataattgcaaaaaatttgcatttcaaaattctataataatttttttttaactttttattttacgctcacaaggggaacattccgaactgtaaccactcagatcgtgtcccgacatttgcagccccgacatttgcggcccgacatttgcggccccagccaattaccgacatttgcggccccgacatttgcggcccgacatttgcggccccagccaattaccgacatttgcggcccgacttttgcggcccgacatttgcggccccgacatttgcggcccatttcttaagtgttatttcccgacatttgcggccccaaattactcttttaaaaatttaacaaaaattaaccactttctagtttctctatatatcacagtgaggtcagttatagttatttgaaaattccaatttatttgattttaaccaaatttttccttttaaaatttaaagaacattattctaatttttcaaccaaattgggcttactcaaggccccaacaaagcttgaactttccatccattctactaatcctgaatttctacagtatcggccagtcgatactgtagagctctgaggtgccctaataacgtttcgtcattcctattttcatcgttatcataacgcaaaatcaaatttttgatcgctctgtcattttccacatattttttcttccttgtttcagtcaggccccttgtggggtccaattcaaatggccgaattctgtttcgctgatattcctcctcctctttaattccgtttatgaatctttaaaattaaagtctcgagattagagctcttaaaattcactttgaaagagctggatgcacgcctcgaaatctctttgcaaatgagcagtgccatctaattttggcaccctacaaatctgaccaatttcaaaatctgccatgacagataaaggaacaatgccttccaaattttcatgcattacagtaaaagattctattgaaaattttattgaataaagtggttaatttttgttaaatttttaaatgagtaatttggggccgcaaatgtcgggccacaaatgtcgggaaataacacttaagaaatgggccgcaaatgtcgggccgcaaaagtcgggccgcaaatgtcggttattggctggggccgcaaatgtcggggctccaaattcgtattccctcccccccccccccgattttacaaaattaattaaactttttcaaaaaaaacaataggaaaatcttttcagcttattaatcttttactttttgttcgatttactcggctgaaagaataggggaaatgctttacaattttttttgccaattttgattagcttacctcacttgtgctcaatcgggtgccgtacgtgtccaaatatttcctctcgagcaagtcgattctgctgaatgagccaccgttttgacgaaagatgtaggcgagacgataaataccctcctaaacaaccgaatttaaggggaaatttgggatttttgaataaattgtactaaaattgttagagaaatattttaaatatccgtggacggacttagccgtaaaacccaccggaacaggcctttcgtacatttgcacaaagcggtgtaagaaggtcgcacattccttgtccaccccttcctccgggcatttatcgcagttcaataa

SEQ ID NO: 21194 - DNA, 2600 bp, Heterodera glycines
caaattgaatcaacgaaattcggcaatggttgccttcctcctcattggcactcttttgcctctttttagtccaaaatgaccacgatttatgcattcatattccatcatttggaagaaaagctaagcgagtttgagtttactgttaatctttgggagtgtattaaatgttttgaacctttcgctttcgaatcgcaaaaattaacccaaaaatgaaaaaacccaaaaaacaaaaggccaacagaacggtcaattggcgtgtattaattgccatttgtaagatgatgattgagatgatgatggtggttgtcctgttgttgtccccccccccctccgctcatttgcccatttaagccttctcccccctccccccgcggttcgtccgtttgcttctccttactcttcgaacaattgacgaccacccattgaccgggggattaggcgaatggatgaggaagaagcaaagggcaaacacagccaaagtgtgggcaatgagtgagttgtcgagcacaatgccaagaaggacaatcaaacggacgcatcggtggcactcacttcccgctgtgtgtcaaaattttgagcaaaaacacagagagagacgagcgaggattattacctaattgcaagcaaacgctattattgcaagcaaacgctattcagcggatgcgatcatttggcattcattgggagggataagcgcagagaacggacggcagcaattaattaattaactaattaatcaattaatgaccggcaaagggatgactcagcggaagaaaggtaattgaaacgcactcatttcagaaatatgtgatgagtggatgaatcttcggttgttccgcggctgttttgactttgtccattctcttccaaaatgccaatttctcttttctccccccaatttttggtcggccctttaaaattatggcaaaatcaaaggggcggaaagtgtcgtcgtcgtccgttccctccgcgccttctgtgaaatatccgtccaatttcgttcgtttgggttcgccgtcaaagaccgaacaaatgaatgaacgaatgactccgtctccatatggcaaatgttctttcctcagcagcccctcgggggataaaagcttttaattagaggggcgaacctgtcacaaggctataattggttgaaatgcgaatgcaaagtgagtggagcgcgaaaagggactaatggacgacaaacggagggacaaaaggaagacgaaaagaggggagggattgccattattagtgttaataggaattacaaagggacaaaaaacaaaacaaaaacaagcagacacagtaacagacacaccgaagaaaaatgggtgcgaagcaaatgggaaaacatcctttatttattttagttttcccaaatttcggttgttattcctagagttgtacgggaccgggactggtaccgaaaaaaaggttggggtcaattccataccggccgtttccatgccataggccattttcgtaccaaaagtataaatattaatagacagtgaaattaaaacatccaataaaatttttcactactttttagacttagctccccaaaagctttcggatgataccaaatttatcaggattcgatcgttttaaaaaaaaagttagaagtgtcaaatctttgaatttttcgaattttgaaccgagccaaaaataggtttaaaccaaattccgcaacttccgggaaacccaaaaccgggctcaaaatcccggagctttagggacttcgggttcttacagtacctgctggggttaaatttgaatagttaaatccgggtcttacttcctaattttcgtgccaattgtaaattcgggaaaaaaaaattctcgatccaatttaagaatccggggaccggataaaactggtaaaatagacaaaacaatattttaaaaattttttacttcggcttgtaaaaaagtatgaatggtcattgttttgaagctttgcacggttctttttttgttagaagtatttccattttcttctctacaacagtaaacataaaatatattgtcttataatgcatgagaaacatcaaaatgttgaaaatccccttctatttttgaaattttgccgaaaaaatttttggtacgaaaatggcctatggcatggaaacggccgcatagaaacggcggcatggaaatgggtcgatcccctatgccaatattcatgttacaaaatgtgtcacttaaacatcaattaagcttcaggaattcctctttcttttcatttgcactgtccgacggattggaaaatgatcaccgatatgcaattgggtattcattcatcctttggcatttgcttgttcctttcattttttgctgcttaggtatcatggccaatgttctcggcgtctccattttcattttggtcattttctaccattacatcgtcgccaaccaaaagaaacagtcgccgcagtgagcgaaagaagcgaagaaaacgccgaagaaagtcaaatgatttgatgggttatgattaattaattaatttatgtattaattgagagggacggcgcataaatttgtaattgattcattgtaaagagaaaacaaagttaattacacaaatgaccaacaacagaaat

SEQ ID NO: 21195 - DNA, 1101 bp, Heterodera glycines
gagatggaaccaaaagttccataatatctttccataagggtggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgatcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgc

SEQ ID NO: 21196 - DNA, 1179 bp, Heterodera glycines
caaaagaaacggacttgcaagactttttccgtgtgcttttgcggctcctctttacttccttcctcaaggcattttacgagcacttcgtgttcaatttcgaaaaattgttttaaagggattctttccgacaaagattctaaatttagttgttttttttacacaattggatcagcttaccagtttcgggcgtgaaaaccgtttcatcagaaatcatccgcagcatctcacaaaaacattcgttggcgtcctgttgctggtggttgccccgttcatcttgagtgtcgaattgtggaaaggtttggcggaggacatgcacaagaaacaacggaatgacttcgggagagtccgccgtttggtccttcgccaaaacattcatctcgttgtaaagcttcttcatagaattggtgaagagttttatgcgttggttcgacccgtcaacagattggttgggattgtattgcttcaaggcggtttcaaattccggcacaatcttaagagaaatgcttttaatgcatgtttctaactttttggttcgttccgtcgcattaattcacacgactatcacaggggggagtaagcaaaaaacaccgaagggaagaacccaataggaacagagcagcaggggactaaccttcaaacactgcaaactcgagttcatgtaacaagtgttgcccaaatttcgtagaccaatggggaactgttggcgcggttccgtctctgtcgaatttgcatggccggacgactcagcattttctgcctttatcaacatcgattcagtgcttccaataagcattataacagttccatcttttattttgattccgttccatgcttcgtcagatatcgtcttgccctaaatatcattgttttttatgtattatgcatataaaaatgaaggcccatttaccttaactatcaacttttgtcgttcaggtggaacatttgtcaacccgaatagttgcgccttgagcaataggggaggttcttcgggattggcgtcaacattaagttctttggtaccccactttatttttattttaaccatttgttgtgaaatctaatgaaaattaataagaataaggtaaaggaaaaccaagatcactaataaatgaaaaagcaatttttttgggaattctaaccaaaaaactcagatttcattttaaaacaaaatcatcaaaa

SEQ ID NO: 21197 - DNA, 1599 bp, Heterodera glycines
  misc_feature (51)..(51): n is a, c, g, or t
  misc_feature (75)..(76): n is a, c, g, or t
  misc_feature (83)..(83): n is a, c, g, or t
  misc_feature (129)..(129): n is a, c, g, or t
  misc_feature (168)..(168): n is a, c, g, or t
  misc_feature (1572)..(1573): n is a, c, g, or t
  misc_feature (1581)..(1581): n is a, c, g, or t
aaaactcaggatttcattttaaaacaaaatcatcaaaaagagagatattanttcattcaatttaaaagaacaagnnatagtgntgtagtaatagtgcagatggtagatataaaatttttttttgaaatntaaagtcatttcattaaataggtatgcattgtaaaacgnactcatttttggtcttaaattttgtgttgaaatgcgaaaatcaaggtcgaagctcgcatttcattcaaatcaacaaatcaaagatttccaagtgaatgcattccgttgccttttcttctttatcaacagaagaagctcgcttgaacttcgaacaaattttccatgagaatggcttcgtccgaatcgatggtgtattttcaaccgaagaattagctgaactccgtgatgctgtaaaattaattgttgaaggctttgacccgaaagaccacccacggacaacatttaacacaagtgacgaggaaaaggttaacaaaatgaaacaaagaaatgccccccccccttgtgggttttgacgatttgattgccagcagcgtgtttcgtcgccgcgggtcttccaatactcaaaattgacgaaaacccgtccatagttaattagggttcttgagaaggagaataggcattttcttaaccaaaattagcggcagaattctcctgttttcgtgcctatctcaattcgaatattctttgttctgtctctatcaaatatttcttttaaagcatgtgtccgacagctacttccttgaaagcgtagacaaaatcaggtttttctatgaagaaaaagcggtggacgagcaaagtggcaaattgaaagtacccaaagaaatggcattgaataaaatcggtcacggtaatttagccgatgattcggtccttcctaataaattacccttaattaagccttacattggctggacccatcttttcggaaaataacttttcatgaacgaattaaagtataagagaagcacagttcaaatgaatcgttttttaagaaaattgtcagtctgaccggcgctgttcagcctcgcgtgatgcaaagcatgttcatcttcaaagtccgttggaattccgtcctttccaacgaatggctttgattcaaaagtttaagcaacccaaaatcggaggctcgactaatgagcacgtcgattcaacgtttttgcacacagaaaacggagacaatcttttgggtgtttggatcgcagtggacccggccaatttggacaatggctgcctatggtttcttcccgggtcgcacaaaggcaaaatttacaatattaaattattcaaaataatgtttttagacgccaattatctttctgctactaagcaatacaaattcacaagaacagaaacaaagcacaatgggaaaaaggcatcctccgatgggccattgttaaaatttgttgggaatcggccttctttcgaaggatgcaatttcattgcattggaatgtcaaccaggtacacaagtattctaacgctaaatgcaccaatttattatcaatgatatcccaaagaaaaatttgataatttaaggctctatagtattaatccacggggatgnnttgttcantaaatctgctcctaactt

SEQ ID NO: 21198 - DNA, 1696 bp, Heterodera glycines
  misc_feature (98)..(98): n is a, c, g, or t
ttatcgtttgcttttggtacttcgtcccttgcccaattctgatcatccttcaaattaccaaattggatttgtatgtgcctttatatatgaccgaaacnttgggatgtttttgcccgtcacatttggccaatttttgcgacaaccattcgccatttgagctttgccgatggcgatgatttggataatttgcgtcgtttggtttcccctacaattctcactgattgcgaccaattcaaaatcaaacttctggcccatcattgaccaaatggttgcacactccgacaactgatggtcaaccgaagagattgtttgcagtgattatttggatccaccaaaaattgattggatcaacaacttcaaagaggtgtctcgccatttttctcaaatttttttgtttttcccaattttgtttagacatttcaccgtgccacctcttcggccagttacactgttcgaattatttttcgtgtgaaaccaatgccaattgcgccatttgaattgatgaacgaagtgacaaatgagaagctgacactgattaagggtggaacttttcgttggctgttgaaacggtgcccaattgttggggagacggcggcggcggttcagaaacagcagaagaaagacgagaaatggaccgtttgaacggagtctacttctgtctttacgatgccaatttctcgactcccgggaccagtgatcagcggaagaaaaagtgatcacttgagaaatggccgatcattattgatttttgataattgggttgattgatgctaattgtttgctctttgaactcatatcacttttgtggtagacttttcaatgttactataactgaatctctagacaatttctattgatactaaagaaatttcccaacaaaaaaatcaacaatggtttatataattgaaacaaaagaattaacaaaagcatttctgagagaaaataagcacaacaaattgagatcgatcatttctcaaatagaattattcaattattcatttccgcacacttaatcagcagacgacatttccgttgctttgatccgcttcttctttttcttctttcgttggtggcgacaatggcctaaaatgaattaaatattttattattcggcaaaatcaaatgctattgctgctgctcacccaatggatttatcgaaactacacagatcaaaagtgacattgttcaaattggcactcggatttacgctgtcttcccatttaattgctggcgccgtctccccaattgggcaccgttgcaacagccaattatacaggcaattatagcctaattctttgctaagtttcagtgtcagcttttcattcgtcacttcgttcatcaattcaaattgttcaattgacgttggtttcacaagaaaataaaattgaattttgtaacttacagaagtggtggcacggagaaatgtctaaacaaaatttgtaaaacaaaagttttcatggcaactcgtacaaaaaaaggtacttgtgtgttatctgtgggcagatttaaaaatatcctaattcaaaacaaaagtgtaaattgaaaaaaccaaaatttgatttgccccccctaaagtgatgttcctttttctcacttcaattaacggcgcctctctttgttgagcaagaaaatggtcaaatgaaatttcaatgagcataattcccattggccaaatggcaaattttgtgcttatctg

SEQ ID NO: 21199 - DNA, 2980 bp, Heterodera glycines
ttttcgtttttttaatgattttgacagtagatttgctatcttggagaaccgataagggctgcctcgaagaaattttttatgatttatccaaattttcaaaaaaatgcgtatacggacggacttgtctgtgataattagggctttggttcttaagcgcgaaaaaatcccgaaataagggcgaaaataagcacaaaacgccaaaataggggcaaaacttgttttaagtgcgaacagctaaaatatgttgccgttgtttcaaccaaagaaaattgtttaaaagttttggcttatatttaaaaaaatcgaaatttttagaatttttctatataaaaacttttaggggtaaaatttttatagacattttctcgaaagtggggaaatacttgctccggtatgggtaagaatgactgtttctttcgaccattttactttgttaaaggtcgagcatttgaaattgactaccaattgtacaacatcaaagtgcgaaaaattttttatcgataatgacgaaagataccggacgaatttaatgaagtgagccattgggatttaacaaaaaacaaaaatttgagatttacgggttggggttagatgggcgcaggacattttcgcgccgctttcttgatatcatttttttaaattttgcaggctaatagaggacacctagggctctcgaataatagcaagaaaataaaaaacaaaaataatttctaacagaatttttttaattaaaaataaaattattttaatcatcaaaaattctgatcatttagaacgaaaaaataaagtgatcttgatatgattcgatagccttaggtgtcctctattagcctgcaaacttcaaataatatacgttgtttccaagaaaatatttggtccattgagtcgatatttcttcgatcttttggccaaaaatattactctaacattttttttttttgttgaaaactttgcttttaatcacctttaatatacaataaactttatttaagtgggtgaaaaattgaaaaagttattgcgtttgacgccaaaatggccggcgccaatgtgcggtgggggccagttaagcgtggccggttaagcgtgagggtcgtttgaacgtgaatacccatatacagggccggatttttaggtgtaaaaatcccgaaataggtacctaatagttgctaaaaaactgccaaaagagttgctaaaaaagtagggtgcaaaataacataagtgaactatagaaagtaccgtatttgctctaattacccccatgggggattatttttcaacctcttcagaaagggggggataattagagattgggggataaatggagaaggggggattatttttcgacagaattattttgtgtaaaatttttgaaattttttgaccatgtcgccaaaaatgcaatcgagtcaaagaaaaatcattttttattgcattttttaaaagaaattctgttttttctagttttttaactatctattaagaaaggggtttaaaatagcatttctgcgttaaaatttttcgatttggtgaaggtttttagtccatataaatccatattttgggggttttcggggataaatccatatttggccatttttgagctttttagtaaatatttctggcttttttagtccatatttttgtccatatttcgcgttttttagtccatcaaccctatctataatgcacaaaaaacacattctttttcaaaaaattttgttttagcaccacttttcatcactaagaattttgttttgacaatttttcaatttttgttgattgaaaactgccatcgccagacccacttaaaaaataattagaaaccttttcgtgatattttaattctttttgagaaattatgaaatttttaataaccggttttaccgggtacccgacctacccggtttaaagactaatacccgacccggtacccggctttcaatacccgggcccggatttgcccaaatacccggacccggccagccctagcttaagcttgtcggattaacttcccccacccctagatcgatcagtctcattgagatctatcgattggtaccatatttgtcggaattcgtccacgggaaaaaacaccgtataagtcaagagaatcgaatatttattcagccaatcaaaaattagtttgaagtaagggattggaatacattgcattttaaggaccacaagtacatacgaaagcatttaaaaaaggcatacaatgtctggcaatacatagatttttgcttttcaagcaacaattttaagaacaatgaagaatcaaacaattaaacattcattttcgttttttcaattataaactaaaaggcaaaaatgtggcaaaatgatgggctttttagttgttaggcatcgcatgtggcatggaactcaacgcgtcgatcaatttcgctggtcacctgatcaatctgatcactgagttcctcagttgaggtatgaaaactgttcagttccacatctaatgaatcagcacgttcaatcagggctaaaaaaaattaaaaaaacaaaaaaataaattaataaaaaaatagctcacaaattttctcttcccgactccgcttaatctttgccaacaattcggttgtgcgcttgcgcaactcttccgcccgctgtttccgctcctcatttccgccttctttggattccaataaagctaacactttgtcgtaggtggactgaaattaaaaaattaattatagtaggcattattaggtgtttcataaaaatgatcctctctgaaccacatttaaaaataaacaaaaaatttaatttgggaaagaatttgataaattaattttcggaaatccgaaaacccatgccaaatacataaaactaaacagcagactgatctattttttcattgttacctcccgcccccttaaaacccaagtagaaaatcttggagaccgtcccctgatttacacaattaaataattttctatacatatcattttaaattgtttct

SEQ ID NO: 21200 - DNA, 1395 bp, Heterodera glycines
  misc_feature (1308)..(1308): n is a, c, g, or t
  misc_feature (1327)..(1328): n is a, c, g, or t
tcgaaggggaaatacacgcaatgaaaaatccaccgccatcgcctgccccttcctccaaaacacctgaggaggaggtaacaacaaattcggtccacaatttttttggcttttgcttgaagaagttgtgctttcactttgaattttttggccccaattgttttaaattatgctttttttgcacagatgcacaccaccaatcaaagcggtggtcaaatggaaggaggaggggcaccgacgggcaatgtcaatgtttgtccgcaacaacagagccaggttttgcgaagagataaacctcactgaaaaattaagggaaaatggttgcactaatttttacttttttaaaaaattgaatttccaaaaagttacagtcggtgctttttggtgccgcttggatttaacccctccccctaattttaaaatcgttaacagaaaacaattgggggagaaataatcacccaattcggggcaggcgtttttggttagcggcgtttttcccctaaaaaatgtccatgattcagtattgtgtttgaataattttcctcccctccactgattttaaatggtgcaatgccgtgcaaaaagatggagggggcgggtggctcatcgggctccacattagggcagccttaagcaaatcttaaagagcattgtagagatatgtttacaatatccctttctgtgtttaagccgcctttcgttgtgttgccaagtcgtttgcgtgtagaagtaaggatgacttttgctagccgttttttagtcaattgcctgcttaaggttagtggccgtactcagacatcaatttccctcacttggatgtctcattccaaaattggtatgacgatcgcctcgtacgtcgtgctcaaaaaaagcgacttaggattgtggtggccgatcaaaaagcaaaaggtcagtcaaaaaatggaataagaaacaaaaaaataaaaatgtacaccattaaacggacaccccggcccttccaaatacgaaaaacaaatacaaactgataaatattcgatcaacatagctcgtcggtctattggcaattgaccatttatccaccccggtctccctccgctcccctttatgtttcacttcctatccaaatccagtagtattttgccaaaaaatgtgtaatttttgctttcattgccaattaacaaattaatgttataaatctacgaaaaaatataaaaacccaattttttataattttgttggttcgagtcaccaagtgccattcgcttttcagtaccagtacccctacaaggagggcgttgagaataacgccacgatcaaacgcttgagccncggtaccgaataccaattnngaagtgaggcctgggataaacacgaccgttccacagacgcatacacactgcctgtggtccgaacaat

SEQ ID NO: 21201 - DNA, 1275 bp, Heterodera glycines
  misc_feature (1248)..(1248): n is a, c, g, or t
  misc_feature (1257)..(1258): n is a, c, g, or t
ttaaaattagtcacaatcatggaaacatcaaagatctttccctatttattttaacataaaaattgaatttaaaagttggaatttttgccttttgttagaattcggggttttggtgttcggaattattagttgaaagggatgtcatattcgtgaccagcgagcgaccccgtaaaccaatgtaagcatattttcatgccatttgaaaaaaattttcaaaaatggggtggggggggcggcaaaacaaatattgccggattttaggccctgtcctgttaattgtaggactaaaaattttaacaaatcaatgttgcgtttttcgagcattttaggccaattagaaatggactaacaatgcatcagtgcttttgggttttcatgtggctcgccttatgcaaaacaaaatatggaggcttttagtgccacaaaacgctgtcccacccttttagcaattcaaaacttgagaaaatgtccttcttgaataattccgcttcgtaccaatgaaattgttagaacagatcagcagaggaaaaaaaaattcaaatgaaaatgtgaacaaaatgagaaaagacacgtattttttaaacgcaaaaaacttttttaaccaatcaaccctcattatcattatcgtcattaatagcctcatcaaaattgtcctcggcttcttcccttcccttttgttcgtctgccatttgcctgcgcgacattttccgccccgccggcgccgcccacccaaaagaattgccaaactgttccagcgtcatcccctcgttgtcaatctgctccaattcgatggtcggttttctgtgaggggcaggaaattgttggccattaattaggtacattcaaaatgatttccaaattagaacagcatgtatgaatcgtcattattatgaatcttatagggaaattttttttttgaaaaaacagacaatttgcaaaaaatgccatttcataaaaaaaataaaaaaatgtttttctctgaaataaaaaaaaagaattttttaagagtttgaaacgaataaacttaaaaacagtgaaattgtgtgccgttaaatgagaagtgaatgactcaaactgacgaatattttggcgggaaagggtcgtcgctgaattcttcggccaacacgtccaaagtcatcggatgtcggaagtcgaaatggaataagccgggcgttctgcaaaaaaaaaatgcggtggacgcccactcattcatcacttgaaatttcgctttttttaaatttcgccaantcaagaccnntgcaggcccatgcaagc

SEQ ID NO: 21202 - DNA, 1608 bp, Heterodera glycines
  misc_feature (69)..(69): n is a, c, g, or t
aaacgaactgtttaccaatcgccatttttgttacttcatacgctagacttcatctttatcgctatatgnagcaagtgggccaactcggccataaaatactctattgcggtcagttaaataaatgttttttttttaaattatttattaaagacactgactcaatttattatgttgcaaaaaatgggagacgattggttcccgaaggagaagggctcggacaaatgaaacgtgagcacactgaccgacgaatttttgaattcatcagtggtggcccaaaaaactatggctttcggcactgtgatcgtgttacgcgggcagatgaaaaggcggagctaaaagttcgaagctttcgactctcttatgccaccaatcagctactaaatttcgaatcgatgaaacaacttgttctggaacattacaactttgatggagaaatgttctttttaaaaaatttttacgtaaaaaatacatttaaaaattcagtgatcccgctctctatatgaacgacgaatgttatgtctgccccggatcatcccgttctatccgtgttacttttccacaaattgggcgctccccttgctcagatttatatacctatcaagcgcataaggattatcgcccccattacgtgaaaggccgcgtaaggccaggaatggagacactgccttttggctatcgcaacgggtttacacgtgccaacacacaacaacaacaacaacaaccgcaaatcaacgaaatgcatggaagaaatgtcaatgatggtgatgatgctgcattccgtgatttgccgggctgttcacattggcaacccactcattatcgcaatcgatataattatcaatagttttaataaagttcttcatttggagtcaaaaaactagataagtgaagaatgaaaatcgacaaaactgaaagacaaagtttaaaatcagcaggtacaaaaacattctcttccaacttgtttcctcaacaaatatgggtaactgacagggctcattgtgtgcacattgttgttgactgtgacttgctcatttcctttctgacgattgtttagctccatatattgcggggggcgggggtgaaatttatcgttggcaataggtcttcgtcctcgcccttgttcttctttgcctctctgacggtttctgtttcgacctcctcctcctcctcctcctcctcttcttcttccttgtctatgaataatggccgaacccaaagctaatctttctccccctcgttggttatcactaattcgtgtttcaacgacacttcttggacctccgcttgcttcagcttttgcacgggcgtcttcacctccacgtgccattacgacgacttgctggtgcgcgccatcatgatcatcattattatcatcactcgtcttttgggtttgccctttgttggctgcagcaactgcaacaccgccttcacgttcactcaacgcttccgctcttacaatatggctgtcctcctcctcctccataccactgccttcctctcggttgacaccggtttcagctctagccctggagccttccccggttgcggcgactgctgcccatgtaccctattcgtgtcggtcaggccattgaaatctctggcattgtc

SEQ ID NO: 21203 - DNA, 1334 bp, Heterodera glycines
  misc_feature (1239)..(1239): n is a, c, g, or t
caaaatgaaaagggggaaaagcacatcgaatggcaccgaatcgcgcaagggcaactcgccgttgcccagcaactgttgtgcccactcgtcgtgttcgttcagcttccgatggatcgcgctcatgtcgcgctccaccgcgtcctgtgctctgatcagtcgttccaccgtttccatgtctttgcccatttcggtgccgcccaattgcgctgctttttccccaatgcgttcgttggtctcttccacgttgtgattgaatcggtgcacttaaatagtgccgcgtccgtcacttccgttggcacggtcactccgctgacctgcgagtgccgcgttgagaagtgttcggtagatgctcagtcggcccgccagccgttgccagccttcgttcacttccgccagccttttgcgcacatagtccgattcggcagactttcgcccgatcaatcgtcccccgaggcgattcgcctccgccagagtgccctcgtcgattccttgactttcgtccagccggtccagcctggatttgaaggggtgggtggtcatccgttgtccgtttgtgctcccccaatcactgacagtgattggcaatgctccaaatcttttcccaaatcttccgcaccgaccatcccttctttggcccgcacaaatgtgcacaatcggtctgctaattgctccaactccaacaagtcgcgtgcttcgtctaacgccgcgtgcaatttgcgcatcgcctcactgagttttgaccaacgcaaaagaaactcatccgcccgagagacctttcaagcaaaaagaataaattaatgagttccaatggggccattttgggcatgatgccaacgttttccgtgtctccgtgtcatgtcctcccccttcccctccccgtccctctcgccaccgtttgactcaccgccgtctccgtgccatggcgccccctcagccgttccaatcgctctctcattttgtcaatgcgtgtgccattggcgtccatctcccgctgcagtgcctgctgtcgcttcagtctgtccaacttttgctctaacgacgccccgcccgcttccgccgtttgtgctttgacgcgcttttccttctcctcaacccattcgcacatttctgacaatttggcttcaaattgctccaactcgactccctcgtccagcagccgcttaaccttttcaattcgctctcgaaagccgcccattcgcaagacgacctaacaaaagttacaaattgggtaattgtggngataatttggataattaacggactcgatgataaatgggatgataaaacggattgctgataattttgtcatttgtgtttccctgccaccttttttg

SEQ ID NO: 21204 - DNA, 991 bp, Heterodera glycines
ctgatcggtctccatttctgtcattgatgactgagtccaggcgagcaaatcacgcaattgggcggcaaatttatgagtttcgtaggaggagagaaggggagcagaacggcagagagtgaggtcacgcagagacagcaaagagtcattcagagaatcggaaatcattagggataattagctaaggaaggcggacaaagccattagtacccggcagaaagtcgaccaaagggttcggtgattcaaccgattcgaagcgctccaataaaagcttaaaatgggaaccaattaatccaaatccgtcggggacggctgttccgccgacctgaagctgttcgtgcagttgtgccacttcgttctccaacacttcgttggccaacatcagtgcgtacgcctgcttcgcgtctttgcccacttccgtcggaatttcggccgttttttctctgattcgttccgccaatacttccgcttctctccttaggcggtgcgtccgctccgcttctttcaatttgcgtcctctccgttcggttaattggccaatttgtgcccaagtcgtcctcagtctgtcgctcattatcgccactttttgggcaagcttttcatcgtccacgtggcttatcagttcgccttctgcttcttccactttggccattctttcgtcgcccatccgaagggattgtctgaactcttcgaacttcgtccttagttgttcgcactgctccaagtcgttgccacattcttcgctgttcgtcgtttgcttctgttgctccatccattcctccaattccgctccgtccgccaaaaatgaacgcactgccaataccgacccggcaccccgtgccgcttccttggccatgccctccaatgcttttgcttggttctccacccgttccattcgctcggctacgctttcatgcccccttttggccagctgttcgccccgctgtctcagttcgccgaatgcctttctccacggcactatctcattttgcaa

SEQ ID NO: 21205 - DNA, 2417 bp, Heterodera glycines
  misc_feature (2051)..(2051): n is a, c, g, or t
  misc_feature (2235)..(2235): n is a, c, g, or t
  misc_feature (2306)..(2306): n is a, c, g, or t
  misc_feature (2383)..(2383): n is a, c, g, or t
gtcatcattatattcatataaaattcaattatttttttaccaaacgggccataaaaattaattaattatctaacatattcaaatctctctttttcgtaaatcacggcatcctttcgccgatcgtaaacggcgctttttcctcccgtcgttttcgttcgtgggcggcccgggccgcggaaaaggcacacaacgcgagcggatcgtggaaaaattcggcttttacacatctcgagttctcggagatttcgttcgcgcgctcgaagttgcatctcggctcagtgttgggcaaacagctcgaaggcaacgatcggacgcgggtgggctcgtcccattcggtaagaacatttgaccaggggtccggacaatcggtcagtggacaattcgtcagaaaattttatttatttttcgatcaatcgataatcaaacgattcgagattcgctcaatttaaattaaatcgggttgggtttagaacctttctagttatttaatagaacaattttcgtttatcattctttaaaaattatttttaaaaatgttcattcattacttttaaaaataaaacaaattattatttaaattttttcaatttaaattcagtccttgtataattacaaaacatttgcatttaggatacagtgttggccattgtgaagggggctatgctcaaaaagcgagaatcatcgaatggttttctcattgatggtaaaaaatgatatgcggaagaaattagaaaattgcagttttactatttaaaactttaaaaaaataaataaaatacaaaaaacgaaaaacgaaaaaatgtggaaatatgagtttttattcggcgattctaaaaatagattagtgtaacagctttaccaattctaaaaatttaacgcaaaaatcttttaaccaaaagtaaaaatgtgggcgaagtgacaaaagtatgggtgtgggatgtggccgaagatgagtcattgcagtccaaagattaaaattatcattttaattgataatttgctttttcaccgggcccataaattatttattttcattatttatcaaaaaaattattaaagagaaataaaacccaaaaccacattcgccaattcattcaattgcacttttacttttctaaattttattttaaatatatttaataatcatttaatgatttagaatgaacttttcaaacttctaaaatttcttactattttagaaattattcttcaactcgatatttgtctccaacgaaaccgacgactaattaacatttaaaatttaccgaaatttgttaaaacaagtaaaaaaaattgctgtactttgatttatagttatttaatttttaaacatatattttaagacatataaataataatagggtaattatttttattttaaataattttcatttattagaatcatttttgggactgaaatgatccatcctcgtgcctgtccccacacccattctttcttttgtcactcaaatgattattaaccttttagggtatccccgtgaagtgacacaaggagaacgctttgagcaagaggtgtgttggcccattaaattcaaatttcaccaaaatgccattttcagatccaatcgcccgttttggtcatttatttcgaggccggcgatgaaacgctggtcaaacggctgatggggcggggacgaagtgatgacaacgtggagacaatcaaaaacagactgcacacatttgtggagtcgacaaaacccgtggtggaccattacggaaagcagggcaagctggtcaaggtcagtcagtcagctacgacaaacaaatgttggatatgttggatatggaaccgttccgttagaaaatgcagggctaccgacatttagggatttgtaacttgggcacccgaaattcggggacccgacttttagggatccgacacttaaggattccaacattttgggactctatatttgggggtttgaaacctggggacccaacttttggcacccgaaatttggggattttaatgaaaaaaatatatttttatttaagttgacgttttgtttgatggcccttggattttttanagcccgcatttttttgttattatttaaaaaataattaaaattaataaattatattcaattattttaaatttatttagtaatctttgagatgaaaataaatattataataggtggaacaagaacaatttataatataaagtatatatataaagctgaaaatatttattaaagtaaaattagtggntaatgccttaccaactcaaaaatcaaattaaaaatttttagtatcaaaaaattaattttttgattactctnattttttgaaaatcgattcttagagttacatttcaaaaaaaaattttttttttgaattttttacaggaaaatttcantaaatttttaaaaattctcaaaatatgtaaaaaa

SEQ ID NO: 21206 - DNA, 3342 bp, Heterodera glycines
  misc_feature (1241)..(1241): n is a, c, g, or t
  misc_feature (1259)..(1259): n is a, c, g, or t
  misc_feature (1343)..(1343): n is a, c, g, or t
tcattgatgaagctcaaagcattttccataaaagtgttcggtcttttggcaacaacacagcaagctcctcgttaaatttctcaacgctcatgcccatcaattggtcgttccattcattagcagccgcgggctcattagtggccacctcttgcttcgctttggttttcggggcttttccatttttagttcctttagcagccgcgggctcattagtggccgccgccggtttcgttccggctttctgagcttttccctttttggttgctttatcagccgcgggctcctttccggcgtcaactgttaaaatggcaatttgtaaaaacaacagagcgacatggattcgtgtccaagggtgttcttgtcgaatgagcaacagatgccaaggacacccttaagcccttggccagtccttagattccaactcattggtttgttgagtgaaaattatttctttgaaatttaatccggctcatttgataaaattaaaaaaaatatatttccgaagaataagtccttgaaattcctaaagacatatattattagattacaaaaaaattaatttttatgaatgtattgtgcgtaatcaaatgttcaattagtgggctcatttttctaaattttacaaaatataaaaaatatgtacattctttaaaaattgcaaaatttgtaatgtatgcatgataaattatgtcatggaaatgccaaacatataatttattaatatttttacatcttttctaattataaaatccgaaaaagtttaattgagtgccaattccagataggtatgcttaccatccaaatacgaacttttattattatacatacccttattgttgtcgccgatgttcatattgcgaaatccctcaacttcgtctaaatataatatataatttattatttgtttttccaaattttcagtccatctcatgtacatggaaaaatgttcaatttttgatgagcaattttttcaaagtgggatttacaccaatgcattacgcttgttccaaaaaaaacagcgaaaatgtctaaatacttaaattttaatttgggaaaagtttgagtttttcaaaaactaaaaatattagatgaaaaaatgattttcatgaatttaaaatttaacaatgacattttcattttacaatttcattgggcacatttagaattgaatttataattgcgtacaaatttattcaaactctccctaatacaataaataagaaaaaaaaaattcagtcttntaaaatttacccacctgnccgttgacttttgccagtttttgcaagtgccatcgaaaaacatggtcagcgagagaagagcaatgccaacgaattttgccattnttgtcggtcccaggaaatttttatttaaaaatgaattaacaatggtattttttgcttgccatttgccagttaaaataccgccaattttggcttgctaccccttctttaaatggaaggaaggggggagggggggtttggccaaaaaaacaagggcccaacccaaaccgtttccaaaagcctgggccaaaaaatttttttcctttttaaaaatttttgtgtccaaaggggggaaaaaaaaatatttttccccttttttttaaattttggaaatttttattccccaaaaaaagggggaaaaaaaaactaaaaaaaaaacccctccctttttttttcttggaaaaaataaagaaaaaaaaaaagaaaaaggggggggggcccccccaatttatttttttttttttttttttatttattataaaaaaaaaaaaaaaaaggcgtttttttttttttttttttttttttttaaaaaaaaaaaaaaaaaaaaaaaagaagaagaaaaaattggtggtccccccccccccccccccccccccccccccccccccccccaacaaaaaaaaaaaaaaaatattttttttttttttttttttttttttttttttttttttatttttttttccccccccaacaaaactataacaaccaacctttttttttttttctaaaaatttttttttggggggtgggggaaaaaaaaaaaatgccccccccttttttccctttttttttttttttttaaaaggccccccgcaaaaaccccccccttattgggcccccccctctccctttttttttttttttccgggggaatttgaaaaaattccccttttaaaacctaaaaaaaaattttcccggggggccccaaaaaatgggaaaaatttttttttccgggccaacccaaaattaaatccaagttcaacccgtccatttccggatttaaccaaaaaggacccttggccaccaaaagcctttttaaaattgaaccaattaatttaatgacattcaaattgcactttttctgtttttttggtccattttttctccacccatggccaaaagatccgttcgatttggcctttttatgccacattttcccttcgtttgttttgttcaatgcaatataattgagtgaattcgatcagcttaaagtgcaacaattagcttatttttttgagttttgttcatttattttgcctttttcgatatttccgcgtctcttttctgtccttttgcgttcgttctgatcaaattgtattgacttctttcgaagaccgaagtccatgacggattattaacttgacaattcaatttggtggttttaattggttttttaaattttaatttaattacccaatttttgctgtgttatcatcgctttcattccgttaataaattttgttagaaatttcttctccgccttttccttcgacaacaaaagctgcttcatcttcttttgtgtgctcattgtttttccgttttggcctttccattgcttttcatttccgtttaattccgcttttagcaattctttggcttttaatgtgccaattgtctgaaggtgcaattgttgtgtcgttttgtccgtttttttgcccatttttcccctcccaaattcgaattgtccctctttttccgtttccaatttcaaaatcatttccattgcttttacggcggcactttctctttcattcgctcttaaattttttaaaattaaattaaaatttgaccttttcaccctccaaatgtcagctcattcagctcatcgtccagcaaatgcaatttttccaacaataaattaattgcgtccgatttggccaatttttcctccccaaatttttcccattttcccccaattttgcccattattttttcgttctcttcgtttttgcaattccttctgatccatttcaatttcgagtaaattgttctgacaaaaaccgcaacattcaaatagcaaatgcatttttcttccaattcattccccaaaaatttttcgtat

SEQ ID NO: 21207 - DNA, 1092 bp, Heterodera glycines
  misc_feature (230)..(230): n is a, c, g, or t
ccccccctgaaatagtaataaaaaaaaaattttttttaaatattttttggcaccaatttccgtgcattatctttgaaaattgaatcaatcattttacagaatgcttccgtacatattgctgaggatgtcaaggaggaggtggtggatgaacacaaagtgtcaacgacgacggcaacctttgacaaagtcgttgttgtacacaatcaccacccgcagcagacaccgccgcncaacaaaagcaacaacaattgttgcttcaaaactcccgcacttccgtccaccgatgggtgcgtaatgttgttgtagtgttggtgtattgtcattgtgattaaaaagtgccaaaaaatcttggcatttgccgggcgctgtctgaggcttattattgttagggcttatgagaaaattcgaaaaaaaaaattgaaaaagttgacttgcttaaattttgaaatttttttatgtaaaaaattttaataaattttttttgtcggacggtacgggcccctgtatttttaaaaaatttaccgtgttagggctgccccagtgaaaacccgtcgtgtgccataaaaataaaggcaaaaaaaaacacattccttcccattttaaatctgattacaattaaattttaaatcctgcgcatggattggtaccaattttttttccggtggcctgggaaggcaccattatagtatttgtatcgcttttttggttattgaaacgacaaaaaattgaaaatgtttgtccactaattggggatacaaactatagtacattagtgccgctggggacacatggtttgctttgagaatgttatcagcagcaacaacataggcacacactgtgatggggcgaaaatgaattaaaaatctgtggtcgatcaatttcaatttttttttcccgtgtgccctttgaaaatttttgaatttgatttggtcgaattcgggattggccaaagtgaaagtcatattcgtgatcagtgcctccgaaaacccaccaaaatgcatcacatgtctgttcaaaccttcttttaatctttttttggaaccattgaaaagagcgaattaattaccctctgtcccctcaatgggtgggcgg

SEQ ID NO: 21208 - DNA, 2638 bp, Heterodera glycines
actccggtcgttccagggcaatgcgacttcggtatcggtcgtcgacgaacgtgaggttcttctcttcgaagcggatcatccacacgatcccgatcgattcgggtcgacgcgtcatcccacgccaatcagaatttcaatccgaagaagtcgttcgagtcgttcgtcctcttttcgaaatcatcttcgatcgtgaaaactctccgtctcttctttcggtcgattcgaacgtgactcgatcgattcggctctcttcttcgctcagtgccgtggactcgacatgacaaatgtcacgtttggcgtttgatgcattttcgatgcgtcttgatccactcgaggattttcgccgattttggatcggcacagtgtgaaaccgcttggcaacttttcgattggttgaacctgcagttcgtgccagacatcaattccgagcatgatgtcaggttgtcgttgttcatgcggaggattgagcttttgttgcctcaactctgtcttgtccagctctgacagttgaatcattggcatgtcgttgaccaagaatttcatggcgttgaggttgaagatgagtttttccccgctcgtgcagagaaatccgagcttgaccaggtcgctgatgtatctttttggttcgcgttctccgaaactggtcaagtggcattcttcggtgtggaccaccggaagatccagtagctgtgctgcctttgacgaaatgaatgatctgtggctgcctggatcgatgaaaattgccgcagtcatgctgagatgcggttgtgctggattgaagaccgttgaagttgcggtcatgaggagtgcgcgggtgtcgcttccgtttacggcattgcacatttgcgatgtcgatgccgttggttcgttgcttccgtcttgagttgtgattgacacattttgttgtgtttgccccaacattgctgctgtgatttggttcggtggtttttcgtctgcataacataatgccgttggatgaggttgtttgcatttgaagcatcttttcggttgtgggcaattgcttgcttgatgattgcttttgaggcatttgaagcataatgcctttgtgcgcaacacttctcttcgctgttgaattgtgctgtatttccggcattcttcattccagtgatcgttgtcacagaagatgcatggacttggaggcttgcgttgattgaatgtcgcattggcatgttgagttggaaattgcctttgattgttgatcgcattggcacgttgagttggaaattgtcgttgattgttggtcgcattggcacgttgagttgaaaattgcctttgattgttgaaagtgcgcaatttctttgttgcggttgtggtgcgcgaggcctttgttgctgtggcctgtgttgaggctgtcgattgatcagccttttgtgattgtcatccaccgctgaggtgatgaatgtgcgttcccgttgctgtgggattggtgcgcggtctcggaattttgatgccgagaaattgggcctttgtggttgcggccgttgttgtggcgagtgtccgtactcgcccatgacttcttggatttggctttcttttcgaaccgcttcgttgagtacgtctcggaactttgtcgtgttccagcgtgccgggtcttctccctttttggttaggattgtgcgcaggaatccgggagtaagcttcttttcaagcatgaggaaggtcggtgggccttcgatgtcttctcctgtattgttgagttcgcgtgtgagtcgttcgagttgcaggaggaattctttggtgtcgcacaggtttttgcagggcttgaggtttgccaattcgaagtgaagtgccctgatgtgttcgtccggtgcgccatatgtgtccttcagcaattggagggccgtgtcgtaattgttgtcctccagtcgaaagccggccacgacttctcgggcctctcctccgagcaggttgcgcaggagattgaacttttccgctttgctgagtgcgtgtgtgccgattgctgatttgaacgattcgtagaactccggccatttgcgtttgttgccgaagaacttgtccagctggattggctggaattggtagaacggaggagtgaaggacggcgtcttatttggttgttgctgcgaggtgtgttgcattgcgtttgcatgagctgcttgagcgtcccgctcttctttgtccgccttgctgcggtagagtcgggattgaactgtgagtgtgcttatgaggtcgcgcaagtcgcgcagcttcagtgctgcttcgtcgactttgtctgttgttcgctcctttttctcgaacttgttgaaatctgcttctgctggatcgcgttccgttgcaggcagtttgcgcagtaaatccgcccatgctgtgagcgattctcgtacgtcgtcgaggaagatgtccattgtttttgcttccttttggaccttctccagttgagcctcgaaattgaatgcgttttcgaggtttgatgccgcttgatcggcttggatgtttagctccgccgcagttcgggttcgggagagaactttgagagcagcgctgagtttctgttgaattggtgcggccattgtttgctctgttgctgtagctgtgcttgttgctattgactgcttgctgtgctttgtttgttgccttggatggcttgctgtgcttt

SEQ ID NO: 21209 - DNA, 1616 bp, Heterodera glycines
ttcatttttcttttaaggttggggagcgatcttaagggaagggggagttgtaaggattattggcgccatttcctcaatttaattatttcccatgggccgttatcaattcaatcacatttatccttttcaacacgtttttcctttacacattgtaatgtttctacgcccattcttttcgtatttctctttccccagcgatcagtcagtcagttgtgatggaacagacttcaattattattccgatttctcgcttcgtgtaaatccagcatcggaatgaatgaattcatcttaacagtcaaggagtcgtttgggggttcggggattggtcaaaggcgcattggcttttcaccattacctcacaacctccatccgggataaacggtgcatagttggtctgggggcacagtgtgcatccctcggtaaaggtaataaagtataatcgtttttcagtgtataatcgtgttcaatgggttaatcatcttgaaggtgccatggaataccctcgcgaaaatataagaatttaggagaggctctcaaccaataatcagtgtacattagatagtagcgcacaaagagagtaagtagtagatggtctgaagttaagcttgtgctgcttagaggaaattatatccaaaggaccatatcatactgtcgtgcacatataaaaattcttgaatttttcatgaccttgaaaaaatatatattatttctcagctcattcagagagtatatactaaaagttccgaagttaagcttgtgctgcttagaggaaattatacccaaagtaccatatcatacactcgtgcccatataaaaattcttgaaattttcatgaccttgaaaaaatatatattatttctcagctcattcagagagtatgtactaaaagttccgaagttaagctagtgctgcttagaggaaattatacccaaagtaccatatcatacactcgtgcccatataaaaattcttgaaattttcatgaccttgaaaaaatatatattatttctcagctcattcagagagtatgtactaaaagttccgaagttaagcttgtgctgcttagaggaaattatacccaaagtaccatatcatactgtcgtgcacatataaaaattcttgaatttttcatgaccttgaaaaaatatatattatttctcagctcattcagagagtatgtactaaaagttccgaagttaagcttgtgctgcttagaggaaattatacccaaagtaccatatcatactgtcgtgcacatataaaaattcttgaaattttcatgaccttgaaaaaaaatatattatttctcagctcattcagagagtatgtactaaaagttccgaagttaagctagtgctgcttagaggaaattatacccaaagtaccatatcatacactcgtgcccatataaaaattcttgaaattttcatgaccttgaaaaaatatatattatttctcagctcattcagagagtatgtactaaaagttccgaagttaagcttgtgctgcttagaggaaattatacccaagtaccatatcatactgtcgtgcacatataaaaaatctttgaatttttcatgacctttgaaaaatatatattatttctcagctcattca

SEQ ID NO: 21210 - DNA, 2319 bp, Heterodera glycines
ttcttcacttttatttttgtcccattcttcgccaaatatctcactcaggtttagtcggattttgcttgattcaattcaaaagcaaagaaaactgctatgaatattaaaaaccacaaattcattgaatatttatataaaacaaaaataatattacgaatttattgaattaaatgaatttatttaatgttttattcgcttttaataatattaatattcattttatttgtttgttttaaatattgccaatagaaaaattgttacttaattcagagcagagtgaaatcaattttttactcattttttaattttattcaaaaaatatatgcaaattaatttttttttttattcgtagtagcatttataatttatccatcgtaagttagttaattcatgaatagttttcgcatttctttctttaatttcgaaatattttttcatctttgggtctatgcccatttcttcactcgtttggtttgttttcattttcgtcatttcgctgaatatccgtattcgaaaattccatcaaaatttgtcagggttttgcctgtatcgattttataagcaaggaaaaatttttaaaaaatttaaattcttcattttacaattcacaaatttaaaaatatcatatgttagaaaatcatactgtgaatgaattgctcaacaatgttaatcaatttttactgttttgttgaaggacaatccataaaattatgacaaaattcgtgtgcctataaaaaaatggactaaaaaaatttaaaaacttttcaaatatatttttgaaaactgttttagctgcgccaaatttttgcatgcggtacggcttgcgtggtgacgccggttggccgaattctgtacatccgccagggcaatgggcgtgccggccgaatggaggacatgcaaattccgatgccaaattcggatgaagaaccattgaacatcatgcagagactgtacaaagcaatcaccgacatttattatgggcgacagaaacgcgaagaatggactcggattgttgtctaattatataattaaaaaaaaaattttaaaagaatgagtttaaaaaataatatttattattttttttattattaccgttttgtgataaaaagtaattagcgtattatttttttaacttaaattcttccagtatcctaattgattaaaatggtaaaagaattaatttgttataatttttaaaatttcaaaatacgtatgttagagactcaaatcaaccctataaaagtgaatgtaaactttaaaacaataattttttttcaatttattcgtcttaattttgaaatcattcaaacatttttaacaatttgccctaggtcattaaaagtattttacataattttaggttttttagcatttatgttagttttaagttagtttaaaaaagtttaaaaattaatttggtgatataatgaaattagtgggataaaagtaaatgaaaagagtttgaactgcttgagggtgctcgacctcttcgtaaaagataccaatattggcactcaacataagtgccaatctcactgattttccgagaaaattcgtcataactttgcttaaactcaaccaaagacgattttttctcggaaaatcggcaatattggcacttatacgaaccgcccaattggcatcttttacgaaatgacccagaaccattaaatttctaaaagtgacaatgcccaatgtttttcgaaaatttcataaaatgtctaactcttgtttaccatatgaacgggtttaaaaaattttctgaaattttgtttaaagcatgtattatttgaggaatttcgatttttgtaaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaaagccattaaggcaccgttgtagcaatgatgcacgtggtccttggaaattcctctggaattaatccctgaatttcttctattttcttatcactcacaaatcactgggggaaaattaagatgattctgatgattagcgttcttgttcgattttggcgctagtgcgatatttattctcatggttcttggaaagtactcaggaagtatttcgatttttgtaaaccatcagctgatataaagaaaagcattgttgtctgtccttttccaattatattgccatttcggcatcggtctaacaaagctgcgcatggctttgggaattcctcaggaattaattttcgttgt

SEQ ID NO: 21211 - DNA, 882 bp, Heterodera glycines
taaaggatgaagatgcgaccattggatggcatttcagctcaacttggggcttttatgcctcctaaataatcgttatgcgccaaaattggcgcttttttttcaactaattttacattatgcacagaatgacacgggcagcaaatgagaaggccaattgcatcacttggttcaccacggattcggcgagtggactttcggtggagaaaaattcacttttaaatttgtgagaaatttgctggccaatcgattggtcaaaatgcaaaaagcccaaaaattcgtttagcgcgttgatcccggggaccactttgaattccagaaacgcatcttttgactgatcattttcattgatcactcgaaaatacgcaatttcggccacacattttacaaaagtcaaattgaacactgtccttttctgtcccgcagaataattaatttgcttttcggcggggaatagcgttgacggatcacgtacaatggtgtctgaaaatcatcttaaaatttgcaaaattttccaaaattctttaaattcaataaatttaagctaacaatctcggaaatagctcaatatggaaaatgaaaaattattttaaaacaaaaaatcaagctaaaatttattaattttgaagaaaattgaaacttttaaattttacgaaaatatagtttagtaggtacttccgtattttgctaccccctcccccctcgaaaaattttaaaaattcatattttggggttcaaagtcactgatcacgaacatggtgtcatcaaatgtcgaaacaaacaccatattttcatgatcagtgactttgaaaacctcaaaatatgaattttaaaatttttcaaggggggagcgggtagcaaaacccggaagtaccgtttagtata

SEQ ID NO: 21212 - DNA, 1072 bp, Heterodera glycines
gttggtctctactaattgccagaagccaaatgctggttcgctttaagcaattctttatctgtctgtctattcttgtggatttttactcattttctacggtagacatcgccttacagtactttcatctgtcaataaaaatgaacatgtactgtaatttgtttctttttttttcttcaaaatacaaaaaattttggaagtcatttttttcaatgtgatatacaaattatggtcaaaagatgcaataaaaaccaattaatgagcataattagtgcgttaattaattcaattagttagtgataatccgttcatcgtcgttggcacataaattgccggaacaatttgcaaattgcgtccaaaaatgtgaaaagtgcgggcaacaaaaacagggaatggacagcacacaaaacaatgcacacgcagagaacccggacaaatacctggaaaaattttttgtaaatttttgaaattttcccgtaaaaacgggcctgagcagtgtaaatttggacaaacgcaaggctcaacacgcaaatgcaagtgcctggaaagaggaaaaaagtttgaaaattttaattttatttaacaaataaaatgaaaaatattataccttcccatggcctaagcgcaaaattttgggaaaatctatgaaaaatgaaattttgacaggcgtcaatggaagaattgcacgttttttgagatttgttaagaaattaagaaaaatttcaaatttttaattttccaaaattttgggaaatttttaaaaataatttttgcctcaaaattggcaaatttttcggagggttaagttgttgttttattggtccaaaatgccgggcatttggtcgtcgcaatgcgcaacattatgccacacaaagcccaagggaaattttccgatcatccaacaatctccttacaaatggatgcttgcaaggctgggaagccgacagaggtgaaagcgtgccgaattttgtgttcaacactttggtcggcaatgccatgcacattttggccacccaaagtgccggcccatttggcggcatggaaatgatacgaaacatgggcctgaaaagtagag

SEQ ID NO: 21213 - DNA, 828 bp, Heterodera glycines
  misc_feature (797)..(798): n is a, c, g, or t
attttctaaaaatcgattacctaattaacaaatcattagtaatccgcaaagaaaattttggggcctcagttgaaataactcatttgtcagttgagttgagatttaccgtatgtccataccgtccatgttcttttcaccattcttccctaccctaccgtattctcctcccaagctttgcctaaggtactataagtaccatgttctcctcccccattctcccctaccgtaccattttctctgtccccattgcccctaccgtaccatgttgcatttccccattctcccctaccgtaccatattgttttccccattctccccctaccataccatgttctccaacaaatccaggtacagtccgtcgtcatgcaacaccgacacgttgaactcgggcacatatttgtccaccacctggcgccactcgcgcaacatcagcgcccggttgtaccagtcctgcaactcatccccatggtacgcaaccgttgtcatcatcgcgtccaactgagtcccatcgctccgattcgtcgccagggtcaactcagtcccatttccttgactttctgctgactgttcttgttgcgggtgcgttgtatggtggtacttgagcagaccgcgccagtgccgaaactcgggccagttgagaactgaaatgtgaataatggcacgaggactcaaaacaagggcctcaaatgattgatttggcactcaattttcggcactttattggaaaactcccaatttttggcacttttgggaaaccatgttgtgtcaacattttttgtaaatttccaatagtaagnntgggattttgccgcttttttcctattccaa

SEQ ID NO: 21214 - DNA, 2081 bp, Heterodera glycines
  misc_feature (70)..(70): n is a, c, g, or t
  misc_feature (102)..(102): n is a, c, g, or t
aaaaaaatggacaaaaaaaaagaggtaatttccaatgcttacaattagctcacgggagcagctcattccnccgccacgccgtaaattttttgacgaattatntaattgtacgtttttcaaaagttttcaattaatttttttttttttggggggggagggcgtaatgcataaatgccattcattattattcatccattcccggagccccgacatttgcgccatgcccaaaatcggactcaaatgttgaattttttgaagccctgatagcttaaacagcactaaaattaagaaaacacggtgttttggttcattaggaccaaaaatttgttgtttgaaaatttaattattattttcaaaaattctttgtttttaactcgatttcgtgacaaaggcgcaaatgtcgtgtgatgccagaaggaacggagtgtgggagaaagtgggataaaggacctgagagaacctctaaaagaggcgcccgtagctcagttggttagagcacggcacggattgctgggaacgtgggttcgagttaccttttatgttctacagtcgggacacgccatccccacctgttcctcctccagaaagcctttggcacgtagcaggcgatagatgcgcaccgcttggtccccaattctttcgcggatggccgactcaatgtgttcgttgcacaaaaattcgatgcccttttcatagtctgtaaatgtgccattaaattccggtaaaacacacaatttttccaagccgtccccgaaaagtccgggcttaaatatgaatggattggtcatttgtggggtgcacttcattctggcacgtgtcttttcctacccttcccgaaagcataaaaaaatttccaaaaaaatttttagtgagaaaatttcttggaaaaatttttaaaattttatagcgatattcaaaagtgtttatgatggatgatgaattaccaagtttttccaaaaaaaaacgcaatttccaattttttttttgttgaaattttcttattaaatttgtaaggggtgtaacaccagaggtcgcgcgcgcaccacaaaaaaaaaattagaaattccgcaagaaaaaaaaatgccggcacccgaaaagcggtagtgttcccatgaatacatacagaagatgactcgtttatctatgcccttgacatatacatgaagatcaccatgaacacaacaaactcactgatgatgtagagaccgcccccactttcgcccacccggcgcacaatgctgttgctgtccttgccgagcacctccaaccgcgcgtcaatggtctcccggctgatgctgtccagcccgtgctccttggcatagcggaacacgtcttggagctgtaatcatgccagaatcaattgttgtactgaaatgtgtgtgccaacgatgggaatgtgagccgacgcaaaaaaaaaaaaaaaagtttcggtaatcggaattcatagggtttttaaaattcgaaaaaaataatttcggagaaggaaattctaagacatttacaacattttaataagttgttcgtcgtcatctgggagaaaaagcaggaatttgtagtcgtttttcccaaaaatgtcccatttttaccatcttgggaccaaatttcaattaaaaaaaaaacatggtaaaacgggtgtccgccggcgccgttaggggccaccggcaattttttttgatgtgaattgacccaaactcccgtccatggcatatatgccattgttgttgctcaccgaaattgggctggactgcccggtgtcgatggacggagttctttgttcgcccaccttcagcaacagttggaccactcgcgccgtgtgcttgtcgtccaccaccaattccccaccactgttgaaaatttacggaaaatgtaattgaaattttttttaatttttgggcgggggggggaatgaagtgcacccaaaaatgccccgttttgtgccctggcccaccaaatggtgttgccgcctccaccgctgctctccaacgcgtccagcaccaacgcgtcgcggaagaagcgctccatgcgcggccaattgatgcgccacagaatgtgccggtcgctgtccctcacgttggcgttgg

SEQ ID NO: 21215 - DNA, 1720 bp, Heterodera glycines
tgctttttcacagagatttacaatcttttgcctcctgaatagtttcgtacgcttcctcaatgcgttacacgtatacatcggcttcattattatataattttttgctggtaaaccttctgacatttgaacttatgccaccttcgacattggtaattggtcttgacactggtctaattcgaccatatgaacttccgtaatatgtggtgtccaaatcaatttcgaatgcattgttcgcgatgaaaacatttttggccatacaaaatgggccgctataatatttttcataaattaattaaatatttatgatatagaaaattaatgctattgaatgtttcaaactatgttaattcggttactttgaataacatataattaaaatctgttgaaaacccatacgagctggcgcatttaagaaacgacatagcgcaaaaaatatgaacttaatctattcaatcttactaatgattatgctgctgattaatatgaatgtggatttcaacggtcttataaaattctctgacaccaagtgctgaggataattgtccatttttaatttgacagttattatatattctactacataacgataattttctctggcgatccgcgcattctcatagcgtacttggaatgttttataaactgatggttcaatgccgaaaccgagcacaattggtacgttatggccataagaagtacgataattataaagaagaagctgcttttctgtgaagaagtattcatgctaaaattattgtatacaacacagttcgataattagtctaaaagaacaacccaaattgatgagatagttaatccggcctctatcaattacaaataagcatccatttgtaacaccaaccgattcattggtgcctgctttggtgattttgatcattgcgtttctttcacccctttcattccgatcacactttacaaaatccaaccgtaagtttaagcatgaatatatatcacccagagaccgttggacggaattaaaacaatcaaaataatagagaaagtaataaacattctaaaaattaataaaccaatataactaaattcctaagcctttttattatatttggtaataaataaggagcccgcaaattttgagaagatttgctaatttcaccttgacagggtttcagaatggaatttctgggaaacaataaagaaaacctgggattcggaccccccgacaaccatatcccgatatgattcccaaccctgaatcccggtattggtctcggaaaaatgatcattttcttaagatatattaaaaattgcgaaatttacaacatttctaatatttgaatgattaaatttggttactctaatgttcagcctttgttagaaaaaatacttgaattttcattttttgggaaaatcccgagtctcggctgggatccctgccctaaaatgccgctttgtatcaggttcatggcaaaatcgggatttgaatccatttcagctgccaaaagtccgctaaactgagatttgaatttcgacaatcctttccacgtaatgggacaattgcaaatacaaaactaaattcgaagaaaaatcaaaaatatatttgactgagataaaatttacaaaataatattaataaaataatatagaaaggtataaataaacatgctaaaatgaaatggtggtgggaattgatatttcaacataacattttgtttacaatgcaacttatgattacgtaatg

SEQ ID NO: 21216 - DNA, 1745 bp, Heterodera glycines
ccactaattatgggggaacgtcgaacgagcgaatgcgattggcgtcgtcggcggttaataaccgctcgtccgcccccccccccctccccccgggggacgaatggtcgtcactttccattggaccaatctcaatcaaattttgcggtgcagcagaagcacaaaatactcgcatatttatcttcattagcatttaaagcccaagtgtttttgtcggggtcaaaagttgcgatgacacaacgaatcaccgccccattcgacggcggcggcggcagtccaaccggtgttgggagtgtcctatttaagcagaaattaaggtgctctcttactccatttctctttttggttataatttgggcagaattaaaccaattacctaacaaacttttattgtttttaaatggacactcaacaattaactaattacataattagtgagacaattaattactattgcttgtttgtaaatgcatttattttccttctcatttcggatgcttacattttcccaatttttggtgtttccctttaaaaaaacaccattcagtaacttttgcctaaaaatgatctctcatctgctgctgtttgtttgtttggagaatgctgttcctccaattcattctttcccgcccccattcgcagatacaaacaaatttcttcgacggcaaaaaaataaataaaagtttaaagaccaaaaatcgtttaaggcacagcaaaatttattgtttgcggagcagtgaatgaaccaaagtccaaatttagtgtttatattataaacatttatttagtaaatctgtggggggaggggaattggcacctcattataaaagttaatgaatgttaattggtgatgctaatcatcatcatcagcagcatataatcacaaccactcactagtgtgaacaaatcgcttgccaaaagtccccgtggaactctcgaaatggtcagaattgggcttggatcaaagtgccagaatgataatgactaattattgtccagcctaattactggctcgtaacggaaaagggaaaaagacacgtcacaaatattcccccgcccctccaatttctctcttaaccaattttccattttcattactagggcaggtaattatatgcacataaaatcgcaaaatatgcgcataaaatatgcacaaaaaattgcaaaatattcacataaaaagtgaaaaatatgcacataaatttttccaaattgaggtcaaattttcaaatttcttcaagtttgttaaatttaagcataaaaatcccgaaaatagctaaaaatagtatgaatgattattttagaaccaaaaaagtaatatttatttattttgaagaaaattgagcaaaaaatggagaattttctattttctgactatttttggcataaagttccaattttttaaaaaggtacttttttatcagaaaatatacccaaaaatctgatatttttgaaaaattttcggtcattagagcccaaatggccgctttaatagagggggccgttttaatagaggatttattgaaaaaatgcccaaatatggacataaaatatgcatgaaatgccgaaatatgcacaaatatgcaaatatgcacataaatcgcgaaatatgcacaaatctgcaaaatatgcatatggaaatccactctagaagcttctaatcaagctaaaaacatgtttttcatgcgtttcaggcctcccgcagttcaggaaaaaaaatatgcatgtgcatataattaccaacccta

SEQ ID NO: 21217 - DNA, 2305 bp, Heterodera glycines
cagtaaaaatggtcatttctttttatgcgtgttacaaatcagaaatttttcgagattttccggagtaaagctcatccgattgtctgccagaatatttttgtatgctgaaaaggaacgctccacttcacacgactgaatgggcgcttatttgaacattgcaataacgtccggcggcaaatgcgtttgaacgtgttcgccgcgcaaaaccataccaatttcctagaaaaaatatgagtttaaaactttttctaaatccaaccaaaattctgtcaaatcccggattgtttcgcaaaaccgtgttaaacttttctcgaaccaatttgcccacattgcccggtaccaattgcaattcatttccaacatcgctcactaagtccaaacctagaaaatttgcatagaaaaatatcgagttttcacaaactttcaatgagtgtgagattgcgtgattctaatttttcaattgctccaggtaaaatgtcaaaatgtgattttataaaggccaaatctccacgaatgcctgaacagtcaaaggcaatttgtgattggcgaatagcatcagaatcggatgggttgaagtcccgaataatcgcaccaatttggttaagattttgacagtaataatccgctgcattgagccaagtcccccaacgtgtgatgattgggcgcggtgggagagggagatcacaacgttcgcggaatttggccaagcgggatggcgcttttgaaaaagtttgaaaaaacctggaaatatgtacgaaaaagtgcgaaatatgtaagaaaatatgtacatatgtaatatgtagaaaaaccccgaaatatgtaaaaatatgtattttaaaccaggctctagaagcttcaaatcaagctaaaaacatgtttttcatgcgtttcaggcctcccacagtccaggaaaaaaatatgtatttacatataaatctaatgcctagtaacgacaaatcttacaaataaggacatttttattgtgtaagatttggaccctccaaataaggacaaatcttataaataaggacagatacgcgccctgttttataccaaaggcaattatccaaaaaatgctgtgatgtaaaattctcatttttaacccattttgacacataagttactcaaaaagtattagacaaaaattagttttatgaactgaaaagatatttattacattattatctttaataaatttttttgttaatgaaataaaattaaaaataaaagatttgtttcataaaaaattttttataatggaatttggtataaaaaagcaaaaataaaattctaaaatggatttgcatgtagaggatttgaacctgggaccaaaaaattctcgactagcgcactacctctacaccattacacacttgtaaatcggcgaaacaattatttcttttctttgattataaagaactaaaaactttggcacgtcataattcggcactcagactcatttcgcagaaaataaaaacatttttcttaagaacccatgggtgctctatccacccaccaaatttcatttggaaatcccacggacacctggggaccttcctttcttagaattgtttttgtttacattttgcaaaatttgaaaaaaaaaaaatcattactgtaccaaagatatggcgaaaatcataaaaaaactcttaattttggtagttttggcactgtgccgtttgggtttaaattttttattttctactcaatttcacgtttaaaaatgccattggaaggcgtgtcgatctatgcccatattaataagcttaacattcgtcaaaatgtaattgtccacgatctttgcactgaccactcgttttcatggccacagtgccggaaattctttttttgtcaggcggttgtataatttgccgttgccgcttttttgtgccggtgccatcgttcgccggcggcttcgccggtgccatgcgtaacaaaatgggaaacatgcgcacttgccagcagctgaactctccgtcgacaaaacggtctccgatcaaccgccgcattgggccgtcggtaaatattaatctgagggctcaaactcaaaattgcttaaaaacagtggatgtcggtttaaaccgacccgaaaagtggaaaaaaggattgatctgtgccaatgacttttttcacagaatggcacaactcttgtaagtgaaattatgtaattggaatggcattctatgaataaggtcaatattatccattgggtgtgtgtcttatgcgttcttttcactttattatccgattgtttgtggattcgtcgactttcgctttgagcaaatgcatgacccaaccgata

SEQ ID NO: 21218 - DNA, 1310 bp, Heterodera glycines
  misc_feature (1214)..(1214): n is a, c, g, or t
acagcaaattgacaaaagaaacgaaacttgggagaagtgaaacaatttaacaaatatttacgacaattttgaacaaattttaaaaaaggcaaagaaagagaaaaaagaaaggatgaagagaatggaaaacagaggagtttggccagagagcagaaaatcaacatttggggtcaaaaatcagcattttggagaattttaatccagattcacggccattccctgaagctgacaaaaaaaaatcaacaaaaatgtttaaacatttttgggaacacaggggggccctccgggaaatttcttttggaattttcatgttttttttctctgcactgtcatttattggttcatctcaaaaattcgtaaaaattatggttatatttttaatttttatatacccttaaatcaaattggccatggattattatcatttattcatgacaaatacaaatatgacagtcatttgatcgaaatacgagacaatgcagtaaatattgatacaacagcgacgtaatatacactcatatacatatatacaacacacataaagtacattaaacacacatcagcgacacattgatcaccatcttttatgggccagatcgagagccttgacgggatccgcggtttcgagtcgtcgttgtgtcgtgccgcgatgctgtggtatcgtcgatcagctcatcgatgtgttgctcaatccaggcgagtacatccctcattgaatagcggcgcactgaaagggaagggaaaacattataattgaaaatgttaaaacaaaaacaaaaaacattaccgtcgtcggcagtccaaacgttcgcgctgatgaattccgcaaatggaggtggcgtcacattggggaagcggagtcgtgtgccgcgcaaaacctgaaaagggaaggggagctgattctgaaaatgggaattttcgttttcaacccccccccccccccactgcactcaccatcggggctacgtcgttgttggacatgaactggtagggctgttgcgcgttactgaagatctcccagcagagcactccgtaggcccacgtgtcactcttcggcgtgaatgtgcgttcgcgcatcatctccggcgacagccatctgatcggcaccggcttgcccgtttccaccggcttcgacggtcctttgaatgcgaggccaaagtctgccacctttacctgaaagaaaacggcaaattatgcgctggtcacaatgcganaagcagaaaccaccgtgttttctgagaagaggcagttcctggcggcgacgtcgcagtgcaggatgcccttggagtgcacgtggtccagtcccgcgg

SEQ ID NO: 21219 - DNA, 2708 bp, Heterodera glycines
  misc_feature (1249)..(1249): n is a, c, g, or t
agatacgtgtcgagcgagccgttggacgccagctccatgaggaccatcagcggttcgcgcccaacagcaacgccgtagaatttgatgacatttttgtgttccaaatggcgcatgatcctcgcttcgttcatgaactccttgatctgaaaaagtggggaggggaatcgattaaaaggctgaaattcaattttttgcccgcccattctacctgtgcctttgtgctcgtctgtgacacctccttgatggccatctgcactggctgcccgatggttgggtcgcggaagacgccacgcttgacaacgccgaacgcgcccttgcccagttcagcgccctgcgtgatggtcgaatgtgcgagctcccatttctgccggctgacccctttcaggagaatcaccttcctttgctgaaaaagggaattttaccgaatttatttttgagcgtataaaaggggctgcattttaatgcgtgaatcattttcaaacatcacaaattcggcctctcttcattcgactcgacttctgcagttcatctgtcagttttcaaattcaaaaaagacaatcacttcaaaaaattttctttataaaattttgtcccaaaaaaataccccagtcgcggattcaaatttccgcggtcgcgcaaaaaaaaaagccgcgaatcgcagtcgcgtcccacccctgatacatacttatgcacctgactgtatatagttaactaaattaaatagtgatgaaaataatgccatattttttaataactttttttcaaggaacattgtttctatttaattcttcttatgacaagaaattcatgcttttaattgttaaacggaaaacatgtctgttaaattaaatattggcttgcatttttttggtgttttaagagaaatgctgatttttgaggaatttttattgccaaatggaaatttgctttttaaaactgattgataaggtttttgaaatgaggtcggttcgctaggtttggtcaatcggtcgttgctttgcttcccatcgccccgggtgtcgtttgtttttggatcagtccgaagtaaaggcctcgccgttggagcagttgctgatgcgtgcccatttccaccaggcgcccatcgcgcatcacaacaattaaatcggccgattgaacggtggccaaacggtgggcaattacaacgcaagtccttccctcgctggccttctccaacgcctcttggacaatcggaaaagggactttccattaacaacaaaagaagatcgtnaaaaataaattggcccatccctccccccccccgcctcatcggccaatcgtacggagttccctgatggggtccattagtgtttaaattgaccaccttttcgctttcggtgtcaagcgcactggtcgcttcgtccagcaacaaaatgcgcgggtcgcgcacaatcgctcgtgcaattgcaatgcgttgtctttgtccccccgacaattgcgtgccccgtccgcccaccgccgtttcgtatttctgaaatttccaattcaaattttcggtgctgcattctttgcctggggtaatgtctccacaaattggtgaatgtttgctattttggctgctcttgttattcgttcctccgtcgcttccttttccgtcagtccgtaggcgatgttctcgcgaatgctcaaattgaacagagtcggttcctgtccaacctttgtgagcagattaaatcaacccattgactaattaaccctaattaccccaccccctgcatatatcatcaatttgaccaaaagtgcgcaccattgtgaaaaaaataaagtttcgaagcgaaagtaaaaaaaacataaaacatgaagaaacaacagacactgtaagaattagacactattaaaagttaatgaaaataaagtgaacgggactgggtcgttttggcgcccacgttttggcgccgacgatttagcgcccacgttttggcgccagggtcgttttggcgcccacgttttggcgcgaagccaaaaattaaaaaaggtaaaaatttgatcaaaaattttacaaaaaagtgaaaaacttttaccttccaatgggtttttcaaattttcaaaaaattcacaacccccttagaattttttttcaaacttcccgatttttgactgtgttttatgggtgtagattagagatcaacatgtacctggatccagccctgtatttttcctggatccaggtacaggcacaggccatttttcggcaacctggatttttcctgtacatttattttcctgtacttatgtacagaaaaaataggtacaggccattttttgaaacaggtacaactacggttttttcaaaatgttgatctctagtgtaaatcaacatgaaggagtgatatgatcaacttgctgtgaacattttgttggtcaacatgaaaaattgacttagcaagaattttttcaaatttttctcttcgctatgcttcaaaaaatgtcaaaacattttgaatatttttaaactcttaaattttttcggttgaaatttcaaaagagttagtgatacatattttcatttattcaaacatagaaaaaatttaaaaacctgaccctaaattttgtatgcttgtaaattagtctatagtaaaccaaaagattttttttctgctcgttttgaaaggaaaattctaaagaatatttctaatttaatcaaaagttttaaaaaattgtttattagcaaaaaaatgaatatgtgttat

SEQ ID NO: 21220 - DNA, 2376 bp, Heterodera glycines
  misc_feature (898)..(898): n is a, c, g, or t
ttactctttttatagggcaaaggcgtaacggagacttttcggccgttgagcaacgccgagataagaagcaacaacggagtgccaacaaatcacgaaaacggacgcataaatcaagtgacctacggagcagaagaggagaaaacgtacaaagcgtataagacaaacgatggcatccaaaaaggcacaacggcacggaattaatcaaagaggagagattaatgagacgacaaatgactaatgacgacttactaaatgaataaaataagcaacaagtaaaaaatattatatttacaaattagccgaaagagggatccaagcaaatgccaaaaaacattaggaaatggcaatcagaattcagataatctaattaaaggatttaatcttatcagaattcagatatctaattcaaggatttaatcttatcagaattcagatatctaattcaaggatttaatcttatcagaattcagatatctaattcaaggatttaatttccagtttaataaaaataaatttaacaaaatgtcttttttttacggttggctgaatgacaaagaaagtccttggaatatttatccgtaataactgatgcggttttgaaaatccaaatgatggttcagtggtggaaatgaacaaatttttttgaaaaattttcacatttcttatatagttcattaaaatttccaaaaaattttcccggctgcgccaatcggcactgctccgccgtgaccccattgaaccattattttttgaaaatttgaccgctaaatagccaaaattagactttttgcccaccccgaaattcttttctgaatacgagcctgagtggtgccccataggcgccgttgccaggtaaagttttgtaaagtgaaacctgatgccaaatgcaacccacaanaatccagctcaatcttaaattgccacacttacgagcgatacctctttaattccaaatttgcaataaaaatttatgacgaataataaacgtttgaaagaaaagtccataaatgtttagaattttgtgataacaaataaaaagtatcacttctaaaaaaaatgatttaaatacgtttgtcaatcagcttcttctaggagtttttactcaaattttcttcggccataaattgtttaaattctgtaaattaattaattaatcacttaatttattggatttttttcctttcgattaatttatttaatttaccattcaaaaattcatttagaatgtttttagcgacagaaggctgaattttgttggccatatttttgtgaggaattattggcgaaatgattggcatttccatcccaatttgggcatggccaacttcgctttgctttctctcaaaccattctcgttcaggggaccaattcagaaatgccccttctttggcataattaatttcttttaattgcaatggcattggccaaacccttaaatggattttgcgattaattcactcttgaatttcataatttcgcaatttcatcaattcggcacaacccaaacacttaccaaaacgagtaaatgaggaaaaacttttccaatagaaatgtcaccgaagtttcgccggggaacagaaggaacactttggtgaccatggtgaggatcacttgtgaattaaagtgaccagcactttcgttgaacaatttcttttctaaattttcattgaattcaaatgtaaattttggtaattaaaacaatttataaaaatatggcaaatttcaatttaatttttaattaaaactaattaattattcttccgttttgtcgccgcaataaaaaccaacttggaaaacatttatggccataacttttttgtaactgaataaaacttcttgaattttagtatgcagatagaggacaccaacaacacattcctaagaatatataactactcgctatatggcttttaacatggagcaagcattaataattaaagatatgcaagcaaacataataatattaacgtggatttatttcaagtgaatcaataaagaagcaatttttatttttttatttaattgattaactgaatatttcttcattttcttattgaaaagccaattattctaagcggtgctgacattttttcctgctcatttttttccaccaatttcttaacataattctttaaaataaaagcatttcattcaaaaaagcatcaccaaggcaatggttcttttggcaaactttgccatgctaatgccaattattggccttttgctgtcctcccattggatgggccaaaatgcgcaacagccggacaataataacaattcgctgcatctgaagctgatccccggcttgggcgtgcccgacacccaccacgtgtattatgtgggtggacattgtgagggtcaaatcgcttttacatc

SEQ ID NO: 21221 - DNA, 2706 bp, Heterodera glycines
tccgacgaaaaaatcattttcattttggtaaaaaattcgtcctcttccgatcagccattgttgtcgccgatcagcagcggtgcagaagaaaccgcagcagaaacagcagcagctcggggaaacaacagcaggtgtgaaggtaaagaacctcggggatggtcaccgaatcgtttcgttcgaaactttaattcgaatttaattaggatgaaaaaatattcgaaaatttaattcgatttcggcattcgactatttcgtgtaggggatttatagttttttttaatattataattatcttaaacatatataattattaaaagtttatcaaattaaaaaataatacattatttttaaaatacatcgaatatatcggatataacaaattgttttatttttaatttatataaaaaaattttttaattacatcgaatcttgaaaatacattaaattattaaatttataaagaatttaaatttaattattcattaattatttcagatttaaattcagtaacgacaattttatttattttctgtaatttattcatttagctcaattttttggtcacgtcgttcgatgttcaccgcaatttttattacgcttacattgcttattggcacagtttctttagtcaactctttttctagtgaaaatagtggtgaagatggtgacatattgggagatgacggcatttcacaaatattttcggatgacgatgccaaagtaattaatatattttaattaataaaaaatctatttcaaaataaaaaataaacagtgcaataataacgggaaaatctaatacgtaacgaagttacaaattctcagaaacctaacatactttctattaaccttagatatataaaaatataaacataaaaatattttaaaaataaaattgtcaaaaatatagaaaaaagttagatttaaaataaaaaaatatttttctagaaagtaagttaaacttttttcaaatatatttaaatttaactaaaacgaagataatttcgtgtattcaaaatattttatttattcccatataatattttttagcattaataaattatttttttgccatggattttcaatttttttaaatccattaattccagggatatcttaatcgttatggttacattgacaatattctgtcgtcccaaggtcatcatcatcatcattaaataaataaattaaaattttttaaaataaagaacaaaatgctgatgccacgccacgagctcatgcccaacaacagcaaagcaaatccggcgaattagttggtgaattgacattggattcaatccgatcggctgtcaggaaattccaagagtttgccggtttgccgacaaccggcgatttggacaatcagacaaaacaaaagatggcaaagccacgttgtggcattcaggatgtgcaaatgctgaccagtgggagtcagatttttgatttattttttttaatataatttttataaaaattaatttattaatttttttttcatatttcaatattaattaaaatattttaaatgtttaatttgtttacataataaattggattggttatacagacaataataattaattttttttaataaaaaatttctatttgaaaatttctttcccattaaatcattagggattttaaaaatttatttatgtttgtaaactgaaaatattgttttaatttttaaaacctaaacttatgatcaaaaatatttactattaaattattttgggcttttacaaaatgaatgattatttacaaaattttaattagctttttttcaaaagattatgtaatgaaatggcgcaagagacgcgtaacctttcaacttatgcagtcaaccaatgacattccagaacgcatgcaaaagttagtaaaaaaaattttgaaaattcaaaaaaaaaaatttttttttttttcattagacaggccatccaaatggcatttgacacttggtcaaagattgtgccattggattttagcgaagcaagcagatatgatacgccggatgtgaaggtgttgttcgcccggagaaaccatggcgatccttggccattcgatggccgaggtaaaattaaaaaaaaattaaatttaattaccctaaaacgggtgcttacaaataaggacaaatgccaaaaaaagtcccaaatttcgacaatttatgcccttctttttaaggtggcgttcttgcgcatgcaacctttcctcaagatggcaaactccattttgatgatgacgagaactgggttttcatggacggaagaaaaattggaaagtaaaaaattttaaaaaacacccattttgccaatatttttaaatttttagccatcgctttacggatttgtattgggtagcgctgcatgaaattggccatgtgttgggcttgtcccattcgaacattgaaactgctattatggccccattttatcaagtaaaaacactaaatgaatttttaattaatctttttttaaggacccacgtgatttggtcgattggcgtggcaattacaaaaggccagagctgactcaggatgatgtccgcgcagcgcaacaaatatacggtaaatttctgtgcaaatgagagttatatgaaaattagcttttcttggatttcctaaatgggagcagttatcttcaacctgctaaattaaaaaaaatttaaattcgctaaattcattcaagtttttctaagaaaaaatattaa

SEQ ID NO: 21222 - DNA, 3091 bp, Heterodera glycines
aaaaccctcgacgaccccctagagactccgtctcctccctccgagcggaccccctcccgccgaccaaaacctttcgacggaccccttagagccagctgccagactccctccctccgagcggacccccttttcaccatcacaaatacaccatttaatctttttcttccaacgacttagttggcccaagtggttaacgtgtccaggattcgcctccccaggttcgagtccacttcagtttttaaattttctgcttaaattctcgcgcaccaccacgaccagagaccgggatctcgaaccgataatagccgagatctcgtgtcgagatctcggccattatcgggaccgagctagcctattcgtgtcgaggcgggaccgagcagcccttaggtacgggtctgctggcgagagaaagttagacggtgcactctctcgtcgctggagaggttagacggtgcactctctcgccccaaaagaagccaataggtttggggtggaaatcaatcgataattgaagtattctgttattgtagtgacgggggggggtcgtaaatcgtcaatccaagcccttaaccccctcccttatctttgtatgcaaatttggtcggcgattttttttcgcggcatttctctgtctccgatcatggcatggagcatctcgaatttaaaaactatttttaatatataataatgatgatttttatatttaggcaaagacatttggataaagtttccattgacaaatgcccaaaatgccatattaaatttgtttggtctggcggctgtaattttgtgaatgtttttttttgtcaagacaataatataaataacattttccaaaatataataaaaaactataattaaagaaacggcttctgaaaataaaagattttttgattaaaaaagtttataattacataaataatttttagattgtgtgcagaaataaatattgccgagcaaagttttgttatgtatgtcaacagcaaaacatcagccatttcgggaaacatctttgcttgttggtttacatttgcatagaaaaaataaaataatttatttgtattatttttaaagacagaaaaagttgaaaacgaaaaagaattatgaataataaattaaacatttaattattatattaggagctgccattcgcgccccccccccccccctccctcctaaaaaaactatttttgcaaaatttcaaaaattttcttggaacaaatattccactttttaaatggttagccgacaatttgcggactgataaggggccgaactgtcaaaaaataaaaaaaagttatgaatgcatttaaagattactcaaatcctcccaaaattgaaattaatgacggtaagctgataactaaatattcaaaatttaaattattacttttttatcggacgtgaaaaatgaaatttttttgggaacggtttatataaacttttcacatttacaatagcctttttcaaaaaatttttcctttgaattttcatataaaaatttttttaagagtttttattatttttttttaaattcgtcggctaaattatgtccggcgaaatttcggcgacgaaatcacatgtaaaaattcaaattgaatgatcactctttattttttagacagttcaatccagaaaacgcggtccgcaagtgtctcactaagattttaaatattgttccttcgaaattccatcacttttaaattatagttgtggcaaaagcaaaccgaaccctgaacaaccatacaaatgccttagttgtggaaaatgccttttcctgacaaaaaatgtttccgaattgaaacaacaaaaaatgtttaaaattcgagcggaatttgaaccgatgatcaaagaaaatgaattaaaaatgaaaaattcggaaataatcagtgatataaagggtaaaagcaaattattgtcataaaaaggagaaaaaagggaaaacgaagtgcaagaaaaaaaatcatggttttactttatttttattttttatttttgggttttcgataaaaaatttatgcataaacattcaaagtaattgcacaaatgttggacaacaaaatttcaaggattttctgaaactataaaaaatcaagacacttttaaagatttcttattttactaccaaaatttggttaaccgaataattataatgaaaaaaattacaaatttcctatcatcactcgggaggggtaaataaaatcacgaaaaacaccaaaaaatcgacaaaaaagtcaaaaactgagcattagtctttgctgcaatatgaccaaacaaaaaatgggtgctagcagagatgttgcgaaagaaaaataaaatatgagacacgagacgagacgatacgagatttttttgttaataattaaccaaaaatttttggtttttacttttacggaaaaaaacgttttgcgaaaagtgtaaatttaacaaaagagagcgaccatatcagtacggttcttgagataaataatttttaattttttaactgtgtgtttccgaccttaccataaaccaggggtgctgcacatccgccggtcggattcaccttaagaccatttctcgatatttttactttctatttgtcagtctctggttcatttatcggtctagaatttcagattcaattcaaggtttcgattcttaagttcatccaattctccgtctcgagtcttgggttcaactctcaatctcaagtctcgacatcctctattgacaggccgtggttacaatcagtttccctatgtcgaaatttaaaaaaaacagagcttttaatgttgattttctacccaaccctgcctgagctttggatctgcctgcacccatcactcttttttcagaatagatttaattcactgattatgttttttctgtccttaatgtccttaaaaaaggtggctgtgctttgccttaattcatatatcctttaacattggactcatcataccatttattatccttcctgttttttcatctcttgtcttacccaaacgcgcagtcggacggcgttcatgccgtatgacttcatcaacgcaaacagatcaatttttttgccgctactgtcgagaagggttgaccatccttatcctgctgt

SEQ ID NO: 21223 - DNA, 1016 bp, Heterodera glycines
caattgacatttgtcggccttttaaccccaaatggggacttattttgtaattcttctgtactgttttcagttctcactaacatgtcagtttgcgtcagtttttggatttggcttgcttttagcaccgacacattttcgaaacttctttggagagagcttcagatagtcggcatttgattttacacaactatttgtcatccctactgattagctttcagtagaagtattagcgctgctgataatttgtctgggcgacatttattagttcatacatgcgcacccactcaatttgtatctaggcgctgcaaataaaaaagtgcagaacgacaaaaatggcagcaaatccgacattgaagaattgacgaaattgttagccaaacagcaaaaactattcgagaattcagaaattccaaataaagttctataaatagaattgttaaattgaaatcaaatgaattttttgagggttcgttcgcttttaaaattatttttggaatagatggattttgtgatgattccacagcatgactaagcaatattaaagttctgatatgaaaaataacagaaggttaactaatgaaagcataaaagttcacaagaataaacctaactttcttttttaaaatatttttttaaaataacgtaatacatcccctaaataatgccaaaaactaaaactaggtagccggctttttaaaatagcagtcaaagtgaattattttgtctgataatatttgtgcttgcgcatcgtcttattgtcttcactgaattgtgtccatctgcagccctgacacaattttcagctgctgtttgacttcgtgcactgaaccgcttcgttgtcacataaagtgaacttcgacgaaacttttaataaaaaagtattgggaaaaatgttttatatttaaaaaaatatattttgccatacctgagaaaatttttgtccgaatattgtgctaaacttgctacggaaatgtgcagaactcatgcaaaacaagtggaaaattgagcattttccc

SEQ ID NO: 21224 - DNA, 1570 bp, Heterodera glycines
  misc_feature (1456)..(1457): n is a, c, g, or t
tttgctaatgccgacattcttgacgataaagctacttttataattaataaaagtcgaaaattgaaattggttatattgtagtattaaaacaagggtcagatttgctggtttatcagcattttgctgcttttcaaggggtcaaagattttttgagcttctgttttacgatgatttttggaatcaaaaatggcaaattttcagtaaaaatcagttaaatggtcaaaatttctaatttttccaccggcggcgtttatcggcactaccgggccgctgttcccaaaaacttttacactaatttataaattttaattttaattgccaaatatggatagcgaaatcgaagatttgtgccaaaaaatagagccattgaatgaggcaacatcacaatgaaaaagcccaaatcggacactgacacagcggaaagctaaataatttaaaattgtttaaagttattttcttattagttgatttgtttaattgagataactaaatcattggcacgattccgcatttcatgagagcgaagaatccacagattaagcgcatcgccaataaagccaactaaaattttggcaattttaattatcgagcaattttttttttaatttagaaataaaaaaaaacaaatttcttttattaggtgatttaacctataaaaggacctgaaaattgaaatggaaaaagataatggaacaagaattcatccaagtccgtagttgtcagcttcaacttcaacaaaaaaaagtgttgaaaggattattttatttattatcttactgaccgaacgtgacgatagacatcgagtaaacctaaaaaaagtttaagtatcaaaaattcataaaataccattgcaccggaggctgaatgagtgtatgtgaattgtttgccatatttagtttttgataaataatgaatttccaaaaatgaactataatttatttgcaatgcagataggtattcaattaatgtttaaataggtaacaattctccgaaaacaaaccacatataacgtgaatgtgaatttcaatataaaaatttaattccttgttttaaattttgtttccaggtacaaatactatatataatgttctgtttctagaaattctttgcctaagagatctttgtcccatatgaattcgtttttagacaattaatttttgtggcatttaaattttcaattctttggcatttgaggaacaatttcattaaaattattggctcagtttttgagaatggccacagcaggaaaagcttatgatttgacgatgaaaatttgtttcatgcatcgaccgacaattcaaaaaataatgcaaatctcttctgctgtgtgagtttggtgcgataatcccacaaaaatgttattatcacagaaacgacgaaacgaattgtaaaataagattattccatcggacaaaaagagggaaatcaaaccgaaaaacacaaaaaaataataatnnaatctgccggattcaaccagcccaacaagtgcaaaacagcgaaagaatagattacgttattttaaaaaatatatattttaaattaaaaaagttattttttacttggactaatc

SEQ ID NO: 21225 - DNA, 1516 bp, Heterodera glycines
atgcagcagttgaccatttttaccactatcttactctcactcatcgtctgctcgtctctcatttattataagctattttcataagccaacgcccttttctccctcttttctgttagtcatttctcattggtgttgacgatccaacattcagtgtacaattttgttaaacctctcaacattttaaatcaaaatcctaataaaaatttcgttgaatttctccgcctcttatttgtgtaaaattttcgaaaaagtaattttctatttaaaatttaaaaattcagaagcaaattcaagaattttttttattctccttatttttaaaaaaattcagcttttttttttaccacatgaattatgattaaatttttgcgtttcgaattcattttggaattaagaaaaataaaaattgataatcatttgatcatttttagcgcactttaagcaccgccgttaggcagcgcagttccaaaatttattccatgccacagatattatgggcaggacacgccaagtacctcaaacttgggtaattaaaccgaagaaagaagtgcagtggggaagaatgacgcccaaaatgaaggaaatattcgatgctgtgcgaactctttgtgacccctctctgactctgccaatgcagcagttgaccatttttaccactatttttctctcactcatcgtctgctcgtctctcctttattataagctattttcctaagccaacgcccttttctccctcttttctgttagtcatttctcattggtgttgacgatccaacattcagtgtacaaatttgttaaacctctcaacattttaaatcaaaatcctaataaaaatttcgttgaatttctccgcctcttatttgtgcaaaattttcgaaaaagtaattttctatttaaaattaaaaaattcagaagcaaattcaagaattttttttatttttaaatgcattttttaccacatgaattatgattaaatttttgcgtttcgaattcattttggaattaagaaaaataaaaattgataatcatttgatcatttttagcgcactttaagcaccgcagttaggcagcgcagttccaaaatttattccatgccacagatattatgggcaggacacgccacgtacctcaaacttgggtaattaaaccgaagaaagaagtgcagtggggaagaatgacgcccaaaatgagggaatattcgatgctgtgcgaactctttgtgacccctctctgactctgccaatgcagcagttgaccatttcaccactatttttctctcactcatcggctgctcgtctctcctttattataagctaatttccctaagccaccgcccttttctgttattcatttctcattggtggtggacgatcccaacattcagtgtacaattttgttaaaacctgtcaacattttaaaatcaaaatcctaataaaaatttcgttgaatttccccgcccccttattgggggcaaaattttccaaaaaagtaatttttctatttaaaaattaaaaaa

SEQ ID NO: 21226 - DNA, 1049 bp, Heterodera glycines
ttaaaaaaaacttgcagagcaaacagtgtaatggtcttcttgccgatgtgaactttttcttcagaagccctacgctcatgattgggcaaaaacatgcttatgatgacattaaataagctgaacaaagaacatgcaaatacgaggagttgagaaaaaagtgcaaaacaatacattgcgcacgcctgaagctgtagttcgcctgcccaatggcctgtgcatggaaatgttgcctctttaatatgagcacagcattccgcgatgacatagtcaaggctttgttggtccgcgtgcacttaagataaaacagggatgttatacttaagcttttaactcaagcaattctactttgtatccaatacggtaaactctcaaatccaccaccattgtcttttgccacgtcgcagtaagataaaatgtatctgttgagcagaactcgaagacgttgataattcttctcagttcctttaatttagcatattcaaacaccaaaaaaaagaatcatcttcacaaacctgtcaagagcatggacaaagtaatatagccgcaatgaccatgcggtttagtacgaaaaatgttgttttcaaaaatggtaaaccgttgctggagaggacacgcaacaagagtgtctttggtcacaatcactgaagtatgcgttccgtcggatggatttgaagcagcaaaatctaagcaaacatcatgcaaaatattgagccaaatggctcggtatataacgatcacagcctttcaattgggcaatagaaataaaaagcactttttgcatgttcgtcgaaagaagccgtaagtcgtccagaattgaaaacacaacattgcagaccaaaaaaattttgccactttaaacacttcaggcgacaatcgcttcaagtaaacaattccatacggctgtaaaggctcgacaatagcccaggctgcattatagaggactttaatctcttgggatttccaatttgaagctttcttcatccgcttttgccccaaaccttcctcaaaacaaacaaacaaactatttatgttaaaccattcagaacctt

SEQ ID NO: 21227 - DNA, 2003 bp, Heterodera glycines
  misc_feature (60)..(60): n is a, c, g, or t
tgtgcaaggaatttacagcgtcaaacaataaaatgtgggttgagaattcgttcgcaaagnccatagcaatgagaagctgggacttcgaaatccttaaaaccaaataaaacttatgaacaaaaatgtactcaaaatgcttttattacctatctctgcgccggatggaattgttttaggtgcagcatcagaaaatatttcattccaaacgctttggttaattttcctcacaagcaattgatgaagttgtgcagagtcgaatgaagccaatttggtcaatgcagtttcagtcatttttgtacgataccaacggccagcgcggatcagcaacatgctgaaatggagtaacataaatatatatacagtacaaaagtacatacccagcaaaatcagcatcgtccgaaatggccttaccaacggaaacattagctagtgcagtgctctgtgctcttttgtctccgaattctgattcatagtcatgcatggaaggtattgctgcttttgacttgaagagttgcagtctcactagctgtgtcttgatatcgttctgattgtctttgttcagccagccgtgttttatcattgaaaccacgcaatctcttttgcactggagcttagctgtagctgaaagtttaattgccataaataattttttatattttgttgttaatagaaatgtaaaaaaccgttctgctttcccaaaacggtgttctcctgttgttgtcctttctccttcatgaccttgacctccttgcctgatgcttttgcagctgaaaaagttgaattcagtattaaatttattaaaaagaattgtctccaaggcgacccaccccaccccgtggggtggccggagcaagttcctcctagagtcgacccaccccgtggagtgcaaacaaacctttcttgccgtcggatggaattttactctttcccaaaacggtgttctccaaaacggtgttctcctgttgttgtcctttcttcttcatgaccctattgcctgcacgttttgcgttctcttctgaattgaatttcaaagaaaaattgtgccccacaaaaggcgacccactaaacaaaacctttttggggttttttcggcaaaggactgctgtcaacatctccttgtgcaccagatcatttcttgccacggggtttggcaacaggttttacattttcatagacaacatctgagaaggtaacggcttttgtcaccgccgctgccaccacttccttcttgttcgatctttcgggtgagggtgctgcattgtattcgagcgaagcgttctcttcgtcagtgttctctgcgtctgaatcagtgctgttttcacagccactcaaactattgtcgtctctcttgtcatcttcttgatcttcaaaaataaaatttttataattacacgttcaatttcccattaactgtgttaccgtctgttccatcggatggagttttaaaaagaggcgtccgtgcaagagtcatgtctttcgtaggctcagtgtacattgtactgcgttgcatctgcttgaatgctttttcccaaaacactgttacgaaaacagtcttccagtccgtcttgtcgttttcttttttgccgcttctgcaatcatcatttatggcagggtggtctccgataaaatattcattgcatacgaattcctcataagtttgattgcgtccaagcacctaatacacccaattagaacatcaaataaagtgaatgagtaaaaaaaaacataccaaaaccccaaaactctgaagcactttcaccaaagcagcagtttgttcggctttagttcttttactggtgatcttctcacacagtttctcaacaatttcgacattaactggactgttaagtagcagttggtcgcattgatagtgcgaaagaatatcagcctgttttaaaatactttagagttggagaacaagttctctctttgctcctcacttttccggccacgagttctaattcgctcggcttaaccagaccctcatgcttgagaagtgtcca

SEQ ID NO: 21228 - DNA, 429 bp, Heterodera glycines
  misc_feature (23)..(23): n is a, c, g, or t
ttgttttttgttgtttctgtatnggagaaaaaaatgttctaaatctgataatcaattaaatgaataaatttttttttgaaaactgaaataatcaattaaaaatgcatacctaatatgggaagggagtaggtcgtcctccccccacccccgccccgtcgtttcccccaaaaaattttttaaatctaaattttttataaaaaaattcctaagaaatttcttagtaagaaaatttcaaaaaaaaagttttgaaaattttttccgcgatttttccaaagtttatgatgaactaactactaagttttttcaaaaaccggtgaaaactttttcaaaaatttttttcttgaagttttcttattaagaaatttcttaggaattttttttaataaaaagtttctaggtttgaaaacatttcggggggggggggggggg

SEQ ID NO: 21229 - DNA, 1463 bp, Heterodera glycines
aaaagaaggcatcaaattcctttttctaaatttcttcaattaggtttcttagatattggaaaaaaattttttttttaagagtagcgatttttaatgcttttttctatgtaaaacattaaaaaaggttgttaagaattttctgttttacgtgtcttttctaaatatttttcatggtctgctcacaaatgatgacgtggcagtcggaaggacagttcaccggcatgttcactataattatataatgtctgattattaatgatgatttggtgaagccgcaaatgtcgggccgcaaatgtccgattttggcttgggccgcaaaatccaacaaaaaagtgttaggtatgcatttttaattgattatttcagttttcaaaaaaaatttattcatttaattgattatcagattttgaacatttttttctccatacagaaacaacaaaaaacaaccagctgtacgtggaacgcatccgaaaagtgcgccaacaattgcaggagcgtcgcccgctgttccaatggaccctcaaggacttcaaccggtgcgcatttgcggaactgctcagctaaattgtcctgcttccactcttggagcagtcggttccccgccccctgcgtcgttcccatccaaaattatgtccgattttgacttgggccgcaaaatccaacaaaaaatttggccgcaaatgtccgaaaatggcccttaataaatgggccgcaaatgtccgggacgcaaatgtccgattttggctggggccgcaaatgtccgggccgcaaaagtcgcgccgcaaatgtccgattttggctggggccgcaaatgtctgagcgcaaatgtccgggccgcaaatgtctgagccgcaaaagtccgggacgcaaatgtggggtaaccaaaccaacacaaactgcagaaaaaagcaaaaaaacaaaaaaaataaataataattttttaaggccagtatccaaatgaaagttataaaaaatctttaaggttgtctacgacacagcgaaagaaaatctgtgccgaaaataatcaaagtgaaattttaaaaagaatgatgccaaaattcctacactgttttaaaggacctaacatttttttttaatttgttgtaacttacattcagtcgaattcgaacatcagcaggcaacagactgtccctgatgaacggttttggcacaatgcaatggaccaattttatccatttgatgctgttgaccacctaaaatggaatattttttgaacagacgaaaaaataaatagatattccatcattttttaaatttcgaaaacttggcattttaaataatatcctttaaatttttggttgtgtttgagacctcttcccacgcgtccgcaaattggtagccgtagggaaaggaaatttccaacgaatcggcactccatgaccacaggcgattggtgtccagctccaattggtgtgcgaacagatcaccgcccacgatcattt

SEQ ID NO: 21230 - DNA, 1568 bp, Heterodera glycines
catttcgtggcaaaaaaaatgaaaatgccaccggggaaagatcaaaagcaaagcaaagcaagtgaaagaaaagttgcatgatgggcttggaatgttaggacgtcaaaagtgtgtgaaaggggcagacaaaaaggcggcattcgatgggtcacagagaaatgaaatgaatgagaggggcaaatgcgagggggggggggcagatcggacgaaaggaacttctactgatcaatcggatggaagaaacttcgattgatcaatcggacggagcttcggctgatcagtcccctcccctccccacgccgctttttgagtttgccgcgacaacagttgtccccccccccatggtcatgttttgttggctttttgatttgagaaattgttctttttaatggggggggggaagaaggccttcctcatcacattttcagatcgaaattgggaaattggcaagcacagcgaaaaaaacggatgagatttaattagattatttttaaccatcgatggcccttttcctgagaacatatttttggcacatctgacagaaaaagcactgccgaaaaaaggcgaaaaggcgagggacagattagtgttctatttttggtgaagccaatttggggagagaatcgtgcgaatgtgtgacaaaaatgggtcggggcacttttttggattggacggacaaaaaaataaggaaaaaaaggaacattttgccggggagcgaataaaatgcttaaagcgactcgaattttaaattcaaaacggggaaatcccggcaaactaaaaactgtccattctttctttgtccattgaaaaattcggtaatttttaaaagaaatttaaaatggcaaaagaaatgccaaagtaataattatgtgcataaacaaagaagggaatgttttaagcgagcttttggccgttggttttgagttccgtttcttttttttgcagttaggaaatttcggaatcatcaaagcgtaagtaacggaaatgcttttgcctcggccgggccaacaaactttggctccctccaatcagacaaccgcaaaacaatcggcggactaagcgggggcaatgacaaaggaaaagccgaccgaccgatgccaatgaatgcttcggcacaaattattgcggtggcacttttggccaaaattggcaaacaaatcccaaatctttcttttgtgttgggttcattttcggtagggaaggaaagaaaaaagttggcgcatttattgggtttaagcggaaatccaagcggaaaatttgaattcaatctctttaaaatgatattttggcataatttttgggtaattattttggtaatgaatgttttctccgctgatttatttctttaaatttttggccttcgttttaaatatttatgccttttttctttgtgtttttcaagtgcttttcgcacgtcaaaagctttgccgtcttttcgtaattgaattttctgcactttcaaagattcgaacgcacaaaataatttatgcaaaattcttttcgtctctttatttaaattgttaaaaatcgaaatgcctttcatgcaaaacaattaagcattcattatt

SEQ ID NO: 21231 - DNA, 852 bp, Heterodera glycines
aaatgtgacaagtgattgtgatttatggttcctaaataaagtaccaaattacaaatgttgtcacgagggaagggaattaatgcgtatactgtataatgctgtactgtaaatgaacccttcactgtaatgtggttgattactgtaatcatcgattggtcgttactctctttgttggatgaaaatagaccattttcacttggttggcctcaaagtattggtcaattggctgtcggtgttctcaccggagcgacggcagcggctacagaggcgggcaaaaggccgcgaaacgcatcggccaaagcattgcgagcggagacgcctaattaaagggtaattataattaattaattacccagatggaaggctgtaattgatttaattagtcgacgggttaaaaaacaacggagaaaacaaatttataaaacgaaaacaatggtaaaaataattcaccggccggtggccatgaaacggacaattggccgaccgatggcttaagcgacggacaatcggccgacgggggacaatcggagggacggaaaagcgcaaaagacgaagactaaacaacgggaagaattctttttcctaccgtttctttcgattttcctaccgtttctttggcctccgtcggcgtctcaaaatttgtcgtcgtttgggcgtgcctttttgcgccttcgtccgtttgcggcatatttcccattttggcgagcacgcgttcgccgatggcacgcgcgtgggagggattgcacgcgggaggaaaagcggacatcggcgggagaggagaagcagcggaggagaagagacttctgctgaattggcattgccaaacactcatcggacaatttgtgttccatt

SEQ ID NO: 21232 - DNA, 1455 bp, Heterodera glycines
ggccgaagaaatggtggcacggagaaatgcctaaacatgggaaacgaaaagcaaatggtatctaatccaaaattttacttaaaaatgaccacacctctgaaattgattgttaaccaatttaattgttcttgacatataaccagaacaactcaattgctttggctttccatcgcttctcggaatttgcaaccatttggtcaatgcttggccagcctttgcatttggcccttttgcatcaccaagggcaacaaatcattggaattgattgaattgatatcgtaaagaattgtcggcgcagtgtagcgaaacaaattttaaagatgaagaccctttgcaaaattcaaatggcgaatgtttggcgcaaaaatgggccaaattccacgggcaaaagcattccaaaatggctggacattcttggctttataggagaaatgcggcacgtgcaaatccaaattgatgcctttgtcaaaaatttgctaattggcacggagaaatgtgatgacggaatggtcaatgtaactgaaaggcaatcctttatcacatcccaggttaaaataagtcaaaaattctttaaaaaataataattttaaaaatcatctttttcatatattttccccgtcttttttctgcttttccgtcaaaagtgtatgccttgctctaccgtttagtaaactatttttctcgatcttcaatgttttaatgagcaaaaaaagatgaaggaccaacggacaaaggacacacaaaataataatttaactaaaatatattttttggcgaaatcaaatcttaatctgttaagattagtttttttgatcatataagtcatatagcatttttctcacagtccaaattgagtaaattagtcacagtttattttttaatctttttaaaattcaaattattattttgttggttctttgtctgttggtcggtcctttgtctttgtgggtcctttgtctgtgggtaaaagaacggcgattgtcaggggaaaacttttgcttttttttcttacgggcgatgccattaaaaaataaatttgcctaaatggaaatttttgtatgaaaagaaactaatgaaatttaatatatattggattgtgaaaatataaaataggaaggtctgaagcttaataatgccatcaacattaatgagcaaaaatgagcacaaaaatatcagatccatcacaatttgtccgttcaatacttcacaattatatttcactgcttaaagttaaataagcaaccagcaggacaaatgggaatcgttatgtctccggatttagggctttaagccattttaaactaccgattaaaagcattgacaaaataaatgtgcattaaaaagtggaactaagtttggcccaataaaatcgatcggtgcaattattcatttggtttgccataggcaaagaaaggggggcaatttgagtaggataagggataaagacggcacaaa

SEQ ID NO: 21233 - DNA, 600 bp, Heterodera glycines
ccattgactaattagtcagttccttatgatgtaattccttccttacaaataaaaaaaataccaaaacaatgaattgcaataaattaattttcatatttttttgttgctgtgattgtcccccgaattttaagcaaacgattaaaacaaaaaatgatcatttggttgtactcgtgtagactaactatatcgcatcaatttccaccgggattttaccttttggtcctttaaaaatcaaaattaaaacgcactttccatgacgtcacctcaaaaagccacaattacataaatcaccatttcaatcacatttaaccttttagatttaccgatttcaatttgtgcataagaaagcattcattttgcctattcctatttttcttgataaatgcaagcgccgcaaccgttgccaaatttgcaccaaattttccaagcggtggaccgcgaccggtccggtcagatcagtgcggacgagttgcagcgcgcgctgtccaacggcacgtggcagccgttcaacccggagacgtgccggatgatgatttcgatgttctactacaacaacgatggcggcatcagttttgcccgagtccaatcactgtggaatgt

SEQ ID NO: 21234 - DNA, 1110 bp, Heterodera glycines
tgagtttttgtttttccctttttcgaaacattaatcagtcattttttgtctgtttttcaaggacacatcaacttcgacgacttcatccaactttgtgttgtgctccaaacgctgaccgctgcttttcgtgaaaaggacaccgacttggacggatggattcgcattcgtaatatgctttttcttctcataatttttaggaatgatgccaaaatagttttattaactgctgatggcaatttatggaaattttgttttttacaacaaaaaatgtagagattttttgggcaaatagcgtccattttgtttagaaaattaattttttttttttttttaatagcgtttatccgggggcatgcaaaatttctaggcctttaattccgtcataagaagaaaaaagatttccgggattttggtgaattccaatttttggagttcgaatttcaaattcgccttttttattttccggtatttcgtaatttcaattttttttttttcacagattatgaggaatttctctccatggtcttcgctttgaagatgtaagtgagtgaaggtaaaaacatttaaattaaatcttttaattccatttttcccctcaccgttcattccaggctgatgatggcctcgcatcgctccaccaaataaataaagaaaatgccgttctgctgctgatatacccatatatggaaatatttatttaaaatgcattaatattactcgctgttacatattttggggttgtcgctttataaactgtaaaattactgaaaatggcacaaaaattttttttgaaagaagtgacaaccgcaaatatactattttctttcctttgttttttgcctgcctttgtttttgaaaagcatatcctttctctttatttctcgttgctttttttcgtgtgcgcatacattttttgcgctgttccccgccccttccgccttggctacgtgactgtgtgcgccttgtcacgggcacattagggtcggcatttttaacaattttttgtgcgtgggcgggcacccttttaggaggttctctcaaagtgactataaaatggaatgacatgacgtggagtgtcataaattcaacgctcaacaaattccacggtgg

SEQ ID NO: 21235 - DNA, 1485 bp, Heterodera glycines
  misc_feature (1421)..(1421): n is a, c, g, or t
  misc_feature (1427)..(1427): n is a, c, g, or t
  misc_feature (1440)..(1440): n is a, c, g, or t
  misc_feature (1453)..(1453): n is a, c, g, or t
tggaaaccagggctggacgcaattgcggattgcggattacggaaattgcggggtttttggatccccgtaattgcggattgcgggttgcggatttttgggatttatccgcaattttgatccgtaatttgactattggattatttttcgagacgatttcttgtaagattattttttataaaatgaatttttttctatttttatttaaagaaaatatatacatttgtttaaattcttatttctttagcaatttaaaaatgtccatctgcattggagacacgacaaaaaaccgaagttgaagtgaatgaatatttacgggaccaaaaaatcaaatccagggccgatccagcattatactgggaagttaattcacaaaaatggccaatgattggtgccgttgtacggaaatttctttctccgcctgcaacaagttcagaaagtgagaggcttttctcaacggccggcctgatttcagatgacttgagaaagagtttacaggcggaaaatctggcaaagcttttgtttcttcaccataacttgcttctaaccggattttcaattgaatgattttgcttttataaatttgctttttaatatgtttttaaattgctttaaaagatttataggattttttaaaataaaatttaaaattattaaaaaaaaaaattttttttaattgcggattgcggattacggaaattacggaaattgcggggtttttggacacccgtaattgcggattgcggatttccgaaactgagaaaatcgccgcaattgcggattgcggatttccgtaattgtaaatccacttgcgtccagccctgatggaaacacacgttgctacagtaattgacagcggcgaataaactgcaaaattgtgtcagaatttaaaataacaaattcaaagaattatattacaaaataataattaaataatagtattgaagtaaataaaaaatagtttaatattatttgcaataacaaaatatacaaacaaatatgttaaagttcaaaaagtatcggaatatagaaaatttttatattgttgttatattatttattttatttgcaatttatcttacatttgattttatatttttctctgtttcaaataaaaattaagtgtaagtttaatatgcatattttattttaaaaatgaatgaatgtagcaaaccagcattaatttaaaggaaaaacgtttttaatcaacgaaaatttaaccgattaatgttattgaatctattaactgaaaaatcatttttcggtgtacatttataaaatgccaagacatttttctcacgttccaagctcagcataactctaaattccaatcgattggagacggcggttgtgccaaagaatatgtacaaattttgccaaagcgttggcacactgtgcattcaaagcgaaaacaatctgatggnggaggnttaatttaagttngctttgatattanaaatgcaaatatttatttgcaagttagagtta

SEQ ID NO: 21236 - DNA, 998 bp, Heterodera glycines
  misc_feature (920)..(920): n is a, c, g, or t
ataaatttagagaaaatcttcgacaaaaagtgatgaaagtgaggaaaataaatcctgtgtttttttaattaattaatttaatttatcgagcaaaccaaaggcacattagtgctcttatatggcgccaaaaagaaacaaacaaataaaattgatcaaattaaaaatacaaaaataccgaaatataaatgaaaataaaataaatcaaatgttaaattcacaggtgattattttaatgtaattgtggcacagaaaatttcctactcagaactcattgcttttagtaaacccctgaattcctttgccttattaatctgcaccgctaaaactggaaggttattccagtttcttactatcctatggaaaaaattattttgagttttggccgtgtggcgctttacccgtaaaagtaaaggcctcctgagcctttctgagaaaaagaaacttttcccagcatcgagcctggtgaaccctttgattattttaaaagctgttgttaaatcattgatttttcttctttcttccaatttgtgtaaactcgtgattttaagtctttccatatattttttgtacacaaatccacattttcgaaaagcttttcttgtgaaaaatttttgtacccgttcaattttgtctatatctttttttaaattagggttccaaacttcggtagcgtattctaattgaggtcgtacaaaagttttataagctgctgttagagtctttatttccctggtttttaagactctcaaaatctgaaagcttctaagatatgcgtttcgtataattttgcttatgtgttctgaaaaattaagtttcgagtgcattataattccaaagtcacgaacattatccgattctgaaatcttttttgagttaataaaatattcttttttcatattatttttccctaaatataaaancaaaacatttttcagttgaaatttctaacccatttattttagaccattttccaaagcctcaattgctttatccaactg

SEQ ID NO: 21237 - DNA, 1799 bp, Heterodera glycines
  misc_feature (1682)..(1682): n is a, c, g, or t
  misc_feature (1693)..(1693): n is a, c, g, or t
  misc_feature (1725)..(1725): n is a, c, g, or t
ttctgttcgtttggggcattgaaccaaagcgacaaataatggagaccagcagacagaaggtttagccactacaccacataagcatgtgaaagaaatactttaagtaaataaattttttttctcaaaatttgtccttctccagtttcattctcttttcacacctgctgacgcccgttcttaccagtgcatatttagtcccaccgggactggcaaaaccgggatttcccatcccggtcccgtgcaactctaatttaaatttcaaatgctcgagtgaaattttcttaattgtcaaaaataaaaatttcgaatgcatagaaaatgaaaacgattgatggtcggtgacgacggtaggggcaaaaacgacgattgacatggacgacaaaaaagataaaacgagttcatttccctccccgcgggaaaattggtaaagttagacccaaattatgtggcgtggcgagacagcgatgaattcgtgggaacaggacaaaatcactccgctagaaattaaaaaaaaaatttttaacatagaattttttcaagaaaaaaatcttataaaattttttaacgaaaatttaaagaaactaaaaatttgaaaaactttcagcgtttttttttgaaattttataaaatattgtttttttcaaaataatttgtaaatgatgggcaacaacagcagatattcaaataaaattcattgtttttcatttagaaaataaattaaatgaattgagttgaccgttttttctttaattttcaaatagtgaaaccccaaataaaagggcaatgttaaattcgactataactcatcaacgaatttatttgtcactggagcacgtaagtgttcagggcttaaaataataaaaaaaattgagggcgaacgaacgtatgaaaagtcaaaaagacaagaaattcctgcagtttgacacgaactcgagaaattatattttcccatttgtcatatgtatttatttaaacaaaaatgagattcggacaaaattgataacaacaataataagatattattcattttaaataagagagatccattgaacaatattggtaacaaccaattaatatgctattcattttaaacatttaaataatatgcccatagaatgctgagatgtgtgccggaatgtccacactgaagccaatggaaatgatcacacctgcaatcaccacggggtcctgctgaaacaatgaagaaatatttaaactaaaattaatttgtaaatttattttttaatgccaaaagatttatggttaaattcaaatgaatttaatgaaaatggcattttctcctagcattaatccgtcagattggaatatatataggaaaaattgttttcaggagctttagaaagttcacaaaaccgggaatttaacccgagagagtttgggtcagtattaccaaaggtctcgaggttgaaaataagaaacctttgcacaatgccaaaaaaatgctttaaagaattttcatcaaaaaccatgctcatgattggcaagatttcccaataaattaaataaaacaccaaaaaactcacaattgtcagtccaatcattaaatttagtttttatttgaaaatttaaattgcaaaaaaatccataaatttttcaatttctttatcggagaagccaatttacgaaatggaaatataaatgtattttaatgagggcataanaatttaaatanatataatgtacataattaagtaattaatcaangataaaaatatgcaccatattttcgagcagacccagaagagaccgaagtcatggagcacggacacattgaaatc

SEQ ID NO: 21238 - DNA, 1665 bp, Heterodera glycines
tctcctcagctggttcctggttgctgctgatccgcgctcatttcatcgtccggtgaaaatgactcaaatgcttcgaaagcacgcgggaagtaaatgctgctttctctcgggtaagcatatggtctgtaaaaataatttattgcttttaaattaaaaagaaaaatttattttttaaataaaaattttttaattcaaaatttaaatgaattttcagaaatttaaaaaatttcctttttaattagtagattttgaagtaaaacaattattttaaaaggtataatatagagaaaagacaatataattgtttatttttattatgaatttattatttaaaaatttatcaattaatgaatttaatttataatttaatattattgtataatttttttacagatgctccatttcgtcgatgaactggtgaagcttgtgtcttctggtcgcatttgacaaatcgcctgggttgttcacaaaaatttgtgccattgtgtagaagggcatcaacttaaataaaaagaaattaaataactaattacttaattttttataaatttctaattaaaatattaattaaaataaaaatcattggtattttcactttgtcttcacgatagttgtccacttccagcagaggcgagtctggcgggaacaatttgaccattgtcagattgatttcgaatccgagcaccgcctaaattcaaaaaaatcttaattgtgccaaattaaaattaattaaaatgtaccctaaagcaaatgacgaaaaacactgccgaaacgatgacaatgccaatggaggcaaaaatgttcgaaacaaatttgatgtatgcgttggcgatccgttcaaaattggaagtgaatttcgcgcgtgaactcgtgtcattgtgctcatccgaatttgaatcggtcgatgaaattgtgccggttgcgctggtcgaattgctgttgtggttctgctcgatgcttttcaattctgccttgaattccaatcgtgcgcaaatgatcagcacttaaaaacaattaggatttttaattaattaattaattgctttttaaatttaataatgaattataggcaataaaatttttaaatttaattaattaattaccggcagtgaacagggtaatttggtagaagaaatcaaacgaaatcttaaatgggggtgaaaaaaattaaattgataataaaaaaaatatgaaaggaattttgaaacaattaaaaataatgaatgaccgattattttttcaatttttaaattccatatttaaatataatattttcgctatttttaaataaaatgcatattaatttttcaatatttaaacgcaccgatgcgatgtttccaatgcagagtaaagtgatttcgggcgatcctgtccacatgccgaccaagtcggacgtgatgttggtaagtgctgagatcagaattgcaggaccagtgtcttccaaaaccttgaaaatttgaattttacaaaaatttacaaaaaaaatttattttttaaatttccaacctcggaaagcgagttcagtaaggagttcatccaacgattttgaatttgttggaattttcaattcaccattttttctcttgcgtttgatggtcaattgccaggaatgaattgtcaaaaaggcgtcatcaattcctattttaataattttaaattatttta

SEQ ID NO: 21239 - DNA, 2399 bp, Heterodera glycines
  misc_feature (32)..(32): n is a, c, g, or t
  misc_feature (53)..(53): n is a, c, g, or t
  misc_feature (126)..(126): n is a, c, g, or t
  misc_feature (2337)..(2337): n is a, c, g, or t
  misc_feature (2374)..(2374): n is a, c, g, or t
agtaaaacacacaaaacataaagaaaatgcgntcgacgaaggggtccgatcancaataattcacaggacggcattcgtgtgcgggaatggcacgaaaaagtcttatgttcaacaaatgtgcaacgntcgcttacaaaaactaatttgcaacgaaatattgttttagattttagactgcattagtattttttttatttgcctatttttcttttttcttgatgtggcacatcgctacccttcggcgatggcattttcttgtctttttgtgtcttatactgtcagattgtccactctccgatcgtccacctctgtcagattgtcctcactgtcggattgtcaactgtcagattgtccgggggccgcataaagcacgatgaatccgtataataagtagagaccggacggggccggctggctttaccgggcccagaattagtctaaaccagatcccggtcattttgacagggctaaaacgggcttaaatttcgccagaactgccccatatttgaaaattaatacatacatattacaaactttaagaaaattaatttatctaaattttaaacaatttgggctaaattaaaatcactcgattttactataagtaaattaatcccaagctaaaatagaagactaaacaattttttttaatttataaatcaattttccaaaaatttggaaaaagcccggttccggcgggcacctggccaaaattttgggtcgggactcttaaacaataaactaatacaggtaatcattttgtagtttaattgaaaaaccttggtacaaaactttgaaaaaaatatacatgatggaattcactcaaaattgcttaatcagacattttagtaataaatctattatcaaaagcagccgactttcagcttgtccgacccaaaatgacagagtcagggttagcttcagctgggtttaacatttactgctaacagatctgaatccctttgaaatacttaaaccttctaaacgctttaacattcccttttatagacttaactcgaaatataaattaggcaaaaaatttataccttttgcggggcgggtaacaaaaatttggaaccaactcgataaaaagcttattgaaataaactcattaaatcaatttaaaaataaaattaaaactatttcatttctgtaagattgaccggaaaaataaaagtcgaattattaattcattaaacaaaaagtgatttggtcattatttttattttttttattgatctaacattatattttattttttggcggcgatctcgtttttaattgtttatgcgctttcttgaggacattttaattaatgttttgtcctcaatgtaagcggatttttcccttttgaggactttttctttattgacaataaataaataaatacattggagtaaataaaaagacacaaacaaaaaataataaattaaaattttcagtcgaaattttaatttttgaaaatttgatcagcttgggccaagacttttttggggcactgtatgctttggctttttgttactttttgaataaaatttttgtaattttacacaacaaatttgaggaagacttttggatttttaatgcatatttatggttcttttagagcctaaagcctacctatgggcgccgctggggaaattttttaaaaactatgctaaatttgcttgcgaaggggtcccccattttggagcccattacgagcgagggatgggtgaaccggaaaaatcccgtcggtcccgatccagtgcaggctccaatatttttgtttaaactcccgtgatttattgctaacttggtagtctctcttttaaacaagcatcaataagtaaaatttatgcataacgggatacaaaagcaataactgaaatcaacaaagtgaaaaatcaagtcctcgaaattgttttcgccaatgaataccggggacccggaatgagacgttgcaaggacaaatactgctggtaggtgccgtaactcatgttgttgtcggcatgcacgttgttctggccgttgttctcccgtcttgaccttttccccgtctgagggtgaagcatgtggacaatccccgcgtttgttcgcattttcaacgggtattttccggatgtgttgttgttgttggagatgttggtgctgtttgtgttgttgttgttctccaattctcccccagcaaatttggtccctttgtgtcgcgtgccatcccatggccggttaattcgtgcgcaagtttgcgaagcgtcctctttttcgtccaccttacgccaccgccgaactttcgaattttgcggagaaaactgctgattttgaccgtccatcaatgttggataagagatgcgcagnacagatcaggggttgagatcctagaaagatattttanatgatttaaataatgatttttaaaa

SEQ ID NO: 21240 - DNA, 1242 bp, Heterodera glycines
cagaatcaaaattgagtggaaaattgggagaattttaggcacaaatcgaaataaaatatacaaatggaaaaaagaattaaatttaaataaaaagaaaatcaacagcatgaaaaagagtttttataatgcaaaaaagaaagaattcattgaaggatttgatgaatttaaaagtttatatggcctcggaaaacagaaagaatttgtgaaggaattggacattgataaaaagacatttataaattggaaaaaggaattgatgccaaaatataataaaagtacctaagagaaatttttatttttattttagatttaaaatgtttttaacacaaaataaatattccaatgagcaaaaatcacaaaagctgaagcaatattttgaaatcaaggaactaaaaccaacaattagtgatggaataatagccgagaaattgggaatcggattttcaactataaaaaatgggttttggaacattgatttttgtgaagaagtttatgctattcgaaatgtgttcgttaatgttaaaattaatttttgttttattttgttttttttttgtgaccaaatggcaaatatttaagtggggttacaaagcctaaaattattataaatatgatttaattaatttatttatcaaatttcatgctgctcgaggtgttgatgcattaattaaatatcacagaaggtacgaaaaatggaaaaaataaattccataaatttactcaaaaacttcaaaaatttactaaatttggttattagtgattttgaaaaaaatttatacagaaaacgcattgcatttgtaggtcaaataaagcttgtaaagaatttcatcattaggcagtcctctttttcaatttgtttttccgtaactccaaatcacggcatttaattagcgtaattttgccgaatcgccttaaatattcattcgccttaaatattcattcgccttaaatattcaatgacaaaaagaccctgccccgaaaccgaatattctccaatttcccaaaaaaatggtatccaccagttaattgactcgcaaatgacttttgtcaagactacagtggaagcattgaaacaactccagacctcttttacctccgaccaaatgccaatttttaataccctaattaccctttgtcctctcaaattgacctgcttaatggatcgatttcccaactccgctccactgctctctccactgaaggcatgccaatttcagcggaggaattggaaagacagagaag

SEQ ID NO: 21241 - DNA, 2137 bp, Heterodera glycines
  misc_feature (2107)..(2107): n is a, c, g, or t
cccccccccccccctctctcaatgatttgccattcgttcttcgtcagctctcgcccaaatggacgcgcgtgagtcgggtcaaatgagtctgttgaccgtcggttactacgtcatcaccacgcttttcgccaccgtggtaaagccaaacaacaaaaaagcataagccgtgtcccccgttcatttgtgtctttccatttcatacgggtgttctgctggtgatggccatccatcccggcgacccgtccatcaagcaggacttggcctatttggaggtgcagcacacgcccatttcgccgctggacacttttctcgacgtcgttcggtgggccaatgccatctctcccatgcctttttggcacttttccgacactcttttcttacaattagcaatatgttccccgaaaatgtcgtccaagcgaccctccaaagagcacagacaaaatattttgccccgagaagaaacgcacagcaaaaaacacaccaaaagcatgaaaaaggtgattaaaggagaggaacggaacagagcaatttccattttggcattgactttatcgttttttaaagtgttcgataataatttggactccaatcggtcgataattacttaccgaaaaaagatcgagagtgtgaatggcattaatatcctcggtgagtgtcccccccccctttccgttcggcacccccccccccccctcttttggcatcatcgttttctgcaccggctttggcattgtcatttctcaattgggccaacgagcgcacatcatcatcgagtttttcatcattctcgaggcggtcatcatgcaattggtcggtgccttcatgtggtcagttagcactcaaatcacagtgaaaatgccaattcgatgcattttgcattagtcggtttctctccagccccaatcgcttttcaggctgacccctctgggcattgtgtcgctaattgcgggcaatttgctcgagttggacgacctcagtgacaccgcagcagtccttctcctttacgtagtcactgtgctgacggcatttacagcccacaccatggtcacaatgccactgctttatttcgtgttcactcgtcgcaatccgtttaaagtgggccaatgaacggcgggggggggggaggagggggtactcacgcggcatttggcttgggcactttttggacacttttacggcataaattttgtttaatttaatcaactctcatttttcaagtgaaactaaggtcgtgcattgtgctgcttttgcaactcccttacaggtcgtccacggcatgctccaagctttggtgaccgccttcggcactgcctccggcggtgccgctttgcccgtgtccatgcgctgtatggaggagcatttgggcgtggaccggcgcatcactcgctttgtgcttccgctcggctccaccataaatatggacggaaatgcgttgtacgaagcagtggccgtgattttcatagctcagctgaacaacgtgacactgacactgaccgaagtgatcacagtgaggcgagtaaagtgaagtgggcaaagacaatggcaatcgatgcaaaacagggagagcgctaattggtctaattatgggcgaagggtcgggtaagaacagggaaatatgtaattaggtattacgggagaagacgtaattgggcaatttcgagtggatgtgggtaaacgtgttttaactgttcagtttcattgctaccatcgcttcgctcggcctcaattctgtccccgctgggctcgtctcgattttcgtcattttgtccaccgtcggattgcccgtcaaggacatccctctgatcattaccaccgattggctactgtagggtgatgtgcccaccgtatcggtccctttctgtgtagtgatcgaattcggacgagtatcaacgtgcttggcgatgcgttcgttgcttcgacggtgtcccattatctgaaggaccgtttggaggagtccgatcggatcaatgagtttcaacagaccgtcaaagaaggagcaggtccctttggccttctctcttttccgtgtttagccatttttgcttttctcttcagatttgctctcggttcactctcgaaaggcttcggtggcacggaagtgaattgngcattcccagccgcacccattccaccgatg

SEQ ID NO: 21242 - DNA, 1239 bp, Heterodera glycines
cttcaaatcgaacttttttttcaaataaattattccctcatcttttgtaaaaaattctgctgctttgttctccgcttacactttctttagaaaattccttttaatttggtgttatttgatctcactaaatattttcgattactcccgtctcatttaattgttgaatggatgactttcgaaaactcgattagacaaataaattaaaatttgaaaaaagggaaaagatagttaaaaaagaagaatacaatattgaaagaaccagaaaataaactaacatctccagcagatttgcacctttccattcgcactgattttatctatgacctataggtagatagatgtatatcctttaggatatatttgcatttctattggcctgatgatttagaatttcttgcgcgttttagtgtaatgttaactcgtacaaaaggcaacttgtcaaatagcttaaactgggcctaagctttaggcttaggcttaagcatatgctttactttaaatttttttgtcaagttgcctttatacaaatttttcaacgttgatttttcgggtggagccaactgaaattgaaagttaagcaatgaatttaatattttcattgtgagctctcaaacgatatagtaaactaaaaaataaattcacaactgcacaaaagtcgagggaaaatccaaattgcctattttgattgtggacaattttgggaaaaaatcagtttggaaatcagccaactgttccattcggccggaataactgatatttttaaaaaaatcgtcgctcgtagcgcagaaaaatacgccctttagaaattcaaagatgaattccatagcagtgataaaattatgtataaaaaaatacaattgtttttttgacaatttcactatttttccatcgccactcgcgtgccgtccttaatcggcaacaatctgtgcctatttactcggtgtttatttgccttttttgttaaatcatttgagtaccggcaataggacgtggcgaaaagcaaggacagcgaaaaaggtgctaggacgaagtgagaaaagtatcaatgttcataataattaaatttaattattattttaatttaatttgctaaataactaatcataacatagcttatacttagtcaaattaataaaatttagtatttaacgacagctccaagtatcctctactacttacatatattttttaaaaattattaaaaatttacaaaaatttgtaaccaaaaaagtacgaaaa

SEQ ID NO: 21243 - DNA, 1829 bp, Heterodera glycines
gtttttgcgtggccattgtcgcgtgccgtttttcaggtggggacgttttcgcgaggccatttacgcgtggggtacgttttcgcgtgagtacctgttttggactgaaattggtcgtatttgtgcaaagcatccatgtttcgaatcccgaacccgaattcggacaaatttcttaactttttaattttttttatttcttgcggctagtatcttctacaataatttgtcagcttggtcggatgtgcgtcaaacggaaaaaataattaaaattttataagaacacataaatagtataacaaaaaataacaaatttcagaacaaactaaggtcgcatttcatagtttcgggaaacaccagtgagaaaattgttaacgttttcgggattcacattgacatttgcataattgtgtcattttgggggaggtgattgttattgatgtcgttataacggtggacgagtcagagaatccgtgcgtcggcttcgcgatacttcttttatcgtttgatcacctaaaaaccaaaaaaataacaaaattgtttttggatataaacccactttttttgtggcgcttttgctcggaaaagctgctagcacaggtgtgcatgttttttgcagcacttgagcacgaatagtcgcaggtgcttcgcacgtctcagcagcacgtcgcttgagtccagttacaagcgtgaccggaaaatcggtcagtggaaaatgcgtcagcagaaaatgcgttagtgataaaaatattttaatattaagttatgtagtattggtattgtaataagaagtataattttataattatcgttctgaatttcgaaccccgaacccgaattcgaacaaaaagtcaaagtcaaaattttcgaaattagagtttttcttcaaaatcggtttaaatacacgaaaacaaactgacatccatcaatccttcaataagcaggggtgcgatctgtcctgatttggaggtagcgaccaaaatttgtcctgatttcttaaataaacccacatttttgaaattttatggcataatgtcactattttatcaagaaaatataagatttgtggcaaaatttagttatttttgacaaaaatctgttaacaagttgattaaaaatcgcaaaaatttttccctgcggcgcctatcggcaccgccggatcctccgtccatcctccaaaatttttcgaaaaaatgcgccgcaaaaagtgtttttaaagcaaaaaagtcgtcgcttgactttaaagttttttggaaaaatgcgccgcaaaaaattttcaaaaatctgattttttgggcccgatgtcctgattttgaaaaattttcgatcgcacccctgtcaataagacatcagttattccgtttttgaaccaaaaatgctaaattggccggaatggataccggattcgtggtcagtgacctcgaaaacgcaaggaacttgtttttaaggcaataaattttcgctgacgcatttctgctgacgctttttccactgacgcattttccgggcgccaattaattaatgcacagcgcaattaaaaatgcttttagcaaaagtgaatgagagtggcggacaaagcgagcgaattcgagacccaattgaaatcggcgacgacgagcagcagcaaatggtgtgtggagaggctattactgtgcgatcgatagttgataatttttttctaaattaaaaaacctaagaaaatgacagaatttaacaatatttttaagagttgttttaaatttttttataatataatataaactttattaaccagggctcccaagtgtccttatttctaagatttttcttattttcaggcttcccctaatttttta

SEQ ID NO: 21244 - DNA, 3033 bp, Heterodera glycines
  misc_feature (26)..(26): n is a, c, g, or t
gaaaaagtaaaaataaaagaagaaancaattgaattaataaaaaacaaaactttttaaaagcacataacaattgaattaatctcacagcttgagaactgataagtcgagcacaaatgatctctaattcttcaattttaattattttttccttttcaaattttatttttgatttcaaaagttaaacattcgttataaaaaatgtaataattacatttaattcctgtgtatttcacttaatttttgagtctttttcaataatcgaaattcaactccccgaggggtttcaaactcctcctccgcagtccgtgccatgccaacgcatcagttcccaaaaagcagtaaagtcgcgcagccaattaggaattttccctactatgggaaaacggcgcaattaaaaataaaacatttctgactcaccggacttagtttcggatgaatacctttgctttaactcattatgatgagcgcttcatttgctgaaattggcgaaaatgccggcaaactttggtccatcccacagagatttgagaaaaaagtgagaaaaagtaattgaattgggggtggattatcatcagaaaggcgtggggataaacaaacatcaaacggcgcgggagaggctttggccgttttgtatgcagtgactgccgacactgaggggaaaccttttggacttttggcatttcccttccgtgccattcccttccccacccgaccgacaccatttttcgatctttcatcattgggaggatggaaaaacaccatcccaaaatggcaaaataacaattaaaaatttgtaaggacgtactaatcagagttacttttgacatgatatatcaaggacattaataaaactgagcatttaaaaatttattatttcattaatatccatttttaaattattctatccctattttttcagtttttagggaatcatttggaaattaacttatttatgctaattacagaaccaattggcatttctgttcgctttttgtcttgcgcatagcaataaaataatgcaaattggcatatttgtgaagaaaagcattcctgtgccgtgccgtttttgggggtttttataacattttttgctttttttccttatttaattaagctatagtccgtttttccttttcatatgaatgactttttacatcattttttgcggcgctcttttttaaaagaacttttcgggaatagggtacggcggtgccgttaggcgccgccggggaaaatttagaaaatttaagtgtgatttgttaaaagattttcaccaaaaaattaccaaatttggcattttgagctaattttttaagaaaaaattgatggttttaggtgtctccgggtgaaaagtgtaaattttagccctatttattaaataaaccataattattagtgttgtaaattatattgaataaacatattttttctgcgcatatgctatgaagaaaggggctcaaaaaatagcatttctgcattaaaattttttgatctgatgaaggttttagtccttataaatccatattttggcagtttttagtccatattttggtccaaatttggccatttttagctttttagtccatatttcgtgcttttttagtccatattttatgtccatatttcgcggtttttagtccatataatttacgaccctaatacataattactagggacgtgaattttaggttttaactattttttttgctcaattgatttgaagaaaggagctcaaaaaacgcatttccgcataaaaatttttcgattctgatgtcattatcggtcactagaaatcactattttggctacttcgtcactaaaatagttaaaaatcactattttgggattttgtcactaaaatagtgaaaattcactattttggagttttgtcactattttgacatttttgggcaaaattccttaacaaaaatgcaataaaaccaaaaaatacacccctaagaatcgacaaaaaaaatttcaaaaagcactcctaagaaatgaaaaaaattttctcaaaaaggtattttcgtggcaagaattttaattttaaaaattatttttttatgtacctattttgtttttttgcccttaaaaatcccagtcctactcatttgcaactgcaatcagtgaataaaaattatttttgcttaatttttggctgaaaattatgtcactattcgtcactatttcggactttttgacactattttggcatttttactcactattttagttaactatttcgggatttttcgtcactaaaagttgcgaccctagtgaccactgaccatttgcatctgtccattgattgttgtcaatggacattaacgcacccgcaaagcctaattaaccttatctgtggaaccaaatttgccttaaaaagtggaaaaaaaaattcataaaatttacgctttttttttgaagaaattttacaatcaaattgaaaataagactagatttttttttgcaatttttgttgctaaaatatgtaattgcactcacaaagcaccgacttttgttggtcaataaacattcaattcttgcgacaatcgatagaaaatgctaatgggtggtatacaaaacccaccaacactcactcactcattcattcatttattcgtcacttcccttttcttcctcttcccttccagcagaatttttgcactttttcatcactgttttataggacaaaggacggacttagtactgttttgggttttttattgaaaaatttgtcatgcaacaaaaattaaaaaataaaatatgtattaatagggctgaagtttttttagctatgaaaaatcccaaaaaagttaactaatgatgaaaaatggcaaaaattagtgacccaaattttaaataatcttaaataagaaacatttttttcttaaagggaaaattaacaaaaaaaaatgatgtcctaataataagggtggaaatttaagtcactaaaaatcttccaaaagtcgactaaaaaagtcataaaaatcccaaaaacatttaactttattcccagccctactaatcttttt

SEQ ID NO: 21245 - DNA, 2059 bp, Heterodera glycines
caaaaaaatcgattttttcaagtttccttttggggttctcaaacatttatgggaacaaaatccaacgcagaataaagttcagggtataggaagcttctccgaagggttcggtctccccaaaatctgggcgcatcggttcgggggactgcccgaaaacaaaaaaatcgatttttcaagtgtcggttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtggcggtcaaagtttggtgcgcttctgatcagtttctgcttaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccccccctcccacgcccttcagagcacgacaaatatttcaacaaaaattttgaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccacccaaagcaaaacgatataaccaaaatataaagaaaaattttttaaaaaattttttctccatcttcctttttgatactaaagcatcagagtgctaaaattaagttgtaaataaaatttggtgcgctttagagcactttctgaaaaaaatatttatgaaaccaaaaaatcgattttttcaagtgtccggttggggtactcaaacatttatgg

SEQ ID NO: 21246 - DNA, 1215 bp, Heterodera glycines
ggccataaaatgcatttggctaattaggagcaaaaaaattttcatgaaatgcaaaaccatggggtcccccctatggttttgagtttcaaaatcacaattaattttataactttttttaaactcatggtataaacatgagataaagcacattagattgggcttaaaattctctacaaaaaagctcttagacgatttttttgataaaatcaactcctgacgagttattgcgccagaactgaaattgaggcctagtaaccaaaaattttctatttccaaaaaatttttgaaaaatttttctgaaaatgacaccaatcgatagaacatgaaaaacggttgcttgaaagtggtctccgttttcgctggaaaaatctgtaaaaaataataaaattcaaaaacggaaaattttcgagggggcctagctcgaaaatttctgaaaatttctgaaatctaaaaacatggttggatagagctcgtcgagctctacaaaaaagccgcttacaccgacctcctccggtcaaaccccggcgagttattcggccggcgctgaaatggccaaaaaagtatgcaatttttgcgcagtttttcggaaaaactggtaggccctacgaggtcggtgaagagcaaaaagttgtgccaaacctcccaacttgatttcctatcgaggccgatttttcatttaggactttaaaaaatttttgaatcccaaaaacagcaaaaaaaaatttaaaaaagccgtttcagcgccgctggcgctcagttggccctcggaccggaatgcctatagttttcctggatgcgccgtcaaaagttgcccccaaggtcgaaatcccgagtccctcccgccagcggttcccgagatttttgttttagcaatgagttcatctgtttctttagtagtatataaactagcgggtgcgtgaaccgtcggctatttagctgggaaaaagcgcttcgcgctttgggagcttcgctacctaggctgtgaagcgattcaaattgatcgatttggttggagagatttttttgaatttttaaaaaattattagaggcttttagtccacatcgaggctcaagacgggcgcttcgcgcccgttttttaaatctgttgaacttacacgggcgcttagcgcccgttttttagcttgttaggcgcttcgcgcccgtttttcaatttttgttggccttggacgggcgcttcgcgcccgtttttcaaat

SEQ ID NO: 21247 - DNA, 1994 bp, Heterodera glycines
gcagcccttcttactgtaggtagaggcctggaattttctttgacttgtagaaacgacttcaacttggcttcctatcagcggaaactttttgattagagttctagaaaaaaagttatgggccttcgaacgcaagcaagagtgagaaattagccgacgggactcagttggccctcggagaaaaaaacctatagttttcccgaattctcctcaaaaagttgtaagacccttccactactttcagaccacggccggccttcgccggcccggaatattaagtttgagatgagttgccttatcattctaacgtatatataatttagcaaataatctcttttgatgattaatggtagtttcaaatacagattgccgcctttataaatttatgtcctcgtacttaataatacatttaaatttagaaaaagatgggtaaaaaagaaattaaaattaaaattattaatctagtatatttaagtaaaatatttgagtatcaaagaattttttgaataaataagtttgtatttaaaattttttgggctgtctgtggggagcatatcaccagcataattatttttattcttagatattttaaattatatatataatttatttaaaatattttttacataatacttggtttattcattttttttaaaccttttgtatatattaacatatttaaaaaaaattaatttattcagctttttttaaatttattaatagataattgctgaaagaaaaatataaaatttaatttgttcttttatgtaaattttaaattactctaaaagaattaaataaagttgtttttctttgcttttttgtttttaaattaaaaaaacgcagaaaaaaaaagaaaatttattattaatttttttgtcgaattgtaaatcattgaaataaaagtaatgaatttctactagagcctattggtttaatcacataatatttaagcctccaaaaccaactttaaggaatttgttgaattattaaaaaaataacttacaaatgaattcattgaggatggagtttttcctttcaaaacacagaatatgttaccaattaataattatattaatttgaattggcctggaccaggacaggaccgcacttttcaaaatcccgacccaaatggccgggaccggtaccgaaacttttgaaatgggaaagggacaaaatcccgggtccgaaactcccttttgccgggaaaagtgaaagattaactgattggttaaaatgccaaaaaggtgaaagatgtgaaaggtgaaaacgaaaccgcgccttattagggtcatatttttacattttttactatttattttaaaattttcaaaatcttaattagtagggctgggatttttatgttttaacatattttttttgcggcttagttatggcgagagaagcccaaaaatagcattttctccgaacaatgtttgatttagagcgagttataaaaacataaaaacacatattttggcgttttggcacataaaaacatatggcacatatttcggggttttggcacatattttggcatttttgagaaaaatcgtaaaaaaaatacaagaaaatctgaaaatgcaccctaaaaattgactactttacgtttattaagcatttagaaaatttctttatatattcaaatgcctaaagcagccaaatcaaacgctgttttaaatcgtcactggatttcaaagttcccggaaggaacttattcaactgatggaaaaattaatccgggactttacaaattgattgatatcgccaaaattttgattggaggtcgggcgaaaattgataaagactgatattaaatatgattttttttgcgtaaatacacttggtttttccaatttttagcacatatttttgcattttttaacacatatttaggccttttttttggtttttagcacatattttgggtttttttagcacatattttattacatatttcaggatttttagcacataaaaatcccagccctattaat

SEQ ID NO: 21248 - DNA, 1946 bp, Heterodera glycines
agtgcatgtgctaacgcaattacaactacaccaatattacacatgaatggacaaaagcaaattactttatttaataaaaatttggcaaaattgttaaaaaaaattcaaatttgtataatttttttcttttctctcacgaaaataccattcttaggggtgtatatttaaccccgaccccgagtcggggttaagggtcggggtcgtcggggttggaagcgtcggggttcgggtcggggttaaccccgaaaaatggccaaaattttcggggttctgggtcggggcggggtcggggttgcaaccctactatagaatttaaaggacatgagagagagaggagaggagataggaaaagagagagagagaagggtgaaagagagaggaagaacgagcgaaaaggagagagagagaggaaacggtagagagagagtgaggataggagagattagaggagagagagtgaggagggaagagaggaatggagggagagagactgaggagaaaagagaggaagggagaaagagggaagagagagagagagaaaaggagggagagagactgagagaaaagagaaggagtgagagaaagagaggaggagaggagcgaataaaataatggttaaagtgagagagcaagagagagagagaggaaaggaggaaaagagactgaggagaaaagagaagaaagtaatgagagagagagagagagatagaagagcggaaagaagagagtgagagagagagaaaagtaaaaagagatagagaaaaaagaaaagaagagagggaaagagaaagagagagagagaggaaaagaggaagagagagagagaggtggaggagagaatagaagaaaagataaagagtgagcgagagaataagtagagaagataggaaaggagggagagtaaggagagaaaatagggaaggagggaataagagagaaagagagaatgcaaattattttctttaactttttaaaaatcatttgagaataaaaacagagaaccgctcgttatggttaaaagatattttaaagaaacttaataaaagataaaaaaattaatttaatttaaaaatatcacctaaaaataaatattttattatcctttaaaatattgtttaaagaaaaaagacaattaaattaaaataattaaaaagaaaaaagtcaatataattattattaaaagaaacaataatttaattaacggaagctgctaacgcaccgaaacaaacatcgctttttcaccatgagaataaaaagataaattgttgaaataaaaaattaacccgaaataataatataatatttgtgatttttaataaaaaaataaataaaacaataataataatataatttaattattgtttaataaattatagtttgatacgaaaaatcattctcaataattgaataaaaaataatgtatgatacaaaataaattttaaattcaaaaaaagatgcaattagaaatgatataaattctttgattattatattttaaattacagcatttattcattctttaattgaatattttctataaataaaaacgatgaaggaaaaaaacaatttcaaaattaaatttacaaaactatataactgcaaaaacaaaaacattttttttaaatttttatatgttgtataaaaattattttagaaaattttaacttatttattgttttaattaaaaatgtttaaataatagggttgcaaccccgacgtcggggttggaaaattcggggtttggggttgtcagggttggaagcgtcggggttcggggtcggggttgacaaatcgttcggggtcggggtcggggtttttcaatttttgccttatgccatatagacaaaaaattttatattattttagctttaattttttttattattcataataataattttatgtgctttttatcataaatatttttgtataaaattaattaaaaa

SEQ ID NO: 21249 - DNA, 1317 bp, Heterodera glycines
aaaaaatggctagtatgtaaaaatttgcggtcacaaataaaaaaaaaatggctaatatgtaaaattggcgtctttaattttttagactaatcggagcaaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgtttagtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaaaaaaatggctaatatgtaaaattggcgtcttgaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaaaaaaatggctaatatgtaaaattggcgtcttgaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgtttagtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaattttgcgtcacaaataaaaaaaaatggctaatatgtaaaattggcgtcttgaaattt

SEQ ID NO: 21250 - DNA, 1376 bp, Heterodera glycines
  misc_feature (1369)..(1370): n is a, c, g, or t
cagttattattttctatttcatctgaagaagaaataattttacttcttttttacaaattaaccaaaaaaatattttagtttatttaagcatcttttatcttcttcaattcaaaagtattaaatttaattagaaaatatttcaagactggtatcgttgtttcaaatatatgcaaagctcatagtatttgtttcttactcatagcaataatattaattttatattatttaattttttggtgtatacattatgtatagatcctatttttttatactttatttctcatatcttttttttaacatgtttagtgtgaaatgatcaaacatggaattaataacttatttcttgtcttttttctctagttcatgattggtttatggcgggcggtcttgaaacgcattttagtttttaatttaattttcatatcataaattttatttttaaatactttttgttttttaattttcattttatagaataaaacagataataatttctaaaggtatttatcaatcgtttcttttggttaattaaaatttgtttatattaatacgagacttttttattatgaagtttatttaaatttcttaattttatctaaatacttctttaaaaaataatctcgcaccattttatccatacagtttgaggaaaatcttggattttttattatatcgttttaattaagataatgatagacatgagtttaactttattaaattacagttgatactgttttttaaatttttcataaattagcatttaggctattcttttatttgttacttcgaaaagatgtcttcataaaaatattttttgaatatttttgatggataatccttattccatttgaataaatagactggtaaaagttactgtatttatttatttaaaattattcatatttaaatttattgagtttatcatttttctataattttttacacaaaagtttcttaattaaaatctgtattttggttatttaatgaaccttttatttgtactacaaaactaatagatttttctctaattatggatttcggatctcgagaattcaaatcggtctcggaccctttagaccggccctttatgacatatatatgttttgaaaatttaaggagtgattttaataagattaaaatattaatattatttataaatattattttctttcattaattcttattcgttaatttttgtgctgtgcatagcgagcaaatcaacttaatattttaaatttaatgatatggaaataaaatgtaaaaatatagtaaaaaaaataaacaaaaaaaaattatcttttgatttaccttttgcttcggcaaagtggataaacaaaagctaggcaatacaaggggaaaaatctaattnnaatcat

SEQ ID NO: 21251 - DNA, 769 bp, Heterodera glycines
tagaagagagcaatggagaggatgcctgtgtagctcagttggttagagcacagcacggaaagctggggtcgtgggttatagtcccaccgtgggttgatcttttgctcttccgcatcaaagaaccaaagaacatcacttggcgctcctggcatggaatcacattcggtgtggagtttgtgtcgagacgacagctccccctccccactctgagagaagttgtccaaagactggcgctttctcatcaagagaccggggaccggtcttctcaaaggccggggatgtgataaatgcggtcactttctccccttgtgccaagacggcagtgaaggagattaagagagtgatcctcctccaaagataggattatacatctgattaaacaaatgcttgataatagtaaatttgggtgaaaaaaagatatttaaaaaaaatttgcctctgcattttcgttaaaccaataacttagttttttcattgaccatatctaacaaacttggtatcattcgaaagctcttaaccagctctatcggcttgcctaaaatcgcaatgatataccgacatgtaaaaaagttataaattaaaattgcaaaaattctgactttttttggttttattgttgcaacttttttataaattgttcaatcgcttagaaatagatataaaagcttctaaacatgtagagctttcgaatgatgccaaatttatataatttaccaacaaagaaaaaagttatgatgtttatgttggccagacgcaactgacccctacc

SEQ ID NO: 21252 - DNA, 1839 bp, Heterodera glycines
gaacgagctgttcacaccagtaaatgcccgcgttttgtgtggttcgagattctcgagtcctgctaaatttctaccctcgaccatctcaaatacttcgccaatatcgttcacctaatccgtacaacattagcttccttttttctgatcagccaaatcattcaattttacagtaatttaagagctaccgtagttttctatcactttttttaaacagagacaatatcccatttatcaaagtaaataaaaaaaatttgatccatttttcaaaaaaaatctttaataaaataatttgccaagaaaccaatgccaagattctgatggtaattctgattttggctcttaaatgactcattttgagagtttttggacccatatcattttggaaaatggtccatgccttaatcatggccacggaaacatggccctttttgccatgtccatgttcatggctatttctggcactcccttcagttgcccttagaatgcacaaatgccatcgacactgacgcgctgctggaccggatcaatcctgaaaaggacgtggacggactgaaccatgtgaacaccggcaaattggccaggggcgagctgggcgacggcatctcagtgccatgcactgcgttggcatgccttaagctggtgcaaaatgccacgggccaggaggactttgccaagggcaaacatgtggtggtggtgggccgctcgcgcatcgtcggcggtccaaccgcggcacttttcatgcggttagtacggcacggcacccgtgaattgataagcatgttatctgcttgcactgatcatccctctgctccgatcaaatccagagagttctgccatgatcggataaattcagtcacacttaattaccggttcccacactaattaatgtgccaattttgccccaggcatgatgccacggtgaccatttgccactcacgcaccgagcggctggcggagcattgccgcgaggcggacattctcattgttgcggtgggccagcgtgggatggtgcgcggtgattggattaagcccggcgcggtcgtcattgactggtcagtgtattttttgtatttggctaattagagcgctaattactccaattaatctgccagccatcccccttttttttactaacaataaatttttaatcaagtaaagtagcttatcaaatttatttcaaatcccaattttatcgtcggcatcccgatcccactcggattttaataaacagggccgagatctattttttgactgttactgactgataaagccaacttcattagtcaagatttcttatcaataacagccaaaatcgatatctgataggcgacgccgagactcttgaacagaaaatgttagcacccaatgagaacatattcatatttttttcattaaaaccgctaaaggataattaatgctgcattttgtgcccaaaagtaaaaaaaaaaaacaaattttttttgaactattccaataagtttgtggatcatttaccgtaatctgtccgaacactttcactttttaattatttttgggtttataaatcgggatcggtcaagatgccgggttctgacatttcggaagaaatactaccaggacagtaaaatatggatttacgtattttccaaatcctggacccggttaggaatttgtttcaaccccgaaattcgattgcgatcaaagtccattctgatcatttccaataccaaatcgagcatgatcatatagatttaatttttttttttcttccttaatagatagtgttcctaaaaattcagattcattatattttaaatcttcttcttcatttatacttattaaggataagatcaaattaaa

SEQ ID NO: 21253 - DNA, 1043 bp, Heterodera glycines
aatggcaatataattggaaaaggacagacaacaatgcttttctttatatcagctgatggtttacaaaaatcgaaatacttcctgagtactttccaagaaccatgagaataaatatcgcactagcgccaaaatcgaacaagaacgctaatcatcagaatcatcttaattttcccccagtgatttgtgagtgataagaaaatagaagaaattcagggattaattcctgaggaatttacaaggaccacgtgcatcattgctacaacggtgccttaatggcattttaatgtcaaaatgcccgacactagcgcatttctttagacaacgaaaattaattcctgaggaatttcccaaagccatgcgcagctttgttagaccgatgccgaaatggcaatataattggaaaaggacagacaacaatgcttttctttatatcagctgatggtttatttacaaaaatcgaaatacttcctgattactttccaagaaccatgagaataaatatcgcactagcgccaaaatcgaacaagaacgctaatcatcagaatcatcttaattttcccacagtgatttgtgagtgataagaaaatagaagaaattcagggattaattcctgaggaatttccaaggaccacgtgcatcattgctacaacggtgccttaatggctttttaatgtcaaaatgcccgacactagcgcatttctttagacaacgaaaattaattcctgaggaatttcccaaagccatgcgcagctttgttagaccgatgccgaaatggcaatataattggaaaaggacagacaacaatgcttttctttatatcagctgatggtttacaaaaatcgaaatacttcctgagtactttccaagaaccatgagaataaatatcgcactagcgccaaaatcgaacaagaacgctaatcatcagtatcatcttaattttccccccagtgatttgtgagtgataagaaaatagaagaaattcagggataaattctgaggaatttcctaggaccacgtgcatcattgctacaacggtgccttaa

SEQ ID NO: 21254 - DNA, 1341 bp, Heterodera glycines
  misc_feature (38)..(38): n is a, c, g, or t
  misc_feature (1297)..(1297): n is a, c, g, or t
cgttttcgccaacttttcgcctcttctccaattaattntggtcatcaacacggacaatgaccgcactttggagtcaattttgtgcaacatttggctaatgatcgcgaaaaacatttgtgccatgcaattgcccgatcccgaatatgcttccagccatttgcgacaatttgtcccgtcaattctcaatgattgtccatcgcttcgtgttatcaattcccattctgatggtttcatcgccgaatttccatactatgagagtgccaaggcttcgaatggacaagcgttggccaaatggctattcactcctcgtccggacaatgtgccaaaggtgttcaaatgcttgttgaagttgtggtatggggaatttaactcgagcatggaagactttaaagcggtgatttcaatttgattttatttgatatttttacggtcttttgggttcgctggcaaaaatattttgttttggacgacattcaactcgtttttggcaaaagtgtcccatattttaggcatttgccaatgcttcatctcctgtcaatttcattgttgccgtttggatttcggcgccttttgcttttcccgcacaatttgatcagaccaacgaagtgactcgggaacaactgacgtttaaaagaattggaaaatctattcgccatttacttctgatccgttgtccaattgtgcgcgacacgaacaaatgggcgaaatgggaaaaggaagcgattgactggcaattcaatgatcaatggaacagaatcgacattcaaattaataatgagcgtaagatgggtcagtgaatgcttattaaaaaatgcgaaattgttgcttttttagacgtttcacacaatgatgggcccaagtgatcaggggaagtgaatgaatgatttgctgtgaagtgatcgaacaatttgaattgcgatttggagaaatgaatttgagcccatttgacgtatatataatattgttctttttgttgcgatgatcaacttttatttgtgtatgcatttaggacaaatttagtgattttctgaaagtgacattgattttaaatgatgattttagaggtccggcatgtgatttcaaaatttttcacttcccatcatccgattgagctgaaatttttatgtaccaagctacttttttaaggggaaaaacaacgcacacaaaaattacaaaaaatcgaccttggcaaaaaatttttacaaatttttttttgaaaaatcgggtattccaaaattatagacgcattaaaaatttcagcaatgatttttttttgaatagatcttacgaaattctngtgcctttatgctgcctaattaatctttttatttttcacttttt

SEQ ID NO: 21255 - DNA, 1538 bp, Heterodera glycines
  misc_feature (1180)..(1180): n is a, c, g, or t
tttggcagcgaagttccacatgcaataccatttgtagtccattcgtttgcaaattttctataaaagaaaacatcaaaagtagaattgtacacaatgtttaccatagcagacttcaatgagaacacaaaaatcctggggcatttcctcgaacacgatcagctccttgaacttcactttgttgttgcgcaattcgcccacgtcgagcacatttgcaatcttaatccgattgcatttaaatgaaaatattcaaaattgtttcggagttttacttgcgtagcataaattgtgttctcatgacgacaaagaacgacgaacgcaaaagaagagtctgagaaatcagaattatgttgtaaaatgtcaatgttcttctcgtaaaacctttgtcaattttcttcaaactgaacgacgggttcagcgcgtaacggcaagcgatccgggagagtggcagcagcagacgagaaaagcatcggagaaggaaacgaagtcgccaacggagaactgacaattccaaactgtctgtagtgagacgtggccaaactgagtcgacgcggcccggtactagtgcagtttgagtccgccttttgggtcaaattttttcaaaattttttttttcttttttattgtcgcaattgttttttagattaatggaaaagcttaaaaatttcactgttgtcgatttatgcaaagtattggctctaccagacaaagaattcgaagaattggcagtcacagatcacttttttccacatacatttctgattttttgtggcgtaagcaatttggaggaccggacattttttataatttgtggacccaaatcgcggaattgtacccaataatcacataaatcttcttttatttgttatttaaagcaattgcgacaataaaaaagaaaaaaaaaatttgaaaaaatttgacccaaaagggggacccaaactgtactagttccaaatattgattaaaaaaatgaaattatgagaagggctcgaaaaaatatggaaataaagtcgcaaaatatggaaataaaatatggaccaaaaatcgcgaaatatggacataaatttttccaaattgagagtttaaattctcaaaatttattcaaatttgttaaatgtaaagtaagtaatactttcaaaataatagaagaaaaatacacgataaggctaaattatttaatctntagcaaaaaacaatccgaaaattgaaattttaacttttttttttttgcttatttttgacataaaatttatcaatttttaagaaaatttaaatttattcactattgtcaagaaaattttgcgaaaaactgatttttgggaaaaataccaaaagtagacaaatacggaaataaattgcgaaatatgaaaaattatggatatatagaaatgcatcctagaagcttcaaatcaggctaaaaacatgtttttcgtacgtttcaggcctcccagagcccaggaaaataatgtggatttccatatccataattccgaggccctacttcttaggactggttcatattgcagtactggttcgccaaa

SEQ ID NO: 21256 - DNA, 2663 bp, Heterodera glycines
ttcaattaatttttgccatgtttttttgtttttttctttattttgaacaatttttcactgtaacaatttcagtacacaaacattgtcgggccgctatttgagcagatcattgaccaacacattgaggtgacggcattcatttcttttaaaaatgacattccccctaatttgtcttcccttttttctgtagtttctgatctcgcgcattctcgccaatcctgcgcttcaacacgtgtgcaactccttcttcaaacatccgacaacaacgacacccatgggcaatgcactcgtcaaatttttgctcaacaaattgtcggaattgggcggaggtgatttttttttgattttctatgaacatgtaaacagaaatgggtgcaccccaaagtctcgccgatacaaaatctcgccgtcgaaataacttataagaaattttccaggaaaaaattcttacaaaaattttctaggattttttgttttgaaattttcttataaaaattttacttcatgatagatttgtaagtttgaaaattaaaaaaaaaaaattcgggccgtgagattttgttccgttcctacaaaaaaatcttttttttttcactcaaaaattcacaaccccccccccctaaactcataaaaatgaacaatttttcgtttgttaagccaactctgagaaggcgtctctccacctcatgctgttcaaactcatcttccaaactgtttccttttcgcagaacagctcggagtccgaaaatttgttaaaagtgctgtgggcatatgatggacgggtggcatttgccaaaaccgaaatccaaaaatattgtaatttttcagccttttttgcaccgaattgtgcaagattccatgcaacttgcgagcacttcgcgcgagtgcaccaattactttttgctgttacgggcgcttttccgctccatcggcaccggcacgcatgacctgctctaccaacagttcctcccgttgttgccgtcaattttgcagcaattggtatttttttttgttttcaaattaaatacaaaaactctcaaataaaccaacaatttgaattatagcgtgtcattttgccaccaaaattcatccattttccagaaccgtctccaaaacggtgcccatcgtcagtccgtccatgaactgttcgtcgagctgtgtctgaccatccctgtccgtctgtcctctctgttgccctatttgtctcttctgatggatccgctcgtctgcgcgttgaacggctcgccggcattggttcagcagggattgcgaacattggagctttgtgtggtcatattttcacattacatattttcattcaaataaacccgattatttatttttaggacaatttgcagccggaataccgtaagattttaagttatacaataaaaaacgtttaatattggaaaatatccgagccttcgactatttcgattctggatacgtccccgcctttggggtcttccttgaactgatgatcaccgataatttaaaaaaaaattttcggggggaaatgacggggggagggaatggagtgcaccctattttttaaattcattcactcattcgtcagtgtacgaccacatgatgccggtccgtgccgcactgatgagcggtctttggcgcacagtttatgcgtcggacacacagtcggcggtggctgccctgcgcattttgggcaaattcggcggttctaaccgtaaggcgttgttggacccgcagacgtggaccagtagcaccgattgctgcagcacaacagttgtcgtcgcctcggctgcccaccgctttggggagacatcgacggcggcgcctttgcttaagtttgaatggtggtcgctacggcagcacattggcgagcaggaacagcaacagttttttccttctcctgttgagagcggcggcgatgctgcaccaccgacaccgcagacagtgggtggtgggatggcaccgatggaagacacagtcggacgaacggcacaccagcaacagcagcgccgctttgtctgcacattgccgcttcgtgaagcagtgcggagtgcggtctccattctaaggtgttcatgggtactaaccagttttacgatggactaggcggaaacattcgaatccaaggattcgccttggctttgagttaggccaactctataggaattttgccagttccccttttttggttctttcagctttgtcttgaagagcattacttattgttagccattcaactgtataccatttttacagaagccaacctgtcactgatgccactcaaattgtcactccaatggccggcactgggccaaattcgttatcatctccttctgccacccagacaaatgccaatttaccattgaaaattcaagcggtggaattgatccgaaatatgctattggtggccattaaaagtgtcgacattccgccatctttgatcaaaaaggcactttccgactctgtaaaagtggtgcaatcaacaacaacagcagcaccatcggatggtgccgtcgatgaacatcatcgtgccatttcatccccttcctcttttgtatgtgccgacaaaatttctcgcgacattttcgtcgaggcaatcagcggacttttcatcgccgtgttcaactccgacacaaagaacaaattttgccgttttttaagatgttcactaagca

SEQ ID NO: 21257 - DNA, 1027 bp, Heterodera glycines
  misc_feature (502)..(502): n is a, c, g, or t
  misc_feature (997)..(997): n is a, c, g, or t
tacaggcgtcacgtcctccgcttcatgcccgttgagtccgtccatgcccgggatgccctccgggcccggtttgcccggcgctcccggcggcccctgagggcccggcggacatgtatttgcctcaccagtagaacaacctgtacaacaacaaatttaccttttggaactcgggaagaaaactcccaaaaactcactgcatccatcgccttggtgcaaggcatttgactgcaaagacggcggaacgcccggtgattggaagtcgaagggcgtaccaggggcatggcctttaggagggagttaaatttaaagcaggaacaactactcttggtctcgagtgcttctcgagcattgttaaaaagaagggagtgccgaatggtttcgtcttacaaaatcgagagcagcgccgcaaaattcggctgaattttgatttagcatcactaattaactcacccccaactaattgtgagtcgtgcggtccgcttccgtcctggacctcagtctnttgtcggcggtgacctgcgcttcgtctccgcgcggcgttcgctgtggcgcggctcatccgccgctttggttggtttagtgcgattaggcgagcccataattggtcagtttgggcacgaaaggtgtcaatttcgaggtcgaattgttgccaaatttgttgcacgtcgttgtggatggaagcgatcagtgccaacgcaacgagcagagaaatgccggcgaaagatgaagcgattaatggcaacacgtgcactttcatcgaattcaaactacaagcaataattgactggcaaacgatgtttatgcggggaaaaaaaacgatgtaatgtcaaaattttggagaattttcttgtgcacaatttactgtgagctaccgaagcataagcttcggtccaagagataagagccagtcccgcttaacgtatttttgaagcgaagaatttccgaagtttatggagatcagctctaatccttcgctttctataaggagggggcacangattgctgacaaaaaattaaaaaatcggag

SEQ ID NO: 21258 - DNA, 1356 bp, Heterodera glycines
tgacaaaaaattaaaaaatcggagtagttttttcccgtttttccgttctttgaatgggcggcgccatccaaaaaaaagttttgttttttaaccaataaacagaaaaagcacgcaaattgtgacgaaagctgccggcggggagataaatgagacaatgttttgtgacggtgcctttgcctttcgccactctctctctctttctctttctctctgtcttctcaatctcgggtttctccttaattgtcttttttatctccggaaaagtgtgatccaatcagttgggaagggatcaacagcagaaacagaggagcaagcaaaaagcgagtttcgggagtcaaaaagcggcgaatggaaatggaaaaccaaagcggaacaacggcacgggctaatgggcgggcgaatgaatgaattaaaaagcgagagagaattgacgcaaattgggcgaagatgggggcagttaaaaacaaaattgtgaaaaaataattggtaaagcataaaaaaacctaaactcaaagcaaaacaaaatagacaatgataaagcaagagatttaaagctttgtcaaattattcaacagagaaacagcaattcattaattaattaatgacagtaaattaaatgaaaatcatagaatagcacggtactgttaacaaggtgtgagagtaattattaagtcggccaagttgggacggatttttcattttctatataatttttcatatgtaaaaatattttcctataaattgagccacaaattgaaacatttggtttttttagaaagaaattttatgaaaaaggatacacttcatcatatttttgatataaaatgatagcttttcactgttttttttcaaataggaattttgatgagagattttgtcaaaaattaaatcccctcattttgaccacttttcaacacaatatgtaagttcacccgtgttgcgacttttgcgccgctcagcaaaatcgtcacttgcgccgcgatatttgcgccgcggacatttgcgccccgacacttgcgccgaccagcaaaaatggatatttgcgccgctcacttaaaaatatattttaaaatatttttgccaattttcaacgaattttactcaaattactgtgcaacaacaaaaaagcaattaaaagaaatgcaaaaaaataataataatcacaacgatagacacctattttatgtttttgttaatgcgtacattagcagcaaaggcaaatttgataccaaggaaaacaaaaataataagtcacatttatatatacaaattttagtttaaaaaactttttggatcacttagaacggtgcacatggattttgtagggcggcgcaagtgtctgcggcgcaaaagtcg

SEQ ID NO: 21259 - DNA, 949 bp, Heterodera glycines
ttgcctttgcttttccgcactttttgcgcctgcagggccatttaattccagcagaaattgcgagttgctcttcattctccgtgccattccttctcctccttcttcggtttgctctttttccaattttcgcaattttttgtcgcggcatttggcacaaaaaaggtaccaaacctaaagatggacaattatgaatttgtgctttttgagtttatctcggcttttagcataatcgttttgcgcttcccaccgccgctccttcgccgccttcgccgcattttccgctccatccgaccgtccaatgccccgccgaattgtacccgcaattccccgcgtcttcgccgcatccctcgtgctcagtccgcatgtgtttcccaaatggtgcggtgacgcatttccccccgcaaagttcgcatggcaaaagttccgtcgatgggtccgttgggtgcgtcgtcccatctttggtaacgaatgcggcttcttcgaaactcggcgatttttgtgccaaaatttcgtcagaaattttgtcgctaagctttcgccaagcattcgctgctgaacgaagtgccggaggcatttgtgccgcatttccatgcccttcggcggtgtcccaacggaacggcactcgcgtaccaatgtccgtaaggatttttgccgcttttatcaattcttcagcggtacatccgttgtcattctccgaactgtgccacaccgaagcgacgaaaacccaacggaaagcttcgaacagtcgcggaccaatggccctttttgccttccgaaattttggcgagtccaaaatggaaatggtcgcgggcgatgggcaaagtttggcggacgattggcgaagggacggcggaggggcgacggaaatgccattggaggaggacggacacagctgaagcagttcagtgccgaggtgtgcgttatgatgaagcacccaagccttaaggga

SEQ ID NO: 21260 - DNA, 1127 bp, Heterodera glycines
tgtgagcagttcgtgcagcgatttgttgtccatttggtcgcagtgactgtccgagccgaacaatgcgcggcacgaattggacaaacaccaaacgaaaagccgctccaaagtcaaattggaagttccctttgaattccgagcggaaattggctcgacggtgcagcgaaagccgaaggcattctgaggattggtggagaacaatcagacaatcagagaaatggccgaacgatcagactttcccccccccctcaaaaagtgccttttccgccgctttgtcgtcgttttccatttgccgttgcgctgactcaaaaatcagccaaaggcaattgccgggaatcagcaattggccccgaggccaatttcgtccgtggtaatttgccactggcaccattttcctgccgttgcctccactgacgtaaacccaaacgatgtccgtcgattgcgccgtttggcactgcgagtcgaaacggacgcacaaaaagtcgcaatttggcacctcgaatttgtgaacggagaattggccaggagagtaaggatgaagtgattcgacagtaatggcggcggaagggaggcaaaaggaagaaggaacgaaaagtgacgaagaaacggacggagaagagggggagggcgagcaacgggcggaagaggggcccaatttggcattggacggagagcgcggcttgggagaagcggacgagctggagctttgcatcctattcatatgcatatggccgccggaagaagcgatgacaaaattggcatttgtcgtgccgttttgcgccacctctgccgcgtttaaatgggccaaaattgaaacgccctaaaagaagaatcacaaattacagaacaatcagtccgttctgtacattcagtttgctctgctctttacctcgtccaatgccgcaaccacgtcaaatgccctccagggacgcgcctccacccaaacgttggccaaccccagcaaagtcgcgcatatccgtcgttcccccgggcctagcaattccgtcgccttcgccgccgtcgtctgccgcaccattcgctgactcatccgccgcacaatttgacggagcaaatgcaggaaaagatcggcctccgcgcttttctttgtctccaccgcccttttcctc

SEQ ID NO: 21261 - DNA, 1484 bp, Heterodera glycines
cataacttttttacaaagcatcccaaatttaaaggattctttatttgtttgcgatagcgttaagagtcatctaatagccgcaaaaattgcaaaaaatttcgtggggtggggtttaacaaaggttaggatttcaaataactggtattctaaaatattttttaaccataactttttttgttgaaaatgtggggccacacttcctgaaaattgttgactcaatcgaagttcgttttgtttgttgtaatctacgcaacgcaatcgcttgggttggccatcttttctcggagagtgcaaccatttggacaatgcttggccagccgaagttgttgaatttggcccatcaaaatcatcaccaaacgcagcgggcgacaaatcataggaattgattgaagtcaattggttcagatcggtgagaattgttggtgaaatgagccgacgcaaattgtccaaatgctcagcatttgaaatggtcaaatggccaatgtttggcgcaaaaatgggccaaatttcacggacaaaaacattccaaagcggctggacagagtcgttgtcagttgaggatatgtacaaattcaatttggtgcctttgtcccaaatttgcttgttggcacggagaaatgcgacgacggaatggtcgatgtaactacaaaaatgcggttttactgttcaaaacgccaaaattttcaaaaatatacccctaagaaacggtacacctcagttgggccggcacgtttaggctccagcatgcttttcctctataatttttttgtttatcatccaaatccatcgaaagcttaacattttagatgcttttattaagctattgtttcgcgagtagacaaaaattatgcatgaaaattgcgaaaaagtcgaaatttttcttaataaaatttttttcaaggcttgaaaatctattcgctttttgtaaggctaatagagctgaagagctttcgaatgataccaagattgttggatttggatgacaaagaaaaaatagtagaaaagcatgctggggcccaaccgtgccggcccaactgagagcgactcagctaagaaatgaaaaattcatcctccaaaattaaagatattagaaattgtgtagactcaatactgattttgcttaatttgttgctttttgactaaaattttgtcattttatacccgtaaaaatgaggttttttagtgaatttggtgatttgaacgaagaaaagcgatgacggagtgatcgatgtaactgtgaaaatggaaggaaagcttttattgccataactctgatttttaattactcaatccgaaggcgcttaaaaaggattttgctgggcaacggacggtcgggcaatggaaatggcacaaatttgtcatccatccgcacagatagtttcggttctggtcctttgtccttgctaatttcgatagttctccaaattgtcaattcgcttttgccatcaaaatgtttgtccaccaacgcatgaaacgggcgaaag

SEQ ID NO: 21262 - DNA, 1435 bp, Heterodera glycines
attttattcatctccctttttgatagaaaaagcatcagagtgcctaaactagcatgtaaataaaatttggtgcgtttcagagcattttgtgaaaaaaatatttatgaattaattatgcaaaaaacaaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggtgggccttcgcccccccccccctcccacgcccttcagagcacgacaaatatttcaacaaaaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaattttggtgcgctttagagcactttctgaaaaaaaatatttatgaaacaaaaaaatcgatttttttcaagtgtccgtttggggtactcaaacatttatggggagcaaaatccaacgcagaattaaagtacaggctatagggcagcagagtgctaaaattaagttgtaaataaaatctgggcgcatcgctttagagcactgccctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcaaatttttcgagtgtctcgtttggggtgctcaaacaaatatggggagtaaaaatccaacgcagaatta

SEQ ID NO: 21263 - DNA, 2259 bp, Heterodera glycines
  misc_feature (2214)..(2214): n is a, c, g, or t
gatatttttaattgaaaccaaaaatttttaatttcaaatggaaaagaaataaatttaagataaaccattttaaaatattttaaaagaaacttactttaaaaaatatgttattaaaaagagctaataatttttttaaataattagcgacttgaattttgggccaaaaaaactaagaaagtctaggccaaaaaaactaggttgcctaaaaaactggacttggacaggaaaactgaggcctgaatccagaggtccataaggagtttaaaatgaaaattaataatgaaaaaataaattgataaaatatttaatgaccaaattaaatattggaaataaaaataaaaattaaaaaatataaattttaattattttaaattaaaattgtaaatttttaaattatttttaataaaataaatatttttcattcattccttcaccttcacattaaaatagccagcaattgtcagattcgattcacacaacaccgggtcatattctgatcggcactgaggggaattccaactgatttttaaattatttaaaattattttaatagtgtaaagcgcaatttatcacatccgtttaatctctttctcacaccatttatccccgcttttccccatctttattccgttccataagtccaactatttaatcgggagcattctctcgataaggagtcagttgagcgggcagttaatcggcgagcgagagccgagagcagaacgcggaggaattattattaatgtaattggcaaatatttatattattattttgctccttctcacccatccccgcacgcgtattagatctagtaggcgcccatgggattaccaatttagggaggtcatttatccagggcccggattttggcttattccttattcccccaaatccaatcctcaattttcctcgtcccttcctcatattttggacataattttccaaattgagtgtataaaatttcttcatatttgctaaatgtaaggttaaatatgacctcaaaaatattaatattgtcttcgtttcagggtcttactaatcagaaagatttaatcatattcgtaatattcttaaattttgaactaatatttcgtgattttcttttaaaaatatttcttttttttgtttataatttaatattttatttaaaaatatcttccatttcttttattaatatctgatgcattttcctaaacacttcattttcttggcaattctttttcttctgttgggaactgctcgaagtaaatttattgaaacactaacgcaaattaagttaatattttttaacaggtgctttggtggagaatgactgccccatttgcgataatgaaatgaaaaaagaaaatcaaagaattgtttcattgtcatgtgaagtaattttttattctactagagcatatcttgtaagtgagccgcttgggatacaaaaacccaagaaattatatcaagtcaaaatttataaaaaatattaacctgataggctcgcaaagtttaggccatgtttgaattggcatacccattttaatttaatatgcaaatatttcagcatgaatttcatcgtaactgcatgaaaaaatggtaatataatttgtttaataatagggctcaattgctacactaaccagtgtgcaacagcaacctcagaatgcttcatggtggactcaccaacaccaaactaatatgcaatccgggcaatggccgaatccatggaataatgtaaatcaacagccgtggagggcatattaccaacagcaaatgccaaacccaccatcgggggcacaaacacacccacaaaatgtgcaacatgattcacgaacaaatccagagcatgttcggatgccatggaccaatttgcagcaacaaccagcgcatgcacaacactggaatgccaatgagcatcaacaagcgccaaatgcaccatggtggtcacattatacatggcaacatgcaggccatccacagatgccatgggcatatgcaccacagcaaagcacacatacaccttggtggacaaaccctgcgcatatgtggtggcaacaagatgccaatgcaagccaagtcaatgcccacaatattcatgtggatggtaacgcaactgttgttcaagaaggaaatgatctgatcataaatgggcaacggcaccgaaatgcagccgcgaggggtgtcagtataagcactggcggacgtgttaatcatgacggtgttcaaancagggagacatcttttcagtctaaattctgggcagaatgtaaatc

SEQ ID NO: 21264 - DNA, 1451 bp, Heterodera glycines
ggggagaagtgagaagagggggggggggacaccgacgcgacaacccttagctgaaagtttctgacgatgcacgtaattctttatgccaatttttgtggaaagaaacgaagaattttgcactgccattctaaacaatcgcacaattaatgacagagtaatcagcttattgttaaaattgccgtggtttcgcttgactatttattaaattaaattaaatgaaattaaagtaaagaattccagtgattacttcggaaggtccaggccagtcacttcagcactcaaaaaaccgttggcatattgcggcagtttgacttggttggtcaaccattcgaccacttgtttgttggtccatccgcgttcctcggattggaaccaattctcccacaaatcgtccacagttatcgcctcgtcgttactgtgaaatgcattttctcgccttattttgtccgaaccgccaaatttgagatcttctttcaagaactaaagggaggcttattcatacatttaaattattggtgcgttcgtgtcatttcactagcacatacatcggcagattcaaaccgatcaattgagcccgaattgtcatcgtcgagaacggcatggatggctttgattgccaagaaaccttcaacatctctttgtttctcttcttccgctgtgattagaacatcttaaagagttaggtatagattattaattaattacaataggtaattaatgagtttaatccctaattttatttgttttgtctctgacttcttgtcggtggtttaatcgattcatcagctgaatacacaaaaaagaacgccgaaatgaaaaagactgaaaggcaaagagaaaagggtttgtggaccatcgttgaatcaaacaaattacctaaacggaactcattattttcacattcattttgctctaaattgtaatgaacttaataatttctcatccatttttccttttaatttcgctttcccttctctttttcttctgtcgcgtattatttcacctaattgttaacgggttatcaatttcatagctcacacatatgtacaaacataagcataaggtaggtaatctggttttttcgacattaaattccaacctcagtatacaatacacattaattaatttgttgccccaaagaatcttctcttcctcctccgcccccccccgccgcccctcccttttcaccccttctcagtccatgcatttattgatggggaattcatgaatgaagaaggaatgaatggatgtgaatgatgagggtggtgctgattgactgacttactcatgcactgtcttgcgatcgctctgctttggttgatcgactggttaacaggcgatgaatagaatgagcagaatgaacaatttctcttcccattcaccaatccatttctccccttttctgcccattctctcctccgttcacctatcccttccctccttcccccccc

SEQ ID NO: 21265 - DNA, 995 bp, Heterodera glycines
cccccccccccccccccccctccttctcattctcacagcgccttttcccttctcactcgctaatttcccatatgctttggtttttttacttattcggttggggaagggaggaaaatggattaaattggataccaagcagattaaatgcgaaattggatgaagcaaaagaacatggaaaattatatattttttaaattcgtcctttttattttatgtacctatttaaaaattaaaaaaactttttttttaggaaattctctctaacttggattttgagccatcgcgttgaaaagacagatgatgaaaaacgactgggacccattaaaaacgaagtcggacattaaacagcggctcaaccgtttgtctaatttttcggattttgtttaaatcattttgactcggattgacaggtctcttcgggcggttcgaccagtactcagaatttgcagccaaacctcggactcctgaccatgcattaacagagcatgtaacgacacccgtaacaaatatccctcccgtaaatgaagagcaaaatggggaaaaattgcgggaacgacgagaaatcgaagggggagcaattcaacggaagaatgatggtccacccgagaacgaatcaaggtaaaatggcatggtggcaatcaatttctgacgaagcaatgctaagggaccatttggaacacataattggccaactcgtcaatgtatcaaagcctctttcaccggttcgctttgtgtccgaaaaggcgacgacttcgtccgccgaagcggacgtatccaatggcactcactcggaagaacagcccgaatgttctgtcgcacgacttaagtaagaaattcccgaacaattgattatttctttattttttagctccgatatcgaaattcttctgcagcacataacctttgttccgccctttatttctccaatcagatctgaggacattttgccgaggaaaaaaagaccatgtcgtgaaataattgttccatttttcaac

SEQ ID NO: 21266 - DNA, 1803 bp, Heterodera glycines
  misc_feature (1769)..(1769): n is a, c, g, or t
gtgcacctcctctcattcacttctatttggtagggccaatcttcccatagtcaaagcgccaaaaaaccgcccgtccaaaattcagcaccagcagcagaaagagagcaaaagctttttgttggttcccttcggtgggccaaaatgaaattgaaggaatgaagggggattgatgaaaaaaaacagggaaagggatggattggcgaatgttttacttcccacgcggtttcatcgtgctcaaagttattcgttattacatattttgccgcattattccgtccgttccttccattgtgacgcaattgttttgttttgtttgtctcccattcccttcccatccgatcacgttgatcaatcaaatccaccaccgttttccagcgcctggaacgtatgtttatacaataatcccattaaatcggggaccaattggtcttttccatgggcccgcgtgtgtcgtaaataaatcattcccccactcattcaaagggttgtgatttatggataatatgcattatgacgacgcgaacggacggattttcctcagtccgttgattttatgtccatttttaagtggctgaaaaaaacatcgaatgttttaatccccggagggaagcggaagaaccttttcactatccctaatttcgacagatggtctagtctctttttttgtcgaattggcgtgagattttctgccgttcctaagcccttcgaatcttcttcgcccatatcttctgtttttgcctttattcataggtttattttctcaagcattttggccaatgtcattctcttttttcattttcttttctcctcccgcgccgccaaaacgaaagccgaccatccgctaaaggctaaagcatttcatgggattcgtctgttttcccttttttcaaatgaaaacctctctcgccattgatgccaaattgaacgcatggaaaatctgagcggaatttcccgtcaatttgcctaaaacattcgccaatccatccctttccctgtttttttcatcaatcccccttcatttcttcaatttcattttggcccaccgaagggaaccaacaaaaagcttttgctctctttctgctgctggtgttgaattttggacgggcggttttttggcgctttgactatgggaagattggccctaccaaatagaagtgaatgagaggaggtgcacttcaatgacaccaccccgtagtatattcattccttcagtccaacaccaatctcatctcatctctctccctctaccctttccctctttttgttttcattgttcgaacattggcacacgcttcagcagccctaccttttgtctgtgttctgctggctgcatcataaatgatgggaataatatgacttttgacagaagacagaccacatgattaccagttgtatccaaaatattcaatccaatgacaggctgtgtgatccggattttaaagttggagcagcagagagagagagaggggggggatttttgggtttctctgctgaacggcgcctactttctttctttcgtttccacccccacctcctttttgcaatttagaagataaatgttttccttccccccccccgggtgaatgtccgtctccttatcttttttctcctttgtaacactatccttttgcaaagtccttccccttcccgtgtggtcacgttgtatttgtgtgtgagaagagtgaaaagcgtcccccaaggggtagttcatcaatgaaaccaatggttccctcttaatacttatttttgagtcatttccggcattcccntatgccagcagtcatcagacataatactttatta

SEQ ID NO: 21267 - DNA, 1514 bp, Heterodera glycines
tcaataacccgctttcaaaaacaaattaaaaaatctctcaatcatcattcaattcccttttttaatacttttttctgttgttgttcattttgtctcttttatatgtctaccaattattttattgtgacattttaattgatttcgattattattaaccaatcaaattttcctatccattggatgttctttaatgtgtcaattttcctcataattccaatccttcattaaatacttttcctttattttcaacctgtaaacaaattcagtttaatttcagggattggtgcccctaacaaatattaaattatttactttttggctcccagaggagtaaggttgtgtacatattttcattcttacgcatgtctcatttttgaatcggtgtgtaaactgaatttaaaattttccagtttaatttaacagaaattctattccgccaaaatggagaaacgacgttggaaacgagcggaaagcagcgacgccagcaccacgtggggcagcagcagcagcagcacaaataacaatcggcccgccatgcgttccattctgaagagttcggaaagtgcatccgcggccgtggtgccgtcgtcttcttccactgcttgtccggcttcgctctgctggtccacgcctcgactcggcagacgcattcgccatgccaatgccaaagcgttttccccggcccagcgtcggcaacactccattgacgccaaattacccgtcacttcgtccaccacatgccgtgccgtcacatttttcctcgcctccgaaagtgattaaaaaaataaataatttaaatcaattaaatttaaaatgaaaattttgctacaaaacgaaattgaaccattcattaatttcttttttcactgataacaaaattgctttcatttgctcattactttctttctttcatcgttttacttcctcaattcaatccatttttttctctttttcttcgtttcgcgatgatcaaaaacacaaagaaagagaaatatttgggggggggggagatcaccgttaattaaattggactattagaactatttagtcggaaaaaatacaatagataaaattgaacgaacttcggcattaaacatgcaaaattcacatgttaactgttttccgttgtttcaggctccgattcatcttttgctgcggataaaaccgaagaagtcaaattgccacggcagcatcgcttttgccgacagaattcctcctcctttcgccgcacttcgctgcccgttcagtcgaacattgcgcgtcaaaatttggtcggttttttctttacattttcatttttactatttaattgaagcatttttgaaaattattcacttttcctcccattttttccttttgctgatctttttgtaatgtgttaaagtgatttctgagttggtcgcttcggttgcacagaatgggcccaccataagcaataggtatttgcaacgccgcgcattcgtcgccctttaacgacttttttccccttccgttgcttttggttttaatttatg

SEQ ID NO: 21268 - DNA, 1248 bp, Heterodera glycines
  misc_feature (51)..(51): n is a, c, g, or t
  misc_feature (1101)..(1101): n is a, c, g, or t
  misc_feature (1115)..(1115): n is a, c, g, or t
ctcaaattaccgtccaattgggatggagtgatccgacacttcaaatcccgncaaagatgatttgagaccccaaattcccatccaattgggatggggtgattggagacctcaaattcccgccatttttggaaatcccccgtcattatcgggtgaaaaattggggattacccgatgaggttcggggtctggaaaaaataaaaaacggcagcaaattccttaattaccctaattaaattttaattgcaattaaaaatgcccattctgctgcttgctgaccatcggagttggtcttgaacagccgcacgtacacctttgaggccggcaactttccgcacatcagtgtgccctccgcacgtgttgagcgcgtggaaatggactcctgcgcaccggtgtgcaagagcccaccaagcagtgcaagcagtaccagcacggggacaaggcggccgagaatgaataatccatgcattttttcttgaaatttttatttttttcggttctttttcccggaaaattcccccctccccaaggcccctccacactcctagaaatttttaagggaaaaagtattttgtgatgaaaattttcggaatccttattggtatcccattcaagacctctttcacccaaattctccaaaaaattcgttaaaatttccaaaaatccagtcgtcggagcggtacatcatccaagccgaattattaaaaaatcatccaagtttttaaaaaaatataaaattcgaaaaattttaagaaatttagaaaacaaaaaaaaaattaaattaaattttgccaatttcccatggccctcccaaattcaaagtgcagcatatcgatcagaagaaaacaagaaaattgttattatttattatgttattttgtacatatgtattgtataaaacgaacagataagagataaggaaggattggtgaagaataaatggccaaattgtgtaaaattttatcaattatcaacgccactttttgctgtcagccgaccccataaaataataataataataataattattattattatttaattggtctacggtttatgatagatgaaagaccacggggccaattaaccgagccgatttttgtncaaaaaacccatcnaaacaacaacaaaaaattgatgaggcagctaatttctgttggctgcccctttatcgataaacaatgaacaacaacaaatacacactatcaaatttaatttggggccactcgagagtcttgaggtggggggggg

SEQ ID NO: 21269 - DNA, 1236 bp, Heterodera glycines
tttttaaaatttacattttttttttaaaatgtgtgggataaataaaatatattgtacccgattttcataaaatttaggccttccatattcatcataaaatggaattacgacttttatttgcttccctatttgccctctgggcagtgacagcggcgatgcgcaagcaggggtcagaaaattttgaaaaattcaaaaaaaaaaaacgatttttttttcatagggttgccatcagcggaaaattcgtgtgcggccacgcgccggccatgagcaattcgaccaaagttcgcattgtcgacattgacacaggtcgaggaatgcgatacgaaaaaattttataccaaaaaaggaaaaaaatatccctaaaaatctttttgtttatattatagggaatgcttatcatgccccccccccgacgaaattttttttagaaatttcaaacagaaattttcaaaaaattgtagacttttttaagaaaacaaacgctagaaaattttttaaatttttctcttaaattttcttataaataaatttttattaaaaaatttctatgtttgaaaaagctttttatatgggcccaaaatttggattgtctcttctccttcttcaggaatttggttacatttagggcccgacccggacgacactttggacgaaaagtttgtggacgctgccggtgcatttaagtgagtaattaatgcgccgctatttggaataccgtagtatttgtctcaaactacaaaattcccccacccatacgggagccatactgtaggaccaatagttacagtacccctatgggtgaaaaaaaatgcatttttttgcagactcaatgggtacacacgggaactcactgacattgatccggtgctgtacgtgtggacagactgtaacgacgggcatacggtagggtgcggaaagtacaaaagaaaactgtcgttcttaaaaagccgtatttttcggtaattaatttccccggattgtaccgtatacagattagtgatttgctacagcattctaccgtaatctttctttaattttagccatgccatcggaaaatcaaatttttgatcccaaaaacaaaggtattgttttaggaaattttaattgattattctgatcactatgtaatcagatcattggtgaagacccgaaagccaatgattggcttgacatcggagtggtcaatctccagtcagggagtgaagtaatttttgctgggattaacggtaattagtg

SEQ ID NO: 21270 - DNA, 3406 bp, Heterodera glycines
  misc_feature (1649)..(1649): n is a, c, g, or t
ttttttcttgccaaatgaggcttttgaaaattttcatataccagccctgctaatagaaaacatacggggctaccgagtgataccaagattgttgagtttggttaacaatgaaaaaagttatagtccaaaaactcggaccacgcgaaaacaatcccgacccgtcaccttgcctttcccctttccactcaccttcccatccaatgcatgaattttgcgcgtttgttggccgtccaacgcctggcagaagaacagcaggacgggcaaaatgcaaatcattttgtcacaaatgactgtaagaaagggataaaatgtaagcatgtcataaataaactttttttttctcaaaactggccacaaatgtggtgctgagccattataaaaagccatcaaagcgggcgataaatgaaaaattcaacaaaaatcacctacccataacttagcttaaacccgacttaaattttaattattattattagcattcgggattcgatagccctaacatttcttattagcctgcaaaatttcaaaaatttttgcatagttcgaacaaagttaggccaaaaattctcatgaaatcaggttttcaaaaatttatggccatagcttttttgaaacttaatgaaattttttgaaattttgcaggctaatatagaaatgttagggctatcgaatgctaataagaattaaaatttaatttggatttaagcaaagttatgggtaatttttgttgaaaatttttcatttttttgtaatgccttttttagatgcattttttataatgacattgcacagcaaatgagagtaaaaatccaatgactttcacaatcactgctactgattcccaacaccggcgtttttgcttttattagcatttttcactgaaagccgtacccccccccccccccctctcccgccatttgtcaccaattgtgagaccaccaactctctattagaaaatattcactttactttattcattccatttcatcgaatttccccttcctatttggcttattgggagggggagatgagaataaaatatgaatgataaaatgatgaacgaagtgtaaaaccgacgggttatttttttaaattgtcctgtctgaaaatgggtgctcaaaagtgccaagattcagcacccactttgtacaacattgttctgaaaggacctaataaaatgaaattgatgttttcatgggcaaaccaaacccggagaatccgaatatcgcctcagatttagtcagttgctgttctatgaccctgtactgcttcaacttcttgtcaacgacatggagcagtacaatgccagagaaaattcagagatcaaatctgaggccagatttggattctccggacatgatttggccacaaaaactgcttttaataaatttccaactgatcaaagcaaagttttgacccgtacaataaaagtgatcggatttgggatttagggtgctccattgggataattttaaaaaatcaatttgaatggggaagaacgaaaaatggcttttaaccgaagcaaaaatttctgctctttcctataggacagaaattgatcggctgtcacttgcggttaacggtgcaaaaaattccgattagcatagcataagaagggtgacagaacttatacaacacccccaatatanttttcacataatcaccaactgaagtgctgattttgtagagcgttgaaatcttcttcagcggtgtgtatcgttggaattgcgctgcgtgcgaaggcgtttggtttttataggaaaaaatgctgtgagcctacaaaaaataaaatttaagcttttccttcagccaaaaaacgaaaaagggtccaaaacgggtataacagaaaaccgggggtactgataaatagggcgaggattcttaggtttttacttattttttctgcggctttaactcgacgagaaatgcacgaaaacacattttttgttcggaaattcttcgttttaacgcccatatccgaccctagaaattcctattttggagctttgccactaaaatacctattttgagtgttcgcccctaaaataagtttttatccctatttgggcgtttcgcccctattttcgcccttatttcgcgatttttaaattttttcacataaaattcacaaattttctaacaaaaatgcactgaaaaatatacatttttttgacgcgattacaggcgacttgttcaaaaaattttccactaaatatgtttttttcttgaccaaaatttttgtaatttattttcttttttgacaaattttgattcttgaatatttattttggaaaaatgtattcaaaatttttttccctatttaagtccatatttggactttttcgccactaaaaaaccgcgccctatttattaattaccggttccataattagaaaagtgccgttagcattctccgacaaagttgcatgcatttgcataattggataacaagtcaaagacggaatggccaacatgaccattatcagaagccaaaacaatttattccaaaactgaaaaatgatcggttattttcagggctcccagactgaggttttatcctcagtttgtggttttttgataggtcaattaggatttttgtgcctttttgagaacttttgaggatttttgaggcttttggggaaaatcgtcagaatctgttaaattttatgattcatcttcttaaatcggctcaaatcgcaatttagccatttttgtggacaaatcggttaacaaatgaacaatttgaaaaatttttgtaaaaatgaggcttttttgcctgccaaatgaggcttttgaaaattttaatctggcaaccctggttatttttaatatttcaaaatggagttatagacttttgaatttttaattagttttggctcattaaaaattgcctttttatgactcagcggaaaagcaattgccgtgaagcgatttaaaagcatgaaaagggtagcgatgttcgtcacttggtaggtgaaggtggtcaagaaatagaacagtgccaacgcccaattgggcaacgcgcggtaaatgggcaaaagtgaggggccgagcagagacggtagtcgattaccgtagcaggaggcggccatcattagaatgtcctgttgatttatttaaacgatttaaaaatgctaattagtagatatgggcacttacggaaatgccacgcacacagaacaaacggtaaaaggaatttgcgcgagtttctttgtttttcacaattgcaaacatttcgccaatgtacaaaaggatcgaaggaacggacaaaataatggaaaaacagtagaattttgtagcatttgaaatgatccaattcgaaaaattgtccattttgtcgagtttgatattttttttaaatggttaaattcaaaaaaagatttatattattttattgaatgctttt

SEQ ID NO: 21271 - DNA, 1839 bp, Heterodera glycines
ttcattatttacatttattaacctttattaccaaaaacgtttcgtttactttatcttggttgaacacgctgaatatgtgtatacgcgtttaagtttttgtaaaacaaatgttatttaaattttttaataaaatttgccaaatttttaaaattttatttctttcaattttatttaatttatttttttcttaaagaaatatttttaatttattgtgacttcattattaaggattgcttaaatttttttaataatcatcaagttttataatccagtcttttaaaagtaaccatttcgcatgagtaaactttatttatccatgcctatgctagcaatgactcttatggtgaaatagtaaatttatatgtctgaataaatacttaagaatttgttatatttgtttttgtaaaatattttactttactcttgcgtgggttgatttatcgataagctgtatttttttcgcgacctgatatttttttgggtgcgtatttcctctattttgcatttattattaattgtcaatttataaattattttatttgaattatttttttctttatattcatttttttaaataaattgtttttttttaaaaatgtgtatagttatttgctatcaaaaagtctatttaaatttgatattttaaatgtgatttaaactttattatattgttttattttattttcaaaatatctaaaaataaagttttattttatttcaaccaaacatattataatcttcacacttggctcgaaaaatggtcgtggtcgtgccttttactgcttccagtccgcggtcactgtccttcctcttggaagtgaagcaggtggagactttcgtgccacagatgacgcaagtctcctcatgggcaaagaaatatttttatctttatatcttagggtattttaaaaaattatttttgcttttatttttatcaaaattgttttgacttaaaagaaaactatttttttgaatatatttattattgtcatgtgaaaaattgtttgttgagttcgaagaggtgcgtgagatagatatttcattatcatttaatatttatgttaattatggtttgaaaaaacagcactttttcttttcgcagtatttgtctatctaggtatattatctctgaaataaattttcaaaaattgacggaaattttaaaaataagttgttttatacgttgttggcaaaatgcacattgttaataattaaataacaacgtgaaggttgttcgcccgaataaactaataaataagttgttttgcctttctctacttttgagtagtgaacagttaaataaaattaaaaaattttgggtttcatgggtgatctgatcatgttggtgtagagtttttgatacgcttcgaaatttaggcttgtgtgaatttttctgatttttggggcgaacattttttcgatattatgaatttttgaacatgaaatatgtatcattttatgtctcttataaattcgatctcaaaatttgggaatagtacagaagaaaatgaattttacactgtttttttaccgctctcttttgttaaaattacacttttcgcgaacgcgtcacagccctggaagataacattattgtatgcaaaatttgaagtgaatataacgtgtagaaaaaatagtaaacgtcacgaagtaaattcagtttttctctattagcagataaagaaaaaataggtttttctctgcgctctctgtttattggctgatctctcattttctcggatagtgcttcaatgattgtcagtgcttgcctggggccatttccgctgatcaacattaaaagggataaaaatcggcattttatttgtgggtatttctcgt

SEQ ID NO: 21272 - DNA, 2202 bp, Heterodera glycines
agagaggcaaacattcaaatgtttgtaattttctctcctttgaactttgacctcaaatattgattttccccattaattcatgcccttcccttcgtccatcccacagtcattctggtattttccttcctatttttggtgctccccactttgctccgtccctccgacaaatattttttgtattattttttccatttgtgttaaataaatattttggtgttcgacattcacaaataattgtttgagcaattaaccggctcaacaaataattcataaattagtaaaaaaattaaataaatgtgttatttattataaattgatgtatttaaaatcatttcttttttcaatcggctatttttgtcaaaatgatgcatgccttttggcattcgtaccgcagcctatcccccaataattagacgattagagtggaataataatagcctttattctatccgtacaaaaatattagatgaaccgcttcgagggatcgagaatagccaatttctcctcctgaaagaaaaaagaaaacttgttctggagggcagaaaaatagtttaagtgggcagagcaaacggaaaatgacgtcttaaggcatactgtacgaacgaagggtcgacggtacacattaaaataataaggatacgttacaaagttttttagtttctcattcaatggaaaaatttaaaaattttgctaagttttgctaatatttatttttaaacaaattaattttaatatcgaaaccaacttaatgtttatgtaaaaaaaattgcttaattaatttttattaataaatattaataaaagacaaaacgaatttgatgatctcagagttttaaaaagccatgaaaaaacaattaatgattaaattaaaatttctcaatttttattgtttttgccatgcttttttcagtgtggcaaagtgttcctccgtttttgatatatcagagcgttagaggtggtttattacatatttttacatagccacacaaaatgttcaaggtacttagaacccgtcttcgcactaatccagagtctgttcttattgatttcgagctcggttttttatttttgaacttttgaatttattgaaataataaggagccagaagcgcatttaaacatgtttggcctcaaattcaaattaggatgtgcttatttcacttatctcaatcggtattacgttatgtgcaggtaaaatgtctgtttttactcctattattttacttcagagacatggtcttatccgtgaatatgaagctaatgaagaacttagaacttaaattaaattattcaacagacggagtaattaattgaaaattattctttaaatatttaattgatgggcaacttgtgcagcagggatgttgcaaaagggaaaataaaatacaagacacgagatacgagaaaaaattctattttgttaagagattttgtccataaaatgattgcttttctggttttggattaaattttaaaaattttagggttttgggtcaggttgtttcggaaatcttgtaaaaatttattaaaagatttggcataaaattggattttttggctatatttaaaaaatgaaaatattttattgtttttatttttgttaataaattttaaaataattttaaaaataaaatgaataagaaaataatattattgtgtgtgggactagaaccaggcagaaatcaatgggaggctggaagtttagacactagactaaattttccttttttattttggatttaaaagaatagatcaaattattttttttcttaatttttccaaaaaatattttttcttaacccacccccattcttaccagtgcataaaaatctcgtgtctcgtgccaaaattcgagatacgagacacgaatacgagacggtctaaaatcatccctgttgtgcagtgagatgattctacaatactttatgattcttttgcgactcataaacgatatcatcatatttcttatttgctcaattagcttttaatgcattattgcatattttaattttcttaatccattaatagattgattagatttatttaatactgcttgggcttaatttgccctacacttcatgagattattttctcataagtcaaaaagctttttgtttatttttgtagttaatataatttaaaattattattttccatatccggtgggtttctcataaaaaagttggccttgtagagggtggat

SEQ ID NO: 21273 - DNA, 1992 bp, Heterodera glycines
aagcgcattaaacaaattgaaatttatgtggaaaacctactacatcatcgagaaattacccgtctcaagccaaaagctatatgctctcatttatattcaccgcgcaaaaagaagtggcactttttatggcacagaatgaaaatggaggggaaaaaatgccgacggacaaacaaattgacgacgggacggcacttaagacaatgcacgaacaaattgtttggaagttgctgaacaacaaagcattcagggacaagctgaaaagtgcgtatggcacaaagagtaccctggaaaatccaaaaagtcggagtttgggattaggatccaaataaatggagcgcgagatccgagattaagaatggaacggggtacgggactcaaaaatggctcagcccctggctaaactcctgttatcggtttgtgcccgccaaagaactgccgtgaacccggcccaggacaggaattaaaaaattattttcactaaaacagaaatacatattttaacggatttaaagcgaaggaaatcaactatttattttatcgttttatttattattagcacaaaatttcgatctgatctcattaaccagccttttttaatttcttaatgatttaaattttaattaaaaaaaatttcatcgaattcataagattaaaacgaatgtattaccaaaaacacataaataatataatgaaattgctaaagtttgtgctcatgtaactttagcatttttcctaaaatttaagaaattgaaataaacaaaaaacgaatgtccgatttaattggcgatggcactgaaattggcaataatttgttaagtgaaagtcacaaaaggaaatttgagccgaaagggaaggaaataattaaaatgggaaaccaaaaagaaacgcaaaaaggtaataattgaattaattaaattatttaaaaaatttatttatttttcatttgttagcagcaaaaggaaacggacagaaacagaacgaaacaccaaaaagtgacgaacaaagtaaaaaaaaaagctaaacgattattgaattattaatagggctgccaaaaatatgtacaaaaagcggtcacataaataaataagaaaaataccaaatatgtaagacatatgtataaaactcaaaatatgtaccaaatatgtaaagaaattttgttatttttttgaaaaaaattcttcgtaaaaggtaaaataggcacaaaatgccataaaatgacctaaatagacttagaatcacattttattatttttaaaattattggatatttctttttttttgaaaaatccgttattttagggatatattttcaaaaaaaaatgttagctatttcacgagaaatttctatatattcttaaaaattcccaaatatgtacaaaaaaatgtaaatatataaaaaatagcgaaatttaggttttttggcgcatttcataaaattttcataaaaaatcctcaaaaatgtataaaaagtccaaaagatgtaaaatattgaaaatccctaaatatgtaaatgtataaaaacttcggaatacaaaatgtttttccgaatttagaccatgtagaattcaggaaaaaatatgtatttacataaaattggcagccctaattattaaatagtaatttaacaagacttaaaattaataatatgaatttataatttaattgttgttatcaaacattgggttacttactgtatgttgcatacggtattttgccatttttagtttttgtgccattgttcgctgatagtagtgacctgtataattttgcttatatttacaaacaagtgttaataaatcatatcaatgattcggccatcaaagagtttaatgtccacgtcactcatttccgatacaaagacacattacatgcattaatttggaaaatttttacgatggaaacggcacaaaatgagaaattggaacgaattcgcacattaattttggacatcgctcaaattgaaaattttggtgaaaaattggcaaatacttt

SEQ ID NO: 21274 - DNA, 1513 bp, Heterodera glycines
ctttcgcatgcgcttccctttttccctctgctcaattctttgtatttttcccaaaggcaaaattcgtaggaagacgaagcgggctccaactgagcatcggccaagtcattgtggacaatctgacaatggacaaacggaagtgttcaaagtgagtttgctttgccttaagcgtctcagtgatttgaatggaattgcgcgagtcgcgctccattagcatgtgagcggcgccgaccaacggcactttggtggcacacttttgcgtgtcggcggcggaacgcagaaaaacctgcgaatacgaaattgacgcgtaattttgaaggaaaaaaacgattgaccagcgccaacgcgggcgcaccgaagccttgagaatgaacatcgtcatggaaggacgaattgaaatggatgtgaatgtcgtagtcggacacttctgtcggggaagaccgaattgtgggatttcatcaacagcaaatcccatcgaaacattggccaattccgttcatttggctaattccaattcaaattcccggcacaaatcccatcgaactaattccgtattcgaacccaccccggcccaacccaaccaatgcctccaatcgaccgaccgtcaaaattgtcgtcgccctccgcttcggccttcgcttcttccctccaccgattcatttccgcttcgtttccacttccaatagcacttttattccccgctgttatcattttcttcgactttcgtttgggccgtgcctccacacaaaaaccctttgaattttgcaccaatttcaaatgtaaattcaaaaaatgaaataaaatttggcaacatttaaaaggacaaaggtttcacttgggacgtccatttgcagcgcaattcgcattggtattcgaatgctttgatgtgataagagcagcttaacgggggacaattgcgaagaatggcaccggacaaacggacattggcacgacatttcgcattcgttcgtcctcactcaaatcgacggagcccagctgaaacaccgacgaaaagcacaaatcgaacagagggaggggacgtgcccttttgagggaaagcgaacggtgccaaaggaaggcaaaagcatcgccaacccattcagctgatggcacaaatacacaaaaggcagtgccattcgctcgaggcgatatttgcgcgtcgacgtttgaatttggctgcgcaaatattggacgagcaaataaccgagttgggcattcatcgcggcaaaacttggacagacttttacaacggcattagcaaaaggcacgggccaacctcgagaagaacacgcaaattgccgcgactctgagaaaatggacaaaaattcataaagggtgggcaaataatcaccgaattgcccccgggacggccgaattcaaaaggcgaaagccgggcaaatcggtgaacacgcagaagcggtcccagagaaaacggagtcggcggagcatttacgagaaacaaagacaagaagaatagggattcctcacacccgactttttagccgttcgctcc

SEQ ID NO: 21275 - DNA, 597 bp, Heterodera glycines
tggtaatgcatgagaaactgtcttcacattaaaagttgttgaacataggcatttaatcgttgtcatttctggttgggatgttgctgctgtgtcgcagcagacgacgcatttcccagcccatcggacgatggcgccgaagcgatcaaagcggcagctgaaggggaaaaggcgaaatggtagatgatgtacagtatgggcaacataccgtaatgctgcagagcattcagatcaaaattggacgctgccgccgccgccaacatccccgggggcaactgaaagacacagacaattgccaagtgaaaaacaaacaaatccaaccccttgggggacaaacggaggcaaaagggatgcattgggttgttgtgctgcggttactgcttgctgctgttggtttgtggtaacggcgccactctgtccagcacttgcgctgttattcctacgaaatgctgccatttggtgctgctgttgttgttgcgctgctgccaaaatgttcgacgcagcggcgcttcccggaggaatgccaaattgggcaccggcaccaacaattaacgaagagaaaggcgggaagaatgggtgatggaggggaggggcggggag

SEQ ID NO: 21276 - DNA, 1575 bp, Heterodera glycines
  misc_feature (729)..(729): n is a, c, g, or t
ctttgaacttggcacttttgtgccatttatgcttgttgcttgttggcattgtttgtgcagtgtacaaaggtgccgacatcagttttgtcacacagcaggaaaaggatggtcaaccctttctcgacagtagcggcaaaaaactgatctgtttgcgttgatgaagtcatacggcatgaacgccgtccgactgcgcgtttgggtaagacaagagatgaaaaaacaggaaggataataaatggcatgatgagtccaatgttaaaggatatatgaatttaaggcaaagcacagccaccttttttaaggacattaaggacagaaaaaacataatcagtgaattaaatctattctgaaaaaagagtgatgagtgcaggcagatccaaagctcaggcagggttgggtagaaaatcaacattaaaagctctgttttttttaaatttcgacatagggaaactgattgtaaccacggcctgtcaatagaggatgtcgagacttgagattgagagttgaacccaagactcgagacggagaattggatgaacttaagaatcgaaaccttgaattgaatctgaaattctagaccgagaaatgaactcgaaacctagaaatgaaccagagaccgacaaatagaaagcaaaataaattgtaaaaataactgatttgaagcaattttgcaaaatgttctgatttttgaccccaaaatctgattttttgagcccgatgttctgattntgaaaattttcgaacgcacccctggtttatggtaaggtccgaaacacacagttaaaaaaattaaaaattttttatctcaagatccgtactgatatggtcgctctcttttgttaaatttgcacttttcgcaaaacgtttttttccgtaaaagtaaaaacaaaaaattttttggttaattattaacaaaaaaatatcgtatcgtgtcgtctagtgtctcgtatttgaggagcgtctggtgtcgtgtctagtattttatttatttgttcgttttctagtgtctcatattttatttttctgtggcatcatctatgctagcacacattgattgtttggtcatattgcagcaaagattaatgatcagtttttgacttttttgtggattttttggtgtttctcgtgatattatttaaacatgcccgagtgatgataggaaattagtaatttttttcattataattattgggttaaacagattttggtagtaaaataagaaatctttaaaagtgtgttgattttttatagtttcagaaaatccttgaaattttgttgtccaacatttgtgcaattattatgaatgtttatgcataaattttttatggaaaacacaaaaataaaaaatgaaaataaagtaaaaccatgattttttctccttgctcttcgttttccgttttttctcctttttatgacaataatttggtgttacccgttatatcactgattatttggcgaatttttgctatttttaatgtcgattttcttagatcatcggttcaaatttcgctcgtaatttttcgacatttatttgttgtttcaattcggaaacattttgtgtcaggaaaaggcatt

SEQ ID NO: 21277 - DNA, 1466 bp, Heterodera glycines
  misc_feature (1120)..(1121): n is a, c, g, or t
  misc_feature (1163)..(1163): n is a, c, g, or t
  misc_feature (1175)..(1175): n is a, c, g, or t
  misc_feature (1206)..(1206): n is a, c, g, or t
gaaaaaattttttaaatttaaaaattatgttaataattatgaaaaaagtcgatttttaggggtgtatttttcaattttcttgtatttttattgcaatttttctcaaaaaatgccaaaatatgtgcaaaatatgtgccaaacccccaaaatatgtgctaacatattttatgtgacaaaacgccaaaatatgtgtttttatgtttttataagtcgctctaaatcaaaaattgttcggagataatgctatttttgggcttctctcgccataactaagccgcaaaaaaaatatgtaaaaacataaaaatccggtctctattaattattaacaaaaaaatctcgtatcgtttttgtttggtcatattgcagcaaagactaatgctcagtttttgacttttttgtcgattttttggtgtttttcgtgattttatttacccctcccgagtgatgataggaaatttgtaatttttttcattataattattcggttaaccaaattttggtagtaaaataagaaatctttaaaagtgtcttgattttttatagtttcagaaaatccttgaaattttgttgtccaacatttgtgcaattactttgaatgtttatgcataaattttttatcgaaaacccaaaaataaaaaataaaaataaagtaaaaccatgattttttttcttgcacttcgttttcccttttttctctcctttttatgacaataatttgcttttaccctttatatcactgattatttccgaatttttcatttttaattcattttctttgatcatcggttcaaattccgctcgaatttttgacattttttgttgtttcaattcggaaacattttttgtcaggaaaaggcattttccacaactaaggcatttgtatggttgttcagggttcggtttgcttttgccacatctataatttaaaagtgatggaatttcgaaggaacaatatttaaaatcttagtgagacacttgcggaccgcgttttctggattgaactgtcaaaaaaataaagagtgatcattcaatttgaatttttacatgtgatttcgtcgccgaaatttcgccggacataatttagccgacgaatttaaaaaaaaataataaaaactcttannaaaatttttatatgaaaattcaaaggaaaaatttttttgaanaaggctattgtnaatgtgaaaaagttatataaaacgttcccanaaaaatttcatttttcacgtccgataaaaaaagtataattttaatttgaatatttagttatctgcttaccgtcattaattttcattttgggaggaattgagtaatctggaaatgcatcataacttttttttattttttgacagttcgggcccctatcagtccgcaaattgtcggctaaccatttaaaagtgggaatatttgttcaagaaaatttttgaaatttgcaaaaataagttttttgggggggggggggggggggg

SEQ ID NO: 21278 - DNA, 2651 bp, Heterodera glycines
ccatcaaagtggttgctgcattttgtgaagggttcaatttgaagtgctgtttttctgcgaattccttcagctgattcgccgctttgattcgctggtaaatttggttgacgtaaatgccaatgtccaacactctgagcaccgattttatcgttggatttgcaattttggaaattttctccgaattttcactctctataaggtcaattaatttctggtacattgcttttagataattgtcgtcagaaaatttgctgacttttttcactttgaattcgaaaaagtccgtttcgatggcattgtttagaaaaagcaaacaatgatcactgatcactgccaaattctgtttcggattgatcgtttcgtcaaatgatcgacgcgtctcggcactttttgccgaatcttcatcgctttccgcatttttaccttaagtaatttgaagttggcggcttttttgtcaaaaatttccatttggaaagttcagttgtgttacggtagctcaatgtttagacattttgcccattttttattatatctgttaaggtttgcttattttttaaatccttggaaatttttaaagttttaaaatttaaatagaacgaaaatttagcctttttgggtttttgcaaccaaaaaaacttttataaaaattattaaaggtggcatccctaataataaatattcatgttttaattttttatattttaaatccaattccatttaccacttgtctctgctgtcatttcccatttttgttctgctgaatgtttttccaccgttctttcgttatttctttcccattttcgattatttttgccattttttatttctttttcatttttcatttttaattcttccgaatttcctttttcttttgtctctgtttcttctgatgcttttgagtttttgaatttttcactttttgataatatttttcctttctttttgcctttttcctcttcttttttcttccatttcgctttttccttttcctttttcttttcttttttggaattttcttcatttaaatttgaactttctttttccttttcatttaaattttctgaatttttttccgttttttcttcaattttattaataatttttgtctctttttcatttttctttttgaaattttcttttgcatctgtaaaaatttcttctccatcggatgaatcagaagaagcagacaattgttcatttgctgttaaatattcgatcttaaattgaaatacttttttctattttttaaaataataaattaccggtgctaacattttcctaatttttgcaatttcttcgccgtttaaaaaatttttcagtaatttttctaaagaattatttgtaatatttttaaaaattaattacaacaaaaaccgtttttggagaacatttttttatgtttttcttcatcttccgattggtcgttaattattttgctaattttctttaaatgtaatttccccaaaaaattgttcttttttactttttttaaatttctgttcaaacacagcgtaaattctaaaagaaattcttcagaaaatttttctgtcgccttattttttgcggagaaattttgcattttttcaattcgccgaatttgtgcgaatatttcttcggtacaaattgcgagaacactcagcagagtgacgtcctcgggtccattctcccacagaagcggaacattctaaaacaaaagcataatatttaagcataagtttttcatggcggggaatattttatttgcgggttttttaaaaagttcagataattttgtttttattttcatatattattctacggagaaaaattgaatatataaactgttcatatgtacaaaaataaatgcaaatttgaattttcggtccaaaacttaatgaaaattgagttattcgttcatttattattttctgctactcaccttcttctcgctcaccatttgcttatacattttggtgtctgctaaaaatcgttcgctcatttttgacactttgccatttcgcgcaaaattttcaacgttcaaacgaatttttttgtcataatgccaaaaaagtttcgaatataaaagccaatcgaacctcaactgatcgatgacatttacgaccaattcttggaccaattcactgaattcaccttcaaatttctgtgtttatttgcatgaacgggtaaaaatgccgatgtcattaatgacaattattcaattaaaacgaacttgcccccgtcgatattttctgagattcattccccaaaaaatcttcggcccattctccgtataaaaatgtgtccaaaacaattcgagctctccatctaccaacttttgtgttcgcttcaaaaaaagattcgtacaattgcgcgtacaaatcattgtatcgttggaaagaaactaaaaaacaaaaaataatcgtttataatttaattttaatttaattcattaaaccgacataaaaaccccagtgtttcatggtgtgcattgctaatcattgccattcttgggaagccgaacaatttcacgaattttgtcctaattgcttggagttcattgtaatcattccttttccatacagcactaaagaatttttttatagcgtatatgattttttatttgcattttttatgtgtttattgctattttaagtttttttttacttaaatgg

SEQ ID NO: 21279 - DNA, 1107 bp, Heterodera glycines
catcaatggaattttccacatagcgctagcgagtcaatgcaagatcactttattttgttcgttctaagaatgtagttacagacccgggactgagtcaacaaatgtctttgggacttaaccgttcactgacttaaaacgcatggaactgtgacaaatacggtgtaaatggattcccctcggcatgtaatcgcgcatcctttgaactttcgactttttgcccgaattctcgtcaggggttcaaaagaaaataatctagtgtgggcgaactgaaaatatgcttacaagggcacctcgcgaactgttagcaataaagtgggtataaatttggtatcattggatagagagcatgttcgacttctattgtgatttttttagtaatagtggtatataggaaaatataaagttatggcctcaaaaatcgaaattttgactgtgttttcactaaaaattggtggctcagttggttaaattcgcatttttggagctcgggttcaaatccacacaaaaataaattaattttaataaattttaatataaataaataattttaaaaagcattttttagactaagaaaatgtataatagtttttctttagagaaaataagcaaaagaataaaaaaatgtaaaggatggaaattaatagaaagtgaaaaaagctcgacgctgctctatccaatgataccaaatttatacccactttttgactaacaattcgcgtggttcacttgttatgtggcgaacggtatccattggctacagtacattgacaggccatgcaatgcaacgggtttatctgtaattttttgtattgattttgccacaaaagccaagccattttgaccatagggaggttgtaacagcttcggtcatcggacagagtgatccgtgatcagaaagagcgtaaaaacagcaaaaccataagaaaaattcaagcaagcattttttgttgaattttacgaataaataaattaatatataaaaagtgtgcatttttgagcattttgcgtgccttttatttcagaaaacaccaaactacgaactaaattttatccttttttttcataattaaaaatgaataaacattgaaaagttgatgtttgtggctt

SEQ ID NO: 21280 - DNA, 1749 bp, Heterodera glycines
tttttccccggaatgtttttttccaacattttttgttttccttatccttttttccttttggaggtttttttttgctttaaaaacctttttttgtggcgccttttttccaaaattttctgggacagaagggggggggggggttccggcggtgccgacaggcgccgccggggaaaaaatttgaaaatttgaatgcaatttgttaacagattttcatcaaaaactgcctaatttttgcgattttaagccatgcgacgactttttttgtttataaaatgggttttttttacggcgcgcttttaaaaaaatttttttgaggataggggggtccggaaaaatttgtaatttttaatgcgagttgtttacagatttttctccaaaaatgaccaaaatttgcgatttttggctaattttttaagaaaaatagtgacttaatgccataaaatttcaaaaattctcaaaaattacatttttaaatgacataatgccataatttaatcaaaatattgttgaaaattacaaagatttctcaaatttctttgtttttaaacttttccaaatgctcattttcaaggacgtccttgcatacaaggacattttttattttcaagaaagagggcccaatttcagggacgtccttgccattcaaggacggatggcaaccctgtctaagccgctatcaattcagtaaagtgatcaaacagatttaaaaaaaaactcattaattatgaacaaaaagaagtgttaacaggaatttttaatcatttttaatagcctattatttgagcatttagtggtgaaatatttacaaattagtccaaaaatggccgtcggggaaatttgatagattttaacctggtcagtaacatattgtgcatcaaaaataaggaaaatttaaaagacttaaagcctcatttagaaaatttagccttattgacatacaaaaaccacaaaatgaggctaaagcctcagatcttggagccctggatataacagattataatagtcaggatgagaaggatgatttagagattgatcgaacatatttggtcaatcgtaaaggcactgatgtgataactagagaccgcatttgaagaaattccaaaatattgaacaaaactaaaaaaaatttgtggaagaacttctgaggaattaaatttgcatttaatttttcaaactaattaaaatttggttttaaagaaatgatcacaagactttaatcttacgctatatccaaaacttaatcaaagaggggtaatactaattgatcgaccaattaataataggatgagttgtttagattgattaaaaccaattaaatatgatgatttctgcaggtaatgaaaaatttaagccaattaaatataaaggattcattcaaaacatttcaaaatattgaaaaattatttagtgttttaattttgtagggccatcccccgatggccccgttccaaaaattctgtaaccaaaacctattgggtggtgttccccatttgcagcctaatagtaaaaaatggaaaaaatatataattttggagatggggtgaaagcgaaggaagagaagacatttattccctacactctctaatttactcttgtttctttattgcattaatttttctgtgtgttttcacccgtgaaaaatttttcacatataattaagaagattaagaaacatatttagggaaacataaacaaatgatgaatgaaaatgaaaattttgaaataatcgctgcgaaaaaaaggagtcgg

SEQ ID NO: 21281 - DNA, 3213 bp, Heterodera glycines
actttgagctccgtctcaaaattggattgtttgctccccccgagggtgcttctcccccccccccccccctttctcccccttttctttctccgaatttcgtgcaaatgttttattccaaaaagaaaaatgattcttcgattattgttgagcaaaattcccactcctcaaaaaatgaacatttcccctcattagtcatttataaatgtataatttaatactatttgccggtccatttgttacaaatcaaaaacttttcgcttttgcacaattaatcgcccggttcgatgagtgtataacaacggacccacaaattagagtcagtataattagaaagattctgttctttattttctttgtacgatattttaccaattcccattgactgttgccaataaattggttgctgacatccttttgagtgaattgtgaatgaaaaaataaattggattatccctaccaaaacgagcaaaaatattaaatgctaaatgttttattcgtgcctttctttcttcacttttcgcttcgtccattcattggattgtctatttttcttggcgtttcacttattgttgcggcgatagaaaatgtcgcagcaaaggcacaacaaatggccaattcgcgcgcggaaacgactggagaagagagtgtacagcaaagggttacaagcggagcaaagaatggccaaggcattcatcagaaggacgaattcgtaggggggatggatggacaagttgaagagacccctgcaggggtagagagagaggggcataattaacgagtaattagctaactaattggggtgatgtattaagaattggacctgcataagaaaagcctgaattggcgagtagcagatgaagtagacggacacacaagcgacctgaagggggggggggacggatgcacggcatcggcgccattcattggcactaattaattaactgtcagcgccattaattggccctttgtcactaattaattaacgttcgtcttatttgtgtattcggcgttctttctcctcattatttaccagcattttcaccaccgttcgcctcgtcttcagtgcttcttcgtgtgcgcccgaaacgggcgcaaagccaacgcaggaattggcacggctattacccttcgagaaatcgttgaacaacggaagttgggccatcgttttgggccaattttggcaagctaataaaaggaaatactcgggattgatgcgcaacctttagaaatatttgtgaccggaagaattggggaaaatcacttcggtcagtcattttacagatcactttttgtgcccaattaatatcttttctccatttttaccttttccattttcgtataatttgtcattttttgcccagagaattcggcaaatttttgtgtaaaggaagaggaaaataatgccgggcaaaaggaagagaacgacgaacttaaaaatgaattttgtaaaggataggcgacgaaggggggggggggacggacctaggcaaatttataaaagtgccaaaagtagcttttcctgttgaaatttgtgcacgcaaaagctgaaagacggaaaacaattcaatcgtcggattccttctcaaaacgcgtgcgtcttcttacagttttccgcctttttgttatgcgtcgcatatggcaaggcggccaaagcgacaacgcaccaaacggcacaaattgtgagcagaatgttcttccgagaacagagacggcgcgcatggagtggaacggcaatggcaataaatctaaggggggaggaagtgaaagtgatcggaatgaacggaagacgggacagagagagagagaatgagagagagggagggagagggtgagagaaaggagagagagaatgagagagagggagggagagggtgagagaaaggaggagagaatgagagacagaaagattgagaaagggagagagagagagagagagaaggagaaagagggagagaaggagagacagagagagagagaaagggagagaatgagagacagatgaaagggagagagagagagaaaaggagagagaaagggagagaatgagagacagagagagagaaaaaggagaaaaactgatcaaaaggcgaatgttccgagctcaaatcaccgaccgttccacgcaaacgacaagttgggtgaggatggaagtgaaaaggaacacgcattccaaataacgaatgatggggcacaaaactttcgaagggatggaactgtggggagagaagcaaaacgaaagggatggcatacccgcaggcaaaacccaaacggggccattgtgccgaagggtagggacccattcgacggttgttgcctgaagaaaggaaaggcgtaaaaagaaaaactgatcagtaaacaacatacgagaagattgagcgcatcggcaatggccaaattcaacaacaaaaggtctgaatggaaaatgcaaaaagagggagacggagggggggggggaggggtaaaggcccaaaaagaagtgatcagtgaatggggaaaagcactgatcggatcacgaggggaaagccaatggaattccgaccagcaaaagtcgtgggcactcactcatcacacttttgcgcatccgtttgtctccaatgattgcgacaattacgagaagattgcctgaaataaggccaacctaacgaagtgtttgttttctctccaatttttggattttttaatttacccaaaagaccgacaaaagtcaacaaagagaaaagggagccgaaaatgagcacagcagtgggcgaaatgagcggacgacgacgcatcgaattggcagcgaaaatggcactatcagagaatttcagacttaacattgtaaaataattaactcgtttctttccgatgaatggtcggtcgaacgattgggttaataaagcaagcgaacgacggacgaagagaaagagaaaagcctaattcaatttagaggaaaaggaacagcaatttgtggaaaatgaactgtggagaaaacaaaaggcaaaagggggggggaggtgaaagttggtcttaaaatgccaattcgaactgccatcagttcgctcttgcatttttgaaatgttagaggtgaaaagggaccctcccatcagaatttcctccgtcgcttcaattggcttcttattttgacgacttgtcaaagcgcaactcagttaattaaaaggagaaaagtttcgccattttgttgctctccccttttccccgtttttattcgga

SEQ ID NO: 21282 - DNA, 1896 bp, Heterodera glycines
  misc_feature (1569)..(1569): n is a, c, g, or t
tgtgagcggtgtgtggccgcgggcgtggacttggactcccccccggaccgacgagcgcctggctgttgctgcggcggtcctgcttggcgcgacggacaacaccgccggtggctgatgcgcgcgcgcgaggacgcgttcagcgacgatgacgacgacaacgcaaacgcggacgggggacgacggtggcggcggccaaacccgcgccgcttgcgtttcttccacgacgcggcgaccgggcgttcgccgatggcacagtttgccgattttgtgctccacgacgggcccgtaaatgtgcgcaccgtgatgctggcccacaacggggtatgtagtaagcgtggcgtacagaagccccgaaatgaaggcatccctcggcactttgtaggggcggtacgatgtgcatctgctgatggaggagctacagcggcgcggagtgcgcccccggcggctggtcgccacagggctgcgcgtctacacgctggagctgggcggccgaaatcagcgcagcgtggtcgccaaggactcgctgaactttttcggctgtgccctctccaagctgccggccatgttcgggctggacggcgtgccggaaaagccgttcttcccctacaactacatccgggccgaaaacatggatgtggtgcatgtgggactgccgccggctgtcgactatgacccggaccggatgcgcccggcggagcgcgacgcgttccagcgctggcatgcggaggagcaacagcgtcgacccaaccgactgttcgtgctgcgccgggagctgctccgctactgtgccaacgacgtgcgcattctgcggcgcgcctgtctgcgcttccgccacgtggtcggtgagctgtcgggaggcgtggagccgttcctggccgcctccaccatcgccgggctcgcgttggtcatctaccgacaacggcatctgccccgtgatctgatggtgcacacgccggagggcggcttcctgcgcgggcgacgcgcttccgccgcctcgcgccacttcttcgcgctgctggagcgactgcgcccgcaatggcgtggtcgactgcgcactgcgcgctggtccatcggcgaagcgtgcgtggaggacgacggctaccggctggacgcgttgctctaccgcccggtgccgctgcgaccgctcgtcatcgagttcaacgggtgcttctttcacggtaaggaaggagagtagggtggggggagtcccttcatgataccattctccacgtctctaaggttgccccgagtgctacccgaggcgacatcaggtgttggcgggtggccaaaccgccgagtcgctgtgtgccaggacacggcagcgtgcctgggagttggagcagcaacacggcttcacggtgcgcacggtgtgggagtgcgccttccagcggtggctgcgccgccagcccacccgagtacggcgcctgtacacggatgtgtgccgggcggtgcccggcccgatggacctgcgccgggacgcgctgttcggcggccgagtggagccgttcgcgctccactacacgtgcacagagcgagaggaaattgacgcattggacattgtaaggatgngggcggggggggctttgtgatgcaccccagcgcccttggtcattgacttcatgctcttgaccaacgtgaaggcgaggcgaggaaggcgaggcgcctcgggtcacaaaagacccaaggggccgtatggcgcgcaatggaatgcaccctgagttacagacaacccaggggagccaacgcgcgaaatggaaagcgccccgggttacaaaaaacccggggggggggggttgtacggcgcaaatatcctatgcgcaaatacaatgggacaatgcgaggcgccgtgactgacgaagatcccgtggggcctacttactcccccctttccttgct

SEQ ID NO: 21283 - DNA, 1075 bp, Heterodera glycines
cttttcgggcagtgcacgaacctttatatcaatttaaccccacaaagaactggttgatttacctgtcgaatgcaggagaacctgacccgcttccgctgctgttggcgcgcctttttgtccaccaaagcgtcgaacagctcgcgcttcatggcgtccaactccaccgggtcacgctgcagcagtgcctcgtcatcggagcacagttcggactcggcggtgctggccgaggagggcaattggaagtgttcaaattcgacgctggtctgacaacgaaaggggaggtttttattttgagtgcaacaaagaattttttggaaaatttgaatgcatgcgttcagtcaaattccccttattcaagtttagaaatttcagaaaaaacccatatattttctaagagtaattcttcataaaatttcgaaaaaatctctgaaaaatttcaaaaattttttacttaaaattgtttagaaaaattaataaattttaaattaaaaacaaatcagagagggggggggggggactggtaaggtagtagtgaaattggggggaaggggtacaacagcacattccataaccatttttagtaatgaagcgctaatagttccttcaaccttcacactccataagacacacagtgttaattggtcaattaaacaccggttgaatgagattggttttatatgtcatagcttataattcactgaccagcttcggtgcctcgtaactctgttcgctgctgttcaccgcgccgccggcgatgccgtgccgccgcactccgtcgtcgctcgtcgtccgcccctcaattgtgatagtactgctgctgctacatggactaatgatgttgttgttcatggcgttgtcttcgttggcattgtacgccgtcatcgtccggccgtttctcatccgtttttccgcttcatccgtctgtccttgctgatctcctcgctcttccatttctacctcctcctcctcttcgccgtcactgcccatgccaatgttttccaattgtgtgtaaacggcctgaacataaaatgtgaaatggtaaataaaaaacactttttgatgccaccccaataca

SEQ ID NO: 21284 - DNA, 1559 bp, Heterodera glycines
tttttaatttaagggaaatatgaaaggttttttacagaaattttctgaataattcgttcaaaaggaaattggatttttcccctccttattttgtcctacccaactacagtactggtgaatgaattcaattttccgaaaccgtatccatttatagtgtaatttttacaccattacggtatcacattaccgttcccgactttgtcgtctttgcggtgcctccaccactgctgctgctcgaccttttcttcttgctcttcctgttgctgacaccgtttctgctgctgccgcttgccatgccgtcgtcttcgtcatcgttggcatcattgtggtgccctcctcctcctccgtctccgcccgctgtgtcctccgtgccgtcttttttcgatgcgtccgcctcctccgtgcagcaattgcacgagtagcgcaacagcagcagggacagcagacacgacttggcgtacgtgaagaagaacgggcgggcaaaggccaaatcgatgaacaggtaacgggtgagctccgaggacagcacccaaacctgggcgaaagcagggatgaggaggtgaaacaatgtcgccatgtgtttaaggtgtatcgtttgccaaaatttttgttttttttaaatgtataaaatcccgatttaatgaaaatgtcgggctggacgaaaccggaaacattaaaaataagaaattttaaacgtataaaatcccgttaaaaatatcaaaaatctaacttttttagtttctaaaatttttaaatttatagagaaatggttaattcatttaaataaccgcgggatatttcaaaaaaatggccaatggattaaaattgtagggaaaacaaaaattgttgcgcatcatgggaaagcttccgaaaatggtcaagttcaaacaccacaaatttggtgtgcttttatgaaatttcttggcgggcaccacgcaattctctccatttaaatgtcccagtgaaaaaaacttacgacattgacgagaacgagcagcccaatgccgagcagtcgttgcgaattggggacaatcatccgatggaatgaaaatggcgccgcccgaatttgtcagttgtttttagttgttgccactcttctgtccacagcacacgacgtatgtacacaaacacacttttaaatgcaaaaataaaataaatatattaaaaatgaatttttttttaatatttagcgacaaaatttgcgcaaattcttgcaatggaacatcataaaatgaacacatttaattgtggtttaagtaaaataaatggtaacacaaaatgatcaaatggaagaagatgaggggaggagcaccaaaattgcgtaacagcaaaagaggaaataaatatataacggagaatggggggggggggggagaacacattcggatgcatttatcaatcaaaatcaatcacaaattgttgtgttttttggtggcgacaaaaattattgagaatttggtgcaccaccatcagcaacaacaacaaaagcagcagcaacagagtgagaggagaggaggaggaggaggaggaggcgatgaatgtttacaatgtaaaaatgg

SEQ ID NO: 21285 - DNA, 2054 bp, Heterodera glycines
acccaaaagtgtacacttcagtaccaggcgaataactcgccaggggttgctttgaacgaaaaattgtttctgagcaaaaatgtatagtatttgaaaggctatccaaccaagttttaaaatttcgaaatttttgaaaaattttcaagctaggcctaaaaaacgattttttggtttttgaattttatgattttttaacgaattttctcagaaaaacggagaccactttcaagcaaccgtttttcgagctctatcgattggtgacatttttagaaaattttcgatttttttccggaaatagaaaaaatttttggcctgagcgggacatttgagtcccgggcccataactcgtcaggggttggttttagccaaaaatggccttagagcaaaattgtagagctttttaagctctatcgaacggtgtacttcattttcgaaaattttcaaaaattttcgagctaggccccctagaaattttcaaaatttttttttgggttgaaaaagaggttgaaaaaattttttctggggtaaattagggtcctgagcacaaatatgatgtttattttagtttcagattttttggaattttttaaaaattcgaaaattttttaatttttttggtccttggaaatttgggttaaaatttgaaaattcataactcaatggaggactggtcaatttaagtgaattaaagctttaaaaatagcaaaaaatcgggagaattttatgagatttatttgaaatttatatcacaaaaacaaaaaaagttattccagaaattctggaaattttcgatttttcagaaaaaaattcagaactcggttctgtaaaggtgtttttgaaattttaaatactgaaaaaatccgcaattttttgctctattatataaattttatttggcatttctatcacatttttaaaaaaagatacaaaaataaaagtgattttgggattcgggaccaaaggggggagcatatggtttttaagtgaaaaaaatttttcaccaaaaatcttccaaaaacatgtctttaggggttatttgggccgctgatcacgaatacgtgatcagattttacttttgacacatcgtcaagacctcagaatccctgtgtgattggggattctgaggcatcattttttgggggggggggcgaagttcgaagccgggcggtgtacattatttttctttgtattttttgggttaattttcattacttttaataaatttaaatgtttggttttattaataataaatttttttagtttaattaaattattttttgatgaataatgattttcatttaaattatttattatatttaattaaagaatttcagctattattttaaaatttaattgtaaaatttttttcatttcaatttaaataactattcaattattatacatttcataatttgtttttcattaataaaaagtgtattatatgttaaaaaatgaaaaatataacacatcgattttttatctattttgattaaaaacaattccttaattaccataaatgctctatttgaatgcccactttctaatcactgttgtacctcttttatcacttttgtacctcttctaatcacttttgcacctcttctaatcactgttacacctcttctaatcactgttgcacctcttctaatcactgttgtacctcttccaacacatcttccaacaatttttgtacctcgtatgagctcaacaacatttaaatacgggcgcgaagcgcccgtccaaggccaacaaaattgaaaaacaggcgaagcgcccgactgaggccgcgaagcggcctaacaagctaaaaaacaggcgcgaagcgcccgtatgagttcaacggatttaaaaaacgggcgcgaagcgcccgttcaaggccaacaaaaattgaaaaaacggcgcgaagcgcccgactgaggccgcgaagcggcctaacaagctaaaaaacgggcgcgaagctcccgtctgaggccgcgaagcggccttaatagcctaacaatttttagaaacgggcgcgaagcgcccgtctgaggtctcaaagctgccttaatagc

SEQ ID NO: 21286 - DNA, 1327 bp, Heterodera glycines
ttttgcgaacaaagggaaattgtctgtgaaattaggccttccttagcttttaaaatcaaacaccaaaacaaaataaatttatctaataaataattaaaaagacaatcaaaattaaattaaaataagtcaacaacaaaataaatcaaaacaaaaatcaatcgacgaccaatcaacaaaacgcctaaaaattatccccaacgaccaactaatccaccaacttcactctagaaaaccaaaatatttgggtcgaattcaaattaaacattatgccaaacaaattcaaacaatcaaataaaaggtcaaacagtcactaataccacaggggttcggggttgcaagcgtcggggttcgtcggggttaaccctgaaaaatggccaaaaatgtcggggttcggggtcggggcggggtcggggtcgcaaccctactttaaaattttaaatgtttataattatatttgtatgatcgatcattgcaaaaaaaaagaaaaaattttttgcatttatattctggtagagaacaattaaagctattaaatgataccatgaaatattaatttggtttaacttggccaagttatgcatttttatgtgttacataatttttgtttcgaacccattggccgttttacgaaacgcgcctagcaccgcaaaaacatttagcgcttttctgtggattacccatatacaaactgctgagcttcagattttaaaaaattattggtgactaaaatttgcaaaaaaaagagagagagaaagagagagaaaaatttcaaaaattttaacaaaaatcaaaaatttattgggaaataaattttgtaaaaaaagaagcaaaattaaaagaaaaatggataatggaattttcaaaaaaaaaatgtgccaaaatttttggaatggaactattggccaattatgccatagcacaaaacggtattcttcccccccccccccccctcccacgaaaaaagtgccattttggtcaggtggcattttttgttggcactttcgtcgtcctcgggagcagcgcgtttccgccccccgtatcaatctccccccagctcgattccctcccgagaatttttttttttgaaaaatttctaagttagcaaatattttttttaatttctcggggggggggggggaaacgatgtggggggaaccggcggggggggggaatgaatggcacccgtcgtcctcacacgctttgcaggatggaattgcgcaagtccaacaccaattccgtctgccgaatgttctttgggcgcaggtcatcttctgcgctttttctcctcccttttttgccaaaaatgcgcctcacaacgctttttgat

SEQ ID NO: 21287 - DNA, 1495 bp, Heterodera glycines
ggatttcgatttgcaactctgatcagccttatcagtgctttaccagtatcacaactatcagggactggccagcctgattagagactgactgctgatcagcctgattagggactgactgatcagattaggagctagctaaccaaaatgaatagaaacaatcagcataatccgagactgatcattaggactgatcaaatgtcaactgaaactctcgaactgatcagagccaatccaatcaaccgacctgatactttttcctgagctcagtgatcagatgatcggtgacagaatattcaaaggattgtgccatctccagcaaatcgtcgggccgctcaatgctcgacggaatgcgcaaaatttggttcaacaaattggatgcatttgacgacggcacaaaagtgccatcggcgagcttcaaaagtgccagaatggcacggaacactgtggtggagccgaagatgaacagatggtcccacactcggaacagaagccgaggcgaaagcacagatgcaagcaaagtgatcagccttgaaggaaatgatcaataaatcaatttgatcagagaatttattgtgatcggaaatttatggcacgaagattaagaaaaaaaaaccgccataacttttcttaaacataaagcaattgaataatcttggtatctttcgataactcttaagttttcaaaaagttgcaatcaaaaattattcaaaaaattaacataataactttctgaaaactgaacaaaattttctgaaatttctcatgctaatagagtataacccaagaagagctacagtataataattaattaatttagttttttttttaaagaaaagttacgacgagtttttcccgaaaaaacccattttttgactgacgaaacgttatgacacattaaaaaaattttttatgtcaatcaagcgcttggatttaggcggctaacactgctaagcaaacagaattgttgatcagtggtttaatgatcaatttcatttactggaggagggactgactgactgatcacaatcaatttctcgagaatccgatcaaataacgtggtgagccgaagcgacaaaaatatgggtgtttgtaataattaaatttaattattatttaaattttatttgctaattaattaattataacttagcttaaacttagtcaaattaatgaaatttagtatttagcgacagaagatcgaagtatcctctactaatatgtttgtaatttttaaaaaattagtagaaatttacaaaaagttgtaaacaaaaaaaagctcgaaaagtttgggctcaacaattttgaccctaacttttttgaaactcaataaaattttttgaaatttatcagaataatagagaaatttttgggctatcttttcatataaagtgcggtgtgaattaattggtctttaaacaattttcatgcatttaaacgaccttacattttttggatggacataaaaatatgacactattaattccttcataacttt

SEQ ID NO: 21288 - DNA, 1220 bp, Heterodera glycines
  misc_feature (47)..(48): n is a, c, g, or t
  misc_feature (93)..(93): n is a, c, g, or t
ttttagagcataacaactgatgacagccactgtcatggtttccaagnnagatttctattaccagattgccaaaaaaagagatagccatttttntggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaaagagatttctattaccagattgccaaaaaaagagatagccatttttttggaccgtccatacctcacatatactcaaacggcccgaaaatcatttttagagcataacaactgatgacagccactgtcattgtttccaagagatttctattaccagattgcaaaaaaagagatagccatttttttggaccgccatacctcacatatactcaaacggc

SEQ ID NO: 21289 - DNA, 2088 bp, Heterodera glycines
cattgtccgatcggtcagtcatcgctcatcaaatgtccccgtccgtagtcatcgtcgccgtctcctcctcctctccgatgacgctgctgcactgtgccaccgtccgctggtccacccggtcgccaatgttcgcgctgctcagctgctttgaccgggaatgcgaacgacgcgttgtaggcacaaatgatggtggtgtcgaacagggacaccgagttgcgggccatccttcctgaagaagagggacatggagaatactatgatttgcaactcgaccacaactgtcatctcacattcagtgagtgttacgttaatatgccataaaaccaaaatttttcgtgtatttttgtctcataatttattggttcgaccctctaaatgagatatattcacaactttaaaatccctgaatcagtgagtgagtaggtaatctctctgggagaatatatgatattgtttatttatcggttccagtcgatagcggtgggacacctatattttggaattgctctccgttgtctcaggaaaaatcgttaaaaaatcacaaaattcaaaatgtcgaaatccgtttgctagacctcaccgtcaaaatttagaaactttttgaaagtttaaaatttggaaaaatcgatctcaccgagctctccaatgagtctgccccccctggttacgggccttaaagaggtgcctagttgaaggggtttaaaaaagtcatctaataagattccgtagggattggagactcgagactttttctcgatgaaagattcaagaattctcgggtcgaaactcgagtatttttcaaaaacttaataaacgatttttaagccaataaaaatttttttgaaaaaagtctcgagtctcgggtttttcggtctcggttcgagtttcggtctcagagtcaagtcttggtctcgagtctcgggaaaattttggtctcaagcatcacttaagtttgtattcaatgaccttggatttgggccttactgcttagaaaattgattattttccagaacttctgcttctgctggtgctcctctacctgatgtaaatatatttgaagccaatcacatttcttggtgggcacaactgatcgattgtcatatccccaaaacatttcggcacttgcactccgccggcgttttggctggaacaaacagaaagcctcccatatgcccattttcgtgttttcaagtgcatgacaacaaggcaatcaaatcgtggggaaaggagcgccaatttcagtccgacttcgacggggcgaaaccacgggaaaatgttcagccaaatgtcgctgcacacattgctgaaacaaaaacagttttttcaggtggagggtgaacccagcccctgcttgattacggcctgccattgactgatttatggaaccgccttattggtgtacggacatttcgcctactcgacatctcgcctaccgacatctcgcctactgacatttcacctactaagccaaaatcggtcatttcgcctactaagccaaaattagtaggcgaaatgtcatgtagccgccttatttatccaataagaaaatacatttttctcttcagtgctaacaaaggaaggtcttgaggtgtccgtggagtttcggaatgaaatttggtgggtgcatagagcacccatgggttcttaagaaaagtggttttattttctgcgaaatgagtacgagtgccgagatatgacgtgccaaacttttttctatcccaataaatcgaataaacatttgtaccgttttgtgttgttcggtggtgcggaggttgtgcgtttggcgtttgtttttgcccccacaggttcgaatccctcttatgcaaattaatttcccccatcttatttttgcttttatgcaattgaatggccaaaaaatcaatcccactcacacccaaaaatttatttttcgtccccgttcctaaataaaatgtccataaatccccaaaatattctcattcccaaccattggacgtttatgtttttcggtactaaagtcggggtagtaaaaaatccatcaaatttttttagaatttggaagcaattcacaagaagaataacataatttgttatggtttacgacattaa

SEQ ID NO: 21290 - DNA, 1592 bp, Heterodera glycines
tgtttcaatgcgatcagacggtcgacctcccgcgtcttcggctgctgcttttttccacggctttgcttttaaccctttggcacttttccatggccaattcaccgcggagaatggccaaacgattgagaagcgaaaggcgatcagtttcggtatttgttaatcgtttacgcagttgattgaccttgaaagcattaaattggcataaaattgaggagaatagcggaaaaatgtgtaaaaacggtgctccgtcacctctctgaacgttgtgccggcaatttgtttccagcggcacaactgtcgctcgctcagcggcggtctgcccccgtggtcgagttgttccgcgctactgctcctccccattttcgctgtccaccgttcccatgccgtccgtcttggctccgtcctgtacacctccaactcgaccaatgcgtttctcaattgttccctcaactgatccttttcccgctgcaatgtttctgctcgtcttcgcagttcgctttggcatttatctccgtcggccattgtccgtagccaccagcccaactgctccaagagtttgtccgacttcgtctcgcgctgtgccgtcgtcgcactttcactggcactgctgccccggctcaaaatggcggataacaactcgtgcatctgcacacgaagtgcttcgaaatgaccgtttgtcattgcgtcgtgtttttggtggtcaatggagacagacatttgttggacagaattgtcatcggcaacaatcgtttggtgactgatcatttgccctttttcttcgctttttattggctcggaatgactcctttccgcgtgttttgctcctttttcaatgtttggcattggcaattgaagcgataagtcacaatgactcggaatattcttaaaggataagcaaaaagttcgctcgaaagggaaaagaaaaattaaggaaagttcgaacatttgttgccgtccaattttctttaatttgcgtttggtcaatcggtcggccgagggacgcctcggaatggtcgaaaaccgcgggcaatgacaccacggagatgtacgttttgccctcctccgactccaattcgttgtcagtgtccaaagggtgccctcctcccaattggacaatgtttttgccgcgatggaaagtgacggtcagctcgggcagcacagttttcttttggttccgttgttgttggctgaatggcgcgatcattttgataaattggcttttgtctattaatgtttgaaaatggcactctttttcaattcgttcggccatttcccgccccattttgtccatctccgctcgcagccattccctgtcgctttccaaattgtgcagtgcctttctcaggtgttccatttcggcaccgtccaggtcaacttcaactcctttgtccaattggttgggtcggcaagtgacgtatttgttgagtgtccgtggccgaacatcacattgggcatcacgacggggacagttcagactgaccaattttaaaagtcagtttccatttgcacaacaaagcactgccggaactggtcgttcacagggcccccggggaaacccaagagaacttttttagttttaaatttcaaaatta

SEQ ID NO: 21291 - DNA, 1524 bp, Heterodera glycines
cccgagcattcaaaatggacgcgtgttcaatggccgagtgaagacggcggtccaattttattcgactgaactgccagcccatgcgcttgtcgttcgccgcttttttttcatgtttaagttgtgctgccaaattggcacttttttgtttcaattccccacacttttttgcccaatattcctcgttttgtttgctgttgcgcattgattcaaccaaaatttgttcaaaatcattttcaatggccaagttttgccccccccccccccgacgaccttttccatgcgttcgtccgtctccgcctccactcgcttcattctcaactcgcacagactcttctcacccctcgccctctccaactcattctcgaggatcggcacgcgttctgtcgtccttcccatctctgcaacgcgttcagtgaatgcgtctctttctcgctggtgccgttcgtcctccgaccgtatgtttttggcagcattttccaattggacagtcagtgtggtgaccaactccgttttcatggtcagcatttgttcgatgtctttcaatcggtcgctcattgtcgttttgtcctccgcaaatgccatttgcattgacttttacggcgattaattcgattttcattttgctttgcttttttaattgtccttttgcccttttactcactcgaatttggacttgcaattcgtccaattccttctcactgtaccccaacgccttcgctgttagcattgtttgtgtgccttttgagcctctgaacgtgaacacgtcccccggggctggtcggaactcgtcgagtcgacccagcacaatgccctggtcgagtccgatctgctccatgacgtggcaacgacgttcaatgtatgccaatgcctgctccaatttgtcccgttcggcctaaatgccgtcatttaactaatgttttaaaatgccttttgtttagcattgcctgcgctccattaagagccatttggatggctttgatttcacaaagccgtgtttctgccaactgcacaaggatggcatgctctgtccgcagtgtgtccaattgcgcatttgcttgttccaagtcggcactcatttcgtgccttttttcctccatttgggtcatccctttgtccctgagaagaagctaaacgaatattttgtaaacattccctccccctccccttttggtccgtcactttttcttccatccgctgcttttcctcctcccaacggtgccgtccctccacgcattccttccgttggcactctccgccgctttgtgccattctctgcttctgctgcagcgtttctccctccgcgacgctttctttaggttggatttgctgacgtcggaatgtttcgctcgtctcgctactgaccaaggcttcgtccctctgttatgtgctcaatgatcactgatcattctttgcttttggttctttgctccgactgtctttcgtcctaccgtctctccgtttccgtttgtctctctttccctctcttcgtccatttccgtcgcagtcttttgcgcttctttcttt

SEQ ID NO: 21292 - DNA, 1305 bp, Heterodera glycines
taaaggactaacttacactgaaatgagcgccgagctactcccacccagaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaattttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttctaaatagttcccccgagcgatgtgctcagtaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctaatgaatttttcaaaatttttgttgaaatatttgtcgtgc

SEQ ID NO: 21293 - DNA, 2891 bp, Heterodera glycines
atctgagattctgaagcaggccggggtgaggtcaggctcccctccacccgccggcgaaaaaaaaaattagttttttgggcatttttaaattcaatagactattaaattttgtaagtgttttttttaatagcttaaaagtcgttttttaataaatttttcgtcttatcattgttttttaaacaatttcactatttaataactcaatcagtttatgattcatttcatacaaatgctttcggccctgccgactcggctctgctgctctttcggattgaattttttgaaatcatttattttgaaaaaatttattttcggagaatattaaatttttattttggtttctgtacaagccaaagtgatgccgggccgaaacgtccccggagccaagacaacctagccgaaacacatttactacagaaacagtaaacaaataatggagctggccatctgctgcagatgccttatcagcggtaaagttgaaaaataattcattaattcaaagatttatttttaaaatatctgtttcaatttggcatggaaaggcattaattagcccattgatgagggagatgacaacaatagaagctttttataaagcaaaattctttgataaaggcaacagacaaaattattcttgaatatacgtgaaaaatgatgaattttgtgtttcacgttgtaattttgttatttagtttttgaagaattcatgtcaaattttcgtgccaaaattggaattagtccatatttatttgtcttcttaatggtaacggatttaggaaacgtccatatgtggcggaatttagaaacgtcccagcactgatgaaaagggcaaatgccgttgtccctacgaaaaagcttaaaaaggaaaataaaatgcaaaaatgaaaagaattcagttataaatgcttatacctcgagaggtgacattaacgctttcactctctttcaattttaattataaaaattaatattttagaaatatttttaattttcgaataaaataattgtttaattctagaaaaacacccattttgtgcactaaagtcatgtgacagaacatccaagtccctcatatattgaataagtggacaatacaatacaactccaacccgaaccccagcaatacccgtccccattaaaaaactaaaattatataatttcgtatttttataaataaaaaataaatatttataagattgcagaacaaattttttttttcaaatttatgcaaaaggaaaaaataaaagttaatttacggcttaaataaaaagacctactaggacaaactgaaatgatctcaataaaggtaaatggaaaaaggacaactcaaggacagccaaaagaaaagcaaatgataaaagataaggaaaacactacaaataggaagacacaatgggttggaatcagggatggcatggaattcctatttccggcttccgaaaatttttgggcttcggaattccgatttcaaagtttttggggcctcggaatgccatccctggttggaatgtaatagggagaaagcgcaacgaaaatgcccttaaaaataaggaaactgttgctcattgaaaggccaaatggcctttggaatgaaaaaagtaacttttttgaagatttaaaaattcctttctgctaacatgccaaaaccccattacacacgtttcagtaggtcactcaaccttttttgtgaatgagttagtgagtaaatgaccttgattttcttggagatggatcgttttaaaaatggtgaaaatgccaaattttctgacattttcttccttcttcgccatgtgttcgtcattggccaccatttcaattattttttccgcaaattcttccaactttttgtcaaattcatcatgaagaccttttaaatcgtgttcatcagatgattgtttatccaacttgtccccattcttatattttggcagtattgggaactttaaatttttgagcttttcccaatcagcgattgagcttttctttcatcaaaatagattttcgacatccaactcagttttctgagagctgcacgtatgttcagagatgggattattacaatgtctgtaaaaatactggttcaaaaaagaaaatatcaaataaataaagccaaaatatgcctcgagcattttctttttgtgttgatcaacagcagaagttctagactgatcatctaattttttagcttgatcaggagttgccttcagatcattcagcaatatgatcaaatcttcgtcaattagctgtgataaaaaaaaattattaagcatagtgacctttttaattaggctgtgcaatttttgaaaatttgagtacaatttgctaaaagattttcattataaatgataaatttttgcgtttgagtcatttttatgaaaaataagtttcgtgggcccgtcggtgccgataggcgccgccgggagaaaattggaaaatttgaccatttttaaacagattttcactgaaaattggcaatatataggtcaaatttacaaaattttaggggaattttgggtgtcggctgtgacgataggctaaatagccatttttgaggattttttccaaaatatcagcataaatcatcaaattttgaaaattttgctctttgaagtcataaatgtagtaaaatggatgaactaattaattaataaacaaaataaacaataaaatttataaggaataaaagtcaaacacagataacacaatatatgccaaaattttgaaaatttggaagtttttgatagcagttttacacaaaaatcgccattcttgaggatttttccaaaaaatcagcataaatcatcaaatttctcaaaaattagcaaatcatcatctcaaaaataaaatcatcattgactccttgatatcatcaaaatgatgataaatcatca

SEQ ID NO: 21294 - DNA, 816 bp, Heterodera glycines
tctagagtcgtctaagatcaaatttgagcaattttttgtttgaaataagcattttgtgaaattctgatgagcgtgaaaaatcgttgattttttgcggcgtttttactaaaaaaaacttttgggtaacgaaggaagggtgggggagtataataacctactaattacgcattgtttgactgaacgataggcgcacagtaaccgctatggttcgctggcttatctttaattttatttaaatagccacgatctactgaaacactagtcatccgcctaatctatttaaggatgattaagaatggaccaaaaataatatgagcgcaattctttgacattattgctcttctgcgttgcacccctgctctaacttattcgatcgcacggccgatttttgttgttataaaatatactaatttatatcaaaataagaaaacttctgataacgtaaatgaattttggccctacatcagaagctcaccattcacccttcacaacaaacaaatttgaacgagaaatcttagaattgctattattacaaattctattccttaattatgaaaaggaatgaatgaacgacttttgtctggttaaattatttttggcattatctaagcgcaccgcaaaatcggaaaggatatcctttactccaattaaagtttcttaaataaaattctaatctaaattatggagaaataaaattcccccgttgaatatttatgaatttataattatcgtcatactaatattatatgattttttttttcccggcagaattatttaaaaataatctttcaaaatgaaatgctattgccaatgttc

SEQ ID NO: 21295 - DNA, 1045 bp, Heterodera glycines
aaaataaaaatatggatacctttaaaagcccaaaaaataaatttttatttagtttttgcagtctccattccatgttttgagatttttttaaaaatttttgaatattttttttttcccgaaaaatgttgcggcaaatgttcccgtccgaaaatgtctgtcacatttctggtaattttgttgctgcaaatgtcttcaagaatttctaaaatgaattagaaaatttgatatatgtagggctgggatttttaggtttttacctatttttttgcggcttaattatgacgagataagcccaaaaatagcattttcttcgaaaattttgatttagagcgacttataaaaacctaaaaacacctaaaacgagggtttcgagtgaatagcacctattttggcatttttcgagttttagcacctattttggcctttttccagaaatttcatagcaaaaatgcaataaaaacgaaaaatgcacccccaagaatcgatctaaaaaatttcaaaaaacataaatatacttggtttttccaatttttaatacctattttcgcacctattttggcctttttgggggtttttagcacctattttgcacttttttagcacctattttagtacctattttaggattttagccagggttcgcagatgaaaattttttcatttaaaaaaattcataattttgtggattttcgaaaaaaattgtaattttctggctaaatttgggtgagatttccgtttgatactctattaaaaaccaaaattcaaattaaataattgccaaacattatgccaatttatcaaaatttaaaagattctgaggattttccccaaaagcctcaaaaatcctcaaaatttctcaaaaagccacaaaaatcctcaaatcctcattttccaaaaaaatcctcattgacctatcaaaaagccacaaaatgaggataaatcctcagatctgcgaaccctgtttttagcacctaaaaaccccagccctagatatatgtaaaagatacacataataattaaaacagaaaaaagtttgaataaaaca

SEQ ID NO: 21296 - DNA, 1439 bp, Heterodera glycines
cgagatcccggcaccccaaaaaccccgtgatttccgtgatccgtgagccgtgatccgtgatcacggccagccctgatgcatgtccaatattaatttgcgatgctcagagactgacaatttctgagcccactaatttgtgagcaaatttgggcactttttcaatcattatgccaaagacgaccatttggcataacgttgtcatgacgccagaggcaatttaaatcatttaaaattaaaaacaaatattataaagtttttcatatgaattcaaaaaaattagcaattaaattttatttattcatcaattagcaaccccttcaacaaaactatgttgaatcatcattaattactttgttaattagtttggcaaattaccgtctcagttccgtcgtttaggcgttcaaattgctgctggcgatgtcgtcggcacaatggcggcggcacagcaacaccaacgtgttcagttggttgttttgcaaaaagtgtgctttgacgctgaggtgttgcttcttctgatcgggcaccaccaccaacaccaccagaagcttgacggaaaacgaaatccgatccgccaaaattgtgcttaaagggacggggcgctgggataaagccgcttgaacggagcggaaagccgacggggtatatggggagataaagcggtggaaaatcagcagctaatccccagggagaacgggaggggacccagagctttgtgtactcaacgcccagacacatcatttctcgagaacaatggtggacaacaacggttgacgaaaagcagcaccggccgcgcgggcggtgggagccccggaagagaagggtgccccggggggaagggggcttgttttttacgttagccaccaacccctccgtcgcccccctgatgacaaatgagggccaggacagtgggacgaaaagtctcgaaattcttccccgcccccccccccacctcgagagttgcggaatatcatgagagtactaggggaaaaacgggggaaatctgtcccttccttcctgtggcattttcctagcgaattgcgggggtgggagtgggcaaatgagtcctggtcgattagcttccaggtgaattgattggcacaataattgagtccctccgagcatccgcccgcacaaatgccaatttggcaagataaagcatcccatagaattgaattttggataattatgccatttattgcgacagagtgcagggacagttgagtgcacggaattttctgatcaactgcgggttgagacatctgagtcccagaagtttttttcctctattttccatcataaataatagtcaaaaattatatagtaaaacccctttacagtaataatcgaaaattcaaatgacacttacaattagacactgaactaactgtccactccactaattagtttttgtttcgagacaaaccaaaaagaaacggtcg

SEQ ID NO: 21297 - DNA, 931 bp, Heterodera glycines
  misc_feature (70)..(70): n is a, c, g, or t
cgcgcgtgttgttgatcatgatttcgatccccaccatcatcatcatcatcgctctccatggatgtccacntctcttcatcgtctgtctccatctctgtgctctctgatgagcacacactctcttgccatccccattcgccctccggcgtcactgtgtggcatcggcgccgccgccggccgcgccgttgcgttgcgcttcgagagcgccagcgatgggcggcacgtggagtagcgggtttaggcggcttttgagagcacaaaattgcagttttgaaaaaatattgaattaaattttcaaaaatgtcttccaatattttgtgcctcaaagtctgcggtttaaactttcgatagcacaaaattttggtttaaaaataatttaaaatgaaatttttcaaaaatttgttactaatttcaatttaaaatttttgtctttaattttagtttaaaataaattaaatttctttttgaaaaattgtcactaattttggtttaaaataattgaaaattaagttttgaaaaaattgcaattcaatgcttgtaaaatttcggtttaaaaattattttaaattaaaaaaattaaaaaaaaaattacctccaaaattttgtgcctcgagggcaacagtggcggtaatgtaaattgttcaggttttgttgcggatgctttcaccgggcgcaattcgttcaacgatttgcttctgcgcatcgatgcctgtggaatttttggcccaaaaggacacattatgccaaatttggaaaaaaaattcaaatttaagagaatgtgccgtccgaagttaaatatttttgaaatgcccaagcaaaaaaaatatatatacaagcaaaagcgaaaaagcgtaaaacgaaagcaaaagcaaagcgattgctgaccttctgcagctgatcaatgttctgaaagagggattttcttttaatt

SEQ ID NO: 21298 - DNA, 1641 bp, Heterodera glycines
ttttggaggtgaatatttgagaaaatttttcatttcttaggggtatttttgaaaattttcgggtcgattcttagggatgtatttttttttaaattttaggtcgattcttagcggagttttcataacaaattttttgttcaccagcaaaaatatttatttatttatttatttattcgtgaataaaaaagttatcagaagggcaaaacaaccgaaaaaaaatgtttttcgtgcgtttcaggccacgaggagctcaggaaaaatagtgaaaaaactataaatatcatcccgaattattgtgtttttttcatttttaaaaatttgcccttttatttttgcttaatccatctttttttcttcattttgaaaaacatgtcatatgttttttatataatttacttaaaagatttggaaaacatgcgcagataaaatcaatttgtgaaaatccttttccatgtgaaatgctataaagcgagattatttggatagataagagcaaacttattcgttttgcggcagcagtccatcaaccagtcttttctgttctatttttttttgatgtgctgcttgtcctctgttttcccgaaaaataactcatttaaactcattagaaaacaaaagtgcaatttattaaattaatcaaaaaaatacgcggtttcctttgattaaatcttatgataatcgaatttgctagcttgaagtgccaaattaaacatctataaaaattaaataaactttattttaaagcgtttttatctgtgattttgaaagaaatagattttttgaacttatgatattagcattctgatcatcaccatgtcgacggcaatgaagaaaagaatatttaccgctttggtggcaattacattattttattgcatcattataaaacaacaatattttttcagagaatgtaaatttttttaaaccttcaaaaagttatgaaaaattagccaatatttaatgatttatggaatagcattacaaaaataatgatgttgatttcaagatataaaaaagacataaaattggagtattttaaagcaaactttttgcctgaaagaatctgataaaattgggcgattgtttcaattcccgggtccgtctcaataattacgaaagatttcttccggatttcaattgccttttcacccatcgaactttatttaagttcgatattttctttgctaaaaaccgaattttttccttaaaaaatggaaaaaaagtcacgaaaaagtcataaaaaacaaaaaagaaatttttatgaaattttcgcggtatcaaaataaaaaaattacaacgttctgtagaataaattattttaaaaattgtgacaaaatcctagaagaacaaaattaatttaattggtacagggtcgtttcataaaactgccaatttaacaaatttttaaaggaaattcgtcatacatacaaattagtgtaatttgaagctctttggtggctgtattagcatgaaaatttaaaaaaatatttcattaagtttcagaaagttatgaccagggatgcaaaaaacatgcaaagcaaatacatattttttcctggcttctccatgctataaatagtaggaaaaacactttcttttttgtgtttgcgtataaaatcgggacttttatttgcatatttt

SEQ ID NO: 21299 - DNA, 1548 bp, Heterodera glycines
  misc_feature (1521)..(1521): n is a, c, g, or t
aaacgcccataacttttttacgaagagaccaagcacgatttagataatgaccaacaaaaatcagaggagaatgattatgacataacatcaacaatatcaataataacaacaacaacatcttcgtctgtcgttgattcgagtggtattttttttatttaggggggggggggggaaatttcgcaatatgtcgtttaatgacaaaaaaacataatatttcgctgtatcaaaaaataaaattgtccggtttctttagaataaactatttgaaattgagaagacaatgcttttcaaatttcgtcaatatatcgcttaattgacaaaagcaaattcaacaaattttcgcggtatcaaaataaaaaatttgtaacatttctgtagaataaattaaagacaatgctccagaaaaataaaagggcaattaagataatggccaacaaaaagcacagaagattgtttataatgattatggcataataccaataatacctaaatcatcaataattagggattttaaattgggatttcagttgggattttaaattggaattttaaattggattttcaaattaagattttcaaattgtgattttcagttgggattttaaattggattttcaaattaagattttcaaaatgtgattttcagttgggattttaaattgggattttcaaattgtgattttcagttgggattttaaattgtgattttaagttgggattttaaattgggatttcagttgggattttaaattgtaattttaaattggattttcaaattaagattttcaaattgtgattttcagttgggattttcaaattgaaatttcaaaataggattttcaaattgtttgggatttaaaaatgggattttcaaattagattcaaatctagattttaaattgggattttcaaattagaattttcaaattacgattttcaaattgggattttcaaattgtgattttaagttgggattttaaattgggatttcagttgggattttaaattggaattttaaattggattttcaaattaagattttcaaattgtgatttttagttgggattttaaattgtgattttaagttgggattttaaattgggatttcagttgggattttaaattggaattttaaattggattttcaaattaagattttcaaattgtgattttcagttgggattttaaattgggattttcaaattgtgattttcagttgggattttaaattgggattttaaattaggattttcaaattaagattttcaaattgtgattttcagttgggattttaaattgggattttcaaattgtgattttcagttgggattttaaattgtgattttaagttgggattttaaattgggatttcagttgggattttaaattggaattttaaattggatttttaaattggattttcaaattgtgattttcagttgggattttaaattgggattttcaaattaagattttcaaattgtgattttcagttgggattttaaattgggattttcaaanttgtgattttctagttaggatttgact

SEQ ID NO: 21300 - DNA, 945 bp, Heterodera glycines
tgggtaggagttttattggattttaggaaaaaaaaaggcccagccagggctaggagttttcttggatattcagaaaaaacaggtccagccaaggctatgagttttattggattttcagaaaaaacagtccagccagggctaggagttttcttggattttcagaaaaaaataggtccagccagggctaggagttttcttcgattttcagaaaaaaataggtccagccagggctaggagttttcttggattttcagaaaaaacaggtccagccagggctaggagttttattggattttcagaaaaaataggcccagccagggctaggagttttcttggattttcagaaaaaacaggtccagccagggctcggagttttcttggattttcagaaaaaacagtccagccagggctaggagttttcttgggttttcagaaaaaacagtcaagccagggctaggagttttctttgatttcagaaaaaaggcccagccagggctaggagttttcttggatattcagaaaaaacaggtccagccatgggtaggagttttcttggattttcagaaaaaacagtccagccagggctaggagttttcttgggttttcagaaaaaacagtcaagccagggctaggagttttattggattttcagaaaaaaaaataggtccagccagggctaggagttttcttggatattcagaaaaaacaggtccagccagggctaggagttttattggattttcagaaaaaatagtcaagccagggctaggagttttctttgattttcagaaaaaaggcccagccagggctaggagttttcttggattttcagaaaaaacagtccagccagggctaggagtttaaagggttttcagaaaaaacagtcaagccagggctagcaggggggggggatttcagaaaaaacagtccagccagggccaggag

SEQ ID NO: 21301 - DNA, 2646 bp, Heterodera glycines
aaaaaaatacgtttaaatttaaattatttgaataactcttaattttttctattcaactgcatataataattgaatcagtttatcttcgctatatgttatttcttaatttaatcatttaactataaatataatgaatgatttcttttgtgctattaaatatttttcattttattaattttgaaaattttttgaataattttttttatatttataacaaatgatgaaaagcaattgtttttaattctgtgttttacaaaaaatttattttaattacttctaactaaattttttgaggctttttattaaaataattaaaaattttaatttttttcgtaagtctttgatcttttagccattttattgcaataataatgtatggatgagagtgaagctgaaattatatctaatctcgtcactcattcatgcttatcttagtaatattggcatatgtttttgtatgtaaaaagaccgaaaacttcattatagcttttcattttttcaataatctagattttttaaatttatttaaatcacctggtgtaagtatagaaatatttatataaaactaattaaaattcgaccacgtagctcgccagatttagtctcacctaataagttgtatttttttcaaagccttaacatttagctaaaatattctcaacaaaaatttactcttaaaacgttaatatttttattccaaatttgtattaattaaacaaaattttttaattacataagtattgggtgttattatttttacatttttcgttaatttttataataagtattatattattagcttatcttagtaaataatgtgtgccaatttatttacaattaacacttcatatgttttgtaccttttcagaagatttggttgaatataatattatataatatgataactagcgggtgcgtgaaccgtcggctatttagctgggaaaaagcgcttcgcgctttgggagcttcgctacctagattagctctggttgtggagatttggaatttttaaaaaaatgttaggggtttttaggccgcttccagtgattagaagaggttcaacagtgattagaagaggtacaacagtgattagaagaggtacaacagtgattagaagaggtacaaaagtgataaaagaggttcaacagtgattagaagaggtacaacagagattagaagaggtacaacagtgattagaagaggtacaacagtgattaaaagaggtacaacagtgattagaagaggtacaacagagattagaagaggtacaacagtgattagaagaggtacaaaagtgataaaagaggtacaaacgtgattagaagaggtacaaaagtgattagaagaggtacaacagtgattagaagaggtacaacaacgtgaaagaggtcaacatgatttaaaatgtaataaataagtaattttttttattaaatattaaaaatcgaatgcattttaattttaaattattaataaaaaacaacgttgaaaattaataatatttattttatttaaaatgaaattaattttttaaaagaggtacaacagtgataaaagaggtacaactgtgattagaagagctacaactgtgatttgaagaggtacaaaagtgatagaagaggcaaaacagtgatcaaaagaggtacaacagtgatcagaagaggtacaacataaattcaaattaaaaattgtatgaattataaatttattaaattaaaaataaatcctccatttattaattgaaaataacgttgaaaattaataattgaatatttaataaatttaagatgaaatttacaaattcaaaaaaataaataattaaattctttaatgtaaaaattttttttaaataatctacaacaaatcttaagattagttaaaaacattgaaaatgacgtaaaaaggcatataaaataatttacaccggccggattcgaacctgccgccccccccccccagaagatgactcagaatctccaatcacacagggattctgagggcttaacgatgtcaaaagtaaaatctgatcacgtattcgtgatcagcggcccaaataacccctaaagacatgtttttggaagatttttgtcgaaaaaaatttttcactcaaaaatcctatactcacccctttggtcccgattccctaaatcacttttatttctataacttttttcaaaaaagtgataaaaagctaaaataaaatttatttggtagagcaaaaaattgcggatttttgttgtatattatttttacaaaatgacttttcagaaggtagttaggaatttttttctgaaaattcggatttttccagaaattcttgaataactttttttcatttgaagatataaatttcaattaaatcccataaaattctcctgatttttctctatttttagagctttaattcccttaaattgaccaaaccttcactgagcaatgaattttcaaaatttaacccaaaatcccaagggccaaaaaattgccaaaaaataaaaaatttttaaaaaattccaaaaattctgaaacttaaaatagacattatattcgtactcagcaccttattttaccccagaaaaatatttttcacccccattttcgtccgaaaaacatttccgaaatttcaagggggcctagctcgaaattttt

SEQ ID NO: 21302 - DNA, 1735 bp, Heterodera glycines
ttgtcaggttcctgcgtcttctcgactgtgtccacctttaggttttttctccattttttctttttgccaatgttttctttcagtgccaaaatcggttccctttgtggccatagttttgccgacttttccctctcttctcagccgtcccttcaagaacaattgatcattctaaaggtgccttcctccactttctgatcatttccttttgtttagctgatcgactcactccctgatcagtccttttgcgtgcgtaactttttgaacgatggacaaattgtggtgaattccgtttgtgcggacgaatgcgcgacggaaaaattggaagaggcgacgaaaacgcacggcaatttgccagaaatgaaagtgaaagtgtccggtcggtggcattttatttcatttggcaattttgagtcgattcacagaactgaccgacggagcatgccaacagagcgatttgaacaattgcgacaaaaaggcacaatgtttgccggaaggactgcgctttcggtgccaatgtcttccgggcacaaaagacacttcaccggaggggcaaggccatcgatgcgaagggacggtgcttttacaaacgtaagaaaagtgggggggggagggacttctggcgttgatcggcctgttccgatcattcctttgcgtccgatcacttcgtcgttcctccgactgttcagttgcaccaaattgttcggcgtttgtctgatcgtttggcttctcatgctgctgttgctctgctttcttctgcccattttttcgcttctctgtcttaaatattgctttaaaatcgatccgtttgttctcagaaaccgttttcggcactttttaatgaatttactgaacaaattggtctgatttatcaaacaactctaaaaccattaatagtttgaagtttaagaaagggaagaaatcgccgaaaatagtgccaataataaggacaagtcaaagcgaaatcgagcaaatgcgaagagaaagtgtgaagccgacgtggggagacgaagcaatcactttgaaggttggccatcaaaaacagtagaaggaccgaccgattgatccaaaacacaaagagtgatcaatccgaaaaataaagattaatcagtgaagtgatcagtcggatcagaggggaggggcggatgagagactgcgaatgaatgccatccctggaaaagataccgtcaatgaacaatgggcttcgtcaagcgacaattcattctccataccgcttgatgccatcagactcagaggaatatttaatcgttcaagaggaagagggagaggagcaaaaagggaaagagacagtgagagaaaagggagtggatgagagagcggaggcagaaaagagactggcagggaagcagacagttcgtcatcagacggaacaatcttcaaaatcgacgatgcaaagcagtacagagacgggactgatccttatgccggaagcgaaactcgggtcacttccatcagcagacgcaatgacaacgaaaagcgaggtggtagtggaggaaacaacagaggtagaggtacatgaagagggcgagagagtggaggaggaagagaaacagaggactgagagagaagcacccgatgagagagaggaagagaggccaaagagtgccgcttcacggacgggcacaccgaccatttgggatcagtacaaaatactgggtgatcaattcgcaaaatacggatcacttgaaatagaaagtgagaggggagagggaaaagg

SEQ ID NO: 21303 - DNA, 1355 bp, Heterodera glycines
ttgggatcagtacaaaatactgggtgatcatttcgcaaaatacggatcacttgaaatagaaagtgagaggggagagggaaaagggagagacagagagagaagggtcaataaacatattgcagagagaaaagaaagtgtgacggaatcattggaagaactgatccaaaaacaagaggaagctaaagatggcgaggagagagtgaagcatgccattgctggcagagagacggcagagagaagagggcaagaaggaatagtggaggaaagggggagaatagaagagatggagcagtacagagagaccgataaagaacagcaaaaaaagggagaattaggaaaaaagcaagagaggcacggaatgaagtggggagaattcgaagaggaagaacgagaggaacggaaggaaaaagagggggaaaaaaaggaaaaagagggggaggaggaggaaaaggaggagcagcggggagaggaaaaggacgcaggcaggtccatcccagcggacactttacgcgagggtgccttgagcatcggctttgtgatgccatctcaagtcggtgcccagaggaaagtgctgacccgtgccgctgatcagtctcatgccgccccgccttttccgcaaattaaacgtcgcgcttttggaagtaaaacaaaatcttaacaaaagataaattgaaaaagaacattttagatgaaagattattcgagaaaaaaccagcagaacctaaacaaacatttgtaaagaagccgatcagagggactgattttgtggtggtcaaagggcgagcggaagaagggaaggaagtgagggagagcacgagatcaatgatgggacagaggaagagagacgcatttgtgaggggacagcagagagatgcacagatggaagagactgaacggatgagaggagagtcccaggaagagagggcactgaagagagagtcccaggaagaggggctaaggaagagagagtccgaggaagagagggcacggaaaagagagtcacacgaagagggggtaaggaagagagagtccgaggaagagagggcacggaagagagagttatacgaagagggggtaaggaagagagagtcccaggaagagagggcacggaagagagagtcccaggaagagagggcacgaaagagagagtcccaggaagagagggcacgaaagagagagtcccaggaagagagggcacgaaagagagagtcccaggaagagagggcacgaaagagagagtgccgagtgagtacactcccgatggccttgagtaagggaggacaatcgccgatggaacagctgttggctacaggttaggcgaatttgtttcacatggtgccaaagtggcgttcgat

SEQ ID NO: 21304 - DNA, 2479 bp, Heterodera glycines
cccccccccccctcccccctatgagaggggtgccgccatattagcaccagagaaagcaaccaattcccgtggcgttggcttctgctttgttttcttttgtgccccgtggttcgtccccatttgccgtgccgtggggcatcatttgccctccccccttcgccccctttgctctcggccaacttcaaatgctcggcaattgggtggaaggggaggaggagaggagagccccccagcagttcagtcaattattcctttcaacggccccaatttcccccccccccatttctttgccccatttttgctcacatttccctcccgacattccattcgcttacattaaacattctccggctggcgacgacgacgatgcgatgctttgccatgggaattttttattttcgggcactccgacgcaatggcaataatactttttgggccattgaaattgacggcggagagatttatttcaaaagcgatattttgccctaattagtgcttcagtgaatttgcaaactaacgaatgaatgcttaattagagtttccctaatttattccttttataacaatgtaaaatataaaataaactttgctaatttaattaaaaactcagaaaatcaaatttgactgaattaaccgctgcaaaacataattaaagtgttaatggactcctcggcaacttcaacggcactccaaccgaacttctccgcctcgtcctcctcctcgtggttggccaacaacggtggagcaaccaccaacaaattggatggcatttgcaagcgtctttggtcgtcaaagtgccggaatgggaacggcacaacggccaaggaaaaaagggtgagaagggagcgcggagaataagaagaagggtgtacggtaggaaacccaggggcatacggtgccacctgccaatcagcagaaatgaaataagcacagaattggcctatttttaagacctcggaatccgttttttttgtgaatcgccaatgtctaaaatttcatggtaaaaatcctcttttcctatatttttagttttttgtgcgggggaaggcccaaccgttttttggccaattaggtatctaattaatggtgatttgcattttgcgcacgcagtttcgctgctccgacttcaccattgaccatttgctgttcacagcgccggcggaagggcgacagaatacggcggaacgtaaggaacaaaagcggcagccgaagcggacgaaaacggcgaccaatggcattggcacgggtcaaatgacggcacaaaacaacagcagtccggagcggaaaagccaacggcaacaaacggtgccgaacacggtagagcaacaaacagcaaaatgcccgacatttttgtcctcctcggcgccttcgtcaatttttccgccgatggcgccgccgcctcccttcattttggcaccgccaaattggacgacgatggcaaaaacaatggaggagaaactgaagcagaacaattattggatgctgatgaccgcgacgacgaccactgacgacagaaaactcggtgatgaagccgtgaatttcgaggagtgcaaaagcaacagaaatggcaaaaacggaagcagttttgatggcgagtgcccacggcaattttgcaaagtgagcccagtgccaaatttggcatttctctcggttggcataaatttttgggatttttttttggttcagttaaaaaaacggacacattttcactgcaacatttgtgaccatggattcagctccaaacagcgcatgtccgcccatttgctaaagcattcgtcgaccgccaattccgaagctacaaaattgacacataaaaacggccataaattgtgattttacggagaatggactgacttccccatggattgaatttgcattaaaaataaatgagtttaattgaaattatttatcagaccgaaaaacagaatttaaaatttaaatcctacaacattaaaatgtgtgtgttcgtcaccccttgacaatggccaaaaacgatgcacaaatgaattttgttcatcagtcaactgctcttcggttcaggcgctaaataaaattggactgtaaaattataacttttaataatggaaaatcataatttgtatcctttagttttttagaagaataaaaacaatttctccattttattaaaattatggattgtttaaatttccggaggggagacgaataacgcctgttccataaatgtgcgtccccatttgctttcgttgctcccttcccctcaccctgcttgaagttgtgccatgcactctgcgagtgggcaatgccaacgcggacggagtgcaccatctcatttgggtagcaaaaggcggtcattgtcagcagtccaatcgaaaaataggaacaataaaaatcgtaaaacttaaaaaatggcaatttcatgaaaatttttgaaatccaagccaaaaatattcaaattaaagtgagataaacaaattttaccaaaggataaaatgtgcgg

SEQ ID NO: 21305 - DNA, 1230 bp, Heterodera glycines
  misc_feature (1152)..(1152): n is a, c, g, or t
atttccgttttttcatgtccgattttgagttagtgggcgaaacgtccgattcagggttagtaggcaaaacgtctgatttgcctcagtaagtataatgtccagtagatgaaagtcgtcgttcctttgtggcccaaccaaataagccagttgacagtataatcatgagctcaaccatgtgtgttcctggccgtctcattcaactaaaagatgaaattaacaagacattggcacaaatattcttaccaggcctggttcctcacgactggacaggaataagacctgtaatttttgatagaaaattaatgatcaatatgggaagagtcatgacctgtgcctaattaaatctaattaagtagtattgattgaagaaaaaacagagatgagtcatcgacagttgctgatgggtgggtgactcatcgcagggactgaaatgggcgcccgttgccttatttaattgtatggtgtcagtcctcgctcgccgcacgcgtcccccactacgggagttggcgcccagcaagcctgttctatatttaggtcgcgtgcgtctgcccattttcccttttttctctaccatgcaatcttttcgctcgcctaccgtatccaaactgcaaggccaaccaatcagcgcttgacaacgtggcgctcatcgtctggggtggtgtttaaaaggaggctctccgaagcagaattttcattcgtcattcactgggaccgcttctattccttcctctcatccctcctcctcccgctcctctgctcccctctaatatacacttccatcacagccctgcctctttttatatatgcttttctctcccatttatttcttatttgcttttctttccattccctcccttaaaatgttatatatttgctttcctctctctcccctcccttcctaaacatgttatgtgtttgctttttcccctcccctcccttttcacttccattgctttaatactcactatcacacttaacatctctctcctttccatcgcatcctttcgctccaattttgctataatgtccttctgcttgctatgcacttgcacaagtttctcatcaatttttaatttagtttcagattttcaaaattttgcttttcaccatttgtcttcgttttattttcgttgtagagagggctcgagaccngcgcattggttagcttctttgtcactctgtcagtgttgtgattgtgtttgtgctgtatcttcatagcatcgcaaaaag

SEQ ID NO: 21306 - DNA, 1171 bp, Heterodera glycines
aaatataatttatataataattaattttaaattttttataaacaattaaatgcaaaaaaaaatgctcaatcgatcggcataatgagcccaagctcgtttattccctacgaactacaccaataacaaacgaagaaacaaaatgattgagcactaattaacgatttttcatttcaggtactgatcagtgatcaaccgatgaacaccaaaaagccgagcgcaatcaaccgggaggcgttgaacgaatcggtaagattttgctaacattgaacacttattaaggctttggaaaattttcaggtttcggcatccccaggacacggcagcaagtcaaaagatttccgcaactgcaacgacatcaaattggccacccgaaaaacaaatgaatgggggaaagcccagctgaagggttgcaccaaagaactgtgcattcgttgtgtgctcgacgcggacatgtactaccgaaccatgcacatttatgacggacatttggccaaaagccgagacgcctgcgaacagatggccaaggagaaggcccagttggcggaagaggtggcacggcacagacgagacagaacggagttgaccacaaaataccaacagttggaagcgctgctgcaccatgaggagcagggacaacagcggcaaatggacgacattctgaaagaaagaaatataaaaatgggagagttgcaggcgaaggtggacgaactcaccggcatcatcgggcagagagatgccaaaatagcggaaatgaccaaccaattcgcaatgacaatgtcaattaagatggagaaagccgaacagaagcctgaagtgccgaaaaaggttcatctgttggcactattgcagtttatacgaccaaaaaaggatttgacaactctaatgcaccataactttttctagaagcatccaaattaaacattcttggtatcattcgatagcctcaagagttctctattagcctgcaaacttccaaagaacttcgttgtgtttcaaaaaatgtgatcataatgttcgaaaattcaacttttcgttgttttctggccataacctttttgaaacaaaatgaaatcctttgtaattttgcaagctaataaaggacattttgggctatcgaacgataccaagaatgttttatttggatgcttcttgaaaaagttatggtgtatta

SEQ ID NO: 21307 - DNA, 3192 bp, Heterodera glycines
  misc_feature (3042)..(3042): n is a, c, g, or t
  misc_feature (3119)..(3119): n is a, c, g, or t
tttattgactcgtgtggcataatcatggggacaaaattcgacagcgtactgatccggcgaagggaatgtaaaattattaaaaataaaataaagaatttaaaatttaaaataaaaaataataatttaatttagcaaattccatcgcatcggatacacaaagaaaagtcaatgggaagtgcaaaacatttttgaccatttcaacgacttttacatggaaaatgaacagttaaaggagggcactttcagcagcagaaaatacgatttacgaaaaaacaattgcattgatttttcaaaggaatttgttgaagcgttgttggagggcgacaagcaattaaaagtgggcaaataattaaaataataagcaaaaaattattatttaaattatttagtttatgctcaattcctatcgttcatataagttggcagctacctaaaaatttttggaaatttttgattaaattttatgttttttcgaaaaaattcaaaaatctcgcaatctagcgcgggacccgaaaattttaaaagtgtgattgcataaataaccccccgcgggatcccgtcctgcaagagttccaatcccgaagctggatcagcaaatttgaatttttgattcaattagtgaaccaagacataaccgtaccgatgagtcacaagcccgcgaaaagcggtccgcaattttgcggtccgcataagtatcatgccgaaaataaaaaaaatctatggaccgcttaaaaacccatcggataccgtgtcatttgctagagcaaacattggcccccgcgtgtgctccgacaaccgcccatcaatgacaaatcgtgcggtttttcgagctgtttcatcccaccaaaaatgccagaagatcaacatgacaattaagaaaaagatggatgaaatttacaaaaaaaaagagaattttgctagcatattctttgaatcaaattatacaaattgtcatttgttgcatcattaaaatttttaattcattcatttaacaaaatttattctatagaaaaattagacaacaaaaaattcattccatatatgcaatcaaatatttattaaaaaatgcaaaaatatatttaaatttttattacattgcgtaagtatttttttatgtttcactaacttcaaacctttaatttaaaatagtaaattataaacaagaaaaaaacatagaattttatttgttttttataacttacttctttttattaattaccttaaaacattaattaattctatcaaatcaataattgtcgtttattttacttgtatgcgtttttataaacaaatatttttcataaaatttattattttatgattttgtttattaaaaatgcttatccccacaaaaatgccgttaattaatcttggctttcccattatttgtgctcatttttgccaaattttgtcaaatcctgacgataacagagcaaatgaagatggacgccttttatcattcaaccaaatcggcgaatttattgaggctattaaagagccaaattttaaacaaattatcacttttggacgcccaacagtgccaatcaatgaagtcactgaagaaagcgaagaagcggattggacagacaaattgggtatgatcaatttaaagtgccgatttatccgaactaaaaatttcatgatgtgttgtcctctgttttcggctcggccctttaattttcgtcccaggcatttggccatatcaagaagccaataaaatggcttttttgtcatcatttttacccccattatcctcaaagcataattagattatttcctgtcccctgaattcgtgtccagacatttgcgcctcggacatttgcgcatatgtcaaaaaatcgtgttcaaacttagatttttcaatcatagaggtctttaaactgcattaatttaagaaaacttgttcttttggtttattaggaacagtaatgacgtgttgtttgaaaaatttgttattttttcataaatttgctgacgatcaaattatcgaatacactcactttcaactgcttatttaaaactgtttagtccatctaggattgaaaaaatgtaagtttaaaccgattttggacataggcgcaaatgtctgatgcgcaaatgtccggggcgcaaatgtccggggcgcaaatgtggggtaaccccttagttggatcataaatccaagccataattaggtaactttacttatccatatttggccatttctacctctctgtcccttgccacacagcatttgcattaatggctaaattatgcttaacaaccattacataaaattggttaaaatattttatcctttgtttttaggcaataaaatgattcaggccggtgaacaatatggaacaactaatctgatccgggagatcaattcgcggattaacacagctgaaccaatcatttttgaatatatacgaaacgaaaacagtgtcacatgcgcggatcagcctgacaattgccaagagatggtcaaagtggcaaaagcacagctgagtgtccgactgttgatctccatggccaaacaaattgtccaagaaaaaattttgcaccaaatttacaacaatccgttacaaaaagcccgactttgcaaatggtggtaccggttcaggtagggcgttttaaaggcatttgaaaacagaattaattatcgattaaagtgtccaatgtttcaaaatcataaataattaaaattaaatctaacattgttggtatcatccaatagccctaactgtcctctattagcctagaaaattctgagaaatttcgttaaggggtcagaaaactttaaaaaactggttttcgaaacattttgcgctataactttttttaaattttaaagaaatttataagaattttctaggctaatagaggacatttggagctattgaatgaaaccataatattggatttggttcagaaagaaaaaaagttcttgtccaggcccaaacatgcggggcccaattgaggtaaaccgctcgctaccttgccataatcccaatagcccttccattttgtggatatttcatttttttttctccgctttanatcgttttcaatcgtccgccactggcttaatccttacaagcagatacacagtttcggactcggctgttctctttggntgaggatggcatttgcagtgaaattcatttgggcattttgcaatattttgagaaaactgtaaatgaatttgaa

SEQ ID NO: 21308 - DNA, 2183 bp, Heterodera glycines
  misc_feature (65)..(66): n is a, c, g, or t
  misc_feature (125)..(125): n is a, c, g, or t
aaaattcattgtatctgcaatagttgagggaaaaaatttaaaaaattaattttataaaattaaanntgcataaatttataaatcgtaaagttatttatttaataataattttttcgaaatcattnaaaatacgggcccaattatattttagagatgggtgagtagtaatgtttttaattgctattcactttgtttacatcatttttatttttgtcttgttgggtttgattgctttgcagcattttcgcgatttcctgccaaataaattcacattatgccaacattgatcaattaagatggtttttaattaaagcaaatttgcagaaaaagtaaaaaagaaaaagaaaagcaaagactccagctaaaaatggccagattttaatggacataaatagggatagaaatgcattagcgatacaaaagttttcgaaacaaaatcctacaaaagtagacacataaaaatcttaatttttttaaagtttaagtattttgaacttttaataatatttttaacttacaaaaataaattaaaaatagtagttatacaataatataaaaataattttaataaatcatatttttctgatattaaaatagaaaaaaattaactttgaagtctttcatacataatatttgttgatgggtgtgttatttagatcaaaaaaatttttatgaagaaaaaaagaaagcatgttaatttagttaacgaatgaaaacattttaaatatattaattttaaataatatcttttaacctaaaatatattaattttaaataatatcttttaacctaaaatatattaattttaaataatatcttttaacctacataaattaacactatgaaaatgtaagaaatttcttttttaatatatgaaattatcaaatatttaataaagataacttttttaaagccccagaatcaaagtcaagttgacctaaaaaaggacctaaatggtcgtacctcttttttcaaaagtgcttgtatttatcaaataattttaaaaatggaaataataaatttgttagcacagttttccaaggtgaatgtatcagaatttatgggtttattttttcatagttaaacaaattcttgaattttttcaaataaacaatttaagttcaacaaataatatttggcatttctttttaattaaattctgggaaaatacaaaaacttttcatacaaaaattactttctacatatataacaatatgcgaaaatattgcaattgtttcaatgtaatattattatcaacggtatagatgggcctatgctatttcatgtgattatttctattgtccgttaatgtgatgtggaaaattctacagttgttgaacatttacagtatgagcacttccagcattgtcgcgtacagtaacgctcgatcccacggtagcttaattggtctgtgctattaaaaatgtttacttatttaacgcaccggcttccaagagtcgtactaaaattgtcatttatttttttaatattaaatcaggatcgatcatgaattcttacgttgatcaggtggcaatgtcgatagaggtggagcaccagctaaaattttttaaatttttcaaagaattaaaatgaatttttttgggttttcagattttttgtctatgaaaaatatttgagaatatccatttttataattattaaaaattaccataaaatattccattcacttcagccgatgaaagcacatctaataaataataaaatgtaatttctatcgagtaaaattaaattaaaaaaattattttaaatttgaaattttttataaccaccagtaggaattggcgaaatgttattcgattcatttgcaggaacttaaaatttaagagtaaaaaaaatacgaaaattttgaaccatttaataaatgtccatatgattcccattcgccttcagcttgtgtcgattcaactaaaatttaaattttgtttaaaaaacaattaacagataattatatactgttcatttaaatgttacaaaatttattaaaagcttctaaataaaacaaaccatttgaaggattagcagcagaattcagatgctcatcgcttatgttttctttaaaaaagcaaaaaatttatttttttaatggtaaaatgttattttttcatttattttgaatttaaaaataaggtcatcaaataattttttttattaattttgaaacc

SEQ ID NO: 21309 - DNA, 854 bp, Heterodera glycines
ttaaagagtcgatgcggggggatggaaagtcaaatgtcccccccaggacaaaaactgtggtcggagtgcttttcccattcctccacaacagtttctttattcattggaaatttaaaatggaatataaaacccaacaacactcattcaaattttttccattttttaaatttgtcgcagtttgataagtggagaaaattatgcacgaaagcacataaattatggtcaaattttggggcgaacattttggtggggaatgaacgtgatggaattccgtccaaaagtttagcctcccaagaatttttgcacgctaatgaatatttgggggggggggagagatattccttgtttttagagaatttcagagttcaaagtttccctcaatttgaaaactgtcgatttcagcaaatgccatccgcttccgctgggacggttagcgtcagcaatggcaccaaggccaatggaaaccaaccgaacaaacacatgcaaatgttggctatggccggcccggctccgttcagcgactcgccggaggcgattgccattcgcgacgcggtcgactacacgcaaaagatcacgctggaaatggcatacaacaacacgggtgagcactcggcactgtccgcaatgactcaaataggaggagcctggggttattgatttggaagcggaacctgggctttaaatcatttaaatttacaaaattgaattaaaaaccaataaaaatgatgctgtattattcccctacaaattaaatgcatttgtatgctctggttcaattgtttgaccttcattaaaattagcattttctataaaccagaaccagagttttctcggctttatgattcatccatttt

SEQ ID NO: 21310 - DNA, 1975 bp, Heterodera glycines
  misc_feature (1592)..(1592): n is a, c, g, or t
  misc_feature (1736)..(1736): n is a, c, g, or t
  misc_feature (1788)..(1788): n is a, c, g, or t
aaaaaaaaattccatgatgacgacttttggcaacgcaaggacccttcttttttttacgaaatttttatttaaaaatagatttaaaaaaattcggtctaacattaagcaaaaaagatcatcagaattccctccaatacaaaatcccggggaccgtccaaaagtgaacgagaaaattaaggcaatattttgcataaataaatataaccaaagagagttttttcaacatttataggcctcaaaataccagctgcagaacaaatttgccgcgatcagacagaagggagccaaaatgctgaaggaatggacggaccgatcggacgaatttattcgaaacttcaccagcacgttcaacagcgacggaccggtcattgccaatttgttaaataaaatagtaaatgttttttcaattttcagattggccgttttctgagcagtcgcagtccgacgccggcattggaggagcaggaagaagcggcggcatcggacgacgacgaagacgaagaacacaacgaagcttaattgattcaccaacaaaaaaggtgcttaattgatcatatcaactaaccaaagaggatgagaaatgaatgatattatattatgttatcatattgtccttttgtgattttcttacaatgattgtgccttggcttgatattatgaaagagtaaagttatgataaatttttgaaggattttccgaattgtgattaaaaattgatcgccacacattttttggctttgttctgcagttggttaccatgaaaatatgctctgtaacaaaattataaggtcaagaatttttttggcacttcttaaaataattcggagatgaattttttgataaaatttttcatttcttaggggtctgaaattgaacttttattcacccattatccgacgcgaatattaaagttgcttgaataagcaaaattttattttacaaagtttgaaaatttacttttattatgcaattttttaatacacatattctctgatgatcaatacaataataatataatatactctgctcacaatcagaatttgttctctccaaatccgtttcttaaattggcatttgcctttttctgctttggcataaatggcatatatttgagcaacggaatggcctcaacggttcgctgaagtgggcccgggaaggcgtaaacatctgttgaaaattgtatcaaaattaaattttattttttaaatttatgccgaccccgtccatcggctgacaattcccacacgacgcccctctcgcgaaggccccgctgctgacgcgtggcaccgcccaccgtattgtcaagcacaaagggaacgaaccgacgaacattgttgtggtcaggccggaaacgatgaattcgggccaatgtactgtttaatgaagtcaaggcattaaattcatgatcagagaacccaagcttgaccaaacccattaattttaaaatttccgcactcaccgaacggaattgtttgcaattggtgttcagtacacaaatcctccacctcggtctgatcgaacacattttcaaatgtaatggataagcttgagaatatgagtgaatgaatttggcgctttttgttgttttttanaatcttggtgtgcgacctcaaaacaggaaataatatatttaggtaatttgcaagagtagaaaaaacaaacggcgcgcttcgagagtgaataaaggcatccgagaaatgagagagagtgtttaaaattgcataatgcaatgcttntatactatgagtctagtacacaaagacattcgtatccattaattgcatccgntggtaaccttttttcggtcattttcttgggaataattgattttgactttcattcccttccttttaataaataaaactgattatgtaaactttccaacagccaccccccttccctcccttcccaacaaacataatttttttttttttttttcccccccaacaaaaaaaaaaaaaaaaaaaaaaaaaaa

SEQ ID NO: 21311 - DNA, 1475 bp, Heterodera glycines
gattcgggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataactctgggcgcatcggttcggggggactgccccgaaaacaaaaaaatcgattttttcaagtgtccgtttggggtactcaatcaattatggggagcaaaaatccaccgcagaattaaagtacaggctatagggaagctattcccgaaggattcggtctccccatgaatggggggggggacacgacctggagaccttcttttttttttgctatttaaccaattactttttttccactgctgggtaacaactgcacttttttttcactaaaaatgaccaaattttggccgttttaaggaaaaaaacttgtaaaaatagtggaaaatgtaggtccggcggtgccgataggcgccgccggaaaaatttttttggaaatttgagtgctacttgttacgaaatttgcctattaaactttttaattttcgtttggggggggggaattcgaaaaaaatttccattatttgctggaaaatttttaaaaatttcaaaaaattccacaaatctaaaaataccttaattttcctcaaaaatctgtggccaaccccacctttgtccttcttccatttgtccaagtgttcaggcttcagcacgcgcatgtacacgtgcatttcggtgaacaacggcccattggacggcggctccattttgatggccacggcatgacgagaaccgctctgaatttacagaaaattgagacaaatatatttgaaaaaatctatgaatttcagtgccattaatgggaacatttttcttttgccaataataggtacaaaaagtagaatgataatcctttccatggaatcgaattgaataacgacctcacctgaacgccctcgtatatccgtccgaatccgccctgtccaatctctttgcccacaacgaactcctgcttccgaccgtccacaaatttggtgccacttttgacaagcactgctttgtcgtgcaaccgtggcacttttcttgcgggtgccatttttcttgtacaaatagaatttggcacaaaaaggtaacaaacttttttaaatatttaaaaggaaatatccccaatgataaaaacatatttcaaaaatttgtttagcattgtgacaacatttattgaatgattgaatttggaataaagaaagataaaaac

SEQ ID NO: 21312 - DNA, 1804 bp, Heterodera glycines
  misc_feature (5)..(6): n is a, c, g, or t
  misc_feature (16)..(16): n is a, c, g, or t
  misc_feature (32)..(32): n is a, c, g, or t
  misc_feature (64)..(64): n is a, c, g, or t
  misc_feature (93)..(94): n is a, c, g, or t
  misc_feature (1753)..(1753): n is a, c, g, or t
agggnncggaccccgngggcggggggggcttnccacgggggcgggggaaggcgggggacagagncgcgggggcggggacgggggcacgaaaannccgccccagcgggggcgggggcgggggtttgatttgaattaactccaaaaattttacaaaaaattaattttttatgaatgatgtgatggctccacattcctttagtcaatgtatcgcctcaattcaattctctttggcataaattaccttagattttgtctaaagaattaccaaattttagagatttttggctaattttttaagaaaaaataggtttttggggggcccgcggtgccgataggccgccaggcagattttgaaatttaagctcgatttctaacagatgtttacaaaaaaaataaaatttttacgataaatttttgtttttttaatatattaaattatcatgatttactcaagcaaaattggaactcagatttgtaacatattttcttgtggcacatttttccaaaaaaaaaacttggtgaatgtgcgagcgtagaggtccggcggtgcagataggcgccgccgggaaaattttttgaaaactgatggatctgttaatagattttgtccaaaaaatgataggtttttgcaatttttagagaatttttttaataagatttacgaatttttgggccctgccatgccgataggcagcgccaggcgaattttaaaattaaaaaaaaataaattaaaaaagaaaccgtcaacctgaatcgaactcacgacagaaagtaatgtcaaggttgattcactaaccactacaccacactacacatcaatgaccaataataaaattaactttaattcataaaaaatttgtcgaaatggttaaaaaaatcaaaattgtataaattttttgccttttatccatgaatatgtcattcttaggggtgtattttcacccccgtgcccccgcgggggcgaaggtcgcgggggcgggggatgcgggggtcagagtcacgggggcggggacgggggtgagccccaaaaacctgtcccgcccccggggacgggggcgggggcggggtccgaaccctactttaaatgtttgtttctttctaattccctttaaaaatgtaaatggtatgcaatggctcgaagatacgcaagcggctcgtgatcgtcaaactgttcgacaattgctcttagattgttatcctgtcgaactggtggtcaaattcgatgttcaaaagtgttcgcaaaaatttctgttaaactccctcccactttccatgtatttttaaaccagggcttccaccatgaacaccaagccagaaaaataagattttaggctcaaaaatatgaacaatttttttaaatcagttagtattaaattttatatttttagtctcccattataatttttaacaattttgggaggaaataagcaaatcgtacatttaaatacaatcggctcaaaaaattagaaaaaatgagggcacacctatgcgaatttatgaaaatattttttatttatcttatggtattcgagagtctcagtgtcatctctcggtcttgagattcgcgaatttccgataccgaaaagcacttaataaattgaaacttaatgagcacttaataaattgaaacttaatgagcacctaataaattgaaacttcatgagaaatttcataaaacaattatgggtactgaagattgaaactccatttttggaaaagttttaaagaaacaattttcatttgcttctcattncatacaaaaagtaactttacctaacaaccaccaaagaaaacaccttgtttt

SEQ ID NO: 21313 - DNA, 1282 bp, Heterodera glycines
cgagaggacgagaggcgagagtttttcaattttctctgcattcttgtttttaatttaaaaaacttcaaaatcgtatattaaattaggggtacgggcctgggtatttgggcaaataccgggtcagggtattgccgggtacagaaagccgggtcagagtcctagtttttaaaccgagtccaagtcatgaaaaatccaaacaaaaatctttaaaattttttcatgaaaattaaaaaatattttcatgaaatatatttattttagaaacaaactttattatttgtccattttttccaccttttttttgcggtgcgttttttaaaacttcggggacagttggggtcgggcggtgccggtaggcgccgccgaaaaaattttgaaaattgtcttcggatttgttaacagattttattcaaaaaatgaccaaaacttgttttttaaattttttgtttttaagtcgctttttttgtggcgctgtttttccaaaaaaaaattttttggaacattgggtgcggggtccggcggtgccgaatcggcaccgccgataggcgccgccggaaaaattctaaaattttgagtgtaatatattaacagaacttgtcaaaaaatgatcaaagttttggttaaatttgcagttttaggctgtttaaaaaaagaaaaaataataatttttaaattgaaatattttttattaattaaaatttcaattgaaaataatttaaagaaattattaaaaaaattctgtaccgttggggaattgaacccaagagaaaaataatgaaaggcagaaggtttagccagcagaccatatttgaattggagctatccaaaaatagagaaaacattaaggaaggaaagaaagagatttaagatttttttttcgcgtaaatttgaaaatttttctggctgctcaaaagttcaatctttaggggtgtattttcaactctcgcctctcgtcccaaaaaacgagaggcgagagacgagaggcgagagtaccaaaaatggcgagagttggcgagaggcgagagacgagaggcgagagttgtcccacccctgctccacatgtattcatcgaataactaggcaataagttctacaattcaatcatgcccttagcaatatctgcaaaaaaaaatatttttttttaattttcgaaaaatgccgtccgtatccgggtcgggttcggggttcgaaactgagtcaaaacatggccggattcgtgctcggcgcctcagattactcctaaaaacaattttctcaaatttttgtaaaaaaaaattttcgg

SEQ ID NO: 21314 - DNA, 732 bp, Heterodera glycines
ataccaatttatgaatggattagtgcacagttaggctccgtttcctatgaatattatgccaaaaagcggctttaccaaaaacaatcgaacaaattttatttatttttcctttttatttttttatttgattttattatcttttaatttttataaccattttattggagacttcaacagtttttttttgaggtttccgtttttcccacctaatcacacaaagatgttactggccaagattttattaatggtcgtatcgtttttctattgctttaaaatcagcgataattgttgatcctgaaaaagccataaaatccgtcatttttttaaattttataaattatccaaaaacaattttgaaaattttataatagagttttctcaatcggcttctcattcataaagccatacaatcccggatggcttagcttttcttctcaatccaattcattctcttctgttccattttggcatttctgtttgtacacacacacattatatttattattttttttaatgacaatgccttagagccgcttaactaattggcaaaagactttatcaaaaaaaaggaaaatttccaagcaaatttgatcttgacaagattatatctcgtagttggagagggggggggggatatccccaatcccctcaccagcacccaccgcttagctttcttgccacggggaaagacttaacaaaacggccaaaaattgttatcccgattcggggggg

SEQ ID NO: 21315 - DNA, 1539 bp, Heterodera glycines
  misc_feature (78)..(78): n is a, c, g, or t
  misc_feature (99)..(99): n is a, c, g, or t
atggcatttttgtcgggagaaaaatgcgcagcatttccaaaagtaataccattagcaaacagcagcccaaggacgtgnacttttggaataaaagcgatngtataagggagggagttactattgagcttgttttaaggtccgcggatgaggtgacatccaatccgctcccacagaattaattgtgtgaggtgctgctgcttaatgggcggccgccggggccgtatggatttgcatgggaaatttattgttttttattattattcagaattaatatgtcgcgaaaatatttggcacaaaattggcccaacatttggcctcgcacttgtgtcctttttcccttcaaacaatttttgttttgaaatttttgagtgtttttcaaatgattaggaggcattaaaaattgggagcacgacaaaacggctttctttctttctcaaaaccaaactttaaataatataatgcaattaatttttgtcgcgaaagaaaaaatccggtaagcttttgtcgtgctatgaatttttaaggccccctaatcatttgaaaaatccttaaattttcaaaataaaaattgcttgagggcaaaaagaacataaacgctgcaatcaagtggtttgagttaggcttggtgtacttgaatttgaaaacaaataccaaaaaaattaggcattaattgattaaaatgaaacaattttttaaattttcatttcattaatttgttttcgacttttacataaaatttcggaaatggtttcaaaaacttttcttcattttaccgtatgacgttcttctgctgtttgcccttttttcctcccaagaaatttaatttttgttacgatattttcaatctcttccaatcggtttagaggcggataggacgctttggcttaagttatcttctgctccccccccccatatccgatgatgaaaaaaacagaaaaatattgtaaacttatttgaaataaatggtgaatttttaaaattggttattaaataaattatgtttaattctagtgccaaaaaacaattattggaccaattttgggaaaaaatccattatttttttggaaaaaaaaaagattttaggctattaattttactcaactaaccaaccaaagaatttgctaagccttttcttataagtctataagcaactttttccgcgcataagcacaacacatgacgcaatgccctattagcctgaccaattttggcactttttgatgctgttggcactcaccattttctgtctttttggctttttggcgatagaggcgggcccactgcatacagtatacctttcgatcctgaaaaaaagggggggggagcaccggcagcagcgggtcggattgtaatgtgctgggagcgcccccagcgccacaaagatgataatatttgctcatcccccggaagaggggagtggttaaaaaggtatcccatccatcccaaatgcatcacaccaggccctaagggttttgggggataggataggatattgggcgaatggggtcccacggcgacgaatcgctttaaatatgggca

SEQ ID NO: 21316 - DNA, 2390 bp, Heterodera glycines
taagcattttgattttgcatttctcatcaactcggccatattttattggtctgatcacttttgttttttcattcactcttcaatcaccgccgcataagcattcgcattcgatcatttcatagttcggtttcatattccgatcactttagcccttttatttggcgttccttaacgtttatgatcattgcgcactcatgagtggggagggggaaacacagtgcacccgttaaagcgttttgattttgcattctgatcaacccggccattttttattggtctgatcacttgttatttcattcactcttcaatcactgctgcaataagcattcacattcgatcacttcagagttcggggagaacacagtgcacctttttttacacgatcactttagggtcttttgcatttctgatccttttactctgtattcgtttcctatgtttattttgcatttctccgtatcattaatacagtttaagcaaaaaagtgttgaattttccagcttaaatttttgccgtaccaattttttacaatgtaaaaacctgtgcgtcgagttcttttgtttggtaaattgggttgtcgagacaatagaaatatttctcgtcgtctttgaatagacttgaatcaggattccgagtctgtatccgggtcctttcctcatcggcccggattcgtgccgcgcttagcctgcacgcctcatcataatcctcgtcattgtcgaacgagtcatccgtaattgggtttttggattatttttcgagacgatttcctgcaagattatttttttataaaacagtttttttatttatttaaagggctaccgtatttcatgatttatttaagaaaaattcagagttattcttggtaatttgtagtattattaaggctacaccctaatttgagttttcgcctacaaagtagggattttttgttgctttgcccctatttttttaaattcattttagctttttaaaaattcctaataatattgaaatactatataaaccaacagtaatgattaatgatgcaattttagtctctaaaaaccgacaaaaaaggtaggttttatgtcctaaataacccctaaaacgggggcgggggtttgtttttaattagctccaaaaaatctcacaaaaaattattttttttgaatgatgtgtttggctccacattcctttattcgatgtatcgcctcgattcaattcttttttggtatacttgcacagatattgtctaaaaatgaccaaatttaaggattataaattatgtcagaatagtcaatttttatgtatgtttttgtctaaatccagggtttctatttcaaaattttcaaaataagaataaaggcgaaaaaataagactatggttaaaaacaagaacattttgcaaaattgtttcaaatatttttacattttattcaaccaaaaatgtattctattattatatctttcatatatttcagtgcattcgggatcactaaatcagatttttaacattttttgccgcacatttccgaaaaacttggtgaatgtgcgaggggagaggtccggtggtgccgattggcgccgcaagcggaaaatttttaagactttataagaattttgttagaaattagccaaattttttagaaatttccctttttagatgaaaataaggtacaaccccaaaaccagaacatttcttagaaataacaacatagaaaaaccctgtattatttggaaaaaaaaataaaatcaaaagaaaacgttaaccggtgtcgaactcataacaaaaagtattgttaatgttgaagcactaaccactaaaccacaaatattttaaaaatatacgcaaatttattttatttcataaaaatttgtaaaagatggttaaaaaattcaaaattgtataattttttgcctttaattccacaatatgccattcttaggggttaaaaaattcaaaattgtataattttttgcctttaattccacaatatgccattcttatacgaaaaacgaacacgaaacgccttaaaacaacaaccctggtgtgtacataaatctgcacatttctgttctgtcatacaaaattaagtattaagcagctattttaattattaaagtttttaatcgatatatttaatcttttttttttaattaaaattgatttccatcaaattaaagaaaataattttttgaaataaaaatgacgaattttaaaatcctcttccacctcctgtccagggatgtacaaacaatatatcgatctatatctatctgtttgtgagctatatctgagatggttataaatcactgcagcagctgatatacacatagtaaaacgaatgtttgtttgtttatttgttcgggccgtccgtcgatgattaattgggggggggggctttttgggg

SEQ ID NO: 21317 - DNA, 3293 bp, Heterodera glycines
  misc_feature (100)..(100): n is a, c, g, or t
  misc_feature (122)..(122): n is a, c, g, or t
taaaaatgcaaaaatgccaaaatatgcatttattctcgaaaacccccaaaaatatgcttttatatgcactaaaaaccttcaccaaatcaaaaaatttacngcagaaatgctatttttgagcncctttcttcatagcatatgagcagaaaaaaaatgcaaaatcatacaacttataaccctagtaattgtgcgggcgaaaataataaaaaaaatcagatttactgggagtttattacatatttcagaatttatagcacataaaaatccaagttctcttcttataaggctcactattatagaccaacaaaattttaaaaaaagtaataacaatcctcgagcagcccataattaattaataagatatttattagggtttttaaaatgaattttttttaatagaaatttatatggaatacacaatttctacggaataaaatttacatgttttacttgggcgaatttaactcgtcaaatcccaatgctcccggtgctggtttattcttgcgaggaatactgaaatcaaatttgccacaactcgatgacacacatgtgtaagttgaaatccgtgagcgaatattaaagtttttactaatttttttctgcggctttaattcaatgaaaaaagtgcataaaaatacatttttagcgcgaaaatgcttaaatgcccctatccgtcccaaggaatccctattttgaacattttggccctaagtaagggcgtgcctatttcggcaccttttggaatttcgcccttatttcggcattttttaaaaatttattactaaaaaggcaataaaaaagcacccataagggcctgcctgttgacctcttgaatttttcaaaattttgttaaaagtaacaaaaattttctgatttttaaaaataacgtaaaaatgaaaaaattaaccgaaaagtcgaattttcggaaagaaaactttttttctttttattcaggaaaaagatgagatttaattcttttgtaattaaaaatcgtgatttagggttcgggaaaagggatttaaatttcgggaaccgggattttcaattcgtgaacgtgctttgtaattggggatttagagttcaggaactgggattttgaattcgggaaacagaatccttagaaatgccgctattaacccaataataactttattgattcattaattgaggtatcgaatgacattatcaaagccccctttggtgtctttgccttacatgtccgacaaattgctcccatttgtgcccaagtcggcaatatattcgcaactttttgtttcaaatcaaacacaaaatgagtggcacgaggacacattccgtctaaaactgaatctagaaggctgtaagcatctgtggaaaacaaagcaaccgcaaatgatgtttaaaattgagaaggtaaaaaaaatatggcataccatttttttgaaaaaccttttttggcgttacttgcaaaatttgtatcttcggaattttattaaagggatacaatttttggtgctaaaattgacaaaacagtaagttttaggttctaaaaatacctaaaaaggtgctaaaatttgagacacataattatataatttaaaattcttgtcaaaaaaattaaataaattttgaagatgaatttttgagaaaatttttcatttcttcggagtaattttttcttttgaccatttattatataccccaaacccgaactttagcaaagtctaaaattcaaatttctcgttttcatttcataaatttacggcttattttaaataatttttcatatttttaagttaattttttaaggtgttgttagcggaatgtcccttctgtctacagtatacggatgacgaagataaattaccacatcgattaaaagcgtgcaacgtaaaaatttttcataatgaacactgaactttttcaaattattaaagaatttagctggcttcttttaaaacaactaaagccgagtcgccttttaaagcatatttttacaactgaagcacacagattaatctgtgacctgggtttcaaaatacaaatctagagaaaattaatccttttaaaatctaagcttaccaaaaacagcctgggtctcgatgcagaaaaaatctcatgtgtggatcctgccagatccagtgtcgatctgtaaccactaaaaggtaactcaaccagtgagacttgaatccaccgcatttcgctatcacaaaatcattaaacttaaataatatttttttatttttagcattttgttcacgatagttgtcttcaaaaaaggtgagtttatgtgagcaggagtgttgaatgtcatgcgtagctcagttggttagagaatccacgggttggaagggtcgtgggttcgttttccaccgcgagtcaatattttatccagcttcatcattacaccaatatgacaagaaggattgtgcactaacggattgtccacttattgtttatatactacggattctccttcactgatggattatccaccaacggattgtccatttatggtttatccactaacggatttgtccatcactgacggattgttcactcatggtttatccactaacggattgtccactgatggtttgtccactgacagattgtcttgaagccccaaaaaacctcgagaacgttcttagcagttttataccatcgcgctcctcacaaaccagtttttttttatttaagtattaaaacaacggataacaagatatgtccagtgtgtcgtgaagacattctgtttctggaatccggtaaaaaagaccaaccagcgcagaccaacaccataaaaaaagtggtatatcggaagatgaaaaaggaaacggttcacgaatttgtcatcagacagccggtcctccaaaatggcgaaggcggtatccgttttacgtacgaattagagctggatgaaaatggcaaaattagtgaaaagaatgtcaatgaccagtcattgaaagtggttgacgaaagagcggtaattatgtttatataatttttaatttaattttaatcattagtaaaatggcattgagtttaaaaaaatttatggactgattcatgatttattgcatttagtgaccatactattaaaaaaaattctaaattaatattttgatagagaacacttagagctatttaatgatatttggttgaatttgagccaatttatgaatttatatgtcttacaatttttgttttcgaaccccttggcggatttaagatatgcccatagtggcggaatctaagaaacaacctaacaccatacatttgtatcagggatgggcctaaattgaaaaataaaaagc

SEQ ID NO: 21318 - DNA, 2559 bp, Heterodera glycines
tttcagttgggtttgtaccgatgtttggatggacattttccgcttttttgaccattctcaactcatcctcaaattggcactgatttcgccccgtttcaatgcgctggtggacacgcattttaatggcagggaattcacagtttggagatgtataacaattgagcaggacactgaggcgaaagtgtcaaaacttcgtgcatttattaatggcaaatttgtgcaatttccattgcctgaccgtccgctgcccaacaaaattcgctttaatgaccttcgaatttggtaatccaaatgcaagcattattaaccgttaaaagcatttcgcgaacaaaaagggcgttataaaaatgccatcaaatgaaaatctttaataaataattatccataagctagctctaaagtaacttaattttaattattattgatttcattcgatagcccaaagtgttttatttcaaaatatttcgttaagtttcaaaattatggccaaacatatttgaaaggttccttgagtacttttggccatgaccttgtccaaacttgacgaaattttttggacttgtgcagaaacatttattgttagtgctatcgaatgatatcaaaaacaattacaaatttagttgcttttgagcaaagttatcggtaatttgtttattaaaaattttcatttgatcctttttaattccttttcagttacattgaccactttgtgctcacttttctcctctccaatgagcacatttggaacaaaaggggcatttctttaaattttcatatattttcacataatgccgatgtcaaacagcaaatttggaatgtttttgccgggcaaatttggcccatttttggagcaaacattcgccagttgatcatttcaagtggcgatttgtacaatttgcatcgtctcatttcgtcaacacttctcaccgatctcaacaagctcagtaccataatttccggttgtctattgcccgacctgcttgatgatgatgggccaaatgcaactgttggccaagcgttggccaaatggttgcacactccgacaaaagatgggcaatcgaagctatttacttacctaaatgatcaactagaaaatttcgactgggtcaacgatttaaaagaagtgtgactaaatttttataaaattttggattgaatgccatttgatttttcgtttctcattgtttagacatttctccgtaccatcacttccgccagctacaaaattcaatttaaaatacggcgttaattgtgccatttgaattggtgaacgaacaaacgcacgaaaagctgacactaaagaaagcaaaggaaagtcaatgggacaaccgatggataattaagcgatgcccaattagagagacggcggcgattaattgggaatacaaaaattgcgaggatttgaacaaaatcatcttttatttgtgtggtgaccataattgccttgggtgagcagctcggcaattgccattgctttaacgaattacaaattttgcacatattttaggccattgcgccctccaccggtagacgaagaagcggatcaaagcaacacaaaagctcttttgagtgccgggccaagcaatcagtgaaaaaagtgaatgcgaaattattgtttcatgagaaatcaggggcagtcacattgatttttggttaatttattgatataattttgattcgaagagatttgccaaattaaaggggccctcagactttgaaagcctcctgacaaataagctgaggccaagtctaacagtggaacctcacgaactgtaatttggtattattggatagaacagggtcgacttctctgttgtgaatttttaatattatcgttgtgtgaaaaaactaaaaagatatgggatttcaaaaaattttaattttttaaccttcttatagattaaatggctcacctaaacacccaaaatcaagtggaaaatcgtttttcgtgcttatctatgtgtaatcaagtgcacagaaatttttagcatttccataaaatgagagccctagtggttaaatataaattgttttgttagattaagggtacacatttttttaaattttaaaatacaaaaatcaaaatatttttttgctaattttcaattttttataaagtgctcaagtttttctagcaatatttatattttgaaaatttaaaattggcgcaggaattgtccattttgtacaagctgtgtcatagcatggccaatgtgctagcgaaacacatccatcaacgttcagacgagcttttcgttgctctcatccaacataggcctaattatgcaatttggtttcaattagccatttttgacaaaatgaaaatgtgctttgctcacccaatgccacgtacaaattaaaggacgacactgttcaaatggtccgccaaatttcgtttttccgcataatcgccttctccacaaaattgggcatcgcgtgataagaaattttgttatacctcttgcacacgtggttgtacgtacctcttccaaccgtggttgtaccacttccgccatggttctacctctaccactcgtgattgtccctcttcccgttgta

SEQ ID NO: 21319 - DNA, 2326 bp, Heterodera glycines
  misc_feature (22)..(22): n is a, c, g, or t
  misc_feature (52)..(52): n is a, c, g, or t
  misc_feature (149)..(149): n is a, c, g, or t
tttccgcggcgctgttgccgancagcatgcgtaccatgcgcggatcttgcgnagcattgccaataaatgttttgtacccaggcggtgccttctccggttggggctcagcaaaatgaaaagtgagtaacgcatccaaatcgctgttctgnatcggacggtacgcgccttgcatcagccggtacacctgctgtccatctccgatgcccagcgtgcccgcgttgcgtaacgcatagtcaatggcttgtcgtttccgctgctctgtgtcacgtaagactgctgctggtactgcagttgctgtcgatgttgatggatgcagttgcacgtccgcttctttccgctgtcctttccttgcggggtcaactgccgccacattttggggtcggtcgtcgttggagctgtcttcgcgctcagtcgtctcagctcctccttttcctccattatcagtgcgtgtcaacaatgagacggcagatgacgatgacgggaagcggctagcttcggcgccatccgtagaggctgatgtcgtacggtgtgtccttttggctggtcgttgtctgcgacgtggaggctgcctcattggtgacgaatcagactgcgacgactgctgttgttgttggtgcggcgccggctgtcttggttgaggttgttgttgttgaattgttcgcgccgcctcggaaagtgcatcgcgcagcagccccttcgaggcttcgtcggtgggcagttgggtgagacgaacaggcgctggacgctcctgctcatcctccagcaattttttgaacctcttgaactcctgttggtagtggatcaaccgttcgtcatcgttcagaaggtgttgtttcgatgccggagatacgccatccgtgctctgggtgacgccgccgctgtgtgcagcgcgcgccatgcgctttgccgtgtgctcaattggcgtcatatgctgcggtaagccgcccctcgcagaggatgcgtcggcaacaggagccgagctcctggccaacaaggagcggtacagttcctccggcactaacagcatgcgggttgtgtgcttcatgtttggatgatgctgtctttgcggctcatgagcttatccgccagcagtggaagcacaacgctggccaccaagccagccaaggccgggacgccgcgcccggtctgctgtctcagcaacagtcgacgtgccccgtgtccgcttctcgcacggcccaacgcacgcacgtgttgggcctgagcgcgcaagtgcttcagatgagtgctcctgagcgggacacgtgcacggagaatatttaacgcactttccaccagacacaacaactgctcactgctcgccccactcaccagctgacgataggcacgtgcgcgtgccgagcgacagttgctcagctgcttgaaaaagctggtgttttgttgaatgcattgacttggtgttggcccttttttcttcgcttgcttttgttgttgttgttgatgctgttgttgtctcttttctagttgtattgtttctggtctgtcagtgttgctgttaccgttgttgtttccactcttatgcttcttccgcattgaacattgctgcccggtctcgtggtgcgtacacaacggtcagctcgcccggatatatatgagctttgaggcgcatctgtggccgggtggtcgggtgcatgtccaccaacagataaccaaacgggtccactgtcgcgtcatcgtaagcctcgaggaagtggcggagctcacccgggaacagctgaacgcccaacgagcgtacctgaagtgcgcccgacggattgcgcagcagcaccagatagtgcgcattgttgcgtgcaatgcgcagctcgcggacgaacaaatgctgcgtgatcaataccacactgacgccccagttgtgtgagccacgtgtgaacaacgtgtccaggaagggagcgcgcatgccaaccatcagatcgtccaacaccagcagcagtcgaccattgcactcgtttgccgcccgcttcactccctcctcgtcaggcagcgcgtggcagacacgaacccatcgaccactattaccaccactgctgctgctgttgctgctgctttttttgacaccattagttgatgttaatctaaaatcctcatttttcattctcctcctttgaccaacttctttatatatgctctcaaatttaatatcacattttttgacaatttttgagccacacatatttaatataaataagtttttatgttgaaactatttattgtttattctctaattatttttatcatggacacgccgtcacatgtatctgatcgcaaggccggcgatggtggtgggtaatgctgatgcaccggcagcatg

SEQ ID NO: 21320 - DNA, 2074 bp, Heterodera glycines
cattattgctcacattttttttcttccaactcatcctcttttcttcgtccgtccgtcccatcattttttttttgtttgtcacgtgtgtgttcttctcgtgtgcataaaaattggtccattcgtgttttatagtggtgagcttttttcggcattgaatgtgatggtctcccgccccccccccctccgcctgcggggataaaaatggcccatccccgcctaaaaatgtggaaatatctgcaggcagcagaggcgcgtttcctatttaattttggatcaactcacgtcccccctcgacttgattgcttgctcgatttttgcgcaatattgaatgcaaaaattctgttttcaattgcataattaaatctcgagtaagaaaatcgagtatgccacactcgattttagcattctgtttaaattaaatctcgagtaaagaaatctagagtgccccactcgattttggcatcatcgagtcgtaattttctattataatcaattcattaagtcgaggaattgatccggaatgaaaaatacacccagtccatccaccactgagctgtgatgatgacaaattgagcatttaaaagcggtgactcttgaacagagagagagtgacgtcatgcatttgtgggataatttattcaattaaacgggagactcaccgccgctttccccgtttcttttcgtgttaggaatgactcacgcactaattaggtcaataatttaattacataaaaaaatgctcccctttgattgaccgattttgataattttttctccttttttctatgcgcgccgcatctcattcaatgaaaaattcttggatttttttcctcattatttttgtaatgctaacaatataattttacatattaaggatggagttccgaggccctaaaaaaatttagaaagtcgaaatttgaaagtgtttcaagaacaggaaaaattatatgggcctcaatttcttaatttatcatattaagaaaggagttccgaggccctaaccctaaaaaaatttcgaaaaccggatcgaaatttgaaagtggtaggcctcaatttctcaatttattggatttcttttttaattcccggcttattatcctacacaaccaaagaaagcatcatcctgttattagccaaattagatttcaaattatcccccccccctccgcccccgctttttgtgctttttgcgtaacattttgtaaattagcgcatttccaatcaccacccaacagcagcgaaaacgaagcgcgcccgcggcctcaagcgacgactttcattattttcatctcgcgcatcaacaggcacagagcattcattcattaattaatcaacaaattttcgccaattcatcaggatgtgttgatgcagcaaacacaacacattcattaatccattgtgtatgtattatttgttattcatgcgtgtgaatcattcattcatgtatttattgcattaataaaatatttttgcttactcatgaattttttttactctttttctctgttttgtactctttttctcatctacatctccgctctctctctctactctctctctctctctctctcactctcccgtccgtttgaaattttctctgtttctctcaccatttaaaattaaaaatgaatcattttcattaaaaaacagtctgaaaatttcagtgtctctctctctctctctctctctgttttctctacgtgttcaaaaagctgaacatgaatttttttttcgcatttttctttaccgctctcttcattttttccattctctcattcctttgttttctcttctttgtggagtcattccgtcctaaaaatatacacgaccaatccaaaaaaataccaaacaatgaaaatgaatgagctgttggctccgtcggaaatttccgcccccccccccttcgacgaggttcccctgacaacacacacaaatcgactcactcacttcaacataacaatgtcataaaaaaaatttaaaagcccatttttcgcgccatttttgtattgttcgctgtttttttgtttgtggcattccgcccaaataatttaattagccattttttacggtgggg

SEQ ID NO: 21321 - DNA, 2099 bp, Heterodera glycines
acaaatgggttgtgctttatacacacttaatatacatataattagatggctaattagataacaaaatacattcatatacaaagtgtaaaaggcgtataggggaagagaaagaaacagagaaataatcagctcactcatttaatttaacacctgaaaatttattaaaatttgttggatgcaattaaaaggagatttgttaaaattttattggttttaataaagcataaatttacaaaaacagtgattaaatttatttgttgtcagcgtgagatttaaaaaaagaaacattaaatggcagtaataaaaaagacagacgcataaacaaaagaatgaatgggaattgattgtcctgtgaaggttttgtcgttgcattaaaatgaaatgcatttttagcacattaaacacaaacaaataaacataagcgataataatcttaaaaagcgaaatgcaaaaaacaaatatcaaaaagtcattaattaattaattgtcgtcaaaatcgttttgagtgttcgtctccatccttccgctggctcagtcctccaagtccgtctcgcggatgggccggcagcgctcgtgttggaaaatggcgtgcgcctcgcgcagcagaaaggcaccgaactcggcgatttgtttgcgcgaccaacgcgaggcgagcccagggaacgagccacgcaccacgttggtcagattgtcaacacctttttgaggggtggcatcaataatatggcaatttgatagttttgccaatagacggggatttggtcccggtatttccgttcccgatatttgtgggacggatcgatcagcaaatagcagaaaaaggacacctaaataggagggacatataaatgggtaataattgccattaaaatgcaaatgagccaatagaatgtggattttaattggtccgatttttgtaagacaaataaatatctaattgtaatttgacactcgaatacgcaattcccagtggacattcttttatgtcatttagtgtctccacaagtcgtgagtcactttttgtttcatatttctacatgattttgaccaatacctctaataaacgattttccagaaattttggagaataacggaaaagtgtggcggttatcgaatgacactaaaataaaattaaaaaccatttttgaaaacccatatttatagttgaaacaagtgaacaaagaggcgaagtcgatgctttgcaaccccctttgtcattagttaattaattgttaattacccaatcaaccactggggagtacggtaaatgtccctcatcactcactaattcccctccgccccaccccaaccacctcctttttggtgggctgcgagtgggcgtattccgtgcgaatttgtgcctcctcccttctgccaatgcgctgactctccgccgcattgccccgttcttcggcgaccaccaaacgctgcagagaatggctgtactctgaacagcagaggaagagacgacgagttaatgccacgcaaaccgaaaccgtagtaattaatgactgacaaatgaacgccctccccaaaaattgaaaaaagacggaacgagtcatttttgggtgcattcattcccctcacccggattttttaaaaaatttaaatttcaaaagaaaaacggcattgaatttgtaggaaaaagggtgctagagcgagagagagagttacttttcccaaatcattggcattgacactcggataaaatacaaaatttcattgatttccaattaaaaattcccgccccttttgttacgttttattgcgtttgggtccctcttctgctgctgttgtcctccttttccgtgccatggcggtgtctccaaatgggccaatttggcctcgtaaatgcgtcggttgcccgcattcattggccccgcaatgcaattgcggcggcgcaaccgctcgcgcagttcgtccagccgaagcatggcgaattggtgccgaagtgcgtccaacacagcctcgtcagagtggcgttgtacaacatcatcgtcatcaccatcatcagcatcgcttggctcaccatcactctataaactcggaaaattcttaaaggttggaaccgcttttccgtatcagataaatttatttag

SEQ ID NO: 21322 - DNA, 2648 bp, Heterodera glycines
ttcccaaattcattttcagttggtctgccatgtttcttctgttggtcggttgtggcaccattctttggttcttttttggacttttcaaaaaacgacgactccctcacaaaaaaatgtaagaaattcaataaaaaaatttgagaatttcataaattcttcaatttttcagttttatctgcagcgattgttggcttttggtgttcgattttcttgcgccttctcagctcggcctcgaaattgcacttatcagccatcgctttgacttttacgtcgacgaacacttcaagacatgcaaatggaaattgaacaaacaatttcttattcaatgggacattgaagaaaatgggaccaagcaaatgcaaattgtcaattccgatggaaatccattgccaatcccgcaaaatccgttgcccaacaaagtcatcggattccgtgacattcagatcatgtaaaaaaaactgatttttttttctctaaattttctgaatttttcagctacatcgatcaaaatgtcgtcgcatttctccgccattttcaccgtcgcattttcgctgtttgtacaatggatttgtacattatcactgaaaatgttcgcattttggactttgttttgctcaacatttggccaatgctccgcgacgccattcgtgttatgtatttgaacaccatcgcttttcgccgtttgcgccaattggccccgtcactgctcagcgattgtccatcacttcgctttgtctcattcaaagatgccattctgcccgcttttccgcccgatgacagtgccaatgcgtcggatggccaaacggtggcaaaatggtcgtttacgccctgcccggatggtcggtccaagtggctcaaatgctttgtgaatgcaccggtggatcagtggtcgtcaatgattgaacagttcaaagcggtgattatcactatttaattggttttttctatgattttttgtccccatttttaggcattttccaatgcttcttcttcggctacttttttcatttcttttcattttccgccgtcttctccgcttgacttcattgtgccatttgatttgatcaacgaagtgactggggagcaattgacacttggacaatcgtcagcaaatgcttgttggctcacccgttgtccaattgcatgggatgagcgaaattgggaaaatatgaggaacgaaatgtatgttcgactgaacccaattgagattcggatcagagacggtggatacggtgatgggtgagcaattttttgaaaagtttcattttgtttatgagtccattcaactattgaacaatgtttttttcagtcttctcctcgacgccgcttctcccgggccgagtgatcattgatcagcagctgcagaaattaattaattggccgattgcaatccgtgattgaaatgatattggggcattatattgtattgtgtataatttgtttgtaggtatttgacctttgcttgctcgcaaatgcatccatttccattgtacatacctatgtatatatatttatgtgaaattcagtgtgggtaatcgttgataaaaatgacatgaacaaaagcgagttgaagcattctttcctttagtgatctcaagcattgtgcaaaaaactgcatagtcctggtcaaaattttaggacccagaagtcctgaaaaaagtgatttgttaatcctgaaaaccggaccgggtcaaaattcttttattctttccggaattttttcaaaggtccgaatttgatacatatctcaatttatgaaccaaaacaaaaattgatcagttctcaaataataattcattccgctggccactgctggtattacataaaatggcattcgcgttaaacgcctcattccttttatacccgacaaatgccgactccgacttttttcccacccccgatggctctgggcgctatgctaatatttgctgtcagggctcccactcgtccttgaatggcaaggacgtccttgaaatcgggtcctctttcttgaaaataaaaaatgtccttggatgccaaggacgtccttggaaatgaacatttggaaaagttttaaaaaattcaaaaaacattgaaatatattaaaatttttcagataatttctttcaacattttttacaatttagggtttttaattaaataaaaaatcaaaaaaatccttttcgcgtttagcagttggaaatttccccgaatccacgcttttttttgttgttgtatgtatggccactgcgataagtgacattaattgtgattacaaatgtttttgttcggccttttttgtgaataattcttggcgcagtctttttttttgtccgttcatttctcgttgttcgatgagtaaaatggaaattgctttttttggttatcattcaaatatatgaaaagtggcgatggatgaatgagatacgatgtgcaaaattttggtattaaattgagcggactcgctcagttcggccgtcacagttcggcccccacggttcggccccagcatgcttttccactacaacttttttatttgttatccaaatctatcaatcttggtatcattcgaaagctcttcagatgatctattagccttacaaaaagcgaaaagtttttcaagcctggaaaaaattttattaataaaaacttgaaaatttcgacttttt

SEQ ID NO: 21323 - DNA, 2664 bp, Heterodera glycines
  misc_feature (2642)..(2642): n is a, c, g, or t
gctataaaatggcgccaaatttaggcattatatatatttttaatttttctaaaaattttaatggttctgccaatataaaatcaaattaaatatgcttacgaggcgattttttaataatgagatttttacagaaaattttaaagctgttcgttaatttcaattaaatttttttttttaatttttattcgtaatttaatttattttaaatatatttgatttaaaataattttcttttaaaatttattgttaaaagtttctaactaattaatcagtcccttttatttttaattaatgcgtcaccaacaattttttacggcggcgcttttttatgtaaaaggcggtgattgttaattgactggatggagtcatccaactggttaactatataaaatggcttttatgagacagatgaggataaaacatgaattaattattcattttttattttttaattgaaattcaattttttctaattaaattttttcctaattaaaattataattaatttttaagccattctttgtttagctgtatttggttaagaattatatttaatcgtctactaccttttttaataaataaacaatgtaatttataaatgatttttttaaatttaaataaattaaaaatcaaaatgttgggtattttacaattcatattttttgatgttaaaaaatcaattattttacctttgccgttctttattcttaatgacataagcaacaaaggcagctgacttactaaatattttgttaaaaatttttattccgtaaacttgaaatttaatatttcattacttaaatcaataataggaaattcaatctttaaaatttgtgttcaaattttttttgatcaaaaatttaatgttttaattctaaatttattaacaaaataatttaattgggttttaatataaattttcacaaataaataaataataactgttatttctaaattctcaaaataatttagaatttttacagttatttataatgatgatcattaatttcggtcctcataaattttctattttaatcatcggtgtcattactgtccaagtttgccttttctcgtccatttcatcaaattcaattcgttcaaaacgccaatatgttcagcaacaacaacagcaacaacacaatgaagaatattttgtccaacaactaattggtggccaatttcaacaaaattcttatgttgtgccaaatcaacaacagcaacttaatccaaatttggcattacagcaacaacaaattgtgccaattaatggacaaccggtaaatgcttaaacttttaaattatttgcccaaattttagcccattttaattaacttaataaaaaaaattgttttttttttccatttaattataaattttaatttgaaattattattatattttttcttccaactaaatcataaattaaaaataaatttcaattaaagcatttaaactcacagccattgccacagcaacaagaaagtgcacaacaacaaatttcacctattaatggacgacaatctgtatgctaaatgttatatgtaaaaaaataatgaaataattttcagtaagcaataaccaattaaattttatttaattattttaataaacacattaattgttttcttgttcggacaattatgtttcaatacaagagtttgaacaaaagaacgaaaatttaaatgttcgcaattttcagttacaaaatcttattggaacttagttcaggatttttggattcaaaagtcataattgaattcccctctgcagataatatttttgcacaaaaattttaaaaaattataattttttcctgaatttagctaattttttatttatattttggcaccaatcctccaccaacgttcagaacccatcagaaatgtcaaaccaaaacagaatgccaatgccaaacactaacaaaaataatgctaaacggcttacacgttacaatgaacagtatgccaaaattatgttggcattgtccgccggtgcctatttccgctcagcgcattcagccgaagaatgtgtggcgaagtgagcgggatttgtttttcatattttataatagaatttcaaattaatttttaaattaataaaaaactcttaatttataaatcttcaccagaaaaaaagtgaaatttattacaaaaatttattttattataaataaaaaactttataaaattaaattaataaatatgttaaatattataaaattgtcaagaaaattgaagcctggaataaatatttataaaaatagagaataaattacaatcaaattccacttttaacagttggttgccagaaccgaatcaatggcatatttatgcatccataaaccaaacatgtgacattcttgacaacccatgctcatcgtatacagtaagtaacaaatgtaaaattaattattgaattactgtatggttcggattgtcctagctcaatttttaaaatgactgaatggtgattttaaaggacacatgccaagaagcgtcaataaagaggttcaaatacccccctcccccccccccgcacaacctccatcaataaaggggcagcaaaaattccacaccctaccccaccaccaccaccagcagcagcaaaaacatataggggcagctaaaagttgagcaccaaanaggtgcagcaaaaaaaagtcaa

SEQ ID NO: 21324 - DNA, 1538 bp, Heterodera glycines
  misc_feature (1528)..(1528): n is a, c, g, or t
gttccaattcgcgccgcttctccaactccgtctcttcgtattggcgacgttcacgctcaatacgctcccattccttcagagaggggacaaacgaaagggtcactcatcacacaaacgaaacgaaagaaacgcaacgaaacgccaaaaagaaaaaaagccaaaaagggaaagtaaaaaatgataaaagtaaaagtgaggaagcaaaaaaaactaatgctaagaaaaactatcaagcgtaaaagccgaaaaatatttgaaaaaagaagaaatttaaatttgttctttaatttaaaatttataaaggcaattaattaggtaattagtccactaaatgactttgccaattatcgatcagtcgcgtcattttattttccattttcgctccttttgtgctttcgtttcaacaaaattgcgcttcgtcgccacccccagtcggctaggcggaggacgacgcgtgcccctggcgcgtgccagcagttcgcggaaacccccgcccgcgcttctgttccccgtcgcgggccgcacctcgcggcgtcgtttttcggccgcctcacgctccgcccggtcgcggccgatgcggtccctctccaccctctcgcggtccaacgcttgcgcctccaatgcctgttccattcgttctctctcacgccgtatccgctccaactgctccacctcctgctgctcccatcgccggcgctgctcatccacgcgctttcggcgttcttcttcctcgcgctttcgcctctcttgcccttcgcgcactcgccgctcctcctcttcgacgtttcgcgagtagcgaagccttagggagaaagacattggaggaaaatacccgcatggaaacaaaaagtgccaacatttgcataattaccccatctaaattttgattctttgctaattaagccccagcctcgatcccccccatccttaccaatattcctctggcatttcatccctctgcggtggcaactgttccaacgtcagaaaaggcgccgcaggggacgaacggccaagcggaagcggcgcactgagcgcctcggttgagcgcgtgacgagagtgcgcgtcagcacctacgatggggaggaggtgacccaacaagaaaacagggccaaggcaaaccaccgcacctctttgcggtagtattccgttggtgcggccgttgtcgtccgcgaggagggcagcggcggcaccgtgccgcccgcggctctgccaaacattggggcgaacgcggacgcggaacgttggatgggaatgtcgcggacggaggaccgagggaaattagcggtggaggaggacatcagaaagggcgcgtcatgcagactttggtcatggcgaggcgacgaactgtcgcgggaatatttgtcaaacggcgaattgggctaaacgcggaaagcaatggcattaaatgagtcatcattgaaatgttcgtttatttttaattttcctcttaattcatctaattcccgtagggacattttgtaaaataagcgaagaagaaaattggagcggttgaattgaaagtgagtngggggggggg

SEQ ID NO: 21325 - DNA, 2995 bp, Heterodera glycines
cttttgtccattttctatttaaattatcattcaatttccttttaatccgaacttgtaatggcctttttttcccccaattcaaaaatttttaaaaaatgcgtcggttttccctcacactttctctggcccattcttgttctcttctcatcatgcttttacatcccatccaccggaatgacccctggttgcttttctccgatttcccatgccatccatctgagatgaaggtggaccactgttcattattgcaatgcgcagcttggccgtggaagttcggattggagagacgaagggcgaagccgagagtttggtccattcattcactttcacttcatttttatttaaggatcggggacgatcctaaggaaaggggggagttgtaaggattattcgacgcatttccctcatttaattatttcccattggccattatcaattcaatcacatttatccttttctcacgtttttccttttctcattgtaatgtttctccgcccattctcttcgcattttctccttccccagtgatcagtcagtcagttgtgatggaacagacttcaattattattccgatttctcgcttcgtttaaatccaacatcgaatgaataaatacatctttaacagtcaatgagtcgtttgggggttcggggcttggtcaaaggcgccttggcttttccccattccctcccaaactccatccgggataaacggtgcatagttggtctgggggcacagtgcgcatccctcactggtagcaccggatggttcccattttgggaaacgacgacccatcattgacgacgaagctgagaattgggtaagccggcagaagtttgtgggagatctccctggcctgagggcctgaaacaaagacgtgtacacgcaagtaaagtagtctgacattttaaatttctgtccgggctagtcgaagactaaagggactttaaaaagagaagaggtgagaaaatctgtccgggctagtcgaaaactaaagggacattaaagacgaagagaaaagaggtgagaacatttgtccgggctagcgaaaagctaaagggattttaaaaatgcaaaaaaagaagaaagaaatttgcccgggctagtctaaatgctaaaggggctgactgcatcgaaaattgacaaatttgacaattatttgtaggagagagagagaataaggaaagagagtgaaggaagccaaaaataaccaaaaaaagtcctggtaacaaacgaataaggactaatttataaaaatatttgaacgaatgtgaagcaaaaaaaaaaaaagagagagagagaagaagtgagacaaaaaaatatagaacaattttttttgaggagagtaaaaaggcccgggctgataaccaatcaaaggggcgctattttagctaactaaaaagagggaccaactaaaacatgagaattaggccctatcattttgtttaccgtatgagctacagttttagagttccaaagttcactttatcaattctctttttttttacgccataaaaatattcacgtaatcacgtgccgccgcattttttttcattgggcgagatcattcactttacacatttttgcggcgcctgagaattgttaattgctctcgttaggcggagtttaagcggagatggagcagataaagtcattcctggaaggcactcgtcattcattacccgctgtcattcattaatttttttctctctcaattaatgcataatgggattaccaaataatttttttagcaaaataaaacaaaatcttattacaactgaacgacttcgaatgtctacatcagggggctcgtcaaatgagttcccctttggtacatcccaagccttcgggcaggaaacaaaaatgtttttgagtggaaaggatgatgagtcctcgatttcggctattgataggaaactttggcaaggaaagaccacgataaaaatctctgatttagaaaaagctcaaaatgatatggggaaattagaagatggagtgaacagagcttttcgctgcctgaatcgttccttgaaccaaaaagtcaattgggtgaaagatgtcgtggccaatacaaatgccaactttgagactctgaaagtccaattcgagaccttaaccgaaagagttgatatgttggaccaagacagtgatgggacgaattcaggtgggactgttagtattactaatttgaatagagcgtcgcgtgcgctgtttgtgacgccaatgggcaatgcacagcccaaccaagttgtaccgaaccaagtgccaattcatcaattatcaagcgaagacgaagatgacgggccgactctttttggcctgaacatgctctcgagcggacccacagtggggtcaggtttggaaatgttttgtgaggagtctgtttttgcatttgacgattgggctgaacgtttcaaggattacctgtccgtgtcaggcaaggcttacactgaacaagaaaaagtcacaagactcaaattggctctgagggacactcctcgggcactgtttaaggaattattgccagcacaaacggacactcttgactcagcattgagcgaacttcgacagaaattggactcccctcagcgtcgggaaattgcgaaacgaactttatcgctgtgcaaacaaagggaggatgagacagtggcgcaatttctgagacgcctaactcctttggtggatgcgacaaattcgtcattaaccggtgacattcgtaaagagaaaatttgcgaggaatttttggatagattgaagcctaacattagttttctgatccgtctggtgggtttgtcacgagcaaaagacttggacctggtaagagcacaggcagaggagctggaagctttactgttgatgaacaaaggtgatgaagcatcacgcctctctcaggcagtccatgcgctgagcaatcagtcaccacagtcgaattggtctacagaagcgaacccgaacaatgaccgtgctggacaatggtcgtcaggcaacaatgtacgt

SEQ ID NO: 21326 - DNA, 1733 bp, Heterodera glycines
tgttatgtacagtacccctattttatttcccacacagacagtaataaaaagggcgggataaaggatcagcatttttcgctgatccttttccccgtgggaaacgcaagatcagttggctcatcccggactttccacaccgagcaactccggagaagcaaaatcttctccgtccctttttccgtttttcctttcttcgattcccggacaaaattcattttctggttttcctccccgcgcccttcccggaccttccctcaggattttccctttttggccgtttttcactgaaatatcttggaattcggatcacaatcactttcaccgattttcatattcaatttcaattccatttcacatttaatttcaattccattcctcagtttcaatccgcaaccattttccatttttaaaataaataaatcgatcaagttaattggataatggagaagccaaagaaaaggatgtgggagtgtaaagagtggagaattaatttaaagggaattggacaattaaaatggaatgggaagattgggggaaaatcacaattatcccggggaacccaaattcgggaaaagccctattttcggcccggcacgatccctttctatttacatgaggttacttacatattagatgattgaaaattaaaaacaacagtctacaataaaaatcaaattccctgtagatttacaattttcggtcagtgtttttactaaaattaattaatattattttgataataaatttttttatttgcatatttaaaaaaactctttttttaattgaaaagagcataaaaaactgatactaaaatagcttcttccgggtcttgtatttttccatatttttacgggtttgttgcactaattttgggtacacccccatggcaatcccctttgagtttttggtaaaaattctttttgatcagaactgatctgaatacaaattttttaggtttttggggctgctgatcccgaatccggggccaaaaaggggttaggattcgggatcaatgagtttgggtgcggttgcgaattccccaaaaaatgatcaaataataaatatcgattaataatttcttaacatttcaaccaattccaaatctgatgctcattttattctgcattagaagatgcataaaaagaaaattgggcttaagattaaagaaagcaaaaaaaaggatttacaattttcggtcagtgtttttactaaaattagttaatatcattttgttaataactttttttatttgcatatttttaaaaactctttttttaattgaaaagagcttaaaaaacttatatatatatattaaaagggttgcttcgaattcgatttttagagtgtatttttctttttaagccgattcttagaggtgtatttttcgttttttggaatttctaattagggggtgtattttgcacaatttttagccggttttcgccaataaattactattttttgccattttgttctccatttttcaaaaatcaggtgaaaagattttccgtattatttccaagtccaaccgcgggacaattactgatttacgcagagagaataaaatatcaataaattcatactttgcataataaagcggaaagaattaaatggattaaaatattatggcgcatatgtaatcctgctgtaaactcactgtcattgtctttatctaatcaaggcccgatcattgttaggcattaatcttttttaaactagaaattacaaagaat

SEQ ID NO: 21327 - DNA, 2278 bp, Heterodera glycines
tgcctcgccaaatttttcacataaacattggtgacttcctggacgggtcaccaatttgcttctcacgagcagtgcgtggcacaaattttccaacaaacctaaagcaaaaaagatgggataaatttaatagcacaaaaacaattttaagtggggatcatccttacactttcttcccatccaaaagcatcccgttcactttcgcaattgcactgttcgccgcttcctcagtctcaaaatggatgaacccataccctttgcttcctccctcaatgtcagtggcaatctacaaaagttgttgtggacaataaagacgaaattgtttgaagttaagcaaacacaccttgcagctcagaatgcttccaaacatggaaaaagtgtcgtagatggccttcgtgtcgatttccttgcccaagtttttgatgaaaatgttcccagcacccgagcgacgaatgcttggatcacgttgcgaccacataatgcgaattggcttgttcaggatcatgtcaaagttcatggtgtccaaagcacgttcagcttaacagaataaggggcttatgatggaagcaaaaaaaattattaaaaaaaaaagcagtccaaatgtgttaacttaccatccgccggttgttgaaaattcacataggcatagccaagcgaacgacgagtaattgcatcacgacaaacacgaatggagagcacaggaccagcattgctgaaccgctcaaagagcatggcctcagtgacctggcaataccaaaaaaattaatcggtgtttgaaaaaaaaatttttaatttgatttctcacatccggatgaagatcgccgacatagagagaagccaacggataagatggtgccataacctgcggttgggttgtttgagccgaggctgcgttagcatttggtgcgggagcaacagcagcaactgcctgcgccattttcttttattttcttaaagtgtgaaaatgttggtagagaagaaaacgaaaacaaggaagaaacaaacgattatgacggattaattcgaataactttattaaaacaaaaagaaaaaccaaacccttttatcagagagaaacgcgaggaacaaagttggatgtgtgttttttaggtagttttttgttgttttgtcaatttttttgttgttttataattttgtcgattttttttttgtattttttagatagaataagatgaaagagaaatataccctaaataaactgtttaaattctaattttgtaggtttattgaagccaataacaggggaaaataggcaaataacgctcataggacttccacttaacgtgattacgaaaccaaaaacgctgatgaaaatgaatcaccggacgataaaaaattatacagtaggaaaattcaataaaatgtattcgttgtaaaaatttttaattcaaataaaataaagcgtgcaccgcatcgcaactcgcgaaatactatcattccccagaacttcggcttttatccatgcgtttttaatcttcaatcgtaccaccatttttaccccatcttttcataagccttttgtgcggctgcgatcccggatttgacaaatgtcaaaaattttgatttttaacaaattattggaatttattccgatgcattccttgcacgccaacatttaaaagaatcaacaaaaatgcgaaaatttattcatttttttattttaaatttgggaatcgaaatttttctcaacagtaaaaatgctttatgacaatttataaaaaaaacgatggaacaatttattttttcgtaaatgaaagaatggtcaattggcaaggttttctgttttaggtgttggattgatggggagtaaaagattgaaaaaatcttttttactccaaaaagatggagatttccaagcacaccagcctccgttcagtatttccgataaattttctgttcccgtgtaatgcggatccaaaaccaaaaattggcaatcgccaagccgcacattataatcaacaccgagaattgtgtgtgccaattgaccaccgcctttaaaaatttgttttaagcattaaaacttataagttctgtaaattttaaagaaaattttaaattttgagagtgatggtggtgtccgatgtgccaagttgacgtcaccattaaaaatttatttgtttatcaacttaccataaaagtttcctatgcataaaaaagtgataacttcaaaaatgtgttaggtaaattaaatttttacgtcaaaaattcttttcgtgcgtggaaggagagaccggaattttgaatcgccggtattagaaaa

SEQ ID NO: 21328 - DNA, 997 bp, Heterodera glycines
tcaatgtacttttgaaattttagccatgaacaaccagtttgaaaagaccgatatgcacaaccccaaccaatgtcatcaacattctgttgcccataatggtaataagcgtctttccgcaaacaatcgcatatttatgttttggttgtactgaaagcaaaaaggaataagttttggattcttttatgggtttcggctttttgttcaaatttaggttaccataatttaagaaattcaaaaaaattttttggagaatccatcagaaaaagtggcaattttttccgatggtgtttttttctcactttttactccatcatgcggagaaattattaaaccagccatttccttcgaaaaggactctaatttgtcatcacttgtggcagaaacaatagcatcatcagcagaaatttgttcttcattcataattaacttttaaatttttctcaaaattgtggaatttcaacaccgattaaaaaaatagataaaaattggtttttataaaaccatttaaattattataaaaatgtttaaaacacacagacaaactgtatggatcgttgatttattcaaatagaaaaaattacacattgtaataaaatgaaaaaaaatcgctttctgctgaaataatttatagccaaatacaaatcacaaaacacatcgattcgttcgccacaattaccattcggcctcaccagtacatttttgaaagcaaaaatcttttccacgaatttgcattacctgaaaaaagacaaaaatttacaattatgacatatttggtgaaaaatgtgcaaatttgttaataaaataccccatctttgagagtaaatttccatttgttgcgagctctgtgcacctgaacatgatggaattgcaaaacaatgaggaggaggtattgcatgaaaatgcagaggaggcttcaaaaaggggcataacattttaccaatgcccctcccacgttgagggggtcgaaaaaaaaaattagaaatgggataaaaaaatt

SEQ ID NO: 21329 - DNA, 2397 bp, Heterodera glycines
tcttggcacatccgagcacatcagaaccttccaaatctttggtatgcaattcgcctcaatttaatttaatttttaatttagatagatatttcctttcctaacttgaactggcgttggccttcgcaaattgaattcattcaattgttttattagccatggagaaatgccaatttcgcgccatgagaaagttgaaaatgactcaaagaactgaaaaggcaaaggcaccgtcccttgtgcatttggtgatgcaataattggttcaattaacgaattggcgttggaagttgattccagattttcctcaaccaaattcattacacttaaaaataaatgtttaaatgtgactctcaaaaaaaaaaaattgttccccgggatttttcgggctcactgatcagtgatcacgaatttagggaaaggaatcaattgatgttagagaaaatccagaaaaataggtaagtcaatcttaaagagtggcaccgaaatttcctataccatcgggactgaaatggcagactgaaaaataataataataaaaatctggtggcgaattactgaaatgtgactttagaggttttttacgaatttttttgttgacttttcaactccaaacaaatttgaataattttccgatggaccaatgtctaaccctaggctttttagccatattatatgggaaattgttgggcttttttacgacatcgttctgataatgacgacttcactcgacttgagaacttagccaacgaactggggagggcgccgaatgcgccgggagacagaagaaatcactcgcgaacgagcagttcatcgtcagcagtctcttcggcgtcctccgttggctcggacaatgaacggatcaatcggcggcacaaaaatttacactccgtttgttagggtatttttattcatttaaaaagggattgtgcgttttagagttcgtatgtcaaccaattgtatatgaacgcagcttttggctcgggcgatgagtcatcttcgaccgaaacgaatgctgtggacgaaaagcggaaggtaacggagaatgatgggggagtaaagccaaaacgcgaattgtcaaggctcgcgtccgaggacttctcgagcaaatccccgtggacatttacacggagggagcgaaagggccggcggagtgtgcgatttgcatgggcgactttgaggtgtcactttggtcttcgtttatgatttatggaaagagcatttgctcctcaggagggcgactccattcgctttttgccctgtgtccattcttatcacctccaatgcatcgacggtccgttccaactgtcccacagatgtcacttttcgttttcagattggctcctccgctccttcacttgtccgtcctgcatggaaccggtggactccgcgctgctttccgtcttcacggttaacaccagcaccgacctgaacgccctcaccggcagtgcgtccgcgtgcaattcgataccttcgcggcaacaacagaacacagcgaaagaaggcggagaagtgacaacccaaaacatcaacaaactgtgatcggtgttttttccgcgttttaaatggaataagggagcgaaatggcggcagctgtctccaaacaccgaaattatccccaaatccctttgtatgcatttttcacccattcccatgtagaagtcttccaaatactttaatttcgactttttgactgatgttcctaaaatttttgtatgagcaacatgaatccatcttcgagcacttatcattttgaataaatcctgtaatattactactgactttggatttttctatggaaatacgagtaatatgacaaattcaatagaccaaatttgcagaataattaaaaagagaatgtaatgcctttattttaccaatgccaatgaggcattaattaagaattacagaataaacaaaaaatggtggataaaatgaagcaagtcatcatttctggaaggttttcaaaattagaaagtcggtaggagttcatccccagagtcgcaaatgtgtggtaatgagttgatcaaacgaaaatatgcacaaacactgtgttattcaacagaactttggttcttttgctgttcgcttttcacttcagtttcctcctccccttcgactgtcacttggccattaggttgctgaactgatgataaatcactttcttttgttttctcctcgacagttgagtctaaaaaagtgtgtcataactagggaatccattttcagtttgccatttttggcgcctttttcagaaaaatccttaacaaaaatgaaaaatacacccctaaaaatcgacccgaaaaattttcagaaaatacaccccctaagaaatgggaaaaatttcacaaaaattacccccaaattttatttttttttcttcataaaaattttgatttaaaa

SEQ ID NO: 21330 - DNA, 978 bp, Heterodera glycines
  misc_feature (58)..(58): n is a, c, g, or t
ttttcatattgtaaatccatataatatttattgtacttcgattattgctaaatcattngaaacagaatctgttccaaattcgcttccatttattttgacacgcatttccgagagagaagcatttggatggattataatattgcgggcatttgttttatgcttttcattagcaacattgactgttccataagaaatttgtattgaaccttcagatgagagaaaataaaaatattaataaattaaattaataataattaattaaagaattggtttacttgggacagaaattatgccggaaacgcaatgataagctgttaaaatgtatttgtggctgatgattgttccagtgcataatcctaaacaatttaagtcaaattaatgaagatttatttcttaacaaaaccttgtaatgaaagcaaagtgaccatccatggcattgaattggcattttccactggttgtcctttatatatctaaatttgcttatattacactagtacaaattcctccatttttattactttcttaaacaataaattttttgaaaattaaattttattaaaattaaaaattcgtttctttctctcacatggtttgtgccgattttcacatttggcacattgtccaagtcgggctcaaagtcggaaatgccacactgagaaaagtttggtttgtgcgcaaaaattgaatacaaattgttgccggtaaaaacgaaaaataatgtcaaccaaaatttaaccattttgccttttaaaagttttttttattaaagttatataaaaattttattttcattggtatttaatattaatttccaataatgaattttttgtcatcttttatacgaagaaaaattaattaaaaatgaagcaagcgtaaaattattacaaatcgtagaaaaaagaaacaaaagaattttattgaaagcaattttgacttaaactcttttggtgaatacgaaatttttcttttatttat

SEQ ID NO: 21331 - DNA, 1432 bp, Heterodera glycines
atatatattctaaattttgctcataattccttaatgaatgaccaaattatattaaagtttgacttcaaaccgcattcagacaaaaaatagatttttctttcacataagtcgagttgaatagcccagattatacatgttaaattatgaaaaatcagatgtcaaaataattgttgagttgtgcaatcactttgattgcgaacttttcgcccataccaatttgcatcacagagaaatgccgaaaagtcttacaaatttttcaattggacacatttcaacaaacaaaaactgtttccgaaaagtcagtgtttaaatagaattttaagaaattccttgaatttaaacgaatcataagctccgttcactttctatgcacttcacttctccatttgtcgcttcttcaatccaattgcaatcaatttgagcatattgacctgaattaaaagaaaaattataaaaatatagaatatatcgttagggatgataaccaaaataggtggtaggcatcaggctttaaaaaatcccggaaaataggctctaaaagtcttaaatttaggtgtaaaatgtcaaaatctattcaatttataggctctaaaaataaaaaataaaactaaaaataattgctaataactcgaaaagtagcttaagaaccaccaaaaaaaacaacttgtttttcgtgtgttttaggacattgggagttcaggaaaaaaataggctaaaacataaaaatatcatccctaattattatgtttatttgaaaagagtttttttgctccagaagaatgtaaatggtaaatttggtttattttaaatttataaaaaataggaaaagccttgtttttgcaaacattgttatacaaataatattactgatgttgaagtgcagacggcgcagacgcccacttggacccaattattttggccaattttacgcactaatggaccaccgctgtcaccataaaaataatttaaattaaaaaaaaattgtttttatttttcaaattttacactttcgattacgctcggtccaggcacaacacaaatgatctggtaatgcttattatgatgagaagaattttcatcatcttcaattgcaactcttttgactaaatcaatgttttattttcattttttcattattacaatttaaaattacattttttgattgatgcactttgacaattctctggtggactgattttcattttaccgtacatcaattggttgcttggacctggcttactgtctttcaaacagtacggagaagtaataccccaaccagcaacaataaaagtggaatgattattcgagcctgaaaatataagcaaaatgtttttgaatttaaaaatatttaaaattaattagcaaccatattcaattaaacaaatgggacgagcatttgctgtgaatgcaattggcttcttcaactaaaaat

SEQ ID NO: 21332 - DNA, 1339 bp, Heterodera glycines
  misc_feature (82)..(82): n is a, c, g, or t
  misc_feature (212)..(212): n is a, c, g, or t
  misc_feature (1132)..(1133): n is a, c, g, or t
  misc_feature (1139)..(1139): n is a, c, g, or t
  misc_feature (1144)..(1144): n is a, c, g, or t
  misc_feature (1155)..(1155): n is a, c, g, or t
  misc_feature (1158)..(1158): n is a, c, g, or t
  misc_feature (1160)..(1161): n is a, c, g, or t
  misc_feature (1163)..(1163): n is a, c, g, or t
  misc_feature (1167)..(1167): n is a, c, g, or t
  misc_feature (1175)..(1176): n is a, c, g, or t
  misc_feature (1186)..(1187): n is a, c, g, or t
  misc_feature (1194)..(1194): n is a, c, g, or t
  misc_feature (1197)..(1197): n is a, c, g, or t
  misc_feature (1205)..(1206): n is a, c, g, or t
  misc_feature (1215)..(1216): n is a, c, g, or t
  misc_feature (1223)..(1223): n is a, c, g, or t
  misc_feature (1226)..(1227): n is a, c, g, or t
  misc_feature (1231)..(1231): n is a, c, g, or t
  misc_feature (1233)..(1233): n is a, c, g, or t
  misc_feature (1235)..(1237): n is a, c, g, or t
  misc_feature (1239)..(1239): n is a, c, g, or t
  misc_feature (1244)..(1244): n is a, c, g, or t
  misc_feature (1247)..(1247): n is a, c, g, or t
  misc_feature (1251)..(1251): n is a, c, g, or t
  misc_feature (1279)..(1279): n is a, c, g, or t
  misc_feature (1285)..(1285): n is a, c, g, or t
ggcatcggtctaaacaaaagctgcggcatggcttggggaaattcctcaggggattaatttcgtttgtctaaagaaatgcgcntagtgtcgggcattttgacattaaaatgccattaaggcaccgttgtagccaagatgcacgtggtccttggaaattcctcaggaattaatccctgaatttctccgattttcttaaacccgtaaatcacatnagggaaaacttctaagatcctgatgattaacatgctcatttggttttggcgctagagtgacatttattcgcatagtcttgggaaattactcaacaactattcgatttttcttaattatacgatcatggcaagaaaagcatgatcattaggacacttgttcattaaaatgctattggatatttattcgcgtggtcctggaaaccacttaggaagaattattccgatttttcgaaaccataaagttatcgaaagaaaagcattattgacgggccttttccaattataatgccatttcggcatcggtctaacaaagatgtgcatggctttgggaaattcctcaggaattaaatttcgttgtctaaagaaatgcactagtgtcgggcattttgacattaaaatgccattaaggcaccgttgtagcaatgatgcacgtggtccttggaaattcctcaggaattaatccctgaatttcttctattttcttatcactcacaaatcactgggggaaaattaagatgattctgatgattagcgttcttgttcgattttggcgctagtgcgatatttattctcatggttcttggaaagtactcaggaagtatttcgatttttgtaaataaaccatcagctgatataaagaaaagcattgttgtctgtccttttccaattatattgccatttcggcatcggtctaacaaagctgcgcatggctttgggaaattcctcaggaattaattttcgttgtctaaagaaatgcgctagtgtcgggcattttgacattaaaatgccattaaggcaccgttgtagcaatgatgcacgtggtccttggaaattcctcaggaattaatccctgaatttcttctattttcttatcactcacaaatcactgggggaaaattaatatgttactgatgatttcnnttcttnttccnttttgcctctnctncnntntttnttctcttnnttcttcgtcnnttctccntcnttctttcnntttttctcnnccttctnctnntctntngnnncnccttnttntctntcctttacgaattatcttcccatttcgncatagntctaacaactttgtaagtggctttgggaaattcctctaggaattaattttcgtt

SEQ ID NO: 21333 - DNA, 2242 bp, Heterodera glycines
  misc_feature (2160)..(2160): n is a, c, g, or t
ttaaaaaattccaaaaattttgaaacgaaaaataaacctcatattcgtgctcagcacctcaaaatagcccagaaaaatatttttcacaccctttttcgatcccaaaaaaatttttgaaaatttctatggggcctagctcgaaaatttttgaaaattttacatcatgtagtacaccattcgatagtatttaaaatgctctacaaaaatgttctaagacaatatttcgctaaaatcaacttctgacgagttatgggcccaggactcaaatgtcccgctgaggccaaaaattttttctatttccggaaaaaaatcgaaattttttcaaaaaaaataccattcgatagagctcgaaaaactatgttttggaagtggtcttcgtttttctgggaaaattcgttaaaaaatcctaaaattcaaaaacccgaaaaccgttttttaggcctagctcgaaaaattttgaaaattttcgaaattttaaaatttggaaaaatcgagctcaccgagctctacaataagtctgctggccaccctgcgctcagatcaaagcctaatgagttattcaacggggactgaactggacaaagttggtactgaaaagttctagaagcacccagcccagggggttagagatagcggcctggaattttttttaacttttagctaacacttcaacttaaaatcctaccagcggaaactttttggtcagggttttagaaaaaaagttaggggccctcaaatgcacgaaaaaatgagaaatcagccgctgggactcagttggccgcgctgaatttttctctatagttttcccggatgctcctcaaaaagttgtaagacccttccactactttcagggcgctcccggccttcggccgggagaaaatggttttagcaacgaaactccttgtcaatataacatatatagtaactagcgggtgttgcatgcgagggtggcgctggggaaagcgcttcgcgcttcttgagcttcgctacctagattagctatctggttgtgaagagattttgaatttttaaagaatttcagtgatttttaggccgcttcgcggcctcgaacgggcgcttcgcgcccgttttttaaatttggttgtgaccagacgtgcgcttcgcgcccgttttttcaaattttgttgagctcaaacgggcgcttcgcgcccgtttttaaattttttttcgcggcctcaaacgggagcttcgcgcccgttttttaaatttttttagctcaaacgggagcttcgcgcccgttttttaaattttgttaagcttgtgcgggctcttcacaaccgtttaccacgggtggcagaggtacaacgatgatttgaagaggtacaatggtgattagaagaggtacaatggtgattagaagaggtacaatggtgatgagaagaggtacaatggtgattagaagaggtacaatggtgattagaagaggtacaatggtgatgagaagggtacaatggtgattagaagaggtacaatggtgattagaagaggtacaatggtgattaaaagaggtacaacagtgatgagaagaggtacaacggtgattaaaatacatgaaattctatcaattaaaaaaaaaaaattaatttaaacttataaaatttattcatcaaaaaaataataatttaaatataattttttatttattaactcaacaaaatattttaaattaattaaaatcattaaaaataacgtaaaaatgcacagaaaaataatgttacaccgcccggattcgaacttcccccccctcaaaatgatgcctcagaatccccaatcacacggggattctgagggcttaacgatgtcagaagtaaaatctgatcacgtattcgtgatcagcggccctaataacccctaaagacatatttttggaagatttttggtgaaaaaatttctcaactcaaaaatcatgtgctcccccctttggacccgaatcccaaaatcacttttatttttataacaattcgcaaaaatgtgataaaaatttaaaataaaatttatattatagagaaaaaaattgtggatttttgtagtattttacttttctcaaatttcttttcagaaggcagttacgaatttttttctgaaaaatctaaaatttccagaatttctggaataacttttttcatattgatgttaganaacctagataaatcccataaaattctcctgatttttctctatttttaaagctttgttgtatgaaaattgacttaccctgagg

SEQ ID NO: 21334 - DNA, 1255 bp, Heterodera glycines
ataaagattgcttcaatataaaattaatttacaattaatctttataatactcggttgtaaattaaatactaatactaaaaatttataggttattagatatagtggcaaaaattgattaaacaataaatgatataataataaaaagcaacaaatataattataatcacatcattatgctaaagaaatcatttaaaatcttttattaatgaaatttattttagtagttaggcgaggaagaagagagtaaagagcgaggaaggagaagaaggagagagtgaaggggagagagattgagagtgcgtgaaggcgagagagagagtaacaatggcgaagcgaatgcaggggggataggtcaacgatggcatcatttattgagggggaagggataaccaaactctagagaatggaaaattgattgccaatgtttgagcatcatatttattctttcaaatttcttataggaatgagtcgggtaaattatgtgtacgctagagggaaacgcacggcatttcaatttgccgttttaaaaattaatgtattttttcgttttgttttcaaataacataaattaattttacagcagtggtcagtgtcgtctttacggcccgtcaaaaggacctcggccattccagaacgcatcgacaaagggttggaaacagtgaacaacaccaggtcgggatggaatgtaaagtgaattttcgttttttttcacatttcttaaatttttaggatgatgttgttgtccgacttgaaaaaatggacgtttcttcccgcgcatgtccaacacaaaaggtgcagagaacagcgccgcaaggatcagcggaacccaatggtttgaaccatggaatgggaagggtttttgaatgatcttaatttttgaaaattcaaaaaattccaggcaccccggaactttagcagccaccaaattcacagcaatgcgcaccagtgaataaaaggaagaggacagcaccttcgaaactgcaacaacaattactaactaatggtttttgatctgaggggagcacaggaacgaaattttaattttagaaaatttgacacttgaagcggcagcggtggatgatcaaactcagcaaaccgtccaaactgagccggaaatggtgagtggtttagagcttgcacaattcatcaaatttgtccctgttttttttcagaacctacaggcggcaccggaggatctgcaaaacgttgtggaccaaaatgagtcggaagtggtgagtggtttagggcttgcaca

SEQ ID NO: 21335 - DNA, 1845 bp, Heterodera glycines
  misc_feature (1830)..(1830): n is a, c, g, or t
ttttttttacaaacgatgatccattttgttcaacatttaatttattttaattgcacattttcagacacactttttttttaaatttcacatttttcacacacatttaatttcacaagtttaatttttaaaataaattcaaattgtcatttattattgcttacattaagtgggtatttaccaaatgatcggttacagtaataaaagaggattattgctttaaatttgatggagtagtgtaattaaagggaaaatgtataaataagcaaacattacagaaatagttttcaaaattgacggtcagagtgaaaataagcgaatgttgcggaaatagtttcaaaaatgaaggagtactgtaattaaaggaacaatgtgataataagtgaatatttgcggatgtttttgtaatgttttaaaaagggtagagtagttaaataattactaaacaaatgttaataagagtcgaaaattgagaagtactttaattaaaataggaaaacagcggcaaagttttacgaaaaaatagtgcaaaatgagctgtttactgtaaaaatagtaatcaatttaccgttatttatcaacaaccaattgtctcaaaaaattaatgtagcatataataattggttattattttacagtaaggacatttacgggcctgggcagaattttgcaaaaagtaaatgagacagcttctacacaatcccacatgaacactgtccgtaaaactcagcgagattaacggtacacaaacataggcccccgtcatttggataaaaaagctgagccggaaattgaacatcctcatccggatcgccccagcaaaaaacttgcttcgtttcacctccgggttgtaggcccgcctccgctggggtccgagcaaaaaggtcggttccacggcaattgatcaacacacagtcatggcacagctcaaaattgatgacaaatcgatcattttcagtgcgtgtcactttctgttggttcttgtacaggcgactccaatcatcttcaaaatttaattttaatttttctcatattatttaataatatttaccggggcaaagataggtcgagagcataaatttccctttcgccaacttccataactcgcgatcatccacctttcacttcttgatcactgatggcgcctcaaattgctcactctgagggaccgcttctaccatttccttcgcgacattgtcctccactgtttgattgggttggggtaaagagcgggttttcatttttctgttaatccttaaaatgatttgtgaatttgggtgggtaaatcaacttgacttagaatgggagggggggggccaatcgcggatgggcggaggagcataattatcccaataatataaaaagcggtgctcccctttggcaccatttcattttatatgaaatggtgcttgtaattgaattttgtgcacaacttctcggctgtgctcccaaagagctcagggatcggctcaactacccggaggaccgcgcgcgtgttctgacacagctgattggaaaaaaggtccagacaacgtacaaagaccgaaatggaatgcggaaaacctttttcattgggggcatgactgaacggggagcagcctttgtccaagcatatgggcgacttcgacaaccgttcaatgtcaatgttgctgcccatttttacgtccggcaccgcgtgaaactgcattatccatacgcaccatgcataattgaaggctttgcacgtggggaggaccgatactatccattggaactgattgaaatagttacggaaaacgaccacaaagatgcgctatttgggacaattggtcagagaaattgataaaacttccnactcatctgacgcat

SEQ ID NO: 21336 - DNA, 1840 bp, Heterodera glycines
  misc_feature (20)..(20): n is a, c, g, or t
tcaatgtaagccaagcaacnggaggacaaaatcctgacattattaacaattgttaaatttaaatatcattagcacagtgaccaaaaacagtctaaataaattctgatcattgtattacataaaatttttctgtattatttttttttgcaattttaaccctctctcataaagtgatcaaattattttgtattagtggtaattatgctcatcagaaagtctgttcatttcatgggttttgtcttggtaagaaaatcattttgttttttgtgtcttttacattttctccaagtgaacgagcggagagtaatgaggcaaaaacattgggcaatttgcaaatggaaatgttcacacacgcgttgatcagtccagcaatccgatattttttggctaaataaaatcttttagcttagacattttaaaatttgcattaaatacaaaaattaaatcaaaaacattgatttagaaaaaattataaatataataaattaaattaaattaaaattataaacttggaaataaataaagaataaatttgaccagcgtaaagcacttccattgcgttgtgttcattcaacccgcaacattcgttcgtgtaaatgaagcgcaacattgttttgaatgttccaacgtcaacatcgatcacttccactgagctgatcacttcccaagtggctaattgatgcgaaaatatttagcattaattcattcaattttacatattaatttccataccatcttcgctcttcacattgaaagtgttggttgaaaacattttgtcgaaaatgcttgaggcagtcttcagaagaagtttatgtgccggtataagctgaaaaataattttaaatcatttgcaaattttgtattatattttttaatgctcagcatctctgccaaaaactcgcctccttttcgtctcctttcccaaccaaaaagtgcacatccgcgccttccccagtggtcattaaatggcgcattcgctgcaccaaactgtcggcatttgagaacattttaaagaatatgtatgtatgtattatcaaattctagtttttaatggctcaaaaaaactcggtagttgtcatttttggtcaaaatctgttaatgttatttgtgtgttgtgaatcattctttctaccaaaaatgaattattcattaaacggcgacaattaacatgcataaatgataaattggaaatttattgtaatattatgaaaacaaatttttatgaaaaaatggatggggcaaaattggagaggaaaaaaagaacaaaatgagtggggaatggggggattgacctcaccttactatgttagatggaccactgaaaaaaagagggatggatgggtcatcgacggattggaggggcaaagccaagcgaagaaaagaaagcaaagattggcattggcatggcatagtaaagaatggcattggcatggcatggagaatggaacaaaatggaagaaaacgaacaacataaaacgggaaaaagcataaccaacaaaattagggagaaatcgcttaaaatgggcacatatttcgtcaaaaaagaaaatgcgcatcctttttaaatagagcgaacatagaaatatttccaaaatagaattttaaggcttaaaattactttttatttttatttttatacatatgaaatcaaagaaaaaggaaaactaaggacgagaaactgtgaaataaggacgaaccttagaataaggacaaataagacctctgctgttttaaaggacaattgtaaaatcatttcacagaattatataaattcggcaaatgaatgaaggcgctttttaaagttacagcatcaaaaaataagtatatattttaaatataa

SEQ ID NO: 21337 - DNA, 1465 bp, Heterodera glycines
ttgctgtgttatttttccattgctaaaacatgtgtcatttcttttcacattctttttgaatttaaaaaaagcattggctaaaaaggaaatgttatttttcatgctttttgaaataaaaaatttgtcattctgatacatttcctcgtgaattatttaatgaattatcgtgttttaaaatttcaattttaattgataaatattattatttaagcggttttaaaaaaagaatttttcattcctttttcggtgaaaaagcccattttacgtaaggctatttttaggagcacaatttcgagaaaccctagctgcttttgttaagttgcttttcgagttcaaatctaccactaaaaatttttatataaaagtttttgttacaaataatttagaatttttcaataaaaacagccaaaaaaatgttcagaatattaaaccaattagttcatccttgtaaatattaataattttcactaaattagttcatatttttgtatttttagactttaaatgggtcatcataattcagcgacgttcctttttggcttacttttaggtaagaaatttaaaattatttataaaattataaatcaaatattatttttcttttaaaggttattttttgcccgaattggcggcacagcttagcaaagatgagcaggattattgcgtcaaattcagcaacaatcttcgcagcaatgtggccactgggaatcagcagaacaaaggcggcggcaaattgccatcggccacgaatatgttggagttggcatataacgagacaattggccaaactgcgcaagtgagcgacaattttttattgaggccttgtggagatattcgtgctttgtcgtttcttaaattcagccaagggccacgaatgattaaaaaaatgcaacacataaatcacaagtttaagcaaaattttttaaaaaattttgaaaatcaataatctgctagtgaattcctagagctatatatatgtataatgatactataaaatattaattaggtagttgaatttgaatcaaaatgaattgaatgtgttacattttttagtttttatcccttggctgatgggtcgagagtctcgacttaagacgacctttcgatttttttttgtctcagtcctggaattctatgtatacattcctgaaatttgttagtattgactctcatccctgtataatgaaacatttcccacgtaggcatgggccgacaaatgccaattttcgcattccaacacggcagggctgggcgagaacatttactggtccacgaaggaagggttcagcaacagtaaactggggaagttgttcaaaacacaaattatgtaattaaatatttttagccgaagcgttaaacaaagcattcgctttttggtggaacgaagcggtgacaattggcattccggaaaatttggtggtcgatgccaataattacgagccgattgggcactttactcaggtgc

SEQ ID NO: 21338 - DNA, 2137 bp, Heterodera glycines
cggctggtgggagttgcgctgacgaacggccctgtcctttgttggacgatttggcaccgcccggctcttccttccctcactaccctgctcggacttgacgacgacgggagttcacacccgtctcttcggctgctccgactggtgggagaccgaactatttgctgctgcttcgggcactcccgaacttcccccaattgcgacgggaagggaatttgatcgggagggttggggaagacgacgtaggccgccgggaaaggaatggatcaggacaggaatgggcgccctcgtttggccccgcacgataatttgccgaccgtgatggagtgaggagggtctttttccctccttctagtgtcccccgaaaacgaatccgagactccgattccgacacaaaatttattaacgaagcgatcgacgaattaaaaatgcgtaaatggtgaaaaattgatcgaaaagtccagcaaacgaataaacgcgaatggttggggggtgaggaagcgaagagagcgaccccttgggcagggccgcttaaatagacattcgaaaaaatgggcggagtgacagacggcccgataatgcgataagaaaaatgggacaaaaaaatgggcagaaattgtgatgtgaaaagtgtgaacaaagaaatggcgcataaaattaaaatgtaaattggcagatgtgaaaagttaaggaatttgaaaagaaagaactttgtgcaaaattgttttgcacaaagtttgggccggagattagccagccgatgagaaatgaatttgaaaagtgaagtaaaaatgggacaagaagaataggaaaatggtgttggagggtacgaataacgaaaggaaaatgatcgaaatcagcgattgagagattgatgaatcggtagtccgcccgatcgtctcgttgccttcctgcccttctttcggtatttcttcgtctttgagggtccggcccacgggttcgtattcggtaccgagaaaactgagtccccatggcggtcctcttcgtccgtgtcaaattctttcccgattcgctgcccgtccgtgcccttgttgaacgcgagcactcgcgcacgccgtggcgggttggcacccgccttctcgtcgccaatgagaaaattggcgacaagctccttggcgtcaaatgtctttagatctgtagagcatttcattatttagtctctttgctttctatcaatctgttctgcgcgaatttcttcaatctcttctggtttacattcagaatgatgttcggtttctttgccatgtcaggttttccatctctaagtataacgcttggaactttgaaatcaaggattttatttttatattttatagaatggcatttatcacatgaaagataaatggcattttggtactgatttgttttcacatatttagccaagtatcatttatccaattatataaatggattctttaagcttaaccgaatagcatgcttcaagttttaattcaattattggatcagatgaaccctaaataggttcattttttgtgaaattactattaatattttacaaaatatgttttaagggttctcaagctcaaattgattcctttatcttttttatcgagagtgcagatcaggaattgttttgatttctttgtgcttatatttttttttaccaagtcattacttcagcattttcaacaaattgttcgtatctagttgaagttataaatatgaagaataaagaaaataataaataaataaatgcttgagcgtaaaacattgtttcaaaagtcttcattttgtaataaattgaaatttctgattaaaaaaatgaaagaataaaatatttttagaaatattttttacatattatataatacaaataaatatttccataaaataatattctttggataaatctagggaataaattcgtgggcaaagctaaattgttatcaatactaaaatcaattccattcaatattaacaatttttttattagataataaatattccattatgttatagctatttatttgttaattaaagatgggattaccataaaatgttgattgataaaaaatcataggaaaaaccagatttcggatttttgcactttttgtgaagagtcctagcaccgattgtttcgtcactattcagttcgtca

SEQ ID NO: 21339 - DNA, 2478 bp, Heterodera glycines
ttaaatttaatattcttaaccgttttatgtcttactgtgttgggagtgccacggcacagactcggtccaacccggtgcatgccattgtcattgggccaatcgccactcacagcagggccaatcagaaacaaaaaacagtgtaaacagcaaaataaatgacaaaaaaattaatatagtaatagccatgtcaaaatcacggaatttactttccatcgcaatcaaaatcttgaaaaagctgcgaatattccgaaacgaaaatttaacaaaaattgaaaggaaaattagtgtgtttgtaagttttgagtgtaagatttcaggccttgaaccgcatttcattcaaaaattctcgaaaaacaataaatcaacttttttaaaaattttatttctttatacatttacttatctttacgcgagatttgcatattctaaaacaaaattacaaaatataataaaattttttgctcaaagaaattctttttatttcaatcaatgggaaaaatgactttttcatttttcatttattccatttattatattgtgtatattaatcttaataagattttttcttgttttttattaatgcttaactttttattgcttttattggcaataaatgcgactaactttgatgagattgcaatggaagaatccattggagttgatcaaaccgacaaacagcagcagaacaaatccgatgaacacaacaccgcttcttctgcttctgctgatccgtcaccaccaaacatcgaatttgctgaacaaaaagcgcaaaaacaaaaaaacatcagtaaataaaaaataaatatttttaataataattggttgacaaaaaaaacataattttgttaaaagctgctaagatggcatttaaaaccaaaatcaacgattgcttgtcaccgaaaaattgatgcaaaaatttgcaaaaaattgggcatttgtcggggaacaattggacgctggaagaaggaatttgggaaatcaattaagcatttatttttttttattaattaattaattagtgttttaaaataatttcgattttttcagttaaaaagggtcgcactgatgctgaaaaatatgaaattgttaagcaataccataaaattaaagagcaaaagccgaaactgcgaaacattgacatagcggaacaattgaacatctcagagacaagccttcgcaactggagaagagaattaaaaagaagattttagaatttcacactaaactttttccgaattccgatccgatttcgtttttttaaatttatggtaaagattttgctcactgccaaatgcttggagtccaatctcaaaatttggccacgccataaaactgctgaatgacctaatctttttggatcagaaaattgagtgcatcttttagaaagatttcttttaggaaagtcattcaccgtgtggctttgttggtgttgttgttgcgaaaaataaaaacaacccacaaaatgaggctaaaggttctgttctgacggaactgaccacttcctgccgggaagcttttccttctctgctaatggacatttaattatttttttatgtaaatataaaaatttgttgctgtttcgctaacaataataaatgggcgcatcaatgttaaattcgtataactgttggacaaaaaaaaaacacttctaagaattggtgatgctcaagagtctcgagccaaaatttcgcatttatcaaacagcgcttaggtataggcaccgccgatgccccgcgttgaccaaagatttttggaaacatatatagtgcggccggccaaaaattcttgattttacaaaaatgaaaaatatttttaaggaaaagattaaaattaacaataaattaaattactcaatttttttgcaccgagaaaatagccggttcgttccgttaaaatataagtaccggtcccggcttttctggtctcggcgagtcacggtcccggcttttcccagaatttacggtcttgtgcatttctaattttttttttttttttataatttttatgtgactaatctaatcgctctttgatcagaaagcgataggatgagtttttacctccttaacaaaaaatatttggaaaaaagaacctcaaaaatccttatttctattgaactcatcagtttaggttgttcgagataaaaaaaaaaaaaattgcgacgtgggaaacgagagcgaaaatggattcataaaaaagccccgccccctcgctttggctttttaatttccagaaatcactcataatgaaaaattacaagcagatttacgtgggtttattttagtgaatcaataaataagcaattttttattttacgagttttatttcgtaatataatattttccattttcttattggaaagccaattattctaagcggcgctgacattttttactgctcacttttttaggcactaatttcttatcattttaccagggattcgaaatctgaggatttttcctcattttgtggtcttttaga

SEQ ID NO: 21340 - DNA, 1607 bp, Heterodera glycines
  misc_feature (20)..(20): n is a, c, g, or t
  misc_feature (1457)..(1457): n is a, c, g, or t
  misc_feature (1482)..(1482): n is a, c, g, or t
  misc_feature (1543)..(1544): n is a, c, g, or t
atttgcttcagcgtgtcctncgtgacaaattaggccggtggacagtaaaggccgccctttccgacactgccgccgggcaaaatcgaccaaaaggcacatcaaattttgggacaatctgtacaaaaattgggcataattatttaattggccttttaaattgccgaaaagagtatgtaaaaacgagcagaaattttccattttgtggagcaaaaaaaactcaccttgcgcagaattttcgcacaaaaaatccatcgcatcgcaaatgaccacttccaatcggtcggattctgtcggaaagtcgaaaagttttcgtgcaattgccaacacctcggggtcaatttcaaccgcaacaatttcggactgaaagggaaagactatttttagggggggggggggagatttaacgttttataatttggtcaaaaaaagtttaatgaaaataatgcccaattaatatacagaaaataacacagcgaaacaaaaagacaaactaaaacacacacctgcttgaacttgtcgtgcataaacttggccaaaattccacctgataatggcatttttaagttatttttgcaaaagcctatttttccaataccgccaaggccgagcagtgcaatgcgaagcggcgcctccaacgcatccgccaaaccggcagaggacaacgacggcaaaagtgtaaacgcagagagcatcattttgtggtgttggcatgacaaatcggaccacacaatgtgccaacggttgccattttttgactcttaaaaataatgcaaaatgtcagtcacaatataagtaatttttctcagcaaatcccccctttttgctacggcactcacttcgcaccacctccacctcggattggatcagattggcactgtccaggaacaccaaccgccgccgcgtggcgcccccctcgacttcgacctgttcaacggaccatttgccactgatttttgaaaagccgtgcccaatttgatcagtgacatcggcagagccaagcgacagcaaattgatctgaagcgggagacaaagccatggaaaagcgttggtaggcgattctgctgatttaaattttaatttgccattgcttccgtgacaaatcgtcgcttactttttggccggcacacgccttgggcataaagtccaaaatgaacacgttcaattccctctgaatgtcctcaaccgtgccgtatctctgaccacgaaaaaggctgacgaaagagtaaaaaaatgcaaaaaattatctaaaaattgtgttaccgtacgacgacgagtcgatgaagttcgcaattttttctgagaactgtgcggccattttgagttgcgaaaagccaatcattttctctaaaataaaaaattaaatggaattaaaacaacggaatttcaatgagccgttcgctccgccaatagactgtttggatatttaattcacaaaattttgtggctcccaaaattgngacggaatgccaacctgcctaatgncactataaacgcgccataactgcacattgttttcaactgttggtcatcgaccacgaacagnntcgtaacgtttcgcaccgtccaatgcagaattttgatggaagttttggtcgacggggcctctg

SEQ ID NO: 21341 - DNA, 1007 bp, Heterodera glycines
aggaattgggcaaattcgagtccaaattgataatcaccgaccttgaaaatccccggaaactgattttaaacataaaataagcaagttaaattagggaccaccattctttacgattgcctcaaaaactgcttaagaccctcctatgtgtgctttaaaaagtgccaaatcgaagatttattacccaccaaaatgtaacggccaaagggcgcgagacaacggccaatctcacggaacatagaagtgaccaaagcatcgctttcaccgcccctttcgtcggcaccggcggaggacggcaaaagggcatcttaaaaatgagacaaatctggcacaacaaaacattgttgaaaaaagtaacgattggatgattaaatcgcaaaaaggggtccatttccgtggctttttgtgtgcgtttgccacttcgttcgcaaatgccgtgccactcacccaaagtgcccttgtccaacacaacattcgccgacgcgtccggcaatccgagctaaaaatgccaaaataaaaaggataaatttgcaaaataaaatgtgacgtcagcggcagaacgttgctcaaatttgagactcggacgcttctcggagtgtttctttcgctgctgtgcaatcacctgaaattgtgaaaatgagttaagttggaaagtcgcacaattcacaagttccatttttaaagtttttcgtagtgaaaatggatggttcggtgaaagaatttttgcaatttcttatgtttcaatttctaaaaaccttcccgatatcgaccccacttttttaccaaaactttgaattttaaccaaaagttgcaaaaactgcatttctataacaaaaaaaacaaccacaaaatttctgcgttttctaattctcgtttggaccactttgatgtttctttaaaaggtttatcaaaaaattaaaattttcattggatttcatttatcgtatttttccattttacttgtccatcgatgtcaatgctgtgaatgttgcggaaaccgtttcataaag

SEQ ID NO: 21342 - DNA, 1935 bp, Heterodera glycines
cagagcacgacaaatatttcaacaaaaatttttaaaaaattgactagagcaatcgaacgctatcggacgacataatggaaagcgataatagatggagagtatgtataatatatagcaatctattgggttctgttatagttacttttgatgtaaactgtcttgattagaatattcgatgacaaaatggcaaaatatgcatacaacctgcatatgttttttgctgcgatggtcatttataaaacatattgtccgattacatagctttgttttccatctgaatccatatggcgttttgtctttgcgccatcgattttttctcgcttttttttctttttttaccgtccgatgtagtggttacaaaaacgaaaaaattttgcgattttgggcgacttttttaaaaagaatagattttttaggtcaaaatgaccgggcccgggacatggaaaatggactggggcgggtttgcggggccgcgactcacggtccaggtggtttgtaccatgtacaaaatagggactgggatgggattcgcggtaaaatcccggcggggccccggcctcgtccgggctatagtgaaaatattatataagccatttttttgtttcataaatcaagaatttatttgcattttgtccacaaatggccaaatttgaagctttgagtctttttaaacaaattttcattgataaattttgtttaaaatttagaatttattttacagtgaagcttcacataacttgccaacaaaaccctatataacattttccttttttattttttaagaaatgccataaacttattttgtagattcccgtggaagttttcaaatttggcaatatgaaaaaagcactgcacttcctgcggcagtttttgcccaattccttggcccataatggcatggcataccttttcccattcgatgacacgtggatgcaaaatgttgtgaagcagccaactggaagagaacacattcggaagggcatcttcaacggggatgaaaagcacgaactcgaacaaaagttcgggtggaaggcatttgtgggtcattgtcggtagaagcaagggacagtctcgataatgggagtaattagtggctaattagctaatttgtggggaatagttataaagtgtggcggtcagcagagaaatggctggctgtgcttctttctcgcttttcctttcacttctcactctcactgtctcatgttcttttctgctacattctctcgctttccttcgtcgtctgtctgcgttcattttgtcttcctttcgcttacactttttctatgcttctctgtgttctcgaaaaggaaagggaaagatatgagagagagagagatgggagagagagaaaggagagagagagatgggagggagagagagtggagagaaaggagagagagagagagaaaagagagagaggagagaaaggagagagagaggagagagcgaatagagagagagagagtggagagaaaggagagagagagagaaaagagagagagagagtggagagaaaggagagagagagatagaagagagtccaacggcgcgccaacgattcgtcaactcagtcaaattcggacaaattttatatcattcgaaagaatttttggtaaatattaatcatagctcccagactctaaattgctcaaaaccacttttataggttttcttatgcgctgaaaacgactaagcaatcaaaaattttggcgcgcttcaactttaaacctgtttttgaaccggttcaaaattcgaaaaaatgaacaaaataaggctctcctaactttttaaaggatcaaatctatacaaatttggtatcattcgacagctcttgacgcgtaggtatattttttagcctcgaatttagcttattgcgctaaaaaaccgccgcacactcgactacggcggccagtaggtggggcgagactacgg

SEQ ID NO: 21343 - DNA, 1771 bp, Heterodera glycines
gggggcccaaaacgagggcccaaaaacgagggcccaaaaacgggggcccaaacgcgggggcccaaaaactggggcccaaacgcccccgactcgtccaattttgggctctcagtgcaaatggtaacatgtgatttcgtcagaagtgatttcgtcagtgagtgatttcgtcagcagtgatttcgtcagtaagggatttcgtcagtgataataatcattttttatgaaaaaaacatttaatttttcataaaattaaaattcattcgataagtgagggatgcgcactgtgccccccagaccaaccgcaccgtctatcccggattcacgtatggaagcgacctttaccttttcgagtgtgttacgagtagctgattttcgcgtagcccagctgacggaaagtgggcacgtgaaaagcacaaataaaaatggattcggcattgcaaaaatttgagaaatcttatagaggactttgcaaatcgtgaatcgtttaaatatttacgggcctgttcttatggctcgaatttttgaatttttttagctaggtgtacgcttttttaataattaattttcactgacgaaatcactcactgacgaaatcactcactgacgaaatcactcactgacgaaatcacttcactgacgaaatcactcactgacgaaatcaccgggaaccgagtttcaattacgaattaggtaattaattattttttattaaatttttaaaaagaaattatttttttcgaaaaaataaaaattctatttaccacccatgggggataaatggagactggtggattatttttcaaccctctcagaaagctggaatattggagactgagggattaatagagtgggtgataattagagaaaatacggtatgtattgtgttattaacccacagtttactgtacaaaaaattctgtgtagactttaagctgttgattgataccaacaatgttagcaatgacctagtaagaaagaagatggctttagtaaactgagcatggtcattgattggacacataaactaaatttaaagcctcaatttactttaaaatttttatttatgccagttttaccatcaaaatttccgtgcatttttcgcttttatccaaagtgcttgaaacggtgtgaacaaacaactttaagtcgagatcgattaaaaatggaaaattcacgtccgaaaacagtgataaaaaataagaagtccatacaggcaaaatcaaagacatttagcgtttttgcatagaagctcgatgtgaacaaaagaacttaaggcgcaatgccaaataaaaaatgagcaaaaatttccgttgggaataggcaacaaaaataataaaatattgggtcaatatgtaaattcatgcgcattattttgagaatgtatgatgagattacgcctccagagttcgcgccttaatttcgcgagatttgatcaacgtggttctctcgtacccgattgcacaaacggaaaatttataaaaggttgccggaagtaacggaccgatctcgaacacatatgcaggcgtgctgggacgaaagctgtcaccgtggtaaaactggaaaatgggtcaattaataatcatacttttttggtagatataaaaaaagttatagtccaaaaactgaggctggcgcccaaacgaggtgtacccattgcctgtgtggtgaactcaggttaccagagacgttccccagtgggttgggtatataccccctcctataccccttcatactagcaatttttaaggaaatttttttttgcttgaaaaat

SEQ ID NO: 21344 - DNA, 2533 bp, Heterodera glycines
tttaggaaattagcggtgatcaaatcaaaaatggtgcagttcaaaattaattgacaccaaaaagtgattgaattgtaatgttcaagaatttgaaaatttaagtgatctgtagtgaaaagtattttaaaaaataattccaagaaagcctgatcaaatgaaaaattttttttcttattaaaatctgataagtaaatttatatattcaacaaagtgattgagctaattgacgttgaattcattattttttttaattaaattcaaaaatcgtttaaaaagatattgcattaaatcaaatcaaattaaattaattttttttttaattaccgcttggccttgggatccattacggcaaaacgtgtgttcaagacgggtgtccacaggccatgtgtcttcacgctaaggtcggccacaaattttcgtgcaagtgcaatggtcacggattggccctgcgcagtggcataaccgacgcaaaatgtgacgatggcaaatgggaaaaggtactgcttgaacttgacggcgtggtgcaacagcatttttgagatggaaatgtgctaaaaagtgaaatatgtgcagacaatataaatgtgtctgaaagtgccaaaaatactaaaaattcttatggagtggcaaaatattgttagaagttttccacactagctttttattttttgattgaatttaagcaaaattttattgttaaactaaatgatttaaattttaagctaaatgatttaaatttcaaaaatgcccattcatgcataaatttaccaaattgtaataatttgtgcaccaaaatatttgttactgtgcaagaaaatgctaaaaaacatttctaaatttaaaacgaagttttcccgattattttttcttgtttgggtgattaagtgagattttataaaatggttaaatatgcttgttttaaatttcaacttccacattgattttttttatttttagatgaattgaagcaaatttgcaaaatttctacttggtttaaatttcaacttttcgcaaaattttattgacaattaaaaataaaatctataataaaaatttaatagaaaatatcaaaatttatatgcttaaatatataattagaaatgaattttgttggtttatttttgtggatattgtacagatatgactgctgatcaatcaaatttatatagacaaataaattattactgttccgtataaatccagaaatgttcagcttcccactcccgccccctccggggcatttcagtcatttccgtcttgaaacatcaaatcatttacccgcaacaaatttcccacgagactctcgagacgttcaaccgttaatttaattgatgaaaacggaaaatgctccacttttttttgtgtgtcacgagacgtcaaacggaatcaaacacaatgttttcagagttttgctcaaacgcaacattcaatcagcgcaatataattaattagttaattaagtctgcccgacggcggttcgtctgtcgttcggcacggcgattgatcactgatttaattaatttaaacgaatgctgatcactgatccataatctttttttgtaatcaaatgaaggatttagcagcgcagaaacgagattagcaataaaaaaaataaatggcgaattgtgaatgcgttgttgctaattaatgctaaggacccagacataattaagtaaataataaagaaaaatagaaatattttttgcaggataattaactatttttaatttaatttattattttatttaaaaacaaaatattattttttgaatgattttaataaaagaacaattaaatgagtattcaccgtaaattgctaaccaaagtttaaatttgaaattaattttcggtccaattaatgctctgatttttagatttttaaatagggcttgaggatatcattctaaaaattttacaatttatctgaattccgaggcttaaataatatttttgaaaagtaacagcagttttttgaaacaaatctcgttcaaagatatcaaaatctttttaaaaagcaactaaaattttaaattttgagttcatatgagaatttgaattgcatttgtcccaaacaaaaaacattacctttatttccattttaaatttaagaacgcaattttataaaattgtttttcgtgaaaattccggaaattgtgtgggaaaattgtgccatttcctgtagaaaaatcaattataataataacaaatattttatttgtcacaaataataaataatcctacttctcaaaattatataaatattcaattaaaaacaaaagaaaattgcaaatttataataataaaaaaaatgaatgtatcatttttacaaaaattatttttttattcgctattttataaaataatatttgtggcttcagcagatgaacaaagtcaaaggaaccaaataaatgggtgcaagaaaggttttaacataaatttaaattaaaatataaaacgaaattcaccatcttttcctaggcataaaaaactttcaatgataaaaattgaaaattgaaattttaatttatattta

SEQ ID NO: 21345 - DNA, 1641 bp, Heterodera glycines
ttttttctttctcaacaaaaataagcattcttgctattattcgaatgcatttgaaaaacgctattaaactgcaaattttcaaaaaattttattcatgcacaaaaaaatcaggaaaaaagttctaaatattaggtttttgaataactttttttgaaacttaacgaaaattttgaaattttacaaattaataataaacactgagagctatcgaacaacaccaaccaatgcttaatttgatttacaatgaacaaattatggctcaaaaagtcttctgacgacgtttcggccaacgccgttttgtggtgcaccgtaaaaaccaatcctctagtctcgatttagaccatatgatttttaatatggttttacttagggtgtaacataagtttccgcacaatttttttttgacaaattcaaaaattcataactccgtaatttctgcagttattttaataattctttttttattttgttcgtcagaaagtcttctttcatttcatgccattgtttcattttttatttgcttattcaattttttagtattttttcccgaccatgcaaaaattgaaaattggcccactaatttttctcgatttttttatggtcaaaaaagtaacctgatataacaaaaaagaaggttttctgtacaaattagaccagtagaatccgaatatggccttaaatctgacctatcttttaaccctgagcttgtactgctccaactccatgcatgaagttggagctgtacaggtttgttgagaacccagagaccaaatctaaagccatattcggactcagcgtggtcaatttacttagtttaattaaattcggaatttccaaaaccacttttaaaacattttgttatttgatggtcttgaaaaatgccgtttttggagaccatttttagactcggccctccaataattcatttttgaagtaataaaatttttttcttataattttttatagtcctaactttgctctatttactcacgttttctctgcctctgtatctcttttcattttctttaaatcagccatcaaaaatacatacctcgaaaatgaccatttttacattatcaactctaactccttaaatacttttcctaatgggatttatcccttgcccgataaatagcaaactcattctcaataataatgtcagatatttcggatcatgattgtggttttctaaatttatattcataaaaaaattctttaaaaaaagttgtgcggaaacttatgttacaccctaagtaagacaatttttgaaaaatttacacaaaaatataggtaattgtggaattgtttaaatcctcatttatatagggtcggggtcacttcgccgcggcaaactcgccgcggccatctcgccgtgagaaactcgccgcgtggccaactcgccgcggcgctatctcgccgccgcccaactcgccgcggccaactcgccgcgccttgttttttggctatctcgccgccagatttttttcattgaaaggttacctcattattttgatataaaattaaaaaatgcattactttatttcataagaatcattaaaataacaaacactggtccataacacaatttgattcttttcgactttattcgaattcaggctggagttataaataggttgaaat

SEQ ID NO: 21346 - DNA, 1737 bp, Heterodera glycines
  misc_feature (34)..(35): n is a, c, g, or t
  misc_feature (38)..(38): n is a, c, g, or t
  misc_feature (50)..(50): n is a, c, g, or t
  misc_feature (1626)..(1626): n is a, c, g, or t
  misc_feature (1690)..(1690): n is a, c, g, or t
tcggaagtataatttttaattattttgaattttnntanataaatttttgnagtgtttaaaaagatttaaatttcatccaccatcacccgccttttttttgtttttctttgccagaggcaccgtttaatctttggttctctggtgcttagctcttgtcctaataggacaaataattagcatggcttctcagaaagaatgttcattaaactgctcataattttcaaagtctcatgatttgtttcacttttttctttctttctcatttcctttttcatttacttaaaaatttactgcttttgtcacacttaccttttttctctcccatccccattctttcccactctttttccccctatctctctctctctctctgttgttgctttctctgtcagtctttctgcccaattgatccaatttctgtctttgatttgagccaatcttctcgatctcttcttctttctcactcctcgcaatctcgcgaagttggaggcacagagaaaaagaaagtgggggggggggcgagggatggccgggcaccacaacacagcctaacccccggctgaatctgctgcaatcggtcggccaatggtatcgaaggagtgtcccttcccctcccctttttgttgttgtttttccatatccctcccctttcccgcgtcattttaataacagtgaaaaaacgactttacattgggaaaggagtgtaataaataattaattactaattacgtcttcactcccatttttaaaatcatttttgatcattctttgctattttagatggccatcgaattgaacaacaacaacgcatgtgcatcaaccgaagaggacacaagcagttcaccgaacgcggccaatttgaccggcacgcccagcggagaggcaatgagcggcgaggaaagcgcacgactcaaacgaaggttatttttgcggatgaaacagttcaatcctaaagaaactcattgagttggccgatgcgtcaataagtaaaacttaaaagaagcttttaaatgtttctgtggtttctgggtggcaatggacccgtaatcagagatgggggggaagcattcctatgaaaaagtgaaaggaaaaaactaatttcctttgattttttcggttgtcataaaaataatacttttgagtcttttatgactttttaatcaaattttcatctctctggacctattacattacaccagagtatggaaaacaattgtgctttttcgcatttaatttctatgcattttcccttttcttaattttttacctgaccatagttttttctgcaaaaaaaaattgaaattttttgttcagttatgttctgcaagaattggtggagtccgagcgcacttacgtccaggacctggcctctatctcaggttctaatcccttcgaatgccggacgaattcggaaatcgcaaaatgcgctcctttcagacggttacatcgcctccctgcgggaaatggaactgagcgacgaggacagagagaaagtgaagatcattttcgccaacatcgagcagattctcgactttcacaaaacattctttttgaaagaaattgaaaagagtttgaacgattacgaagcggcgggcaattccttcattaaatatgtgactcatttgngaatttggacgcattttcgaacattttaaactttaggaacgccgactgcacactttttatgtcnaatattgccaaataagccaaaatctgactttttggtcagccaggact

SEQ ID NO: 21347 - DNA, 1809 bp, Heterodera glycines
ttaattctgcgttggatttttgctccccataattgtttgagtaccccaaacggacactgaaaaaatcgatttttttgtttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttaataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatt

SEQ ID NO: 21348 - DNA, 2502 bp, Heterodera glycines
aaaaattgtgaagaaattttcaaaacctttttttcttgaaatttttaaaaaagagtaaggtttcctttttccattttatttccgcccattttgaggtgttcgagggatggcgtcttctgatgaatcgccaagcgccccattacagcaaatcgcagcttaacaaggcgttcaatcagctggtcaacttttttaaaaagcatccaccaacacacttcaattctcgaaacatgattctttcttgctgtttcttctcgttgggcctacccccaaacaaattttgggtttttccataaattgggacgccttaattccgcagttgatcaccatttgtttaaaacaccgtccgaatttcaggccaaaaagttgcaccgtcagctcgtcattgagacgggtcgtcgcattgacgggcgcgcgttggacgaattccgtcccattgactgtcgcgtgaatttgtacaaaaagttacacggctcggcactgtttcagcgtggccaatcacaggtttttactgccctcgtcgttgctgtttttggtgtattatgatttttccccgatttaagtgctttccacgggtactttccactccgctccagcggcctttcacccggacgcaattgccgtaaatcctttttttcggaaaataagacaattaactggaattaatgttaaagcaattgctcggtgctcaacgcaagaaaacgtttatgttgcactacgaatttccccaattcgcgacaaatgaatttgaggagagaggcgggaaaatgaacacaaatcaatgagcttttgtactttttgttacaggaagttttgcaaatcggcgcgaaattggccacggattgttggcggagaaggcattgcgccaagtgatgcccgagcaattcccgtacaccgtccgactggcgtgtcaggtcattttgagaccggacagcgggggtcggagaggtcccgatcaatccctagaatttaaaataggctcgggacggatctcgagtcggccagccctgggagtgtcagggatggatttatagcaaaaaagcaatattttagggtaaattaaaaaataatttaaccgattttgtataaaaatgggcccttttggttgtgttctctctctctctcccactttaattggctttttcaggtcctcgagtccaatgggtccacctcaatggcctccgtttgtgccggttctttggcactttttgacgccggcgttcccctcctggccaatcacgtggtgggaaaggaaatggcaaccaaaaaagtttttttcatttttaggccggcctggcacttggacttttcaccgacggagagggaaagcggtgattaattaatatcatttaaaactccaattataacttttttttaaatcgaatcgttttttttcgtttagcaccgagtacactctgatgaccgatttgatgggctacgaggattatgccggcgacatggatctcaaaattgcgggcactcaaacgcgcttcaccgccatgcaaatggacctcaaaatttgcggacttcctttgaggtgacaaataattaacactaaaaatcggaaatccgccttaaaaacccatcggaattgttgccaaattttccatgtatttttagtgttcttcgcgacgctcttctccagggcaaaaagggcattgtccatctgctgggactgatgcgcgacacaatcgcggaaccacggtttgtgcaataattcttaataattttatggtcacaagtttgggttaggtttccccggtcccttttttttttgaaaaatccggaattaaacgtaatgaaaaaattacacaaaactttaagcttaatgtgaatgatttgttccaaaagggccgagttcaaagcgtccgtgcccatcgtcgaaacaatgccattgcccgtctacaaaaagtcgatcattttccggtcgggcggttacaacgccaaactgctcgaggcggagacgggcgtgaaggtgaccggaaatcaaattttaaaaaattatggcgactaagattttaattagttttcattgtttttacgcctccctttccatggttaagataagttcggaagatgaagccaacattttgctgtttgcacccgacaaaaaatgcatggaaaagtgtaaagaaatgttgacaaagtaagcggtggaaaaaggggctccattccaaatgctttatggtattaatatttcacttttgtttcaaagattgctggaggaacgtcaggaggagcattaccaattcggagccatttacaaggcggagattgtgcagataatggagggcggagtgatggtcagttttgtgggggcattgctctccgtccactttaattgctcatcaaatgtgccattttcaatttcgattattttcctattcccaaatataaatgtttcttttttgtttttaggtttctttgcgtgacggtgcccatccgatttggctgcgtaattcggacctttcggcatttggacggaaaaatgcaatttctttgggc

SEQ ID NO: 21349 - DNA, 1367 bp, Heterodera glycines
ttgcctgtattaacagtgaggcgacataccccccccccctttttttgcagaccaacaaaatggtgggtaaactaagggaattggccgatccttaactaacttgtaaggaaactgataagtcatagacatcaatttccagttggaagtatatgagggaaattcagtaaataattttcattttgttatccctaactataaattactcttttttagtcaagcggccgcgctcgcagagaaaatggctcattttacattattgtcgaggagcgaaatcacgctaaccttatggaaaagcttgaagactacgctaagatagaaaaggtgttttaattctgtcttcattaattttctctgtccctttagtttattatggaccattacaattcgggcaatgaaattctgaatgaggctgagataccccaaaatgtcgacgatttggttccaccgtatgtcgttgatttgccttcaggaaaggctcaagtgacacttagcggcgcaattccacttataaatcggttgcattttcacttctttttgcattcctttttctccttccttctcagatattgttccaaattgccttctgatattttcacgcgattagttccccattatgtcgttaattccttacaaaatgccgatggaaagtgttcttattttgcacaacttcttcttccgatcaattcgccgttaaaacaaagtatttgttcggatgcaaattgccaaattggtgaaacaagcgctgtttttgcttcgaagtcattggcactaatgtccgttgcattggaggtgaatgagtcatccaaaagcttaatattgtaagcaaaatattaataaaaagttttaggcgtgtagaaaattgcatcggcaaaaagaactgagtgatcagttgacaccaacgggaaaagaaataattaccaaccttttcggggaattggaagacgaagaggaatacttgccatatttgatcaacaaatgcggaccttcaaagcgacgacgcctttacgaccgaaaggtttggacagacggtggggaaacgttagaaaatgtttaaaaaaactaaccataagtcagtaacaatcaaaaaagctaatttttgaaaagctttttgaattggtttttttgaagaaatccttttatgaaatgcctaatatttttaaaatttaagaattcaaaaaagtaaaaaattttcaatttaagtaaatatggggggggtgtagtgcactcggcggggtttttcacacttaaattttcatatatattttttgttctttctgtttttgctctccctcttttgctagacctttggtcataaaccagttttacattattttagacttccaaatcattgcttgggactttgtcgc

SEQ ID NO: 21350 - DNA, 484 bp, Heterodera glycines
tcataagcggattgtttggtggcaaaatgcaaacaaatttttgtgttattcgaatgcgctaggcgggctcgacatttccaaatgtatcaacaaaggggtctatctacactctctggcaaggtatggccagccaaagcagagtggggcataaacaagaattttttaatctttggtatttcctctattttgtgcctgctctacatttatgtcttgtgccaatatgcctattgcaacagaaatttattcagctttcccgacaaattgttgagataattattctagacgatttttttatatctcaatgcttaactatcgcctttttgtttggcaactggtagaaattggcagtgaaaaaaagtttgtttgtaactatttacaataaaaatttatgtagcatttgtagggcggcaaatagggcacagttccctcgaccaacttttaaaaatagattttaaatttataaatcaaagaaatggacaacctg

SEQ ID NO: 21351 - DNA, 1271 bp, Heterodera glycines
tgagcattgtcggcactgttcgaagcgtccaagacgagtccgctggtatcgccggccgaattatccatggtggtgtcggtgttgagactcttcccaatacagctaaagaaaaggaaatatagtgcatttacgggggtacccccgtaaatgtacaagtagtaaaaaacaaagttaggaaacgcactccgcgcaaagccatgcttcacgttcgatccctttgaggctgctgtagttgcagcagcccctcgctttgaccttgtggtatcagcccgaacagccacaacactggatgccctttcctggaacctaaaaaccgcattcattttttggaattgtgaatttttaaaaagaaaaagcctaacactttgttggtacggcggttcagaacgtcgattgggtagtggcattttcggcacgactttccctgcttgtcgtaagaggcatcagcgtccgaagagctgcatcggccctttcgttgattgtcaggtcgtctgggacattgtcgttggcatcgtcctgctgctgctgctcggtgttgtcggccgcattctcttcctcctcgtcctcttcgctttcgctgctgaggtccgggccaatgtctgcgagaccgagcttcttcagcttagccttaggagcgatctgtttgagctgttgcacttgctgaaaaccattaattaaaaatacaaataaaaggatgtacaaaacgtacatttacattggtacccttgtaaatgtatatttagtacatatttatttatagataattacatggtgcaaaagaagccctgtactaactgtatatttacatgggtactacccttgtaaatgcacattttgtatattaataaggaaaaaaaattacattgtgtagagcagcggcccgagctctcagagcagccaggtcgtcttcggccgcagcaaggtcgtcttcggccgcgccaaggtttttgagcgttgcacggagatcacttttcaatccgttcttacgctttcgaaacttggctttggtgcggtcgagtgcactcctgctcaacaccacctgttggaagacaatgagaaattaaagtcagatcaaagctaaattcaagtccaattgcttacctctcgctgcagcagcccaatgatggcttttgcgcgaaggctgcgcttgacgatcgtgcccatgatctcatgggcgcgtgtcggcgttgacgttcttcaacgtcggagcggtcagaggcttgatcaaatccacgtccgccacatcttcctgtcatataaaaaacgagtaa

SEQ ID NO: 21352 - DNA, 1533 bp, Heterodera glycines
  misc_feature (1511)..(1511): n is a, c, g, or t
tctctcgctctatataaatgctctatgtgtgaccaaccaaatattgactgtaccgctgctgttctttgccgttctcgtcccgtctgttgtctcacctgccgccattgtgccacccatccaaaatgccattccgccgcccctttcgatttgtcccatttccgtccctccttctcatcctccgaccatttcatcctcccactcttccggcgactcttccctccttcctcccctatatgttcctcctcttccccctcctccaaatttgccaaaatttgggtaggacggcgacggcatttgtccccacacatttcaacacttcctctcataaaactgaaaagcccaaaattttcaaaatgaatgccaagcaaacttgaaaaaaatgcgcgaccgcaggattttctgtccgcgctctccacccctgatgtacacccccaagtattgattagaaaattaaaaaaacatacccttaagaatgggaaaagtttcccactaaattcatttattttcttggtcataatttttggtttttgtaattatgtattactggaaaaatgcattcaaaaactcgaacatatttttcactaatcaatttgattaaatattttttggattttaataaaaaaaaagccttttcggtaataacacaattgatagaaagaatcaatttaatttacattgcgaaattaaattttaatttttcgcgactacgcctttaaacttgagtttatcttaattaaaaaagttaatgaattttttttggcacgcttcaagcatcgctcggttaacacggttttaggtcagcaatttttcagctttgccaatgattcattgtttgagtattattagattaaaaatttattgatgagagtcaaaagacaacaaaccaattcaaagatataaattaggatttagaaaacaagcaaatcacgtaaaccgaggcttagttgcgacggggctcattgttaaaacatcaacagtatttccatgcttatttagcgccacaactgtcaacgcgtaaagggtcgccggcttcagattctttacgactgcggtgtaagattttttcgggagaaacgcgtgctgaaaaacgcggcatttcgcgatttaaaaagtttgtccgtggatgtgccaaatgggttgatccatttaaaccgaggatatttttgcaattgtttttattttttggccttccgcgccgaaatggggagggcggcttcgggctcgaccaccccaacccccccccccctcctttcttcataccgaatttttcagtcattttttgtgtggtgatgcttagcccagtttttttttgctatgcaatgccttcctttttgcttgcactccctgttttgtttactaacttgcggacactttatcgtcttccaaacttcattgacattcttgtactgcacttcatagcactcgatttcaacatcggtaatgctttggcttttccacgcaatggtaatcgtggctttcggtgctttcaatagacttaagcttgcattaancaaaaactgagcaaaagccatt

SEQ ID NO: 21353 - DNA, 1119 bp, Heterodera glycines
  misc_feature (95)..(95): n is a, c, g, or t
gtctgtccttctcgctttctcctcctctgtgccgtcatttcgagcccgccggtgtttgtctatggaaaatcaaataaaagtgtgtgctaaatttntaaaaggcaaagccacaaccctttacataatttgtatattaaatattgacattatttgctgtttccgatgtgggcaaagtgttgctgcaggaaggttcaggcgaacgcgatttgtttcctcgagtcaaccccttatttttaaatacaaagttataaaaacacgaataaacttaccaatttttcaaatatggggtccaatttttcttggatggtaagcgatttctttaccaaatataaaaatcaattccgaaaaatattgaaatatttacttttccttgatttgtgtttgtggcagtgcctcgctccaggcggccaacgcgcacctatgcaaaaaaggaatcgacataacccattgaacaagtcatttggtagggaaaaggagtccattaaaatacctatcaaacccgagtttcttgaactaccatttcctatgttcaaatacaccattcttacatgttagttttttgtttagactcaagtcgaatgcacaataagtgcattaaaacaaaaagctacgaataaaaccactgacaacaagtgcgaatccaacagaagaaaagcccattgacaacaaacctccaaagcgtcgaatttttggttaaattcaaggcgtaactcgtctttcatttcgtccaatttcgttgatatttggtcaaatttcgttgttattttctgctccatctcttctttaaattggtcaaatttctcgattattctttcttccatcgctttctaaaacaaaaacattaaaaattgatttaaactattatataaaacagattcttattaggattattttttgatcatttaacccaaattcaaacaaaaactgtcgtaaaatttaaatgaccattaaataatcggaaacaaataaaaggtaacaaaaacgggtcggggtcgttttggcacgggccgttttcgtacgagcacaagtttttggctataacttttttctttgccaatattagcatgcaaaatttcggaaaatctcgttaaggttcaaaaaagttatggacaagaagaa

SEQ ID NO: 21354 - DNA, 1352 bp, Heterodera glycines
atcaggacaaatcttttatgtttaatataataattaatggatataatcattatctttatataaattatgaaaatataatttaaaatttcataacaaatcagaatagctgatatgaaagaaataataaaattaaaatttcgaaattactgaattatggacattcaaaaatttagtaaataaatctattaattcgaaagaaactaccaaagaaaaaagtttgaattaacaatcaaaaaattctattgtcatattatgtctttatatatgattaaaaattaaagaaaaaaattaataaattgttcgtaattgatgttaaatatagtaataattaaaataaaaaatagagaaaagttataaatatattgtagcgaataaatttgaataaacaagtcccaaaactattacggataacataaaacaaaattaaacaaatcaatacaaatttattttccacatctaaagggctaatgttggcttaactatatttgggtggacgagcacgcgtgctcaaacatcggcaagagaccaatcgaaaccatgagatgtgtataaaatttcaatttttagacaccgatagcctgatccttgtccatcccgatggtcggtgtcatcttaaaactggcccgcacctgggacagtttacggacgagtacccggaccacaaaatcatcgaatttttctaaattataaagtaattgatgcacaacaaataaacaagtgctttaaagtttttgtgcaagaaaattcgagtgatataaacaaaaaagttgcttgaataagacagttcgaatgaatctaaagaaaatttttaattcaaaaaccaataattattaattttcatataataataatataaaaactttttgaatgttagagcaaaaataaatattttaaaaagtcaactagttaattcatatttatatatgcaaaatattatgcaatattaataatattattattaaaacaaagtttaatagaaattatcgaataaaataatttatcaaatgttttttttatagttttagttttttaggcactttatatgttgaaagatatcatttaaaataaacgaagtgataaaaagagagacaaggatattaaatatttgacataaaaatgaaaaaaagtaaaaacctttgatatcctcaaaatgtgccgaaaattttatcatagatcgatttattttagtttaatgaaaagaaaataattatcagatttaagtaatatttttagttcaattaaattttcaatcaaaatgatgtgaatgttgtgattctacccagggagaaattttcacagtagtcgtgaaaatatttcacatagtcgtgaacgagcattgatgatgattttta

SEQ ID NO: 21355 - DNA, 1605 bp, Heterodera glycines
  misc_feature (225)..(225): n is a, c, g, or t
  misc_feature (256)..(256): n is a, c, g, or t
aaattaaaatcgataacccataaaaataatacttttatttcaatatgtaaataaatgacagaatttacatcaattagcaatcaaaaaactacaaaatgaagaatttattatattaataatattgataaataatattaatattttaatcttatttgaatcactcataaaatttcaaaaacatacatattatattaaagggccggtctaaatgggcccgagacctgnatgaaatctttttttcgtaaaattttatttntaaaaaataatgattcaaaatattgtccattatttctggaagcttaaaattatatccatgcttctaaaattatattattaatatatttaacgattaatgactaaagtgaaaacagcattaaatcatatttacaaaaaaaattcttttttctacaccatagaatattattaagccattttgatgcacaataaccaattgttataaaattaccacatataaattttcttttattttgagtaatattaatcaaataaacaaaaaatttagcttcctcactcgggcactgccggcacggaatgacagagatttttaaatagaaaaattaatacttcgcttatcagcttttgtttgaaaaaaaaataaaataaataaaataataaattattagataaaaaattaatgaaataaataaatgtaataaaataaaaaaagataaataactaatagaaagcttatttttttctgaaaattgcatatttccataattaaaaaaaaattcttggttatttttataaaaactgatattgtaaaaaatacgaaaatttgcccattaaggaaaaaataatcagataaacatttgagggataatagagaaattaataaataaaataagcataataaatgatacaaaaaataaaaagagaaaattttttaatttatatttaattatttcttttaataaaacaatttaaattaaaatgaaatttcgaaaataggagaaaataaaaataatttattttaaaaaactaaaaaaatgcacttttgtaaaaacttgtataaaacgaaaagatctaattaaaaaaatgctgtattataacgagaaagaatgtcgcaaacttacctttgaatcataagaacaaacaaagaaatacctaattatattggctttaggaaacatgcttctcaacaattcaccaatgactcagcatttaattctttaaacattaaaattacatattaaaaataaatgaaaacccaaaataaatctttaaatgagtttgggattaaaaaaaactagcaataaataacatatcaaaaatggcaaatattaatgattttaagtgctcaaaaaatgattatattgtttaatgctcaaaaaaaaaaaattataaattatatgacgaatggagcagatccattggtttgccttgtttgtaaaaattgaaatataataatttctatattttttcataaccaaataaaatattaacaatttaattcattaaaacataaaaatcacaacataaaataagtgaaaatctaaagtaaataataaatttaaacgagcttgtgataaaaaataaatagcaataaatagcttatcaaaaacaataatattaattataaaa

SEQ ID NO: 21356 - DNA, 1476 bp, Heterodera glycines
  misc_feature (6)..(7): n is a, c, g, or t
ctgcannggtcctttttccagaaattttcagcggatacccccctccccccccccaaaaaaaatttttgtacatttttgtggtctcacttaattaataaattttgtacagagagagtacaattttatttaattacgttcattagatgtagtaattaattgcgacaatatgttattttacaagcgtttttttatcaattggagaaaaaaaacatgcaaaaataaaaatgggttgtatattttaaaatggtcttatcaatttacaataaaatgggaatgaaatcccattaatttttggtcactattctgacaaaataaattcgtaatttgccaaattaaaaaaaaattcaaaaataatttttcagccgtgccttcctcgatgagcctgttgtggcttggtaaggagaacattccgccttcgtttgagaagcatgaaatattggtgagttgtgagttagtccaattaaaaagaaaataacaattttttttttggtttataattcttacgaaaagtttgaatttttttttaattttgggaaacatagaaaatcatgacaatagggacgaaatttattgtgttatccatggtccactatactaaaaattaaaaaagcttaatccatgcatgtagcgagaaaaaaaaccattttggaggaagaattcagaagttttttgttgcttcaagaaatttaattttggacaatttttcacaaatttttggaaaaaaaatttgaaaaaattttttattattcttttttcctaataattctaaaaatttctaacaataagtttgtaatatttaaaaaacaaaattttttttttgggtgggggagaaatttaatacatccaccaaaaacaaaatagtaataaatcgaaatttttgccgaggtttcaaaaaaaaattttttttttttttttgtagttgaatttttcgtctggcactgacaacagctccaccggcgccgccactgcctcttcgctgaacagttcaaattcatcaacaacaacaacaacaaaaacaagcgccaatgatggagatgaacagcgaaggattaaaaggaccaaaacaatggcaacgacgacgaccaccactgacagtggaaaaagtagcagcaaaagccgaacaacaacaacaacaatcaacacgacgacgacgacgtcgagcagtacaagcagcagcaaaaaattgttggtggtggatgaaaatgcaaaaacgtgtggtggtgttggcattggtgctgatgggtaagaagtggttgttacaaaaaaaatggaaaattggaaaaaaaaaattttttttttgaataaattttttttcgtaaaaaaacttatttaaaagatttgaaaactaaaaaactttttaaaaaaaagttgaaggtggccatataaagctacgaccttctcccgaaaatttttttgaaccatcagaattagtttaaaaaaatttatccgtttttttaaattttaaaatttgatttt

SEQ ID NO: 21357 - DNA, 418 bp, Heterodera glycines
gcattgcaagattgctaagcagttttgcaaaaaaaaaaaaaaatgttttttcattctgtttcggagaatcgttatctgtccaaaaaacgcgagcagtccccccccccctttccccgtaaaacatttgaaaatttttagcaaactttgaaaaaaattttcgattaaatttttttatttgtttgtccccacaggtgtgtggatgtggtcacggagtttgagctgtgcccggccacctttttcctcaccgtttccctcactgaccgcactctgtcccgcgtggactgcccccgggacaaattgcagctgctcggcgccgccgctgtgttgagcgcgtccaaaatgcacgaaattttccctcccaccatcaaggacattgtgcacgccacggacggtccgtctcgcgcgtcatattcaaatt

SEQ ID NO: 21358 - DNA, 2140 bp, Heterodera glycines
  misc_feature (2127)..(2127): n is a, c, g, or t
cccccccccactaatttcccaccccggggcggtgcaacagagaaggaagatatcccttatctctcatcccatcccatgcttctccccctttttatagcttcccctctcagcccaaacagcccccctaagaaacatttggccaaattttcgctcttgacaaaccgtgtgctttaccccctcccatcctcccatttgacagcttttgtgtggcgccgccgccgcttttcctcctctctcgcagccaaggcttccacccatccctcatttctctcggcttcttcttcttccccttgatccgccgatatccgtctccaatccgcttcttttcaagcagccgccggctgactgacacatgatgcaccgccattcgccgatcgtttggccttccgccgtcgtcgtcgccgccgccggtgcgtccgtttggctctcacttttcactcatttgccgccaccgcctccaccgccacaattcacatttaattttcgctcccatcagttttcattcatttggcacaagcatctcaatctcagattttgaaacccctttcgttttattttttttccgtttttttggcaatcgatttatgcttagttcagccaaccatatgggggttcggtgaaaaattttttcatttaaaaatttgtttgaaatttttcaaaaattgtcttttatttttaaaaggaaaaacataggaaaagtgacgacaaaaatttaaatgttttaactatgtctagtgtagaacataaaaggtaactcgcccggtgggactcgaacccacgaccccagcaatccgtgccgtgctctaaccaactgagctacgggcgcctcttttagaggttcttcaggtcctttatcccactttctcccacactccgttccttctggcatcacactaggccaaaatttcattttgaaaaaatttaaaaatttaacgaaaatgaaatgaataaaatttttgttgaaaattttggcagaggagagatgttttttagttttatattttaatggacattttgtcatttgatgaacaatttattttaattgctttttttggatatttgattctaaaaaaaacaaaattttatttttaaatacaactaaatgatattcattttaccaaaattccgaattaaccaattcaaaactttaacaaaatttttgtcatgactaaaactatttttttgcgtattttaagattttgttgatcgacaaaaagcggcttttgcgccatcggtgccgataggcgccgccgagggaaaaattgagaattttgaccatatttttagcagattttcattaaaaaattcttaatttttggtttttttttgggaaaaaattgattctattttcgttttgatgctctattaaaaacccaaattattaaataattgtcaaacattatgccaatttatcaaaatttaaaaagattctgaggattttccccaaaagcctcaaaaatcctcaaaattctcaaaaaattcacaaaaatcctcaaatcctcattttccaaaaaaaaatcctcattgacctatcaaaaagccacaaaatgaggataaatcctcagatctgggagccctggatatcatagtgcttcaaatatgtttcacattgcaaaactttatcttctcaatattttactcagatccccattcttacaggtgcatatttttttgcctatgccgcgggttgagaaaaatttcgggttcgggtttcgggtcgagtcaaaaaacctcgggatacgggatcaggttggcatcactgttgtgacaacaataatgttggattttgatggaaaaaaagaaattaaaaaaaataatattcaaatgacaaataatttttaaaaacatttgacaaattaaaaatgaaaaaagttaaataaacggcaaattgtaatttgtaaaggaaacaatagaataattttaaattttatttcattataaaaaaatgaaattttattacaatttaataagataaagcatccaacgcacacacgcacaaaaacttcagtgaacatgatgcataatattttaatatcttataatatttccttttcagttttaaatcattagtttctgtttggaatttaaagtttaataaaatttatttactttctcgtatcttctctnttttgactctaga

SEQ ID NO: 21359 - DNA, 2550 bp, Heterodera glycines
  misc_feature (1149)..(1149): n is a, c, g, or t
atgaagggtagggacagatgggggattttaattgtatttttgaggccggggttgaatactataaaaataaaattattttttaaattatatagaaaatttctaggctggttttaaggttcgctgattacggatctgacatccatttagaccaaatgctaatcccgacccgtattcaaacaaaaacttgaaaattctaaattttaaaaaatcattttatggtgcgaaaatagctcgaatacggattcggggttcgaattggatgtttgattcgtaatcagcgacccctaaaacccactagaaacttttttatatgatttaaaaaatgatttattttttatggtctgtaaaatgcataagtaccaaaattcaagtttccaaaccaccggcccggattttaaattttcgtttttgtcagataattggcagcttaaccaaagtgcataaaagtcccattttaaatgaagagatagaaaattttgactagcatttgtgcaagttttagtcaatcaaacataaagccttaattatgaagagaatattgaaaaataaccacagctttttttaagaatggtctttttaattatgagtaaatttggcgaaaaaataaataaaacgaaatttcgatcactttttcccgatcataacattttgaactctgattcttcacttttcaaatgctgctgctgctgaacgtcgtcgtcatccaacagttcatccccgtcctcggcaccacttccggcttcaacatcgctgacgcatccgtcttcggcacattccccgttgacattgtccatggcattccgtttccgatgcttgtcaaaaaaggcacagcgcgacggttggaagcaaaaggtggccaataaagagacgaaaagcatctcgacacagagcaaaaagcaaatgtaaacagtgggaacaaatgaaaatcatttaaaaatactgtaaaagtgccaacaaataaattgtgccacttttcctcactgctcacattgtgccaccgccgaagagggcaatttggcgggagcatgcgctatgctcggcaccatgtcgagaatgccacataagtcgccgacaaacttttgcacggaccaaaacagttggcagaagtcgacgatacggaagagcagcaaaaaacttgaaaaatcgaanttttcccataattatttcatttgaaaaaatgtgagacgtgccgatattcgtgcaacagcgaagcgccgacgggcacaattacgtaagagccgtaggagccaataaacatggaaatcatagcagcaaaattggatatttggaagtacatgtgtttgcgactgctcagctcctgagtgacagaatgccaaattatgaaacattttacaaaaactgtttgttcaccatgaacacggtgatgttcaaaatttcgagcataattcgtacaaccggcgattggaacacgagcacttcaaaccggcggaaattttgcctgaattttcaacaaaaaaaaattaattaatttttcaattttcgaggagttcgaagatcagagaatgttgggagcacttttctgatcaatttcaaattctctgatagctcagatcacttctctaatcaaaaagtttggtccattctctgatcagttttctctctcaatggtcatgtaaaacgcactctgtcggcagaaaatcctcgaagcagatcaaccaacaagcaaacggataaattctgatcgaaattcgctcgcctttggccatcagtttttcgcacatcgatttgcgagaaccgtgcagctgaaattggcacaaaaatgaggtccaatagcattaatgagttaaactgaccgtgttcatctaacagacgagcacaaaaatgcagatcatgtaatagacgagcgcaagtgcgtacaggaaaagtgccgccatcggcagaaccatgccagtgaagccacaaacgacgatcacctgaagagggggggggggggggggtggtggatagtaattagggtaattaactaattgaggaataattagataagtcactaattgcatgaggcttatttggcgtaaaaaggaggatggaatgaattttttcaaaatttcatcagatttaacgggttttcgtctaaattttgcatagaatgaataaatttttggctgccatgatcaatgatcatgtttcgtttctctcggctaatcaatcggatataatatggaaatggttccaaacgctaaaaatggttttaaaaaggacgccctaaattagttttttttaatatgttttattcaccggtggcattagcaccacccaatagagttcggagcgtattttctcgtcactgatcaaagtgctgacgaaaatcagatggagtaggcttaagcagatgacaatgccggtcattgcagcagcgccggtcatcatccaatgcgaaatgtcaccaatcgctgaaaatgggaggaaatttgaattaccaactcatttcgttcgaatttgggctttgaattagtcgaaatggacgacttttcgttcgaatttgtgtccgggcttttgagttagtcgaaatgggctggcattattcgc

SEQ ID NO: 21360 - DNA, 2451 bp, Heterodera glycines
  misc_feature (28)..(28): n is a, c, g, or t
tttttcctctgttagcagtgagttattnagatattttttatatgggttttcgctgatgagtttgttttcagccaaggtgatggcgtaagatttgagcgaagagaagaagttcaggcagttgctgaataaatatgcgagtgaacaattgcgtttgtcaaacttggtcaaaccatttgaatccttttaattaattttatttttaattgtatgtataaatgaaattaataaaatatattgcactttatgacttcaattaattagattttcttggttttattcccatccatttttttattgtggtgggcggcataacggaaagtatccaatgatttttaatacataagaatcttttttggtgctacgacgttaaaaaagatacaatataacaaaaatgaaaataattaaaaatacagtattcgcatatcaaagatattttaaaaaaagcggacaaccatttaaaccgatggcgccaaaatcaaaattacgaaaaaattttcccaatcccctagggattttttcggaactcgaacagccacacaaatggacgaccgaattcagcctttctgcttaaatgtctcgtcaaaaaagtggacgaacggtggggcgcttcacaattgctaatggtcagtctttggaatgggaaaaggaaagagccaggaaataaacagtttaatattttacctattgtaaacagtcataggaaggaaaatgttgtagcaccatcagatttttccgggtgcactacgttcccccccccccggccacttatttgactctcgacactcatttctctttcgacttcaccactcatttctctctcgatttcatatgcttgatcagatttcataaacctgatgaaatgtaagcatctttgaattcaaaaccgatttaaaattattttccaaatttaggtgcgttaacattaaacatattttggtggtaatactatactattgtatatgaaaactgttttcggtcaagtacaaagattaccagttgatcagatttttattgctttaaattttcaaaaattttggttctcaaaaatagaagtgccaattaatatgtagcattgattgacttactttttcatgtcctttggcttgtatgttccctttttgaacagttccaacgccaacttaaaaaatcgataattgcgttgttttctattcattgtatttcttttattgagtctatttacattataataataccagctttttcttatcttgtttaatttttattttgcatattctgatttaatatatttcccccccataatttgatgtagtcctaaagtcttaaactgtcttaaataggacagcaacaaccatgttatcaatcctatttgaaatttgtttgacttttgactatgcgttgtttattattctataatttttagtgactttttcataaatttagacatttaaccgaaatttactaactatgatttacactttcttctatgctttaccttagtcgtatcaaaatttttgatttcaaagtcgaaactttttcaatgttttaccaagcctttgatttcttcttttcactctccgatttgctcaaaagaataaaaatgagttcgaaatgttgaaaaaaatattttgaaatgatttagtaagtttaaaataaataaaaaattgccaaattttcaatattttcatgcctttttaccatattttcccctattaaattgcgtccgtccgtctttttcattttccttctttttatccgttcgttcattttcatttgcctttttctgacctttcggccattttccctctccaataaatgcgaaaagcaaatactcacaaacagaaaatgataagtgataacaaacatatcaaaacactggccagcaaaatcaacaaataaaaaggcacataaaaatatatgcaaatttatttttgtttttatttggcgatttattggcgagaaattccaatggcatttttctatttttggaattctcccgttttgaagaagcacagcaatggaggaaaggcgtacggcttctgcccccccccccattcccttcccggccatcaattcgcatttgaaggaaaattccaaatttttatttctttaacttctaaatttgtttcacctgttgaaattggacctcacctgccgttgaccgtttggctatgtttttggtttttccgatgaaatcccgtcgtctgagatgagggagttctcccgttgttgttgccgccctcccatttcctaaagcccacccgtgttgctgttgtggtgccattcggatgacagttgcctttggcccatccatccctttaagcggtgtgattggaaagcaaagggaaattgacacatgagaagtgatcgatgagtggggggggggcttttggggcttttggttttatccattgctttgatttggtggtggacactgcaatcactgacagccaaagggaagaagcaaaggat

SEQ ID NO: 21361 - DNA, 1165 bp, Heterodera glycines
cgcatcactcgactcagcaattccttcctcaatgacttcgttgcagaagcggtcaacatcgactggaaaatcgaagtcttcgaataattcgtcaaagattttttgcagttcgacgtcttccccacaagccacagcgccatgagcacctaacgagaagcaatagcgtaacagttttggaaattagttcaaaatgcttggcattgctcactttggccacacatgccatcgcggacgccctcttctccactcgttttggccttccattgccgctgcttctgctggccctgcttgactcccgctcccgctgctggggttcgtgaaaggatgctgctgatcctacagagtctcgctggccaatctgttccgccgctttttccgccggtcgtaccaaaaaggagggcttcatgtcgatggtctgctgatgatggttaagcattcgttgtggccgaaactgccgttgcatttttcgctgtggtgccaaatgactttcctcgtaattgctgggctcatgctaaagaaaatataatgtttttaatagaaatactttttcgttgcaatttttaatgttacttcctaccccatttttgactaatcacctaacaataagccaatttgtggcttttgggctggatttaaaaaaaatatttgaagaaatttttggtccggcgatgcagatatcgaatttgtatgaaatttgttaagaaagccggtaattttataatgttcatagttttcaataaaatgtttctttgttcttttttcggtctaaattttatatttccgtttcgatttttttgagaaaattaatattttcattttttcgaagggaatctttttatttttgcacgcctttggcctaaatatggtcaatcttattctttggtttgaccattggattttctttctctaaactaaccttggagttgtgtcgttcgaatgtgtcagtgttgtcctggtcgggccccgtgcttttttcctttccaaatcgaattatctgattctccgcctccaatcgcgtgttctcccccctcaacagattcacttctcctcgcaatcgtccaatttccaccaaagcgcgtctcaatgactcctccaatcggtgtgtgttcactttctttctgtccacgagctgcctgagcggcaatcctaaatatttgtgagctgt

SEQ ID NO: 21362 - DNA, 984 bp, Heterodera glycines
actcgtcttcttcggactgatcctggcccacccgtcagaggcgttctctgctgacgggacagagggcgatgccttttgtcattgactactggctggacatttgaaaactgttcgccaggtgacagcaccgtagaagtgggtgctaataaaatttgacgagacgaaccgagagccttgaaaccacaaaagataaaaaaattaaaataaaaacaattgtgcaaattactctaataatcaaaaacacacctcctaattcgggaaaaatatacatctaaaatctagtttttgaatccacccctcaaagccaaggatctgacgtcagatttgaatcccaaaataataaatggattaaatgaccaattcattttccacgattaccctttgccagaaagtaacaaacatttcctccatatgtacaatttgtacgtaccattgggtcaatgattcgaccgaccactcgcaacggctgtggtgaggatttcgagatagtcccactcaaaaatggtgtaggccgcggttgtatgtgcagcgctgacagattccttgtggtaataaatgtcccagggcgtgcgctgttgggggtcctccggggcaaaatgtacggactgctgttgtttctggtggccattctgctggaacggttgttttaagttttcctagcactccgccccaccgtagtttttcgtcacttaattgttgcccggtaattccttccttagagtagaaagaccaaacaggttccacattcgcattggcttattttgctttggggttttcaacgacgacgggatcgaatgaggcgaggggaaaaggaagggacacgtcgactaaaagggggaatagaaagagaaagaagttagggaaaaagagtaaagtgggcgtagagagagagagagagagagagaaagagagagaattagagcaataagagaaatggtggaagagcagaaggaaaaatgaatgaaaacagagcgaaaggagaga

SEQ ID NO: 21363 - DNA, 2380 bp, Heterodera glycines
  misc_feature (149)..(149): n is a, c, g, or t
ggggggggggctttttttgtatctttagagaatgaccatttttgaagtcgcaaggtttttgaataaatttaacatattttggtcaatttaggattttaaattttgacttttgtttcgaattcgggttcgcggttcggaattcaccaaanaattttcaaaaaaaaagtcgacattttttgaaaatctcctaaaaatagctcaaaatcgcaaagttcgtcacttttcgttaacaaattgtattaagaaatgcaaaaattttccggcggcgcctatcggcaccgctggaccccctgttccccaaaagtcttttgaacgcaaaaaaaagtggcgtgaaaagcaaaaaaaaaaggtcgtcgcccgggcggaggtacctccccacaccaagccgaaattctgggaccgtccctgctattctacatacttataattgtttacaaaaaagaatctttttaacttttggttaattttcacaacttttttttgcactttttcgtgacttttttgccggtttttgacttttttttcagtcgactttaaatttgatttcttcttaggaaaaaattttttttgaggagggggggcttctaactcaggggtggcttctaggcacggcaactaatatcactgcgactaatgaaagcggcaacgaaatgacacagcaattaatagggctgctaattttatgtaaatacatattttttcctggtttctccatgctctaaatataggaaaaacactttttttttgtgtttgcgaacaaacgttgggacttttatttgcatatttttacatattttgggatttttcattaaatatgtacatatttttatacatattttggctttttcgtacacatttcgcaatttttcgtacatatttttcatttttttttacatattttgaggatttttgagaatttatagaaattttttgtaaaaaattaaaaaatttttttttgaaaatgtatccctaaaaaatcgattttttttcaaaaaatgatatatcaaaaattaatttgtaaaatattcaaatgtgattctaagcctattttggtcgtttttatggcattttgtgcctatttcactttttacgaagaatttttttccaaaaaataaccattaaaaaaattttatttacatattttcctacatatttgaggatttttgtacatatttcatacatattttagcattttttatacatattttatttacataattcgcaaattttcttacataaaattagcagccctagcaattaattatagcggcaactaaatgtcacggcaacaaattggcactgcaactaaatgacacttcgactaattagcgcggcaacgaaatggcacggcaacaaattgcactgcaactaaatgacacagcaacaaattggcacggcaactaaatgacacttcgactaattagcgtggcaacgaaatgacacggcaacaaattggcactgcaactaaatgacacaataattaattatagcggcaactaaatgtcacggcaacaaattgcactgcaactaaatgacacagcaacaaattggcacggcaactaaatgacacttcgactaattagcgtggcaacgaaatgacacggcaacaaattggcactgcaactaaatgacacagcaattaattatagcggcaactaaatgtcacggcaacaaattggcactgcaactaaatgacactgcgagtaattagatcggctactaaatgacaaagcgattagtgatgacaacaacaatagacacgacaacaatttgacactgcaactaaatgacacagcgattaattagagaggcaactaaatgacacgacaacaaattagcacagcaacttaatgagacagcgattaattaactcggcaactgaataattcgcattaataaatagcaacaaattaactaattagttattagtagggctcaaaattatatcgactaaaaacatcaaatatggacataaatatgaactaaaaatgcccgaaatatatgttttaaacccaaaaattctcttaaaaaaagaaaagttcgcaaaaaagggcagatatttataaaatgccaaaatgatcgacataaacataatttttcgtattttggggtgtaatttctaaaattttctaaatattctatctttactaaagtgtctttaaaagcaatgaaaagccagaaattccaccattgttaacattttattattcttttacatcgctctctctgtcttagttatttttcactcttaaaataaaaaatttgttattttcatcaaaatttaattgtcttttgtattgctcatatgtaacaaatcttacatatttagcggactgtccattatgcctttatcgtttactatctcacatcattggctgtc

SEQ ID NO: 21364 - DNA, 946 bp, Heterodera glycines
ccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtctatatttacactgagcacccgttgaagcgggtgatgcgaagccatagcaaactgtatttttaaattctggcagcaattctaccaaaaacgtgtttagaccgcagtaactcggctcagagtgaagattaagggacgcaaaagagacgatttaaaagcgattcgaaaattctatcgac

SEQ ID NO: 21365 - DNA, 3209 bp, Heterodera glycines
  misc_feature (3091)..(3091): n is a, c, g, or t
tgcttcatcatttgttatccgaattctcaaaaagcgggagaagaagcagtccgatgaaaaaaagtaacatatgcttaataattaattgatagtggctgaaataactgatttttgttctggattttaccagtaggaaaagcattagtgatgcagcaatttgttttaccatcatatgaaattttaagcacgaattggcggacaaaaaatatttgtcattttttaaaataattttttgaaaaaataaatttttaaaaactgtgtgactgttttggaattccgatggctcaaaaaatgtcgaaaatcggcatgctgtcccatccctgatgcgcttttactgatgcattttcgagagccgagttgaatctcagttctcaggatcactaattgatttgatattcttttccgttttttttggtgttttttaagtgcgttcccggcacctttcaacagctcaccggacgacgatttgacggtgaaaattggtgacaaacaggtgaaaaacagaaagaacaacagcaacattaagccccccccctcacttttatttttctccaactgttttttcatggaaacaaatttttgaaacaatttatgcttgcctgccgtagtttaaggcctgttctgccaaatctgtgttcacaaaaatccgtcagtaaatgccaggatgtgtaactgaaaacgggggggggggggggggggggaaaggaaatggaccaagtttattagactcattgaacagaccaattgttggaatttgatcaaatagttgattaaaaaatcctgatcagatcactgatgaaaaattaaaaatttatattaaggacctataattagattaatagtaaatcccggtcagatcactgaaaacccattctgatcagatcgctgtgtccgcccattggctgatgtccgtttccccggtgatcagtcgcatgctcagcgtggagatgaaggagaagcagcagcgaatgatcactttggacgaattgggcgtggacatggaccaattcatggagtttttggaggccatcacttatctgaacggaccttttctgccaaaccgtaattccatgatactgtatttattctactataccccctaaaatatttatatcgtgtttttatggattgaaaatttttaatttatgaaacggattcccaatttttagccaaaaatgtgctgatgctgctcaaattggccgactacttccaggtgagtcttctgatcacttatcacatcctcttttttctgtctgatcattttaatttaaatattaaatatttatgaaaaaataaatctagtattttgaatgagacaacgaaccgttctgtgatttttcgtaaaccaactttgtgtttttataacctttttctacctaactaaaattttttaatttggtaggctaattgggactattaattgccatcaaatgactcaaaacttgctaatgaatttgctatttctaaaaaacgaactgttctgctttgaggtgaccgcgttgaagtcgcgttgcgaaacgcatctgatcaattgcgtggaaatcccactgatcgaccgtttccttctgattgagcgctacggactcgaccatttgaaagtgattattatttaaaatagagttgagcgtgaccgggaattttgggcaaaaccgggaccttttcggatcgaaaaccaggaccgggaaaaaaccgagacttggtactcagttgtccgtgttttggtcccggtcccgctcaactctgatttaaaaaatttaaatttacaatttaaacaaattttaatttatttcccaattttagaattattttttgaatttggatgtcaataaattccgtgcctttttcaaggcgaacaatgaacagttgtttttggttgtcagcaaagaatttttgtgtgttttatttgtccgactttgtggatgaatttgttaaactctgctgattggttccggctttgatcaaattgattttggcatttccataaattttttttacaaaattcatttcgatgataaaaaaatttggttaattttgggcaaagttatgaataattttcggtcaaaaattttccatttgatggttttttgagtaacttcttacaattagcaccaacgataagtacaatacatgtgaatagaccagtgatagattaaatgccatcatttataacggtcagtcacagattatattaaatcttttttcaaatttctttatataaattcattgatttggctcagattcaaccaaattaatatttcattgtatcattcaatagctttaattttctctttcagaatttaattttacaaaatttttttcttaattaaaacaaaattataaagcattgaacatgctatgttttttacaatggtcatatataatagaagagatcggcatggacctgggtccaggcctggatttttcctggatccaggtcccgaggagcctggattttttctggacctggattttcccggatttttgtccaggaaatccaggtccaagtccaggcttttttcaaaataccgatctccaatataaaattataaacatttaaaattttaaagtctttaaagtgcaattgtcccaaaattaatttatattcccataagaattctctatttaacttttttaacgacatttatacaaatgcatcataaatattcactcccataatattcgttgctaaaatattatttaattaagtaaaaatatttttaaattttcataaaatcaacgcacacatattcaatggcaatctttgacgaatttattgttgttgacgaaaaagtgatgagtgaattttctattggcatctattcattccgtgatgtcacccaatttgctgcactgtaattttatttttgtaattttaaaatatacaaagaatttagtcaatttatgattaatgtcaaacactttggcatcatcgaattgaaaatcacggacattggccatgcttttaatccgtcgaattcggaaccattggcacaaattatccattggaaatgggatcaaaatgaagtattaaagaaatgatcaagcgtataatttaattacctaacaaatattattttagacccaaatactncaaaaagggcagtgaagttaatttctacatccatatccacaatgtttctccttcatttgttattcggattcttaaaaagcgggagaaaaagtaaatttgataattaatcacaccgttt

SEQ ID NO: 21366 - DNA, 2964 bp, Heterodera glycines
cgaacaactgactccgatgcgttcattaggctcatcaattagtgcaaaattgacgccaatgcattcatttgatgcattgatgagcgcacaattggcaccgtcgcactcatttgacactgctgccgacctaattggtcataatcactcatttgatcaaatggacagtaaaaaagcgggaaaatcattgatcaatgataagaaacaaaaacatattgaattggaagctgatcaatttgtggcttttatgttgaagaaaatgctgaagaaagtgccagtggaatttaaagaacgattaaaaattgtaagaaaaaattgggaaaaaattaataaattgcggataatttttagtttcaaaaacagaagagaaataggacacttgctgaggaattgagcaatttaacgtcgaaacaaaatctactgatgcttctcgaattgtattatatggcgaattctatgggtgaaatttttctaaaacaaatcgctgcaaatgatcagacggatttaagaagattcggaggaaaaaactctctgatcgattttgaatattacgaagaaacaaaccaaaaattttcaaaaatttaccaaacaattcttataaatgagccaactaaaaaaagtgccaataaaatgtttccctttcggagaacgaaaagcggcaaagccttcttttggttcaattcccataaaacgtttttggtggctaatgaatggcgcgacggggcggagaatattttggaatggaaatttaagggtaaatttgtaatttcatttttaaattgaatcgaatttagtcaaaattgcttctacaaagcttggtaaaataatcagaacaattggccaatttatcaggataaaatgtggcaaatatttgtggaatttggacgaagaaacggatgaaattcaaaactgtgcaaaacaaataaatttcagtgaattaaaccaaattttcttaaagaaatttgccaaaaacaatgaaaatacgttgggtttgcttaatttggtaggaaatttattaaacgtcgaagcattaacaaattcggacacaaatgaaaaggtattaattaataaatatttttaaaattggaattgattcttagggatgcttttttggtttatgtcgctttttgttaatggatttagtgaaaaattctatttttaaggttttctgtttggaaatcttaaatattttggtcattttttggaaaaatctattaaaagaataataataataataaactttttagtaatattaaatttttccggcttactttggcatcatcggctctttgttttccatgctttaaatgctaaattttacaggtttcttctccttacagtgaagacatttttacagaaattgaaagttatgaacaaaaaattcacattctcaacggacttcttaattttggccgtttatttatgaatagttttttggctttagcgatgaaaattacggaagaaaatcgaacaataaattggaaaaacatttcaatcatattcactcggaacaaaaacgccgaagaggaaaattatttgttgaaaaaattaatgatagaaggtaaataaaaaaggaatctatgagtaaatggtaaatttcctcctaattacaataccttccattaaaatgaaaaaaaatattacataaattaatcgccagtaaatcaatttaaaattcttaagctggtttaatggaagaagcaaaggaaaaagtaagaacataatcatcaagaagttaaagagaattcgtcgacaattttttcgttctttcggatttcatttttaaatcgccaaaaacagtaagtaatttacatcgaaattacattgtaaaatttagtgatgtcataaagaattgattcgacggtggttattgttaaaataatcaaaaatttacacgtcaaaaccgcgtcctgattaaaaatattatatttcccaatttttgtcgtaaaaatatattattgagagatttcgtttttttatatacagattgaaattctttggtatcttattcgaaaatctggctggtatttttgtatttggtaattagcctagggaggaggaattcttattaagagagaggttaaaaagtagaatttttgagaattttttaaaggacgttgttaaatcttgaattaggtgaactatagtgaacgccccacttagaaaaggttaaatgatattactaatccagtggcggaaatagctttgaacctagttttaaaccggtttaaaactcgaaaaacgaagaggaattggcactttagcttttttaaaaattcgaaccctgacatttttgttgtcattcgaattcttgacaagctaaacgtaaaaaatcagggtaaagtcgaaccaatgccatctgctgacaatgagagattctgaaccggtttaaaacaaagaaatttagtgcaactaatgccaaatttgaaaataaaaactacctaattgtattgagtagtatttttaaattcgagttacctatgtcaattaagagacaatagtcgaaacggatgccggatattttacctatcagcgaccgcgaaagaaaccatttctgatctctaaataaaaaagagttaaattagggaccctcattataattaattgccgtgtagtttcaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatgagcgctaaaattatcagagtgccgaaaatcgcatgtgatctaagcctagcaaaaaatggtgtaagtaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaa

SEQ ID NO: 21367 - DNA, 2041 bp, Heterodera glycines
gcgatgctcgctcctcagcactcagctaaacatttttcacaaattcaaaaggtaatgtaattttgaataccaccttaaacgcctcggtaattacggacgatttgatcgtaggttgtgaaacagacgaccaaacaccgatggatgaagaactcgttgacatgacagcagcagcatcgggcaattggggaaagtcaaccgaataatcgagagtctttttctcagtagtcattgcgaattgaagccgtaaaatagaaagaacgattaaaagatgtgtttaattttgctttctatgcttaaaaccggtttaaactctggtatatataaggagattagaggtggtgtgattaaatgatttttttaaaaacaattatacaaaaagttgccatcaaaaatgtattaaattgattaatttttctgaatgatgtaacgcaatgagaagatcaaacttatctgattatttaaccgaaacatttataatgggatgggcatcatacaagcgcaaaggctgccctgttgaggtgggaaaacatgcaaagagagaggcggagaaagggaagggagggaaagccaagaaaaagcatagaaaaggcgaatggttgcagttacattaggtagtttgactactgtgctttttggaagaatttacgcagcgataacatttcaaaagccgactcagtcccagcacaaaatttaaaaaaaacgaaaaatgctttgtttcgtttttagtcgccgcgatgcttccacggagagcattgagaaaataaaaaatattgaaataaaaaatatataatttgctttagttatgacttatcacagaaggccgttttccagaagattaattatatccctttcttttattttccatctctcggaattcgacaaatcagaaaatgatttataacacatcgctttttagcatttatcatttgtgacataatacaattcaaacattgaaactttgcacctcattcatcctctgttagtaaatatttgtttcatgtgtacttctacgtagtcttggaaagcagccgcattttgtggcataatttgcgatcgaatttgcttcattgattctcttaggaggttcatatcggatgctaaaggaaaaacatgtaaaaacgaagctagtttgagataactcacaagtaaatcttttattttgagcgccgattgttctaagctgaaagatgacgagaaatgagaccaattcaattggcaaagacccacctgaagcattaaggaggccaaagaagtgataagctgaagggtccttttattcctcacgctcagttcagtgttgctgacaatgagcgggaagtttggttaaattaataataacaaaaaaacattgtcagagccctccacgccctttttttcgcttacttaccaatgcttcacaatttggtatgccgtcgtgttgcattgctttcgcaaaaattctggtctatccgatggctgtggttcactcaaatgaggtaaaagtgtggcgtaatgggagtgaagggcagcgaaataaatggcggaaaagtctgttgactgactccaaatcaatgaccaactcgagcaaatcggacctagaattagagaaatggtgaaatgacgaaaactgaaaattaaaagctcaaaattgggaaagatgaccttaaattcgtgcgggtaactaattccccaaaagattcattttctccgcataatcattcatcactggttaaattggtgaccaatttttttttgtattcgaccactttgcacaatttcacctgggaaaaggggagaatacccataaatggggatggaaaagaaggacaacagaccaaaattacgagcattcgtacgggaaagtttccaactttttcatcttttggtgaaaatggacgaatttcatgggattttgtatgaactggtcccgattcgttcgtcctttttcggttccacttaccaattgtcactttgttcttcgtcgaatggtgcatattttgaacggcattcattggagagacaacaaatcctccaccaccagcaaacgcgggcatattgacag

SEQ ID NO: 21368 - DNA, 1223 bp, Heterodera glycines
cagcaaacgcgggcatagaccaggcaaattcgaataaaaatgccggttgaccaaaaacgggggcagggggtggcttaacgccgccacgccaaccgcaccattggcacggttttgttcaagaaagtaattgacggaaagcaattcggaaggctggtcgaacatcacttcgtaatcctgaaataagaaacattcgagtttattcagtttctgtccttctcatcacaattgcaccttaatgtaagcggcggggagaatgtcttcctgaaaatgaaaactcgaaaatttatggagaatcatcggcaattaactctatcgaatacaactcggtaaccatcttcggtgatcgcatcaacagtcgcggagtaaattccgtccctcggggttcgtacctgacaaaaaataaataaatactctcaaaagacaattgtaaaggattaccctcgcgtaaattttttgaccgacaattggcggacgcggcaaatgagtgggcaaatcgatgaactcttcgtccaacgaagtgcaagtgccattgtaaatggcacgaatcttttgccttaacaaattgggcttactaatttctaaaattttcaagtggaaacaaaccgttttgcctccagcgcttcgcactcttcgtccaaaaatgtttgagaacagcggcgcggcttgccgatcaaacggcgaatttcacgccactcggccttgcgcagttttgtgcactttaaattgggaaacgattcgcgcatcagctgcgaaaattcattttcggccaaaaacagctgctgatcgacgcccgaatagaaaaactcgcagaaaacaaagcgacgcgcttggggtaatttgagcacattctgaaaaaagaatgggggtaaacggaagagagtcaaagggaaaggaaagagagtcaaagggaaagaaaagagagtcaaagggaaaggaaagagagtcaaagggaaaggaagaccttaagtttgcgcaagttgtttttgagttcagccgacagttcggcgccagcagcgcaacgccgttcccacgaaaagcgattgctttgaaaacgcggcggataccgaagcagagttttgacgggcttacaattagtctcgacctgctaaatagggacgcattccgcaactttttctcatccgttgctttgttttccttccattttccacttacaaattcaccaccctcccctccgccgtcgttttccttctccgctccgatga

SEQ ID NO: 21369 - DNA, 1709 bp, Heterodera glycines
  misc_feature (24)..(24): n is a, c, g, or t
  misc_feature (49)..(50): n is a, c, g, or t
  misc_feature (52)..(52): n is a, c, g, or t
  misc_feature (83)..(83): n is a, c, g, or t
  misc_feature (101)..(101): n is a, c, g, or t
  misc_feature (106)..(107): n is a, c, g, or t
tgctgcttctcccctttttgctgncctgggcgtggaatgagtcaatgtnncnggagaaagggaaaagggaaagaatttctgcngaatttcgcttccgccgncgccnncggggcggggacatgtccgttttttcgcccgcacttcgccagcggcgaaaaagtgcaaaagaataatgggaggtgataaagcacagaattaatacataaataagcacaataaaacaagatgaactcttctgaattaagctgccatggatttgcaaggacagaaaaggaaaacatttattaagcattgccttcggttgtgccgacggaaaacattttgaaaagtgaagaaattattcataatttattagtaaatattaaagtatataaaaacaactgaagtatgttttacacccatcggcatattaccaatttccaagtacttcttgaaataaaaacactttcattttcagcccaaggacgaatgaaaggggccaactccgtccctgccaaatttaagaagccataaatttttttccttttcataaaaaaactaacaaaattgtatcatcgaaagttaaatattgtaataagaagctcaaaaaaagttaacgttatgaaaaccgcaaaaactcagaaagtcgatgtttatttctagtttttgaaattaataattagaagaggttaataaaacttgcaaaaaactttctaatgattctatgattgttgttaggtttgaccagcaaaaaagttatttaaaacttattgtttaattgttcgatttgtatttatttgtaggggttatattctcatttgcatttgttggcccagtcctagggtcttttgtgcttttatctgtcccccctttgctttgccagtgtcaatttgccattataaattggcccttccttcgccctctctcttcactttcttcatttcccccctccttttttcccttttcattttcgcttttgcccttttcactgcgcgaaatcccatcaaaaagcaacaaaaaaaagaagggcaaatgaatgagagtgaaatgggggagtgaattaaaagaatgcgattcgaataaagagagcaaaaatgaggcgagctgattgcgaggagacggacggacccaccgaacgataattcggatggatttggattggattttcggttttcggtgggataacgacgacggactttttacgttgtgggggggggggaaataaaatgcaaacaaaaaacggacgaagaaacaaaagcattttcggtcctaaaaagtttttgttgaacacaaaaaaaaaatgtttgctaaagcataaaaaataatccataagtaatttaattttaactgcaaaatttgaaaaaaaattttattgacaataacaaaaaaatgaacaatttaggataggaaattaaatcaaattaaaatatttaatgttgaaaaacatgaacaaactcaagaaatattaaacatttaaatatttttaaatgaatttattaaaaaatatatttatccattaattgaccattggaaatatttgtaatgtgtgcaatttccgtttctaaaacaattacaaatatttgcaaacgaagcgcctgagggagggggagagtaattagcaggtaataatgggtcgaaggacgtggcaaaaagcaaagacattattttgccaccattgaaattatgtgataattgaggtgtgcgagttattttattagtcagaccgattg

SEQ ID NO: 21370 - DNA, 2206 bp, Heterodera glycines
ctttggtttcttgttttataggatttgcgcacgatccctctaggtcaaagttgcatcgctgccgatttgaccgccaacccttccaagaacagattcactaacattttaccgtacgaccactcgcgcgtgaagctaaagcccatcgacgatgacgacgggtccgattatgtcaatgcctcgtatattccggtacaactcgaaaaggaataattcctttttatctttttcatcttagggattcaattcacgtcgagaattcatcgctgcccaagggcctttgccgtcaagtaaatttattcataaatcattctaagtaatttgataatccttttgcagctcgcgatcacttctggcgcctcatttgggaacatcaagtgccggcagttgtcgcgttgacaaaatgtattgaaaagggacgagacaaatgccaccaatattggcccgacaataatgtacgttttctggcaaatccaaataaatatcagaaataggaaaaattgcagagtcgcagtgttctctacgccgacattgaggtgggcatcagcagaagtgaccacagttcgaatgtatcccatatatgcaggtgacactactgaccgaatccatcgaatatgacgaattcaccatccgcgaactgcggctgaccaacatggccgagccaaaccaaccggcccgaacggtgcagcacttgcactaccaggttgatcaacagccatatagtgatcctctgtttcctttacgcaggcatggcccgattttggcgtgcccgaccatccagccggcatcgttcacctcgcgcgactgttccgcaacaaattgcccccctcgtcttccaacaaaccgaccatagtgcactgttcagcaggtgtaggccgatctggcacgttcatcgcattggatcgactcgtgcaacacattgaatccggacgacccatcgatgtgttcggcactgtttacgaaatgcggctcgagcggtgccatatggtacaaaatgaagtaagggcgagaaaagttcggtgtgaaatagtacaatgctttctctgttcagcaacagtacatcttcattcaccactgtctgcagtatttgctggagaatttctacccctttctgttgtgtccctcctcccaacaactgcagcagcaacagcaacacacagtcggccaccgaccgctgtcctcgccaaatccacacgccccgttcggctcgtccatctcttctcccatctgtgccgactatttcggctgcggttcgtcgtcgtccgttttgtccaacgcaagcagaggggacggcggtggctggtcatcgaaggtgccgatgacttcgagcagtaacaacagcggagccggcatcaattgttattggccgcccacctccgctcaaaataagtcgacggactcttgcgacggaattgtcacgacaataaagcactcaccaccgaagattgaggtgcatcaccctcaaaggaatgacgggtttctggaggacgacgaaggcatcgccgaatctggcctctgattctgaccagaccgaacctgatcggaaaggttgtgatggattattgccaacaaacaaaaagttattcccgatgatctgccataagcattttttgatgagacggaagaaagggtaaagaaactctaacattgaaaaaacatctctcttcggatattttaccaaagccgaatataacaaataattacaataagtcataaaaacaataattaataattcaaaaaaacgtttttgtgtttgcccattatttacttagagaaacccgagttaccctctctttaaaatgcaatacgaatgactatataaattgtcaataccttttcctattttcttatgaatagtataataatcatttacaaaatgcatatatttattttacttacacttaacattgacataataaatgaatgatttttattttggcggtttttaataatgtgtttatttccttgcaattaaccttaaatgcccccctccacctaaaatccaaggcgaaaaagttcattagttaatgcgtttatatcaaattatttaacaaatcaaagcagtccgcttacaatccgtgctgttccgtgtcgttatctccgccccacaccgtttctctgtcccgtccttctcccccttctgtcccgtcaaattcctttggtattttcatattgcgcaatccatttccgctgattggtggcatcaaaa

SEQ ID NO: 21371 - DNA, 2493 bp, Heterodera glycines
  misc_feature (48)..(48): n is a, c, g, or t
  misc_feature (105)..(105): n is a, c, g, or t
  misc_feature (2400)..(2400): n is a, c, g, or t
  misc_feature (2449)..(2449): n is a, c, g, or t
aaacgacggaactgacgcggtgcggcagcagcagaaacattgatgcancggcggacaagtacaattttgtctttcgttagctaaggggggggggggcttttggtntacaaaattcaccggatggtatatgaaaaaaaaaacttgttaatttggaaaaaatttgggtcagtgttgcttaataaattctcattatatttaaatcttttcagcaattggcggcaaacaacaatggcggacaacacgcggaagcagcagtaatcgatggcactgggatgcccagcggacaacaaattgaggcggcagcggatgaaaatgacgacacaattgggcaagcggtaatttttcacaagcttttccaaaaaaaattattcctttaatttgaaggggaacaaattgttgcggcgggcggtggccaatcaatgcatttcatcgtccggctcgcgcagcacagtctcgcgcacggcgtcgcccgcactttcttcgacttcgtccaatgcctcccgaagacagaggaagaattacaacaaaagtggacgcgtaccggtaagaaaaaatttgcaaattcaagccaaacacacacacacacacacacattcacttcctagataaatgtgaatgccgattgccccaatgttccgcccggtgtactgccgaacccaaaaactcgccagtaccaggtcaagagcgttttggcgcaattcactcatgcatcggggaggaaatgctatttcttggagtggctcggtgagtttgatgatgaaattgaaagaaaaaatgtgtgaatgaaaaggtggacggatggataaggaaattgaaaatttattgtaaaattccaaacgtgtgccgagttaacctggtttagcttcgccacttttggaacggaataatttgagggtgtgggccgagttaacacagtttagcttcgctacctctcttgctatttcactttaaattttctttttctttttccattaaccaatccattttcttctctcattttttctcgcaattataggctttcgcggtcgcaactcatggtgtttgtcggaggacaccgactgtacagagtacattgaaagatttgggacagtggcaacagtcgacgcggtactctctgcgctattgggcgaaagcgtcccagcttcgatagctgatgagctccaggccaatcctaaatttggacaaggtgtggagagtgaggggaattaaaaattgcataattttttgtcagtgttggcaaagttcgatgacattgaagatgaattcatattgcggacaactaagtataatattttgttcgcaaaagggcttatggaaagcgccgagggccaaggaataattgaggatgtaagcacacaaatgcactttttaatttaaattatatatttcctaaggcgaagagtaaactgggacgcttcgtggcaaagtgtatgagctgatgagtgcactggccggccgaattgaacattttcaccatttaaatttcaccatttaatttcaccaataaaatttcaccatttctcatcatttaaaaataaattttttcgtacatttattcaaaatatatatggaaaaaaaagaattgacaaatatttaatgctgcatgtaaaatgtggtgcacactcgacaatagggacatttatcaggactgggtgaaatttttaagtgaataagcaaacactgacggcacagtcccacatgcccacaggccccaaagaattgagccatccccacaatacacaaacacatccccccaatattcgggtacaacaatgtgtcggggaaatggacaggtgccaaagggttcccccaacgaaatacggctgtcgtttcgctaccagcttgaagtgcggcttccatcgggttgcgcgctgccgttgcattgagctgctgttctctggtcggcggaccaaattcgcggctgatgcgaccgtagggttgtcccatgcgcatcctttcacaattccgttccctcagtttttcgcacaccctgcaccgggccgaatggcactcgccgcatccttcaacagaacaatttggttcaaaaatttttttgacaaaactatattacttgctattccaaacaacgaaggtgcaattgtagatttgcggcgcgacattttatatttttagagggtttgtgtaataagacaatgaatggtccttccactcgctttgtccctatccatgtgccccccccccctcagtgtctttgccagattcaaattcggcaagccaattaatcatttcaccttaaccaacacacaaaaaaggaaattgagggactgtctcaaaaaaatatatgtttattatgcagaataaatatcaaaattatggattgcatcatcaaaatccattattgtcttttggtcaaagttcactttttcttcattggcgccnaaaggtcggttgcgcggcagttggcccacacgcattcctcacacatctncaagccgaaggcaaaaacgtccccctccagcgctcactttctgc

SEQ ID NO: 21372 - DNA, 2566 bp, Heterodera glycines
tctttgcatctttggagcgtcggcacagaacgaagcgcagcaattgcccatctgattattggtaatttgttatttttaaaaattttatatttttttttatttcagacgacgaatccaaatttattgaagtgacaaaggcggccacaaaacttcttcaaaacggtcataaaattcattttacaacaattcaaatagaaattcatgaacaaattcattctcagtgcaaattttgtaaaacattactatgacatttaaagttgtatcgaaattctgacagtcgaaaattttgtttgtttttatttttcaaaagagaattctcgtaagttacgagtcgtaacttttaagaaaggaatgattttctatttccttataaataaacacattctcttttctggtctaaaccttttgttttataatttgaccaggttaattctcaattttcacactaaattctaaatttattaaaataattcaacattaattaaattcaaaatcatattattttaaagcacaatattatttattcattcactttgtccatctccatgtttcattattatatataaaaccaaaatttctttagtcatttgtcctcatcttcccaaactttctggccaatcccaaaataattcctttgctttctctgtccattccgtcaatgcccgtccgtatttcctgatcagaaaaagaatcaagcgacgatgttgcattaattcgtagtcagtgtttgagtgccctttttcgccgttgtgaatttggctttcaaacgttgcgtccaaccaccagcagcgggtcgatgttccgagtcgacataatcttattcatcggattaaaatgtttactcttcttttcgcttacaatcaaaggtccttcgggaattgcattcttgctccgatgtctgaaattcgacgagaggtccttcaggaacccgtcccacagaatcttccgctggattggtcataacatcggcggatgtacgaaaaaaacggattgaattaggcgattgggaagtgcgagacgacgttaatagaacgggcaaattgcgacttcgatgagtcgaagaatggtgccgatgtcgataatcagatgaattggaacggccgagcatttcacgttggaagtttgggtcgcgacggagatacctcagaaactcgcggttttggaccagcaaagcgattttctcgtcattggcacattggtccctcggcggagtggacacactctttcgccgttcatccgtctccgaattatttccttcttcttggccacttcgtcgcaataattcatcgatggttctgctcacatcgccgtcacaattgcgcagcactgactcaacgacggacgaattcaaatttggaaacattgcgttgaattgggccattgcctgcatgaaagtttcgaacagatttcatggcgaatcaccgacgacattaggacaaacctcttcgaattgcagcattttttgcagatagaaaaacggtcgattagggttttaatttatcaatttatttcttgaatgtgtgcaatagagaaatgtgcaaaagcgagatgagctcaatgtggagaaaggagagaataaggtgaagaagggagaacgacgacggcagacattagaaattgcaccactctctgccctttctaacgtttctcatccttctctctctctcgcttttctctccttcttttcccccacttcttttcccccacggcgactttttacatagatgtcccccccccagccaatgcttcagtaaactgttgaggggctgcttaattgagtaaaataaaataaaaacctttgaattatcttttttattgttgtttgtgctttttaaaatggaaaatttagttttgaaaccggtttttagcataggcgcaaaaaaaactcattttcaaccttatttattaggaaaaaatcaaaaaaaattttagtaggctatcatttgatgttgaccaaaaaaaaaaaattataccaacttgatcaacactttttcatggtgatcggggcatttttgtttctgaagaaaagtcataaatcgaaaaaatatttagcgctacttcgaatttttcgagtcactatgggtcaaatgcaaattatttgagtaaattattttaaaaacaagatgattgagttatcctttattaaaatggaaaaaaaacgaaattgtactcgaaataattttgagaaatcagaaattatacaaattaattgtgtatttatttgcgaaaaagaaaaatgaagaaatgaactaacggaaaataattaaagggaagggataaaactaataataagaacctaaaattttaatgttaatgaggaatggtatccatacatgcacaagggggtcctccgacacccccccccccccccctctcgctcgtcgtaagaggcctcggacacccccacttcgttcgtcgaaagttttttgggaaaaacgcgccgcaaaaaaaggtgctttgaacagcaaaaaagaggtctgaatagcagaaaaaaaggtcgacaccggagaaaaatttggacaccttcgtatgcaaaatcggccccgagataccccccccccccccc

SEQ ID NO: 21373 - DNA, 2944 bp, Heterodera glycines
atttaataaaaaaaatttccttatttattacattttaaatcatgttgacctcttccacgttgttgtacctcttctgatcactgttgtacctcttctaatctctgttgtacctcttataatctctgttgcacctcttctaatcactgttgtacctcttataatctctgttgcacctcttctaatcactgttccaacaaaaattagaaagggcgcgaagcggccttaatagcccaacaaatttagaaacgggcgcgaagcgcccgtataagcccaacaaaatttaaaaaacgggcgcaaagcgctcgttcgaggccgcgaagcggcctaaaagtcccagatatttttttaaaaattccaaatctccacaaccagagctaatctaggtagcgaagctcccaaagcgcgaagcgcttttttccagctaaatagccgacggttcacgcacccgctagtttaaaacatatatatgaacatatttggcattttttagcacatataaatacgggacctgctaattaacgatgactctctttatgggaattgtagacatttttaaaaatattatttatacaattcgccaaaagaaatgtttattttcaccatattttgtccacggatggtttttatttatttgtgcttaaagatccaaaaagaaaagataacgggaaaagaaaaatgttaaaatttatatctaaaatggattcttcaaaacaaaaaataaagtttattagaataaaatggatttataataattcaaagaactattatcataaagaaaatattaaaaaacaaaaaataagaaatgaaaatgtagatttacataaattctgaacaaaatcatattcttaatcagaaaattaaaggcacttatcaaattttaatattataattagtaaataaaatttcaaattgatagggcttaattaacttaaattcaaatgaaaattgtttggtcaaagaaacacagattacaagcgttaattgaataaaaataacaaatcaaatgaaattttgaacttcaaaattggattatttcaaaaattgattaacaataaaattaaattaaatctaatataaatgaatattttttaaagaagacaaaaaaaacttattaaataaagaccatgaaatttaggtcaaataaaaatataaacattaagcatatttagtcgaattcgatcaacaaacaataataattatatgagaattatacaatagtttattttttaaagcaagtaatatatatttcaattgtttgaaaatgaatgtttatgaaattttttaactgtacctaaaaataaatttgtataattttttaaaaacaacaccaataaatatgagtaattaaaaaaaatagtgtagtaaattaatatacaaaaaatatatacttatcgatatgatctactaaaaatcaaactgtttcttcgacttatgagcaagttcattaaaaaataaatatactttgaatcaagttggcaaatattatctaacaaaataaaacaaactaactagtgagttgccaccaattagttctataaagattattataaataaactcaaaaaattttctcaacgaaattcgcacaacaaaagtttaaaaaatttatttgaaaattaaagcgaaaaaatatgataataatgaataatagtaacaaacatttgaatggagcaattaaaaatttttaaaacgcaaaccatctgcaaacaattataattaacctttaattactctaaaaataaaaatatacaaaaaattcaaatataaaattcaacggttaaaaacataaatttgcatgcgcaatataagtttgttctaaaacaattttattaaagatatgtttggcaccacattcttttagtcgatgtatcgcctcgattcaattcccttttgcataaattgcaacgaacatacattcttcgactgtaaaggttttcaaaaaagctccaacctttagaatttagggtcagggttcgggggttttaaattttccatatttaaaaaaatttatcaagcaaaaaatttaaaaaagtcatttgttaacagaatttcaccaaaaactgccaaatttttgcgatttttagccatgcgacgacctttttttctgggaatgagcttcatttgtaggaaaaagactcaaaaagtgtgttgaaatttatttaatatagtctaaatttccatttggaaaaattcattagttcaattttttacttaaaaaattttttaaataaaaataatcaaatttataattctttggggggggggtaggggtgttcggtgccgataggcgccgccgggcgaattttgaaacttatgctctctttttaacagatattcaccaaaaatttttttagatttttccgataaatttttgttcttccaatcggttttttgtaaaaatgttttaaaatatttaaatttttatgatttacttaaggaaaattgaattgttaattacaacgaaattttcatccggcggtgccatcagaatttttttgataaattgttcaatttgttaacaaattatgccaagatgggtgttttgttattaatcgtaaaaaataaatcaaatagaaacgtcaaccggcaccgaactcataaattttgacttttgtcccagaaaatattaactacatatttcagaatatcgcctcaataaaaatcatgacccttcaaatgaatataatatgagataattaaaggaaaagtggaaaaactttttataaaaaatgaaaaaccatttcataattttacatggtatgaattgaggtattttaaaataattaaaaattctaatctgtgatttaattaaataaatataattattctaattgtaaacaatttttaatataattttataaataaaacatacgcattttattaatagagataaaataaatattaaaatgcaaaatttataaagaaatattttatcattttaataat

SEQ ID NO: 21374 - DNA, 776 bp, Heterodera glycines
ctccctttcttcccctcttccttctctctctttccttctctctcatcctcatcatcttccttacaccctccctttcttcccctcttccttctctctctttccttctctctcattctcatcatcttccttgctctctttctcaccatccctttctctctctctcttcttctctctcatcctcatcatcttcctctctctctttctcaccatccctttctctctctcctcttcttctctctcatcctcatcatcttcctctctctctttctcaccgtccctttctctctttccttctctctcattctcatcatcttccttgctctctttctcaccatccctttctctctctctcttcttctctctcatcctcatcatcttcctctctctctttctcaccgtccctttctctctttccttctctctcattctcatcatcttccttgctctctttctcaccatccctttctctctctctcttcttctctctcatcctcatcatcttcctctctctctttctcaccatccctttctctctctctcttcttccctctcatcctcatcatcttcctctctctctttctcaccatccctttctctctctttccttctctctcatcctcatcatcttccttacactctccctttcttcccctcttccttctctctctttccttctctctcattctcatcatcttccttgctctctttctcaccatccctttctctctctctcttcttctctctcatcctcatcatcttcctctctctctttctca

SEQ ID NO: 21375 - DNA, 1241 bp, Heterodera glycines
  misc_feature (28)..(28): n is a, c, g, or t
acttgggaaagaagaggaaataaatttntgagaatattttccgttttgactgagttcaatggggggaagcgatgagaagcgcacaaacaatagaaacagtgatttacgattcgctaaaattgctgctaatttgcgaatgaatgcccggcacttttgccacaatctctcggccttttcattctgtcctttccctcgctctctctttctctctctcctctctatctctttgcctttagtccgtccgtttcaccgtttcgatgcgtttgtgtacaatggcacgtcctcctcctcttcatcttcctcctcctcctcctcttccctctcttcctcttcctcctcttcctttccatcccttccgtctccccgtcctttcctccgctttttccgctcactttgcccgtaactttcgtctctgtcgccctcctccatttgaatacctccaacacaccgattggcttccgtgttgttcagcatccttaaaagtgtgtgccgttccgttgcttttcgcttctcacctgaccgcgtcccacattgtctccggaaggggcaaatccctcgtctcgggaaggaaataaatgagcacaccggcgaacagtgagaagatgcaaaagatggccattgggacggtgggcaaagtgacgtcggaaagaatggcgatgtaaccggaggcagcggagccgaagcgggccatcattgagcaagtgccgacggcactgttgcggatcaccgtggggtacagctcggaggtgaagctgaacgaagggacggcacggaaaggcaattcaatcagtgggggagtaaacgtacatgtagagaatgttgaaagccccctgaatgcacactttgccagccaacatgaaaagcagcgagaaggtcatctcctcgcgcagggaaaggcacatcgcgacgaaaattaaagtgccggcggaaatcaaagtgatcacttgggaactaatggacgaaggggggggggcaatggcatggttttgcaaaatggactaaatttgtaccgttttcgaccggaatggagcaaaaaaacacaagcctgaagaggaaaatgcaatttggacaacttaaatgagtgctaaaccaaccatcagagtcggcaattcaatggcaccggcgatggcattgttcaggaaaaagttgccgacaaacattgctcggccaggggttgactggaaaaggccaaattaggggcaaagggccaattaatggggcggaattggacggagagggaa

SEQ ID NO: 21376 - DNA, 3151 bp, Heterodera glycines
atttccatcaaatattaatttatgttttattcttttgtcttacaccatgcactaaaattattaaaaagtcattgataaaatatctcaccctactttcaaaaattaaaaattctgttctttaccttttgatgcctttacgcttcggttgcacaatggcgtcgtccccgacgtcattttgttgtgccggcatcggaccaacgcagggcgcaaattcgcgctcaagcaacatgtccaacccgtggtaatccaacacggttggcatctgtcaataatgacatacacagttgaaatagaaaaaaaaattaaaaaagttttttatttttttgaattatttataaaaatgaaaattgcagtttgagtgccaattttgtttccaacattctcaacgcaataaattaatttaaaaaaaattctaatttttgccaattttctgccatcgctcaaagattctttgatggaatttgtgttttaatttcaattttactataattaatttaaaaaagtgctttttacttccgtaaatttattttcaaatttcaatttgctagtattctgaatgtgagcattattccaattcaatagttttttatttaaaaaaaatgaaaaatttcatatttttttcttgtcattttaaacggtacatttcaaatattgtaaaacgtattttttaactgacccccaattcgtacgaaaccaattgcttcggttgtcctcgccttggacgtcgcgggtcatcaccaacaagatggacacgcaaagcgggatcctcctaaaaaatgtgtcaataatagcaaaatatatataatgagcaatatattgtatttatatcattatttacacttatttgcttttcaatttaatcggaatttcaaaaaaaaaacaaaaaaattttttttgaatttttattttttcaaacgaaaattttaaataaaaattgttgctaaataatgtatgggtggaccagggatggcacggaatttcgatttccgatatttttgaaatcggaatcccgaaaaattcttgggccttggagtttaggtttacgaaaattttttggggcctcggaatgcaatccctgatgggaccgggaggtgatgccatgtcccattatattttcttaccagtgaagctgcagcccctttgctggcaccggacggctcgaatttgttgcccgtgtcaaatgagtcgaccaggcaggagaacagtgcgctggaatgtgcagccacaaagtcggcccaaccatgctgtgccagctcagccatcaagtccatgtagcactggagaatgtccccactttggcacgcaatgccaacaaaattgagctaaaatatttttaaaaaatatataattttgccgggtgaactatttcccactccctgcccagtatcgtttcccgccgaaaatttttttgaaaaaaatttcagtggaaaattttcagtgatttttgaaaaattttaaactattttcatggaaataataatttgttttaatgcttttatgcatttataatttttttttcaacagggtcaaactcgaaatggagcatagtgttggtaccaaatttatccaaaaataaaaattgctcattctcagctaccttggaggcaccggcgaatggtccagccaatgtgtgatcacagcagcagccaactttgtctcaccgtacctgtgttaaaaatctcttcaaaaatgtgataaaatttcacaaaagctaaacaccaaataaacccaaagaaatgcaacccatttttgtcccaaattgcgagtgatattttgaattttcgacgactttttgttagaattcgagtccgggattcgaaattggtgaaaataaatgttggattcgtgatcagagcgacccagaaaaacacccataaatataagcaacatgtcaaaagccctgaatttaacctgtccccgtacaccagcggatgcgtgaagagaacggaacaatggccgtcttcagtggacaagtccaacacgttacggtagcacatggccaagtcgaactccaccaactcgtccaggtcgaccacatcgccttggacaggtcggggcaaaatggcgtgagcaatttctgaaaaaaggaaagattgaatcgcaaacgaaatggaaaaagataaaaagagaaaaatatgaaaattttttaaataaattaattctcaaaaattttctccggcagatgaccaccaaagcttctaattttcctttaaaaattgctcaaaatcgcaaataggtctttacatggcaagacccctgctcaaaaaatttgtttgaacccccccccccccttttttcatgtagggttacgatattttactttttttatataggtagttcctaataaaatattttctctattttaaaatctgtcggctacttttgaagttggtcaagccgtaagagttggacagacgacagttgccgatgccaatgaattggtattgggcacagaagtccttcaactgagggccggccaaatcgtggacacgcaggaaagtttcatcgcctaaaattggaaaaaaaaattaaaaagaagaacggactggcaaaaccgatccggcgctttttggaaaaacccggattgaccggcttttgatagacccacgggggggggggggtcatcgtttttttttgagtgtcaaattctgaatgaatggacatcatgttaggctgacctgacagaatatcgctggcacaaaagttgaccaacacatcggcactcatccgttccaggccaccgacggcattggcaccagtcgttccaccgtcctcgccacaaccacctccgtcgccaacgccgttctcatccgggcgcgtgctgcacaacaatcgcagtcggccatccatgaacgtctccaccagcacttgctgctgtcgttgttgatcatgctaaaattgaaatttaaaaaaatttgatgaaactggaaatttaaattttgaccccataattacaattcaaccacctgcaacgcctgtgcacttgtgcatggcaaatcggcgtcatattgcgacgattgagcaaacagcatgccttaaacaaaaaaacagaattaaaaatttgtaagtcagatcaaaaaaccttaaccgaacagatagcttatatgcccgtgatttttgagttaaatcttgaaaaaataaaacagatttt

SEQ ID NO: 21377 - DNA, 2073 bp, Heterodera glycines
  misc_feature (48)..(49): n is a, c, g, or t
ccccccccttgtgccccccaattgtgccatttttccctttgcattccnncctcacattttgtccccattgtcacaatttccccccattgtatttctcacacatttcttatgtatgggtttaattacccaagtttgagctataaacttgtggaatattttggtgcaatttcttgggcggcaaatttgggcaattggcggcagcgaaaaacggacaaatcggcgcagacccctcccccatctgcgtcaagtggcgctcctgggcactcgacggaccaggcttcgacaagcggccgaacggacattgcgcacaggagcatttgggattagtgagtaaattgggggaagaggaaattttgagatttgggcagggcaaaaaagggaaaaacaggggacggtaggaattgaacccggaaggttgcccttcggattttctgtaatccgtagcgcttcctttggtcccagagctgagtcccgcgaattttttgtaattcgtggcacttcccttgccaatcagcgcagccccacggattttttgtaatccgaggcgcttccctggtcccatagttcggcctcacgaattttttgtaattcgtgtcgcttgccttccccagggtttggccccacggattttttgtaatccgaggcgcttccccggtcccatagttcggcctcacgaattttttgtaattcgtgtcgcttgccttccccagggtttggcccctcggattttttgtaatccgaggcgtctttttccttgctcagttggcccctcgggtttttcgtaacccgaggcgtgttcctttctccagtgaccgacccctcgggttttttgtaacccaaggcgtcccccattgtgagcaggtcgctcctagggttttttgtgacccaaggcgcctcccgcttacacggtcggacccatcgagtttttcgtaactcgtagcgtccttcttcatacactgtaagactcttggtgggtctgaagtcaaactcacttagtccactgtttgttcatactgctattttgtgaccccgaaccccacacaatttgttcggaagtcgggtagcagaacccaaaagtgagcaaaaatgtcgggatttttgcgtacaaaaatcgcaatagagctaaaggctcttgagaaggcgaaaacggcaacagaattgtatgctgagccggaccaaactctgacctcattggaaaatgcaattctcctggaaagcgcggcagagagaataaagtcagaggtggaggcagtgaatgccaaaattgagcaaatttggataaccgcaagcaaatggcatgacgtcatacaaaaaatggacaaggacgaaagaaaaagtgagcaaacagcgtatgaacaatttcaaacaacggagaaactgaacacaaaaatggaagcagccaacacaaagctaacagagctgaaggacctggagatgaaggtggaagcaggagcaaagctgcaacgctccaaagcagacagagacgcgcgagtggagcaaagagaacatgcaaaagcaatgtcgaagtcgaatgcagaagcagacaaagggaataaccgtgcgagaggcaatgaaatgactgccgcattgtaccaattgccaacactaagaattaagccgtttgggggagacaaacgggaatggcccatgtttgaagaagcatttaaagtggctgtggaccaaaagccaggaagcaaaacggagaagctaaatttgctgaaatcgctggttgagcgagaggccgcattgctcatcggaggcctacgcctggaagagaaaaattacgaaattgccatgaagctgttaaaggacacctatggcgacaaaggcgaatatgtaaggaggttgcacacggagttgtcgaacctcaagagatgcttttcggtggaagacacaaagcaattttgcatggaattggaacgcctagcaagagaattggaagcagcggaagaagacattgaagggccgccaatttatttaatgcttgagaagaagctatacaagcctttcctgcgtgaaattctggaagagaaagcaaaaatccagacttttgggacacgtcatccctccgaa

SEQ ID NO: 21378 - DNA, 1484 bp, Heterodera glycines
ttttgaatgacctttcaattgtgcgcaagcgttttttcgaaattgtccaactttctaatattgtgccgtcaacaagggtcaattgatgccgtcggaaaatttttttttaatgaatttgtaaaggtgtaaattccggattggaataacgactgtaacgaaatggagtatagccgccaaaaaataattcgaaaatctttcccaccatatgcattagtggaatctgtttttgttgcttttatgccaccaaaataagtccattttcgtgccgtgccctttgttggcgcagtattttttaaaatttttgtttcaaaattttgtgtcatccgtataaaatgaaaaagtaataaatgccaaaattttttattgcttctttgttcaggaatgatgccttcgaggagcaggacctcattaacgccttggagccatttttgatggcggaacgcgacagatcgtaagtgtgttgcaggcaattatcgcaccttcacttcaagaatcccggacgcggaggcgttgcacccaatcggattttgagagggcccatttgcccacaatttttagtaaaatggcggggatgtggcggcaatctgaaatggtcaacctccgttcccgcccctgaaaattttgaaaaaaaccccggctctgtcgaaaaagattaccccttcgccccgtcttttccatgctgtttttgggtgcttccgggttggtgaaactcatccccgaaattttttgaaaaatttttttttatgggtaaacatgcgttagcgtaaaacaaattggttaaataaattgatgtttcatttgtcggtgcctaaaaatgtattcctaattcggatgtttcttaagggtgttgcgcatcatgaaacgcaatcgggagctggagaacgaggtgatgaaggatgtgccgggatggaagaccggcacttggtacggcgagccggtctatttcacgttgggcgacaaatggattgaaccgaatgcaatggtcagttttagggggacatgggttgttcaattttttggaaattctattcaaaacccattcaattttcaagttttttggacaatatgtttcacgaagaattcaagattttcattgagtcggcaccgtaatcatgcatgtacaaggggtgcgccagtcagacccccatacgtcggacgtttggcgcagggggggggggtgcgccaggcttacgtcggcccctattttccccggcgacgacctttttctttttttgctattcaaaccacctttttttgcggcgcgttttttccaaaaaactttgtgggaaggggtggggcggtccggcggcgcctatcggcaccgccgggaaaattttttgaattttatgctacggaaattgttcacattttaacttttttcccctttgttatgaccccccccccctcctttacagccgccccccttacgacgcacgtggggggggggggggggggtgcgccggcgcaccccttgttcatgtatg

SEQ ID NO: 21379 - DNA, 1311 bp, Heterodera glycines
  misc_feature (1275)..(1275): n is a, c, g, or t
  misc_feature (1303)..(1303): n is a, c, g, or t
ttcattttaattttcatggatttcagagtccagcgtcgtgtcttgaaatgttcatccacataaaagtcaaaacggtagctaatcatgcaattccaaggccaagttgataagccggaagcaaatcgaacacacaaagccaacagtcggcggaaacgaaactgaaaaaaagggaaacaaaatttaaaattgaatttaaaattggcattttttattttacattgcttttgccatttttcgctccgccgcttcttttcgattgtctgacattttgttgaaggcaattattaagacagaatttcggcacttttgtacttcagtgggctttttcttttctcaaaaattcatatgaaaacaatgcaatcaaagaaaaaaaaagaggggacatttaagtaaaacaatcgcaaaaacacattttaatattatttttatgcttttgtaaaaaatgtgaaagcgtacaatttttgaaggcattgtcaaggagaaaaacctgaacaaagagagaagaaaacaaatgatgaatgtataataaaattatttttacacaatttgcatatttacagttatatgtaatctaataattagggcttcttttttaggcaaatgcctaaatttttgcgcacttgatacgcaaagataagcacaaaaaacgcattttccgcttggtttgggatgtctacaatgacttttataatgcctattttgcctatttcgggttttttgtgatttttaaattgctataacttcaaaatttagtataaaagtggttgctcttcctccgccactttcattattattattattattattcgttcgctctctctctctctttgactttttctcctgacaattcctccaaaaatgattctgtacgttttgcatatttgttcacttaaccctttacttctcattttttagtctattcgttgtgccaatgtttgtcggatgttgtgccattctttggttttattgggaccgcctcaaaaaaccaaaaaagaaaatgtaaaaaagaaaaaaattcaaaaatttggtatttaattttcagtttcatctccgccgactgttggctttgtgtgttcgatttgcttacgccttcacaacttggccttggcatttcaatgatcagccaccgttttgacttttacgtggacgaacacttcaaaacacgcaaatgggcattgacacatattcaaatttggcgcagaattggagaaaatgacaccaaggaaatggaaatttgccatgacggtggaaatcctttgccaattcctcaaattncattgccacgcaaagtcattggattccnacgcatca

SEQ ID NO: 21380 - DNA, 1472 bp, Heterodera glycines
  misc_feature (1376)..(1376): n is a, c, g, or t
  misc_feature (1415)..(1415): n is a, c, g, or t
aaacaaaggcaaaatttgcattttgcagtgatttctgcgaaattccaacaattttccgtgcccatttccctcaaatttctgccgacctccgtcactgccgctgcttttgcgttgggttccgtgccgagcacatgcgaccgaccgacgatagcgaacagtcgcaagtcgccgtcgcaattatttccgtctttgtgcaccattgacgaacgtctcccaccgccggaatacatttgtaggctgccgatgtaaaagccttaaaaagacaactatcgaagttttcggccaatgtaaaacaaatgggttgtgctttatacacacttaatatacatataattagatggctaattagataacaaaatacattcatatacactttcctacaactgttcttcaactttctgttttgtccactagttttaatacacgcaaacacatgtgtagatacgcgaaatacactccttaaaatcggcggaagtgaaagtgtaaaaggcgtatataaatcgatatttgattctacagtatcctttttatgttttgttgctgcaagaggcagagaaaagttgaaaaacgaagggagaaagagagatggacagagacggagaaaatggggaagagaaagaaacagagaaataatcagctcactcatttaacacctgaaaatttattaaaatttgttggatgcaattaaaggagatttgtaaaattttattggctttaataaagcatcaaatacaaaaacaaatgattaaatttatttgctgtcagcgtgagatttaaaaaaaaagaaacattaaatggcagtaatgaaaaaaagacagacgcagaaacaaaagaatgaatgggaattgattgtcctgtgaaggttttgtcgttgcattaaaatgaaatgcatttttagcacattaaacacaaacaaataaacataagcgataacaatcttaaaaagcgaaatgcaaaaataaatatcaaaaaagtcattaattataattaattttcgtcaaaatcgtttgagtgttcgtctccatccttctgcttggctcagtcctccaagtccgtctcgcggatgggccggcagcgctcgtgttggaaaatggcgtgcgcctcgcgcagcagaaaggcaccgaactcggcgatttgttttgcgcgacgcgaggcgagcccagggaacgagccacgcaccacgttggtcagattgtcaacaccttttacggggtggcatcattaatatggcaatttgagaattgtaattgatttttaaaaatcatgccaatgccagggatttgttacccgacatttccgtccccaatattcgggggacaacaaccctaattcgggttgtcaaaatggaggtcgaatttgcatttttggatccctanagcgtattcctttgattagttaattagccctcctattanacgccaccgatggcttcgatcattgccccttcgcgcacatgcgcctcggccgagtga

SEQ ID NO: 21381 - DNA, 1179 bp, Heterodera glycines
  misc_feature (1163)..(1163): n is a, c, g, or t
attagttgctaattacccaatcaaccactggggagtacggtaaatgtctctcatcactcacaaattcccctccgcccccaccccaaccacctcctttttggtgggctgcgagtgggcgtattccgtgcgaatttgtgcctcctcccttctgccgatgcgctgactctccgccgcattgccccgttcttcggcgaccaccaaacgctgcagagaatggctgtactctgaacagcagaggaagagacgacgagttaatgccacacacacacaccgtagtaattaatgactgacaaatgcacgcccccccccaaaaaaaatggaaaaaggcggaacgagtcgtttttggatgcaattcattcccctcacccggatttttaaaaaaatttaaatttcaaaagaaaaacggcattgaatttgtaggaaaaagggtgctagagcgagagagagagagttacttttcccaaatcattggcattggcactcggataaaagtacaaaatttcattgatttccaattaaaaattcccgccccttttattacgttttattgcgtttgtgtccctctgctgctgctgttgtcctccttttccgtgccattgccgtgtctccaaatgggccaatttggcctcgtaaatgcgtcggttgcccgcattcattggccctgcaatgcaattgcgacggcgcaaccgctcgcgcagttcgtccagccgaagcatggcgaattggtgccgaagtgcgtccaacacggcctcgtcagagtggcgttgtacaacatcatcgtcatcaccatcatcagcatcgcttggctcaccatcactctataaactcggaaaattcttaaatattggaaccgcttttccgtatcagataaatttatttagaaaaaatcccctaaagagttctaaagattttcgatggaattcattgcattttgggggcaaataaaatgtgttatttcgtcaacgggaaacatttttaggcatttttcttgtttaggtggcccggtgaaagtgaaaagccaaaaggggtacagacggacactttggttttgtattatttttggtcaaaagagataaaatgccattgattcatcgaataaaagtgtgccaatttttccattttctttaaaattccatttaaaaattccctacctttctgctctntggtcatcgtcttccc

SEQ ID NO: 21382 - DNA, 1600 bp, Heterodera glycines
aaaatttgcactcttccgatcctttggatggtcagtttcagcaggcgtcgtcgctcctcctactttgactcatgtcaagtgctactgataagtatggggggggggaaggtgaaattgcacggtcgaagagccaatgcgaaagtgacgaccgcgtgcaagttccctaacgtttcagtcccgaagagacgaggcgatcgatcgctctcttcacattgtattcgtctctgctgctgtccaccagacatgctccctcgtgtcctaatcgttcagcaattgccaatccaatcctgtgaataggcacattttgtacggcattttcatatcagtgatcatcgattgagtacccttctgaatgctggtgtagctcaaacagtggtagctgctgtgttctactcgcccttcttttacaattgtaagagtttggtccaagcgaaacgaccccccccctacaccaatcgtctatcgcatagttttcgccttggaaggccacttgcattgaaaaaagcacaaaaaactcgtgtgggctcgcttcatacatatgattgagaactggtgacatcaaaatgaatacattttagggtgctcgggtactcaaagtttgagaaggtcaatccggacatgaaagactatatcgacgaagtcagtgctgaggatgaaagtgaagaggaggagagagatgatgataaaagtgatgaggaggaagaggaggaggaggaacggaagaaagggagaaagaagggaaataaagatgaggaagaagatgctgagagtgatgatgatgaggaggaggaggaggaagaaagggagaaagaaaaagggaaagaaagggagaaagaaaaagggaaagaaagggagaaagaggaaaggaaagaaagacgaagaagaagatgatgagagagatgaggaggaggaggaacggaagaaagggagaaagagaaaaggaaagaaagtttcggggtcgctgatcacgaatccgacatccatttcgacccatttcgaacccgaattcgaacaaaaagtcaaaaactcaattttcaacaaaattcgcatttattgttcaaaatcgtttcaaatgccacggcagcatcgactggtcaacacaaaaggcattcaaaaacgcagaacaatggacaaaagacagcagatttttaattgaagagaatggtgaccagggctggccgtgattgaatttccaatcacggaaatccgtgagccgtgatcacggggctttaaaaaaaatccgtgaaccgtgatcacggcaccccaaaatccccgtgatccgtgagccgtgattataaaaaaaatttttctaatgattttttatttaaatttatttaaaaaacggaatttaatcgcgggaaaaattcccagagtaatttatttaaatttatttgttttcttatttgttagtaaaaaataggataagactaacaatactgctaatattaaaaagaaaactaaacatataaacccgctttttttgcggcgaacttttccaaaaatgactaagtttacgatttttggcaattttttgaggaaaattagagctttttatagaaatctccaatgaaaattttttatttttacttaatttattaag

SEQ ID NO: 21383 - DNA, 3183 bp, Heterodera glycines
atttctttaataacttaaaaaacagttttaatagaaaacaataaaaggtacttttctgtttgagaccctccctgaaattttcaaataaatttctaggtaatttgtgacgctgattacgaatatgcctttgttttgcaaaattccgaacccctaacccgaactcgagcaaaaattcgatttcatatttacaaggtcattcagtttgtccccccattttttttaaaaaaatttttctttttaagtcataataacatattttaagggttttcgggatagctgatcacgaatacaatttgatcaaattcaaacccccaacatgaattcgaacaaaacgtcgaaagtacaagtttttgaattttgaatttttagtttagaaaatgttttaaataattttttaatgcaagaatgatagattccagttatttttatgtatttaagccgtttttagacgaatatgcgaaatccgaaaataatttgtttatttaaattgaataaaaaaattcgtgattattgttatgatataggtaatgattttctttattttcataaatagactaaaaaaatatatatgcaaaatgtatttaattcttatctttattatcataaatatataaaaacaaaattcataaatttacttctgcattccgacgcttttcaactgcttggagtggacctgcttcagcagctaaattgaaaaattaattaattaattaatttttcaaaaatttttcaaatttaccatcatttaagtctcttgaagaaataggactggcaaaggttggatggctggagatggcaagtaaaacgagcaatgcaacaagacttgccaccgacaaggacattgttctcatttgactgacttgcattggcaaaatgtaaattaaaaaatcgctggctaaaattaagaaaaagatattaaattattttcaattatgttggctaaattaagattatttatatcaatattaaaaaaaagcaactttctttgcttttgctaacatgtttttttctaatttgcttttggttaaattggaatataaatattttccaaatttccaatttagtgaaaattacgaaagacaaaaatgaaaggcacaaattttctcatttgcttcaaagccaaaaaccattaatggcatggaaaagtgccgagaacaacaaatgtccaacctacttcaacatgccaaagaaggaaaatgtgtccaaaattagaaaaaattaacaacccccacaattcatcaaaatggttgggtgaataaagaaaaaaaagatacactgcctattacaatttatgaatatttttatttagaaagtttaaaaaaaattaacgaaattcgaaatttaattaaattttgaaaaaagcaaaaaaaaaaaaaaacgtaacctaaatacccacatagataaaaatgaataaaagtcaatctttttatatagaatttatgacgcataaagttttgtccttgtgataaatttggccatgacacagggtggcatagtcagaattgggcacattgttaaatttcaaaaaggtcccaaaatggcatattttaaacaaaatttgtgccaactccccacacaaataaagtgaaatgtatgatgaaatgccgaaaaaatggacactaatttttgacagaacacatcggctggatgtcggtgccattagtggtggtgatgctaccataaattgaatttaaagacgaataggaagacacaaattttttgtgacatttcctttttcaggcttagttcccggtttatgaagaagaagaaaaaatgctgaaatccgatgcaaattacttttttgttttatttatttaaataaattaaataaatatatatttattttgattttttgccgaattttgtttatctgctccaaaatgcatctgtggaaatgcggagcttttgaaacaactaactgacaaaatgtaaaatatactgtgaaaatgggatactgtaagtttgtttcaatacaaattacgacaaagaattaagaatcatcctattacagtgtcatatttaaaaaatatactgtatcattaaagaatttttcacactatcttattttcagaatacattgaactttccgaaaataaatattagtcgctaattaatagattaaaaatgaaatttatatattttaatttcattattattgtggaaatccttcaaatttacccacgagtgtttttttccacattcgctgtttaaaaggttcaatagaaagaagaatcatcattcagtccacccaatgaagaaaaaaaaaagtgggacaaggacagaatgccaacaaggcaatgaaggatagataattggcacagaatgccaaaaatcagaaaaatgcactccctcgatgccctggagggatgcaatgttttcccatcagccgccgataagacgacggaagaaattaaaggctctcctctggccatgggatgtgttgttgtcgtcgtctacgacgaaaattccattatcttccatggaagatgggacatcggaagaaaattggaacgcatttggcggatgggtaagcagaaatcgtggccaattcaacaggaaatgatgtgatggcgaacccaattttcacaaaaatcgtattttaaatgaataaataattaaaatgcaattttaattttatagcagtcaaatttaattgggttgttattgataaataaattaaaaaattttatgcactttattttactttattttcttgataatataataagatgatatttaattgatgataatttatagttaagaaataaatttgaataaaaaattaacatttaaaaaaaaagtgtgaaaagtttttaatatttaattttgtcatttttctaagaaaggtttgaacataaaattttcttcaattataaaaaactttatttatataaaaaataatattttctaaagagttttattttcgcttttcaaaattaaattattaaatatttttcttttaagttattctaaataatttaattagttccattatagaaatttcttctaaaaaaattgaattaaaatatttaaattttatcgattttattctataaatttattattcattaattagagctaattttctataattacaaaataataatgaaaagagtgaaataatttccaacaattcaacaaagatgtataaaatatttatttattcaaattttaaaaattcta

SEQ ID NO: 21384 - DNA, 1131 bp, Heterodera glycines
  misc_feature (1094)..(1094): n is a, c, g, or t
  misc_feature (1125)..(1125): n is a, c, g, or t
caactccgtctggccaactccgtctgagccaactccgtctcgccaactccgtctgggccaactccgtctgagccaactccgtctgagccaactccgtctcgccaactccgtcttagtgtataaggggccaactccgtctcagtaaaaaaaattataagaaattttcaattatcatcaaaatatcacttcggcttaatttttaaaaatctcagttttatccaaaatataataacaaataaaattaacaaaaaaatcaacaatccgtttgataattgctcgaaattcccctaagcatttcaataatcgaattttggttttggttttggcgatattcccctgatcattttcgatttgcggctgcgctttttcctcattgtagcgctgcaaaatcctcagaattcttttgtccgtgtcgcggtagcgctttgcttttggcggcggagcatttccggcaaggaaatgttcgaagtcaacgtcgattactttctggtgctcacgcaaaatattgatgaatttccatattgttgggtgtccttgtccgatcgcatgttgcaacgtgcgatggtacgcttcggcgaagttgtttgtgcggtcggtgccgctcattgtgcgctcatacacactccattcttcaggacgaaacaatggacgagtgcgtgtgccattgttgcgaagtcgcccaacgtagttgattacaaacctttaaagtcaataatgaaattgaaaaaaaattaaactcaacaaaccaatcgagaacgccctcaagttcacccggcagatgatcttctagggctgccagcgccggtgtaaggtcctcaagcggcacaaacgccagcgaagtgaccattttggcgaattgtgcaaaggctgcgtcagttttgaaacgctaaatttgagaatttcaaaagtaataaaaaatttcttacgtgagtttgctcgtcggtaagacatgctttcatgttgcgcaccaaatggaataggcaaaagttgattgagcattgtggatgtttggcacggagggcgtaaatgtacatcgactgctgaaggcaatttccgaatcgcgaagcaatcgcttagaaaatcagaattcttanatttaaaaaatatgtgaaaagctccccttanaacaca

SEQ ID NO: 21385 - DNA, 2461 bp, Heterodera glycines
aatatgtaaaaatatgtaaataagttccaacttttgttcgcaaaaacaaaaaaagtgtttttactactatttagagcatggagaatccaggaaaaaaaattaagtatttacataaaattgacatccctaataatgaccacgaataaaaaacgccaaatatgcaaattgcagcattattattttcacagaaaaggtttcttacttgctttaaaaatgtgcaaaaaataatataaatttatcctcatttttaccagttttttaaaaataataatcttacgaagttcgcagagacatatggatccacgttgctaatgatcgaggttgaaactgtcacgagttgattctggtaccattccattcgtttttcgtctccggcgaagctcagatttgcacaaattgaaccaaaaaacatctgtcaaatattttgcttcagtaaaagataaaattgatacattgaacattgatatattaatatatggaagcgatttttacgtgttattagatggttgggaaagttggttattgtaactctcggaacaaaaataataatttctaaactatgtatagcttcgcgattacacaattaccaaaaaagttatacatggaagttgcaaaaaaaaatcaaaaattttgaaactttttaataaatttttccaggtttgaaattttctcgttttttgtaaggtaaatagagcatgttaagagctttcgaatgacaccaagaatgttgaattttggtgccaaagaaaaaagttataagtggaaaaacatgcttgggcccaaatgtgtggggcccaacatgagggccaatcgaggggtccaatcgtgaggaccaaactgacgggttcaggtgacagtgattttaacacataaaaatcgcgacgctaattaaactttttaaaataatttattataccaatttaacaacatccaaacgaatgatattttcaagctcttttatttcctttctgtggaagtttttgccgacgacaatgtcattgagtaagcaacttcaaaaaatctttttgaaatgcaaaaaagatggaaaactaacacggaaatgggtccatatgttccagtttcgaggaaaatttcttttacagctgaaaatgctgatgaagacgatgcatattcaaatgaagagactattagttttaaaatatagcaaatagacagtgaattaagtgcaacagaccaatgttattttccactttttgaagcacgctgttcgcactgtcagtctcaagttctgtgaaccatataactaattctatacaaaaaatatttttaaattagaattaatgtaaagcaatgtttaatacccgctgaaatcgaatcgaatttttccctttcgatttggctgcttatttgcatacgaattttgttgagcatggggacaaattctgcttgacgttcaatctgttcaggcgacaatccaattgtgcagtcgtcgacagtgtatgtttgtatgtactgaaaggtgatttgttcttaatgatttaaataatttattcacatgaaattaaaatgataaaaactataaccgataaagcaaaaagtatttttattttaaacaattactttaatctatgacataaaaggcaaaaatactgtttttatattataattaatttagtgtgtgatcaagctacccttacgtcgagaatacttaatggtgtctgtttgtcggggtcatcacaaagaccaatgaatctttccacgtctttgtctgtttttacaattgcagggtcccaaaatagcgacacgtatcgacgcagagttttcatcggacggcgaacgttctgaaataccaagtaaactggcaaaaaaatttcagtagtaaataaggatttccgaaaatagttaaatctataatttagaaaaagaagttacaggcccgtaacaaaagggaaaagagggaacactcccccccaaaagaaacttatttttttttaatttttctaaatttgcatgcttttcttatcatatttaaaatttcaaaataaattcatgccggcgcctaccggcagtgtcggaacctagaaccattatgttttgaaagttcgacaccaaaaatacaaacttctgtcattttcaggcatatctactaaatataaataatattggagaaaaggccagagagcaaataaaaagttctttgggtctactccccgaaatttttttctgtatactggccagttgattaatatttttatttcgtttacgtttttataatcgcgtaggttgccgcgaagcgcaattacgcgttccgaaacagcaatcgtgctctgcaacttctcaaaattttcgtccattgtcttttgaagcttcatcagagccttgtactcatcagattccggctaaaaaaagacgttaaatttaataagaaaaaactttaactctgaaatttgcgataattgtcagaagttattgaacaaaaatttttgcccgttttaattta

SEQ ID NO: 21386 - DNA, 975 bp, Heterodera glycines
ttttcggggaaaacctcatgttgaaggctgtagaaaaaagagatagccatttttctgagaatatctattcttagttatggagccattttccaaccgaccatttgtagggctcaaccgtatatagtaatgcgttttcggggacaacctcatgtgtaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgttgaaggttgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctgagaatatctattcttagttatggagccattttccaaccgaccatttgtagggctcaaccgtatatagtaatgcgttttcggggaaaacctcatgtggaaggctgtagaaaaaagagatagccatttttctga

SEQ ID NO: 21387 - DNA, 934 bp, Heterodera glycines
  misc_feature (70)..(71): n is a, c, g, or t
actccaaaaagtgggtctaaacgtcgtttttgagcaaaataacaacatttcgacccccctggagtaaccnncctgtctggaaatgtcttcctgatcatttttgtagagttcgaacaatgttcgacttttcgaccttttgttcgaactttttattttcaataacccagggctcccagtcactgtagaaacatttaaagtcacttttgaggtcttacaagtgctctgtgagcgaaaataacaaatgaaatttgttcgaactccaaaaagtgggtctaaacgtcgtttttgagcaaaaataacaacatttcgaccccccttggagtaaccccctgtctggaaatgtcttcctgatcatttttgtagagttcgaacaatgttagacttttcgaccttttgttcgaactttttattttcaataacccagggctcccagtcactgtagaaacatttaaagtctcttttgaggtcttacaagtgctctgtgagcgaaaataacaaatgaaatttgttcgaactccaaaaagtgggtctaaacgtcgtttttgagcaaaaataacaacatttcgaccccccttggagtaaccccctgtctagaaatgtcttcctgatcatttttgtagagttcgaacaatgttagacttttcgaccttttgttcgaactcgttattttggtctgaatagggctctaatccattgcgcaagtatttttgacgctttattttaatttgtaattaaaaaaatatatttaaattaatttttgaatataaatattagaaataataattagcgaatgggagcgccgtagcatagtggttaacgcttttgattaaatgctttggggttctagtccgcacggcgctcccataattaggtaggaattaacaattattaataataataattaaagctttaataataataaataatgctttat

SEQ ID NO: 21388 - DNA, 1778 bp, Heterodera glycines
taggcattaataactcgaaaagtagcaatgaatgaaatgttgagaagtgatcgatcaattgcagggtaaaatggaagatgaattcggttttgacgtgatcattaaatgtattaaactgaacatttcactgctttcggctgttctacggttggctcatcaattgagaaatccgtagaaatcaattaacaataaaaattattcttaacgattaaatgcttaaaccagggacggggggattagtacttgaatgtcaagtacgtacttgaaaatatttgacatttattttactgtcgacatgacattgtttttcatttttagtaaaatgccaccgattttgagccgcttctcccgttaccgctaatacgtaaactttcatgtaactcaacataaaatggatattagcttaaaataatctcagattcgttttcagcaccaaaaattaccataaaaaataaaataaaaaccgaaggaacagtgactaccgactttatcattagatcaaaagaatgagcctgggatttcaggaaatctctaatttatcctaaaggcatatacccacacatatatataatacaatttgtgatcaccgcaacaaaaagaacaattttatatacgtcaaattaattatctaataccgcaattcaaattgatcgatcacttctcaaacaattcattcattcatttctgctgctgatcatttgggcagcgaattgcgtcaagaagcctaaaaatcgtaacaccacaataaatttgaattattttttgggaaaaccaatctctcacccacccgtccccgatgttgtcctcatcattcatttcaatgccaatttgattccactgatgatagccaatcgcctcctcttcccattttgcccatttgtccgcgtcgcgcacaattggacaacggatgagcagaaaacgagtacaattgtcgtcaattattttcaatgccaattgctcccgagtcaattggttggtcagcacagagggcacaacgggatcagcaaaaggcaacggacgaaaccaaacaatgacaataaaattgacaggagaagaagccgaggcaaatgcctaaaatacgggaaaattgattaaagaaatgtaattaatatggcttttcggttggggatgggcacgaatcctaattagtaaggtgggcacttttggcccaattagggcataaaatttcttccaatgaactccaaaaaacgtaaaagagccaaataaatcattcgaaatcaccgctttgaaggctgcaatcttcgacggcaaattcacagcatccaagtcccacgcgcatttcaacacctttggcgcatcgttttgaagcggagtgaaaagccatttggccaccgcttgtccatccgatgccgcggcactgtcatcggcagggaattcgatgaagaaattggtgacatggatagtgagaacgtgaagcgatgggcagtcgttgagaattgacgggacgaatttgcgcaaacggtgaaaaaatccgacaaacaattccaagcgattaatgttttttccgaacattggccaaatgttgtgcaaaatgaactccaaaatgcggtcattgttcgtttggatggacaatttaattggacagaatgagtcgaaaagcggacgaaaatggccgagaaaagcaatgacattttgatcgatgaaactgaaaatggattgaatcgttttacaaacagaaaacaacaaatcattcgcttcaccttattgaaatggcttcgaatccgacgactttctttggcaacggatttggcggaatt

SEQ ID NO: 21389 - DNA, 1588 bp, Heterodera glycines
tgaaagtgtgcgtcttcgaagcaaagaggaagcggcgcgtgaagcggcgcgaagggaagcggcggattcgcctgagtcggagagagccgcggaaggaatgcgccattttgtgttggaggacaacgttttaacagtgccggaacgctttttggaggcggttggtccctttgctgctttgctttgctttacctccgatcactttttccgctgctattcttctgatctttttccgctttgcttttcctctaatcactttttccgctttgcttttcctctgatcacgttttccgctttgcttttcctctgatcactttttccactttgcttttcctctgatcacttttcccgctttgcttttcctctgatcacgttttccgctttgcttttcctctgatcactttttccactttgcttttcctctgatcacgttttccgctttgcttttcctctgatcacttttcccgctttgcttttcctctgatcacttttcccgctttgcttttcctctgatcacttttcccgctttgcttttcctctgatcacttttcccgctttgcttttcctctgatcacttttcccgctttgcttttcctctgatcacttttcccgctttgcttttcctctgatcacttttcccgctttgcttttcctctgatcacttttcccgctttgcttttcctctgatcacttttcccgctttgcttttcctctgatcacttttcccgctttgcttttcctctgatcacttttctcttccctttctcttttccataatcatttttcaattaaatatcaatctcttttttcctgttcaagattagcaaatatgcgggaagtgaccagcagatgggatgccaggatatgatcatgctgataactgatggagcacccggctttttccgcgaaacattcgaattgttcaatccggaaaagcgggtaaaaagggcgaagccaacaaaagtccaaaaaatgccatttcaaaattcaggtccgtttcttttcgtttgtcgttggagaagaggcaaaggattttgagcaggtgcttatcccttatattcggccaaatttgaatttgaaaaaggtccgatggatggcatgtgcaaaccgcggatttatggcacatatcagttcaatggccgacgttcaggaggtgagacaggcgaaaatatatgggaaaagagagagagagagaaggtaattaattacatttgatcaaggcaattaaaaatgaaaaaacaaaggaatgggcaacaaaaatacaaacttttcggggatgaaacattcaaatgcattcaaacgtttatccacttaccccatagaaagtgcagcaatacgttcgcattttgtcccgcaccgtttcgcgacaaaaggccgctttcaccgaggacagtccgttttggagtggggcaacccgcgaaagaatggtcagtcggtgaagaagggagacataaagcggggggaaagggagggaaaagcgtgtccttagtagcaatggattggtaactttacgttaacaatttcgccaaatctctccaacagagcgacgacttcatcgtttctgtttccttcccgtcgtcctccccgacgg

SEQ ID NO: 21390 - DNA, 1461 bp, Heterodera glycines
cggttgctgccattcccgagggtcttcccattgttgcgtctgttacgttggccattggtgtcatgcgaatgggcagtctaaatgccgtggtcaaaaaactgtcggtgcgtttattattttaaatcaccaaaattactactcgaaaatttaatttcttggttttactttgcgtcatttaaggcggttgaaacattgggctgtgtgacggttatttgttccgacaaaacgggaacactgaccaaaaatgagatgactgcttgcattgtggtggccgctgacgacacgcgggcggaggtaaacgcaaagggttttatgcattcattcgcttttacccttacacatttttcggttcctgtcgtcggtttcaacgattcgccactttcgcccgccaacggaagtggcggagagtgtcgcctgtcgaacggtgagcgcgtggttggccattcccacccggcgatcagccgagtgttggagattggctgtgtgtgcaacaactcgcacttggccaatggcacaatcatcggacagccgacggaaggggcacttttggtactggcgacagaggtggaaaacaaacgataaaaaacaacgaagaagacagagttgcaaaaatagacccaattggacatttctcgctcatatttccgccgtctcaacgaaatgccgttcaattcggacaacaaatggatgggtgttcaggtggaacccatcaatcgggttagaatcatttttataatgctctataaatgatattgttcacgcaaatttaaagcccggcgaggttgagctgatgctgaagggtgccattgaccgtgtgttgggaatgtgcgttggctatttggacaacggagtcgcccatcggccgttggacgtacaacggagagaacacattttgcacttggccaccggacttggccaatccgggctcaggggtgagcatgaacatttgaatgcctcaaaatgctgctaattgtaagattttgctgttaagttattgcaatggcttgtggcaaagacatgaactcattgtattatgttggtttagtcggcatcatggacccagtaactcatttttattgttaaaaatgtgttcttatccataaaattaagccacggcctggttgccgacaatccatcgagacggtacagaatgccggagtctccgtcaaaatggtcaccggcgatgcgttggaaacagcgattagcattggtagaacaagaaataacagtggaaaatggatttatgcattaatagtctttcaaatgaaaaaaggctatacatattttttgatttttctgaaaataatattttagggttttaaaggattacgatttgttaccctggtcaggatctcgaattttattactgaatccagtccgggtccagttccgagtcacttaccttatccgaatttttcaatatggttttttaaattgcaaggcactcgactaaacatcttc

SEQ ID NO: 21391 - DNA, 894 bp, Heterodera glycines
tcttttacacaatattcccgttcatggtcgcggtttgttaatccatgggcgaggcatgctatttgcgaaagtgttataaattacgccatttaccgttttaaggtcttcaaaactttttccagaaacatgaagcaaaagataacgaagatagtatttttcaccctcagttgggctaactggatacattcttccaattgttttacttattgtatgattttttcgtaaaatccatttcccttgcttaggattccaaacacaaaattttggcatttcaggatataaaaataagggtgaatttggattctctttaaaaaagtcaaaatatgccatcagtttactttttttgtcttttttctcgattattttttcctcctcatcattttcatcaaaaaatattgtttgctcattttctaagtgcacaggtaatctttgtacagaatgtgacttttcttgtaattggaacttaaaaattttccagcaagcctctacagggctgagataacgtgcatcaagaaaggagcctgcttcatcataaattaattcctttacagtacctttttcagttgttacacaacgaactgtggctgcgtcatatcctttaaatatgtatttgtatatatattttactgcttttatatcagcaactttttcaatatttatgtgtgatttaaaccgtttaatcaaatatggattataaggcacaacatcctgattagtcataactctttttttccctgttttccaatcaatttttgtataagttcttccattgttagggcgtttatataacgggtaacaattttcatttatttctgttttttcacggaatttttttggaaattttttactacatttgttttttttcgaacaccaacacattgcattaggaaaatc

SEQ ID NO: 21392 - DNA, 579 bp, Heterodera glycines
gtatgcctgtgccgaagtcgcattagaatcccttacaatctgtctctcaccctcagacatttgatttcggcttacttttcgttttctgtctttttcacgggaaacatcagctttttcgctggacatattcatacgtgataactgcattctgctgattgtggtttgttcggaattttctatctgtttgtctttctcggaaagattacaattattaccaacaaaaaattcttcaaatacttcatcaaggtctatcacatcaaaattatttgctttacgtttaatcgtttttctatcattatcattttcaatatggtcagactgcttttttagggagcttacaaccctttcaatcgtttcaccgctttttacgggagcttcgaacccggcaatctgttgctgattatttgaagatgtatttggaaattcatttgaatttccaacagaaaaattttgttttttacgaaccattatctaaaatcaaattaaaaagttataaaaaaactgtagaagaaatattccaaattttaaaatatttatgtttctactaaaaaaaagaataaaatataaaaacactaatag

SEQ ID NO: 21393 - DNA, 1485 bp, Heterodera glycines
  misc_feature (1421)..(1421): n is a, c, g, or t
  misc_feature (1460)..(1462): n is a, c, g, or t
  misc_feature (1471)..(1472): n is a, c, g, or t
ttattatttttggaattttttataaaattatctgttccttcaatgaacaagcaaatcccttctcaatgttaacaatacataattttgttcattcattttaaatgcatataaatttaaaaaatttgagatttaaaatttggattacttaccattttcattttgaaaccattttttatatgtaaaatcattgaaaaatgcaaaattttaatttattgcgttttgggtaattcttatttagcgtagcccgtacttaccccgtgtggtgcgcagcctgtaaccctaccttttacttacactcaaatttttataggagggaaaaagaagaaatcaatcagtaaccgatggcacgacgacatttcgcctaataacccgaaattgaatatttaaaacatttcatttttgtacattatcaaagaacaaaatgttggatggattcttgacgaagccgactttgaatcggataaacgattgactaacgccttgcatctgttatctgttcggtttcgtgatcaagattttgtgagggaattcggtacttccgtgttttgctacccccccccccctaaaaatgtcatgatctcaataaagtagagcacttttctagggtagttttaggcgctggtcatgaatctggcatcacaacttcaaaattttttgattttgtctgtgattttcatcatatgactttgtctatgattttttaaaaggaaataaaatcatatgatatatcaatcgattcctctcgtcgaaaggaatcgattggtactggttacagagtttttcgattcctctatcaaaagttgtagccctacaaattttagctgggattgaaccggtctcttttcaaatgaagccgatgcgctaccggcgggccgctcggcttccctcaacccttttttggatttttagaaatcctagctagacatgctcctggggttttaaaaagaaaaaaagacattttttagctttttcgaaaaatcattgacaaaatcatagagtttgcagtttgacctcatattcttaatcagtgcctaaaattaccctagaaaagtgctttcctttatcgggaccatgacatttttaggggggggggggtagcaaaacacggaagtaccgggaattcttgttttagtaggcgaaatgtgacatttttatggggaggggggtagcaaaacctacaagtacctaatttttcaacttggtccaactgggtatttaaacagtgcaaaattttttttcaaattaatgctaaaaattaaattgatttcataaaaaccttttacaaataagcgtcttattattttaatgcaaatgggaccaagaaagtgttggctgtgttgtgataatgtaaagaatgatgggcaaagaatgagagtaaggaaagctgattctgtgtaattcatggtgaccttcccccaggngtattatcgaattgcgcagatggagctatttgaaatgtnnngcaattcanngcttttgattgcc

SEQ ID NO: 21394 - DNA, 558 bp, Heterodera glycines
gggggctgcagtcccccgtacgaggccgcgaagcggccgagccctccccaactgttcaacatcccaaggcacacaaaaagttaaaaatgctaaagaaatttgctgaggttgagtcccggcgattggaatgttggtgggttgagtcccagtgattgaatgctggagagttgagtcccgttgattggaatgttggtgggttgagtcccagtgattgaatgctggagagttgagtcccagtgattgaatgctggagagttgagtcccagtgattgaaatgctggagggttgagtcccgttgattggaatgttggtgggttgagtcccagtgattgaaatgctggagagttgagtcccgttgattggaatgttggtgggttgagtcccagtgattgaatgctggagagttgagtcccagtgattgaatgctggagagttgagtcccagtgattgaaatgctggagggttgagtcccgttgattggaatgttggtgggttgagtccccagtgattgaatgctggaagttgagtcccagtggggaggctggagagttgagtccc

SEQ ID NO: 21395 - DNA, 861 bp, Heterodera glycines
ctgggccccgccatctgggccccaagggccagtcacattttccacttcatattgtcaaaaaaattttgaataattctaagatatgacctgaaaaattaaaaaaatacatccctaagaattgaaaagtgttctcgagaactgatcgccaaaatttaatatttttttgataaaaaattttatgtttatattttctttattcgaaaaaatatataaaatatgtatagtcatttaaataaccaattaaatttttttttgattaagttttacgtgttttgttccctaaaaattagagttcagcgggaccgggaattttgggcaaaatcgggaccgcgacctaatcgggttgaaaaaccgggaatttcccaggtcaaagccgggaccttggtactcatttgtccgggttttggtccggtcccgctcaacactatactaaaaatcgctaataaaaaaaatttaactcgcctttttcatcgccttctcgggatttttgttcctttttcatgcattttttgcaatattttggtgcctattattttattaaaaattgctaatacaaaattcaatataatgataattacggctgggaattatatggatataaaatctcaaaatatggccataaaatatggaccaaaaatagcgaaatatggacataaaatgtcaaaaaatggacataaaaaagttgtggtaccatctaatttttgagtttaaaatacactactgtcttttaataatgtttgacaatatgagatggaaaatgggaccggcccagatggcggggcccagttaatctggggcccagtcggcggggcccagttggcggggcccagttggtggggcccagtcggcggggcccagtcg

SEQ ID NO: 21396 - DNA, 1411 bp, Heterodera glycines
aaaaggcaaaaaaggcgtaattaaaatcaacttatgtagaagcttcaaaccaagtggaaaatgtgttatctatgcttaatatgtctgaattaatgcgcagaaaaaggcatattcctcaaaattctttctctaataattaattattaattaaggaattgatggacccgagcaaaggcctttacaatgaaagtaaggacaaagtgacattagccatagatatttcgtagtaaaaaaagaatgaaatgactgaggaaagatggattaaattttttacagtcaaaattatttcatgtaattgtttattttgcagaataattggaaaaatataattattattaataattctttatttctacgagtctatttaatattttaggaaccctttttgattaaatttaaaatttcttcatttaaaaattttgcacttaattttttgtataaaattcttgtaacccatgtggattatcttatgaaatatagaaacactcaataatatatataattctggtattatcataaagaaaattgtatattgattataagttcatttatatctttatcattgatattacaacaaaaaatttattggtttataaaaatttgtattaaaatgacaatattgcaatttaatatcctttatttgtatatcacacatcatataaaaatgaatatatatttttacggcaaattttattgtatatgtttaaacaatattttaacttgaattttcgtatcattaacattattaaattattttagaagaattttcttctacatttaattttaaatatgatcattttccatttaattattaacttttttcagttaatttaagttaattttctgaatatactatcatctaagaaaatttttatagtagtaatatttgaacataattttattaagtggacagattttttgaatttttacagttaaaattatttcatgtagttgtttattttgcagaataattggaacaatataaattataactaataattatctttatttttacgagtcggtttaatatattaggaacctttttgattaattttaaaatgtcttcattgaaaattttgcacttaattttctgtataaaattcttgtaacccatgtagagtaagaacttatgaaatttaaataggtaacatagaataatatagataattcttatattatcataaaaagtgtatttattatagttcatttatatctttatcattgatattaaaacaaaaaatattgtttataaaaatttgtattaaatgacaatatgcaatttaatagaaattattcttataactggggttctttactgcttattatcattcttcttattatccttaatttaggtatatctgaaatttgtagtttaatttattttaatttagagtattttttttttgtaaat

SEQ ID NO: 21397 - DNA, 1161 bp, Heterodera glycines
aggattcggtctccccataaatctggggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcattagcaaaaatatgagtgatcgaatttcactaaaaaagtaagcctacattttttggcatattaaaaagcaattaaaaatttttaaatttaataattttctgcaccgaaagtactcactcgctctcctgggccggggggggggggggggggggcccccccccccccccccccccccccc

SEQ ID NO: 21398 - DNA, 1519 bp, Heterodera glycines
tctccttttcttctccatttttcctttctctctctctctcttttttctctctctctctaattcactactcctcctacagtctctcctccgtcccttttcttcgcccttcccattttgatgtctttccgttcagtttcgacttcccctccactgcttcttcctcttcctcttctgcttctcttcccacaatgcaaattcccgctgatcatttccaacaacaattcgtttccccaaattttgcgcaaaatccgccaaaattgtcctccatttatcagcaacaattcggcagttcacttagcaggtaaaaaagatgaaaaacgaactttgatgggcttttggtgccgaattagcatttgccatttcccccggggcattctttggccttatgtccactctccgccgtttgttcagttgtcccccgccggtcacttcttcgtccgtccatcagcagctcagcagtggcggcggttctggctttatcgcctcgtcgcatcccttcgcccaatcggccgccaatttaatgcgcgggttcaggtcgcttcataatttggctgatctgtgcctcgccccgtccgactgtcgccccaatttcagcattttctcgtccgactctcagcagttccccttcccggtgcctccccagtcgcttcagtctgtgatgagcggtgccccctctgcttctctcgctcgtcctacctccttcccagccgtactctcttccccgagttcgtccttcgttgcccaacatcaaagttccgcctcttcgtccggccaacccgccgtcatttcctcgtcctcgcccgattcaccgatcacttccaatcacccggcagggccaatggaagaggggcaaatgcacgaggagcccaaattatgtgccgtttgcagcgattacgcaatttggtaagtgggaggaatggaatgaaattgaggaggagggaagggagggcactccctgcaggaaagagtgccaacgaattggtcaccgttcgtccgttattccctcaacaatcattggcatttggttttagtcagcactatggcgcgttgacttgcgaaggctgcaaaggcttctttaagcggacagtacaaaagaagtcgcagtatgtgtgtggtgagtgtccaattgtctctttttctctcaccgtctctctttaagcgggcaacaaaaattgccaaattgacaaacgctatcgctccaggtcagttcttcgctcttttggtcgtttattactcaatcgcttggcagatgccaatattgtcgcttccaaaagtgtttggaggttggcatggtgcgcgagattgtccgttacggcagtctccagggacgccgggggcggttgccttccaaggtgaaaagttcgagcggagggattggcggcagcgccggcacggcgatgccaattggcatgggcggcggagtgcagcccgagccggcgccaagtccaccgctgcccattctgaccatcattgccaaggtgggtggcgcctgaactgtccgggtgatcagattttgaag

SEQ ID NO: 21399 - DNA, 2166 bp, Heterodera glycines
  misc_feature (33)..(33): n is a, c, g, or t
  misc_feature (2152)..(2152): n is a, c, g, or t
gcaggaagcagttcaggcaagttgatcaatttnaacattctaagtgagagattttttatttgccggtaaaaatcaaaaattaaaaatttttatggcccaaaaacatggtcagttttaaattgtaaaaatctatttttttaaattaagttggccatcgacttccgcacccattgtcaacgcgattatcccatccaaagctgtcgcgtcgcattctcttgccggttgggaattaatttaaattaataatttaccaattttttgtataaattttcaactactaatgcttcaaataaatttttactttaataatttattttaaatttagttaaaaaatatatgatttgaattgtcattaaaagtaatattttgtagatgttagcaatgttcaggacgcgtacattcgccgtatggaattgttttacgcagggtgagacagttcaaaagaattgtaaaaagataaattatgaaaattataaaaaaatatttttttaattttccatttaaattaacgcaataatttcataatttaagtcaaaagaaataaattcgtacctttttaaatttttttttgaaaaaattattaaaatatctacataattattcatatttccgtatttttatcaatttatttttatttcatattcttcgtctttaaattcaatattttttgcccatttagcaaattgctcaatcgaattttggacctccataaagccgaccaaagccccacgaccataacggagcagccaaaatctgagccgaccgaagaaattggtgttgatcagaatctgaacccggtagtacaagcgggattggcccatttcagtctggtgagccttatatgctttgctaaattttttcttttttgagggtccttttagcataattttttagtcttaaaatttttatttaaaaaaccgggacttgaatcccgtaattttattccgaaaaacacgatttaaactgattatttatttaatttaattgctaatttttctttattttttgcaattcgcataaaaattcaataataaaaaacttcggtttttatcattagaatttttaaaattttcaatctttaaatttccattttttgtccttaattgtttcacagttgacgcacggatttggtgggcattcggtgcaagcggtgcttgaaacaatgatcagagtgatcaacgagtgtaacgttgtgctcactcgcaaataccaatcgccgattaatgccgtcactgccgctggccaacaaaatgccgttctatcgatgccatttgatctcccgtaattccgactgaacgcattaaaaaagcataattaattatttttattgaatgatgaatgattattggagatatatgcagttttttgtatttctcttatttataaaatattgtgcatggcattagtgttactgtacatcacaattgttcatacggtagggttttcggcggagagaagttcatactcattctcttctaattgttttttctttattaaagcctaatatttaagaaatgtcagaaaacatttttatgtttttggttttcttatggcgagaagcccaaaaacagcattttcgcctaacaatttctgctttagagcgacttataaaaacataaaagcatatattttggcgcctttggcacataaagacaaatcgcacatatttggcatttttcaaaacaaaatctttaagaaatacacaggaaaacagaaaatacacccttaaaaagcaactttcttgccatttcttacagaattttcaaatttctttattatttcgaatgccgaaagtaactaaatcgaatgcttcattcgtctttagagtttgatgttccccgctggaaaaatacgagacgagacgatcaacatccttggtggttacctcaattgattcgaattcgtacattttgagtaatattcatttttagttcataattcatgcatttttaaagaaatataaaaattatattaataggattttaataattctactgatgaatagggatacgatttttaggtttttacctattttttttcctgagctccccgtggcctgaaacgcacgaaaaacatgtttttttgggctgttgttaagctacttttcaagtttttagcacctattttctaggtttttatttttagcacctanaaacctaaaaaaaa

SEQ ID NO: 21400 - DNA, 2110 bp, Heterodera glycines
  misc_feature (37)..(38): n is a, c, g, or t
  misc_feature (98)..(98): n is a, c, g, or t
  misc_feature (193)..(193): n is a, c, g, or t
attttttgattatgtttattttaatttgaaaaataannaaataaaagtttttaaaattttattttaaattttataaaatttttttacaaataaaaatntaatcataaatatttttacttttgaaattaattttattttcatttattgcaaatggcttttgctttttaaataaataatttttaataataaattntaaacgaataaataacgaaattaaatgcaatttaattaattaattaaaaattgaaatataatttatttcttaaaaattaattttcttattattataaaaaaaaacaaaaaccaagaatagtttcatatctttacaggttcgaatgaattaaatcggccaattagcatctaattaatttgcctaattaatcaattaattgcccattcgtgctaatgagttaattagcggcggcacttacggcgcgtacaccgcctccacaaaggccttcagcggtgtggtgatgtccgcaaagtcctccaccactttatcggtcagcacgcgcttcatgatgtccgccagctcgcgcagcttgtcgcgcaactgttgccgcgcgttgtacgcctcgggcgaattgccgagtccacgacgctccaaatctgttttttgaaatgaaatgccaatatagagattaaaagctaaatttctaaaaaaaaattaaaaaaaaatggaaaaagtcgaaaaagtgcaatgccaaatttaaaatttacagccatattttgctcattattagcttctatttggcgcctgttatccctttaaaatgggtgtgtacttttgatggaaaaagttaataaaaaaaaggagaaaaatttaaaaaaatatttgtggacaggcaaagtcaatagagcgagggcacatctaaaatccttgaaaattttcaaggattcaaacccaatgaatgatacattctcgagtcatatatgcaaggacgtccttgagatcaatgactttgtgaactgccaagaacaggagttttgcgtgggccgccacagatttcaaaataaaactgattgagtattttgaattcccaagaataggaggggggagttgattttaaggactgtccttggcactcaagggcagagcggagtgagtgccgccgagtcatgatgctgattgacactattgatcacggaacccgtcagttgggccccggcacgtttgggccccagcggttttttggttataacttttttttctttgtcatccaaatcaaacattgttggtatcattcgaaagctgtaagtgtcctctattagcctgcaaaattttgaaaaattatgttaaggttcaaaacaattatggccagaacaactcaaaaaaccagattttccaacttttatggccataaatttgttcaaaattgacacaattttttgaaaatttgcaggctaatagagcatctgaagggctttcgaatgataccaatgatgtttgatttggatgacaaagaaaaaagttatagtccaaaaacctgctgacgcccaactgacgtagaccgccccctcactctctcattttcccatattttcaccaacttttatctcaattgaaacagatgattttttgtttaattctgtctcattgtcaggcatgagcattccccgttggtgtccacgtggagcactcggcgcggaacacgcggcgcccatttggtcagtgatccattcgatgacaaaaataaattggggagcaggtcgtttccccccccccccgtcgtgcgtttcattttgggcaacggcactttttattttatatacaaaacgcaatagtgcacctattagggctatatgagagtcgaaattttcagagactcgggaacccgagacagaccgggaattgacaccgccgacgagagtcgagactcgaaaaacccgagaaatttctcgattcgagagttcgagaccgagaatcttgagcagggtgcactacgtttcccccccgccgtttcccccccgccggttcccccccgccgtttcccccccgtatcagttcccccccagctcggttcccccccgcatcgtttcccccccgagaaaatttaaaaaaaaaaaatagctaacttagaaatttttcaagaaaaaaatcttagaaagt

SEQ ID NO: 21401 - DNA, 2087 bp, Heterodera glycines
  misc_feature (11)..(12): n is a, c, g, or t
  misc_feature (68)..(68): n is a, c, g, or t
  misc_feature (1919)..(1919): n is a, c, g, or t
  misc_feature (1991)..(1991): n is a, c, g, or t
atgacaaaatnnttttaatgaaattgggaaaatttcaaactatttacactttttaaatccctggcggngtctggcggcactctctgcgaatttaaaaaaatatattttcgcatgataagagtagcattttgcgtgcatgcaaagactataattgattctgttgtcattcactttgtgataagaaagggggaagcaaatgaatgaatgataaaatggcacataaaacggacaattctctccgtttcctccccccaccccaagaaaatgcacaagggcagtttagtgccactttttggcaaaaatttgcgacaaaattcgtggagagcgtttggggagaagagcccactgaaaaggtggcgattaaacaaattaagtgccttcaaatggcttattagttttctcttctccaaatcgcttcccctcgtccttctgctgatcattttgctgctttacttccaatttcctctgaatcttttcggcccgagcgatggcaccgattttgggcgaattatttccaatggcactttcctcgccaaatttgttgattttcaaaaacggtattttatgagcaaaaggcaaactttcctttccagtttttcaaaaaattattcaaccatcgaagaaaagctgaggcgtttttcaatttttgttgccaatttcgaacaattggaaaagatcggaagggaaggcgaagtgtacggaattacgacatttttcgattggagcgacgaagaattgaaagaagtgatcactgatcagacacaaggaacttactgatcggctccattttcagttgataatgccacatgaatactttgaaagcgttcccttttcttgggctaagccaatccgcgaatttcgtccgatggatgcgaattttaagcggccgagcgaattcgattggcgcaaaaagggagtggtcaatcacgtgaagaatcagagtgagtggacgaagtgatcggagaaaaggccaaaaatgaaaagggatttgcttaagtgcgttgcggcgcgtgttgggcttttgccacggcagcagtggtcgagtcacagcacgcaattcacaacggaacactgctcactctgtcggaacaggtcactgactccaaacgaaagtgatcagccgaggccgaaacaaagggaataaatccgacagaatttagtgggatttgcaatttcatagaaatcaaaagccagaaataattctgcttgattttgcgtattgatcagattgctttgctgttgatcaactgtttgtttagcaaatgatcgattgcgaccaatcgaacaacggatgcgaaggagggaacagaccaaacgcatttcggtcggtgctccctttgatgccattcattgtctgtctttcacttcccttcctcatttgtcagctacgttcgtgataatggccttctccgtgaagataattaccctgtctctcgccccccctcccaatttgccacttttgtcctttcatttgccttttgaagtaccgcggtgccgatggtaactgcgaattgtcgccgggccccgtggacccaacgcaacggacattcgtcgacgaagtgcgaactttgccgagcgacgagcagcaaattgcggattttgttgtggagaaagggcccgtttcatttggtagacgaacagcaaaaagaaagggaccaatgggaaaggaactctttgaggaatgaatgtgaccaaaacaatgtttcattatgtggggggcattttctcgccaactgccgacgaatgccaattccattcgatgggtcggcatgccatggaagtggtcggatttggagaggacgaaaagagtggcggaacacccttctggatcatgaagaacagttggggcagttcgtggggcatcaacgggggatatatgcacattcggaggtcggcagaagagggagtgatcgggaggngagggggggggagtgatcggaaagcggtcgtcgtagaagtgatcgctgctttgtcacgacttcttttcaggngggtcgatgcgtgcggactttcgcgggaagtacacacggctctgattacgcgatactgatcaaaaaagtctatccgaattgatcagtatttccatt

SEQ ID NO: 21402 - DNA, 809 bp, Heterodera glycines
aacggattaaaggtgacaaagacaaggccaacagctatcacaaagagttccaaacttttcgggaggatgtccatgatttgttctacgataagggcgggtggttcgactacgacctgaaaaatcaaaaactgatcaatcgcttctacggaagcattgttgtgccactgttcgcgagatgctatcacacggccgacgtggaggagacggaaaaaatgttaacccaattggaagagttcgacaagaaaaaccaaataatgagccagaaatttggggtgccgacgaggtaaataaatggcaaattgaactaaaaaaagaaaaagaattgtttcagcgcaattgcttcggggcagcagtgggatttccccaatatttggccggtaaaggcggaaagcgtcgtttattacaattaaatgaattcactgttcttaagccattggcacatatgctcatcgaaggattgcgccgttcggggatcaaacggtaggtacagtaagacaaaggcatttctttgcaatgccatcgacagaatggaagacaaagccagggatttggcacagcaatatgtgtcagccaaccacaaattgttcaatcagtgtggaaagcatatgtttgagaaaacgacagcggacgaaggcgcccccggaaaaggcggggaatacaccgtacaggtgagcaaagaaacaattaatcgcttcaaagcccattctgacaaattgttttctgctaagagataattaattttataaaaataacaaaaactaattaaaaacataaaataatttaccaataatccaattttggttattttt

SEQ ID NO: 21403 - DNA, 878 bp, Heterodera glycines
  misc_feature (837)..(837): n is a, c, g, or t
tatggttttagccctaaaaagttaaaaaacgatgtcgcgggtgtcttaaaactagaggccggtaaaaaaatttcctggagcagaagcgggagttaaatattttccgggacgggagtcccgaatcggaatccgtaaaaatcccgctaccgtaaaaatcccgttcaccaaaaagaagcgggagcgggaccagggaatccaataaaaatcccgcgggagtcccgatcccgccaatctctacttaaaaccctgagaatcaaaattcaaatttggataagaatcctaaaccgtaaaaattgtcaaacaaaatttaaaaaaatatattaagccttaactaatttacctacattaaatatggtatcatggaaaaatttattagattcaggcctggacctgattttaaaatttggtttataatgaaagaatgagattttttaaaaagaaatacacgtatttattgagtgtttttcttttcaatttttggcaaaaatttatgcaaatataagggcctgctggatccaggttaaacgaaaataatttcagcttttaaaattagaatgaattcatgtcaactctttttgctctatttttggactttcgtaataactatcctgtccaattaggtaattagttaattaattaccgctttaaatgcgtctatttttgatgtcaactcctgctcactgaattcgagctcacaatgaaacattcgcggcgaactgtccggacgagggggcgagcacagtaaccatttggcccacgcttggcaatccgtcgccgtggcactgtcgtcggccggaaaggtgggaaactgttcataggaagacactgaatgaaggntttgggcatcgcgcagaatggacgaggaacattgacgaaaa

SEQ ID NO: 21404 - DNA, 2192 bp, Heterodera glycines
aagttttccgtccattggccctgtcggaaatatgttttcaagacttttgatagaaactatattttaaaaattcggcacctaaacctgctaaagttgccaaaatcattgaaaaaaaattaaaattttatttaatctcatacatattatagatttatgttcaaagataaaaaataaatccgtttttttttgataaatttctacatttttacctggctgttgctgcaacaattttcgcccatgaaaactctgaccggtttcattaatttggataacagtgtttttgtgaatgtttctgtctggcaatttttggagctgatcaatttgatcagcactgatcactaattctgtgtcacaatatgaatgatcaccatcatcaccatccgtttcacattcactgatattctaacaaaaaaataataattataactttctaattataaagtaaaaaaaaattatttaaatcacaaacggtcccgatttaagacacttattttaccctctattcttgagtgtcggaaaattcattaaaaattctattttaaaaaatgaaaaatttgtattaaacttaccctaaattaggagaatttggatatctatgcttatatacatttattttatttttgcctatccaataaaattataaaaaaatgttttaattaaatgaatgaattattccaacttgatggcccaattgttgtattgtttctttgtcaccgtccaaattggcccaaatcgacacattcggcatgttcttattcatcgccatttgttccacaatgaattcacacttttgcccgatgccattattgtccatgggttggcatgacacaaattgttgctcaattggcacaaaatgattgtcatagcctttatttgattaaattttaaataatttgcatttaaaaaaatgatgaaaaaatacttacggagcatcacatttgttggcacatgtgtatgtggcacgaacaaacggatcagcataaacacataaaaccttgaattataattttgagctttttttaataatttattcaaacccaaaaaattagaaataattttcgaaaacataaaaatttaattattttcgagagtctcgtgatatttttgggattgtccattctgtccgatggaataataagttaatacaaaaatttctatcgtttttttatgaattttcaaaattttcgtccacttacattgccattcccaatttgcttttcttttcacccaaatctttgcttttcactccactcttaagcttttgttgcagtttcattttgcttccaactttcacaccttttttattcgggttttgccgtctaaaataattaaatttattttttaaataattttttaatgttttttatttttacattttcggctgagctgcgtttaccggtgttggttgatgttgattttctaaattaaaaataatttatttatgaataaataaattcaattttccgaaggctttaccttctgccgatggattgagcctgagattgttaagtgaatgggcgacattcgtcaccaggttgatgctcggattttgttgctgaattggtggcccaccaccattagtcatagaaagcgaatttgacccaccacggaccatttcgccaactaaattaaaaaaaaattaaaaattcactttaaaaagctaaccatttattaagttggcgaacaagacaagcggtagaacagaagcgaaaagttgtccaatcatttcttctgttttagttaaaatagtttctaatttggttaaaaacagcactcattttaggaaatcatttaagcatataatacagagattttttatcagcagtcaaaaaatcccgttttcgaggcctcataaaatccccctgggttttcggttatgggaaaaactttaaaaatttacaataggaatcagcttcgctccatccgatggtgtctaatttaaattcttattttctatctaacaactgtttggaatgattcccttgtcaaatgcgtaaagctgaatctcgactctggtcggaaattcgggattttcccggattagtcccaatttaatatttttttaattttcggagcaatttactaataaacatacgatatattctctaattatcgcccagtctctattaatcccgtagtctccaattatcccccccctttctgaggaggttgaaaaataatccccccagtct

SEQ ID NO: 21405 - DNA, 1813 bp, Heterodera glycines
  misc_feature (10)..(11): n is a, c, g, or t
  misc_feature (1707)..(1707): n is a, c, g, or t
  misc_feature (1723)..(1723): n is a, c, g, or t
  misc_feature (1767)..(1768): n is a, c, g, or t
acttaaacanngaggaataatcgagagcatgatttttggcatctccttcgccaatctcctccaagtgattgcggtcgagggtacgtcgggcagtgtggtcgagaaggactttcagtcaccgttgttccacaaaatagtagctcgagaggtggacgtgctggacgttgagattcgtacgctcacaggacggtagtgttgtgattttcaaaatattttccttctttaatttaagagaggtgccttttaaatttggccaagttgtgctgactcttcagtttaaaaaagtcgtaactttctgatacaatggtccgagttatattcaacgggtcgaacttgcggttggagaattatcatcagcagggtggaagtatttcgtactttgagggagccccaacctttcagcgtggctatggctacttccttggaattccacggcataaggaagcgggggtgggagccgtactgcggaacctttggcgttatctccgccccatgatcgctgcggcgaagcctacgtaacaacatatcagctgcgacggcaagtactcagcggcacatatcccgcagatgggtgccaaggtgttcaagatttccgtgcagtctgattgttaacctggtatgcttattttttgcttcattcgctcatcgtatttccattcaggaccctgcaggtatgccgggaactcattggtgtgcgatatgggcacagtctcctgctgttgcctacttctttgactcttatggagagatgcctatcagcttgatcaaaaaatatttatccgataattttaaaaagatttactataataagaggcggtttcaatcggtgttgtccaatgtttgtggtcactatgtaattactttcgtttattttatgtccgtcggattgtgtttcgaaaatattatgcaaattttgaatcgttcaaataaccctgatggatttgtttatcggtttgtaacaaagagcatagaataaatattaacgaaattagtcttcatcagatgtgtcatcctcataaggcatggaaacaaaaaaaagtaaaggcccaattccgaataaattcagcaaatccatttagtccatcatatttttcataatattcgttgaccactttttggctcgtgccgtcctcttgccttaagaaacccttcacctaaaatagcaataaaatatgaaacatattttccattaacctcaatacagtcttcagcatcgaaaatgtagagtcgattcaacgatgtcagcgtgcgaatcatcatacatccgcttacacgatagtcacgatggctactgtatgctggagttagtgttgtaaaacgaaagaaacatacccaaggtttggtagtggcgtaatacagccaaattcacgagcaacttcctcaaggattggcacacattcgatgagtcggaattcggtgttggatgtgacggtcatttttttcaataaaaatcgtaaaataagattgaggaaaattaaagtatgaaatatttgtacagtaaacagtacgcgaaataattgaacatttcaaagcactttatgaatcaacactgaagaaacacatgacattgttacggaggaagttatagaattcatcaattcccttttctttgtcgaagtagatagtctcaacgcttaggacgtatccaaactgcttgacaattcccttgaactcaatttggtctccttcttcgctgatgtagatganacgcggcttgtcctgntgctcgaaaacgtaacgcttctgctcctcctcgtacggcaccgnnaaattttgcagtcgaacataacccgcaccagatcaaatgctgtgc

SEQ ID NO: 21406 - DNA, 1559 bp, Heterodera glycines
aaagttcatggtttctaaagaccaaattttaaaggcatattaccaaaagccaattctcgcaatggacgacgtgaaagggcggcgccgctttggcataatgcccgctgaacaccaattggccgctgactgaatcgaccaaatgcaaccgcagcagagagagggacgggtcggcactcaaaacggccaccaaattcgggttgttgtatttgtacagaaccgaacgattgcccaacactttgccacggctgtgcattttttctgatgtgaataaaatttgagatagaaaatgaataaatctttctaatgtgtagactttggttcaccattagcagactttcccacaatggcataaatggactcggagtcactccatggcaattgcgtcatccattgttcggataatcgagcatttccatcggcagaaaattcaaccttatggccgagctaaaaaacacaaaaaaatgattcagcgtttttaaaaagtgtaaataaaagtaaaataggctgaatatttattaatacattttatgaaaacgggatttgcgtggctagagaaaagtattgtatataattaaatccaaccaaggtgcccttttcgtgcccaacattgaacaaataagtctgtttaagaggctcggaatttggcatagattttggcaaaaattccacaactgttgggtcagaattcttgaaaatcagcaggggatggagttgttctgagttgggaaaaggccaaagttcaatccgaaaaagcccgccagggatctgaaaaaagagaaattcagaaataacagtgaaaataaaaataatacaattccaatttcttatgatcagaaaaaaggtaaaaatactaacccgaacccgttcaatttgagtgccggtgattgggttgaaaaacaaaacaacagaatcagccgaatcctaaaaaacaaaaaaaattgattttattcgctgcgatttcaaaccaacctttgcattgaatacggcggccgcctgactcggccattggtaaaatgccgtgccccgttggatgagcaacggcactttcccttcccttgctgcctcaacagaatggcgttcgttgtgataaggcgcaaagtcattgcccaaatacaacgaccaaagcaagtggccattctcattggaaatgccgaagagagtgccttaagacaaaccactttcatatggtcgaaggattgtaagaaaaacgacctggaagagtgctgacaacgatcactttgcgcatgttgaagcagtccctctccaatcgtccgtcgcttaacattccctccggcgcagggccaaggccgaaaagttggccgaaaagggcggagaagcgaaagtcaccgttgatgaacatttccaacgtttgtacgaagcgattggcagtggtgaagaaaaagcgatgcaattgttcgatttgactgcgaatgcgcagcaaaaaggaaagccaaacggactctgaaaaaagggggagacaattgaatggaaatcgacaaaaactattaacaagttaaaagcaacaaactcaaattttgtgactgacccaaatttgtaaa

SEQ ID NO: 21407 - DNA, 2397 bp, Heterodera glycines
  misc_feature (14)..(14): n is a, c, g, or t
atttttctaaaaanttatcgtgacttcaatcccgcgggatcccgcgggattggtaaaatggtcgggagggatcccggttcgggatccagatgaaatcccgatcccgatcaatcccgatgaatttaaaaaatccttcgggacggatcccgaggtcgggatcccgaatttaatcccgcgggatcccgatcccgtccggtctctagtaaatatttactgggttggcacttttgctatacatttactctcgcttctcccaccgatcgattttgcatagatcatttttctgtgaaaaagcccaaaaaaaatcctgaccaagtccgaatcattctctggacctagtccaatctcaaatgtccatctaatttattaaatattattgtgattgaccaaggtgattgcgtggcaacggcataaattggacagcctttggaattttgtagggtgccaatgtttgacggaaggcactcttctcatcgtccgtcaattggtgcgcaacgccgctgagcttttctgcgaaggcatcggaaggttcgcagacggcgacgaccgcctcgccaaagtcggggtgcggaacaccttttaagaaagagaatgccaacgacagaattcggaaatacggcataattagtaaaatgaaaataaaaaaatgattttactcatttaaattggcatttagaaaacaaatgtactttttctgagttagtaaaaagctaaggaaattaataaatttggatttaaatttaaaaaagaatttttacgaaattaataataatttatttctcaccaataattgcgcattctttcagcttttcgccgaaaatgttggtcaccacgtcatccacttccggcgggtaaacattcagtccccccgtaatgatcaaatccttttggcgccctttgatccaaacgaagcctaattaaaaaagcaaacaaacaattaagttttataattacacgaacaaatcatttatgggagcagaaaaagtcaacagaaatttatactttaaaatccataaacaaatttttttttaaattttccaaatgacaaaggcattttaaataaaaaaaattcaagaacttttacgaattttatttaatattttctcctcatacagtaaataagttcatttcttcctccatcactcattaattcaaaaagaataaaatttaataaaataataaataaatttcaccgttttggtcaatttcgcccatgtcgccggtgatgaagaagccgtccgctgtgaattcctgcttggtcttctccggcaggttcagatacctacccgttgaacagactcggactcttcagctcaatgactccggggggggggggcgtcgtgtggaaatacaaacaaagaaagtgtgctaggcagggctgcacgcaattacggattgcggattacggaaattacggggttttgggagttacggattacgggttacggatttttgggatttttccgtaattttgatccgtaatttgacttttggattattttttcgagacgatttcttgtacgattatttttataaaaaacaaatttttctattttttatttaaagggctacccgtatttcgatttatttaagaattaaaatagatttataattttttatttgttgttgttaaggctatttgggtagttcgcctagaaaatagaggcatcacttttttgtcacacctatttttcacgcattttatgaaaattcataaaaccttagccaggtgaggggaggaattccccccttcccccgcccgaaatgaaaaattaaaaatttttacaggaaaaattgggacttttaaatttttttgtcgatttttcttaataaaatcattaaaattaaaaaaaaaatttgcccggcggcacctatcggcaccgccggaccacgatttactcgattttaccttatttttttaaattttgactacaaaatggcaaaaattagtctttttttggctagaaatggttacaattcctgtttttgctgtccagcgctgaacttttttaaataacactaaataaattttaccaaaaaaaattcttcggattcccccccccccctccgtaatttttttctggctattaaaatgttgaaataattatatacatatacataaatccgattataatgatcagactttcaaaaaattttcaaaaatcaacccataaattcaaaaagaatgatttaatcagacacaaaattataaattatttgtaaaatttaaataaaaaatgaagaaactccatcaagaaaatcagttttttgatttttattaatcactatttaaaaatttttttctaaaattctgttaaaaattgatttttaaaaattacggattacggattacgggaaattacggggtttttggacccccgtaattacggattacgg

SEQ ID NO: 21408 - DNA, 1100 bp, Heterodera glycines
  misc_feature (21)..(21): n is a, c, g, or t
ctgaggcccgaaggaaaattngagagggctaatttatatgtaatattcgaaagtgccaagctaattagcgattcaggcgcacattggggcctgaattaagccattttccctttgatcggtacaaaattgggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaaagagatagccattttctgaggcccgaaggaaaatttgagagggctaatttatatgtaatattcgaaagtgccaagctaattagcgattcaggcgcacattggggcctgaattaagccattttccctttgatcggtacaaaattggccgaaaagagatagccattttctgaggcccgagggaaaattgagagggctaattata

SEQ ID NO: 21409 - DNA, 934 bp, Heterodera glycines
ttattttggcatttttttagcatttttactatttgtctttttttttggaaaaaatggtttgataaataaaaattccacccttagaaaggggggggataattggggacggcgggattaatggagacggggggataaaaagagaaaatacggtataggcatttgaaaatgtatattaaaagtaccccgtaaactgcacaatttcaaaaaaaaattatttgttaagttttttttgaaatttttttgaaaaacagtaatttatcattaaatttcaaaaaaattgcttaaaaattctcaaaaaatttttctttaaatttttccttattaaaaattttctaagaattttttccttgaaaaattattatgtttgaaaaaaaaatttttttgaaatttctgcggcgagattccggcggcgagattttgtcccgtccccaattgtatgcccccctgcaaaaaatgccccttcatttacatttttgaggcgtccataaacgcggcaaacgacatctgttggacaaaaaacccgggttgttgcacgtgtgcaacatctgtgagcaggtgttcgacgccaaggccatcgcttcgcactgtgccgtccaccatttgccggacaaaggcgctcagttggcactgccctacgggtgccggttcagcgccggcgtcaaatgccaattcaggtgaacttcgggggtatggtaattggtaatggtattgaaactctttttcgttttcgaatccatttaaatccttttttgattgttgtatttggctgggaaagaaaagttatagccaaaagcttgtgctagtacgaaaacggcctggtccacctctttgcaaacgactggcttatcatcaaccaacttataagcattggactcataaaatcaagaacatcgcatcttttgcaaattgggaaatttttgttagaaaatcataa

SEQ ID NO: 21410 - DNA, 1484 bp, Heterodera glycines
aaaattttaaaaatttatttcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaacttttaaaatatacgcctaaactttttggcctgtttaaaaaggaattaaaaatttttaaaaattttattcatctcccttttgatagaaaaagcatcagagtgccttaattaattttttttaaataaaaaaatttgactagaccaatcgaaagctaacggtcgacctaatggaaaaaaatccccgaaggagagaatttaattaattccattccttcgggggtccgtgccgggtgccgcggggtaagcagtgctggtttcgtttcatcacggcccccatccttttgactagtcagccagcgttgcttaacttgtcagatcggacgggtacgcatgattccaattttccaagcaccccaccgaaagtagaacgaaataaccaaaatataaggaaaatattttaaaaagatgttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaagttcgatgaaactttttaaaatataagcctaaactttttggcttatttaaaaagcaattaaaattttttaaaaattttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcatttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaaattttattcatctcccttttgatagaaaaagcatcagagagccttatttaacttttaattaacatttggtgcgtttcagagcagtttctgaaaaaatatttatgaattgattttgctaaaaaaataaa

SEQ ID NO: 21411 - DNA, 1163 bp, Heterodera glycines
  misc_feature (1097)..(1097): n is a, c, g, or t
tttttatccaaaaaattttttttgggtttccggggcagtccccctgaacggatgcgcccagatttatggggagaccgatcttttcggaatagcttcactatagcctgtactttaattctgcgttggattttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttttttgttttcggggcagtccccccgaaccgatgcgcccagatttatggggagaccgatccttcggggatagcttccctatagcctgtactttaatctgcngtggatttttgctccccataaatgtttgagtaccccaaacggacactagagaaaatcgattttttt

SEQ ID NO: 21412 - DNA, 586 bp, Heterodera glycines
agtataagggaattgaaccagcaaagaaaaaaagaaaacctatagcacaaccaatgcgccaacaagggagttgaaggtcattcttctctattgcatttattgggataaaaaaaagtttggcacgccatatctcggcactcatgctcatttggcaaaactggttaaaatttcacaatagaaactaggggtgatctacccacacaccaagtttcattttgaaatcccacggtcacttgccgacccctcctttgtaagtcattttttaacatgatatgacgacttatataattcgttttcttcttttcttacagcagaagaaaattttaattatggtggggcaccttattaagaaataaaataactcttattcaataaatacggtatttattattttcattagttttaacacagttttgttagattatttctcaatttcataatattaaaaagaactttatgcgcacattcaaaaaattatataaataattaatttatatcaattttctcaattgattaattgataacattaccaattctaatcttccaagcctttcgtaccatgtcgatatttgaatggatttatctg

SEQ ID NO: 21413 - DNA, 1088 bp, Heterodera glycines
  misc_feature (201)..(201): n is a, c, g, or t
  misc_feature (221)..(221): n is a, c, g, or t
tttttaaaaattaaaaaaattgttcttaatcaaaaagatttaagtcttttattttttacttttaattttatggagttttcacaagattttcataattcattcctaacaaatgaaaaattcatctccaaaattattttattattttcttgaccaagaattttaaacatttttgtgattttgaggggttataacgtatatttnggcagtttttgtccatgttntgtaccatattttgagtttttagtccaaattttatgtccacatttagtgttttttagtccatataattcacaaccctatatataagcaaaaaattttttaaaattttttcccatccctaaaaattttcaaaaaaattttctaaatattcgagtttgagttattgtaaagaaaatgacatataattatccaaaatgaaaggcaaattaaaattttggtgatttttaaacactggcgccaaaaaaccattacgggcgctaaaacggccgctccaaaaaagcggcaccaaaaaccggcgccagtggccgcgccaaactgacgccgacccgatgagacgcccacccaattgattcatttggtttttctgcccgtggtcaaccgaagaagaggcagaagagagaatggcagcaacagtgcccaattgattcacccattcatttcctcttctcctcagaaaattcatttgtgcattttcccagtggcgcctaacgacaccgctggacccccagccttcatggcgtccgcttcaataccttcgttacacatattttccaaaaattttgctaatttttgaaaaattagcattgtaaaatcaattaaaatatagctaaaataaaatatggaaaattgaataaataagtaaataaattataaaaatgcaataacaacatttgcaaatatttaaaatagggttcggaccccgtccccggggacgggacaggttttatggccttacccccgcccccgccccaaatatacccttaagaatggcatattcgttgataaaaggaaaaattttttaaccatctttgacaaatttttatgaaataaagaaatttgttttattttttaaatatatttgtggatta

SEQ ID NO: 21414 - DNA, 1388 bp, Heterodera glycines
cagaatgtgatcggggtacaaaaaattcgggttcaaaaatgggtgtaaattcccttggagatgcgttagaaaagaaagaaaaatattgttcggacaacttttgaagagctgcattgaatgctgccgtccccgctgctgtacgcccccgcgttgctgagttagggtcgagagcggcatgaaaaaagacaaaaaggagggaaatggaacaaattcgcggctttgccctcgcgttggagaaagcaatgcgcagaataactggggagacttagggttagcgcatcaattatttttttcagaatgtgatcggggtacaaaaaatacgggtccaaaaatgggtgtaaatccgcttggagatgcgttagaaaagaaagaaaaatatgttcggacagcttttgaagagctgcattgaatgctgcagttgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaaatacgggtccaaaagtgggtgtaactccgcttggagatgcgttagaaaagaaagaaaaatatgttcggacagcttttgaagagctgcattgaatgctgcagtcgccgctgctgtacgcccacccgttgctgagttagggtcgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaatacgggtccaaaagtgggtgtaactccgcttggagatgcgttagaaaagaaagaaaaatatgttcggacagcttttgaagagctgcattgaatgctgcagtcgccgctgctgtacgcccacccgttgctgagttagggccgagagcggcatgaaaaaagacaaaaaggaggaaaatgaaacaaattcgcggctttgccctcgcgttggagaaagcaatgcgcagaataactggggagacttagggttagcgcatcaattatttttttcagaatgtgatcggggtacaaaaatacgggtccaaaagtgggtgtaactccgcttggagatgcgttaaaaaaaaagaaaaatatgttcggacagcttttgagagttgcattgaatgttggcatccccgctgctggacccccccccgttcctgagtttaggggcgagaacgggcttggaaaaaaaaaaaaaggaggaaaaatgaaaaaaattcccggcttt

SEQ ID NO: 21415 - DNA, 1129 bp, Heterodera glycines
tcgaaagactcatttgggtatgcaaaaaaaccacatttttcgataaagagcctcattttacaaatttattcaaaatacgtttaaaaatggtcaaaagttatatttttgttgtccatctgcatgggtacccccacccccgcccacgggcgacaacctttttttgcttttaacataccacttttttgcggcgctttttccaaaaaacttttatgtggtgtctattttcattattgcattttctcatcgctttccttgccgttgggaagaggtcattttgagcacattaattaatgcccttcattcaaatgatgcggcgatcggcaatgggcacggcaaaatgaatagcgagctgtactttttcctttttactccctctgtccaccaaatgaccagcaattgtacaaaaaattttgttttaaaccaatgtcttggtcatatatttttcattccactccaatttattctggggctgttaggtcattgtcgaatatttcactattttgacatttattagtagtgtttaatcagggtagccagattaaaatcttcgaaagactcatttggcatgcaaaaaaaccacatttttggtcaaaaagcctcattttacaaatttattcaaaatacgtttaaaaatgttcaaaagttatatttttgttgtccatctgcatgggtacccccacccccgcccacgggcgacaacctttttttgcttttaacataccacttttttgcggcgctttttccaaaaaacttttatgtggtgtctattttcattattgcattttctcatcgctttccttgccgttgggaagaggtcattttgagcacattaattaatgcccttcattcaaatgatgcggcgatcggcaatgggcacggcaaaatgaatagcgagctgtactttttcctttttactccctctgtccaccaaatgaccagcaattgtacaaaaaattttgttttaaaccaatgtcttggtcatatatttttcattccactccaatttattctggggctgttaggtcattgtcgaatatttcactattttgacatttattagtagtgtttaatcagggtagccagattaaaatcttcgaaagacccatttggcatgcaaaaaaccacattt

SEQ ID NO: 21416 - DNA, 1080 bp, Heterodera glycines
ttaataaagtggaggcgttccgcgggggggggggaaaatcttcacaaaatttggatgggatttgcgaaagaaaattggtttatctttaattgattttattgtaaatttatttagtttggcattctgtcttttgtattttcaaaaacaatacaattcggatcccgcaaatcgcgcaggttccaaaaaaatacgggattgcggactaggaccccgcaaaaccccgtgtctggatcccgtcccctcgccggtccctaattttcactctttcggaccgagactttactgagaccgaaaaacccgagacttttcaaaaatttttgcttaaaaatcatttatttttttcgagtcttttcttaaccatttttttttaaattcaattaacccgagacttttcaaaaatttttgcttaaaaatcatttatttttttcgagtcttttcttaaccattttttttaaaattcaattaggtacatattataactccaaaaacacaaaacaagaaatttgtaagttttttctctccataaattgaatttttcactgccgtattggtgcgccggtggcccctatcatggctcggcgatttttttaaattctttttgtgaagggaattttgggggttcggtggtgccgttagcgtcgccggggaaaattttgaaaatttgaacgtactgaataggttttcaccaaaaagtgacaaaattttcgattttgatcatgtctttaagaaaaaatttggggttttaggcgtcgccgggtgaaaaaagtgcaaatcaaattttattaaatttaaaaagttaccaaaaatgtgttaaatttaagtttatcaaaagccaatcattagggaagtaaaaaaatctcttttcggtctcgagtctcgaaaatcgagaccgagactgaaaataccgagagcgagaccgagaccaaaaaaaacccgagacttttctagagccgacaccgagactctcgagcatcagccccggcttttaccatttacgggattttatgaatactttcattcctgctcaatggatttaaatttctccccatcccttgttttgaaagaaatttataaatttcg

SEQ ID NO: 21417 - DNA, 1418 bp, Heterodera glycines
ttcccctttatgttatccaaatgattaattgtcctcgtacttttaaatcgtttattgagaaaacgaaatacaatcaatgatcgtctggtttgaatgtgtctcatcgaattggtccccagcgatgtttcccgacagaaacacaaacaaattaaaggtgtacgagacgattgatgggatggagaccaagaaaacgcaatacaaatattctcagtatctgctcaaaagaacacggaaaagcaaataaaaaattatagaatacataaaatcaatcgaatccacgggaaaaatggtcggtgaatgaatggatgggtggagaggagataatttaaatgaacgaaggaaatgaaaagatcgatgcagtgacggtgttgagggctgtgccgaagcgattatttcgtcgtcatcatcgttacgaattcttaaaagggcaacttcacaattcgtttgtaatcacaaaggatacgatatttcattagtacggtttgctaaagaccatttgttcttattttcttattgcccttttttaattccaatctcccagggtgtagctaaaaagagagaaaaattttatataaaaggaggaggaagaccccaatacaaccaccttacacaactagcccatgataatgctaccataaacactgaccttcgtagttgacttgcccatccccgtcaatgtccgcttccctgatcctaaacaaccattcaaactcagtcctcccctttccgcccttccattcgcttacatttcgtccacttcttcgtctgtcagtttctctcctaaatttgtcatcacgtgacgcagttcggccgcagagatgaagccattgccgtctttgtcgaacacctcgaaatttataatcaatatctaatttcattttacattttgtgttactctgaatgcctcccgaatctcttcttcgctgtccgtgtccttcattttgcgtgccatcattgtgaggaattcgggaaagtcaatggtcccgtttcctgaatgtttgccgatacattacgcttattcaaagccttttaggaccgtctgcatccacttcgttgatcatgtcctgcaactccgcctccgtggggttttgacccagcgaccgcatgaccgtgcccaattccttggtggtaattgtgccatccccgtccttatcgaacagcgagaaagcctctttgaactctgaaaaggataaaagcatacatccagtagtgtaaatatggggcaaagcaaacacatttagctaagccattaccaaacgaaaaaagaagggatctgatggacctgtcgtaataatttcgatggggcgatacgaacaaaatccaaattaccaaatgaaaaaatggaggggggtaattccaatgaaactcggattaaagtatgcaagactaaatggtaaaaccaaatttaaattgcaaat

SEQ ID NO: 21418 - DNA, 629 bp, Heterodera glycines
acatgacacccctccaccctcccccccccccgcgtccgcaattgcattgcgcacaaaaagattattcgcctaagcagcaaggcgttgttatgttgttgtcgttgacggaaacattctcagccggtgtgtttgtccgtcatcggcggggaaaataatcccccccccccccgctctctctcctctttcgcttctccgcccgtccttcttacatattgcgccagaatcgtcgacgccgggggaaaaaacgaaaagggatggggaaagtgcctatcaacatcgacgagggaattttgctgagagaaagcgatcgatagagcagcagcagccgaggagagaattatcgcctccgtggacatcactcgcccccccccctttggtcggtctctttttcctctgctgctcccttttgaagtgtcgctaattaactgacgaagcgagcgaagtgaagggtatgaaagagacggcgcgaaaaatcgaaagagggagtcatcgcatctcacacgcactgctggcgaaagggggggggaactaattgaaaaagtcgggttgaattttgatgacaagcggaaattggaaattaaaaggaaagaatggaaaaggaaagtgaaacacaaaattaaaagggaaaa

SEQ ID NO: 21419 - DNA, 1513 bp, Heterodera glycines
gatcgaaaaattttcaaaatcagaacatcgggtccaaaaaatcagattttggggtcgaaaatcagaacattttgcaaaattgttttatttttacaatttattcgatcaaaaatgtattaaatattatatttttcacctcccatgatcatctttaaaaattttggtgaggaaattaacaaatcgtaaatttcagtgttcagtgcactcgggatcaaaaaatcagatttttaagaatttttgcggcgcatttttccaaaaaacttttgagaaatgggcgccgggggagggtcctgcggtgccgataggcgccgccggaaaattttttgtaatttcgttctgatttgttaacagattttcacaaaaaaatgccaattttgcaattaaaagccacgcgacgacttttttttcgcttttaagaacgcttttttgcggggcccttcttccaaaaattttggaggacaggggacccggcggcacctatcggcgccgccgggaaaaatgtgtgattttagtaagatttgttaacagatttttgtccaaaaacgaccaaattttgccataaatttttttaaccaaaatccaactttatttgtccaaaaccgattcaaatacatgcacataatgaccatgaaatcttattttctattcattccatgcatttgaatcggtttagacaaaaaaagttggatttatgtaaacaatgaattttcgactttgtccgagttcaggtccggggttcgaaatacttttttaatatttctttattttaaaaaatatgtgactcccattcttcataattgccggataattcaaatgtatttaacaaaaaaaaaggaaagaattttaaattaattaaaaaatgctcaaattaccttcccaatcaatgtagaaaagtcgacttttttctttgtcatggcacacgtacattgccaaaatttttttaacataaaaacattctggctcctccttttcaatgatgcttacatcttttgttgccttctcctttactggtttactcactttactcatggttatcttaattttaaaaaattatttttaaaaataaattaaaaataatttaatttgccatcaaaaaaaaaaaaggattccaaaaattattcatttatttttaattttcgaacagaaatgaattgtccttgaaagttcactcaccaaaaaacctggtctgagcattcaagattttttaaggattgtactttacaaatttaatttttataattttattttagatgtcccttaatcagaaataattaaaatttaattaatttcaaaaatgatactaaactataaaatcatttcttgttaattttcataattatttgtcgttttatcaacaagaatgaattgtccttgaaatttcaccaaaaaacctggtcctgagcattcaagattttttaaggactgtactttacaaatttaataattttttttaataatttttttttactgtttgagtctcttgtagaatttcctcctaaactattgtcactgt

SEQ ID NO: 21420 - DNA, 1079 bp, Heterodera glycines
tttttatgtatttttttcttatttttacacgttttcctttatttcaagttaataataaaaaattattatcttagggcgtaaacctgcctacaactttttgaaattaatatttcaaaaatccattgaattttcaatatgataaaacatattacactatatgttacatgctaagagaggaaattcatgaactccctccgttttcatgtaacatgtaacatattttgaagcgggcgcgaagcaccgaggccacgaagtgttcttacgagccccacaaatttagaaatgggcgcgaagcgcccatcttagggcgtaaacctgcctacaaccccttaataacatttcaaaaattcattgctttcattatgttaatacatgttacatgttacatgctcagagaggaaattcatgaactccctccgttttcatgtaacatattttgaagcgggtgcgaagcaccgaggccacgaagtgttcttacgagcaccacaaatttagaaatgggcgcgaagcgcccatcttagggcggtaagctccaacaaccccttaataacttttcaaaaattcattgctttcattatgttaatacatgttacatgttacatgctcagagaggaaattcatgaactccctccgttttcatgtaacatattttgaagcgggcgcgaagcaccgaggccacgaagtgttcttacgagcccctcaaatttagaaatgggcgcgaagcgcccatcttagggcggtaagctccaacaaccccttaataacttttcaaaaattcattgctttcattatgttaatacatgttacatgttacatgctcagagaggaaattcatgaactccctccgttttcatgtaacatgtaacatattttgaagcgggcgcgaagcaccgaggccacgaagtgttcttacgagccccacaaatttagaaatgggcgcgaagcgcccatcttagggcgtaaacctgcctacaaccccttaataacatttcaaaaattcattgctttcattatgttaatacatgttacatgttacatgctcagagaggaaattcatgactccctccgtttttcatgta

SEQ ID NO: 21421 - DNA, 2336 bp, Heterodera glycines
gtggcggattctcgcggtgttcaatgccatcacaacaatcatcaatgtgggcgttacagttttgctggtgatgcgggtggccattgctgacaatgaaaaaggcacaattttaaaaaaaaaactattcaaaaatttaaaaaaaatgccaaacttttgggtttggagaaatttctaaacgatcaaatttttcagagtgatgggcgagagtaaaccatggaaaaagccagccaatgtttctgattaaatacatttttatgaaaaaagtatgagtatgtatccgcctccggaggattttttgaaaatttgggtttttcgtgttggtaatctcccaaagacttccctcgcccaattattttttttagatgaaaaccccctttttgaataatttctagaaaaactgcatcagtgtgtttatatatattttttccccgctctttaggggccttgaattaatatttacctcaggtcatcatgacgatgatcagtgccatcttcgtcgtcctgctggtgttggttgctgatgtttttgttggtgtcccggtcatcgtttgttgcggtgccgtcgtcgtcgtcagtcgatgccaacaacagcgcatccaacacatccgagtccgagtgttcaatgaacacacaaaatttgctgactgaaatttgtaaggggaaatttaaaaaatgataaaaaataattaattaattaaattaaaaaagaaaattcttacttgatcccacaaaatcactggcatttcgaatacactgctgcacactttcatgaagtttgctgagagcggacggtaagaaaagtgcgagcctggaaaattttttttttaaatttataatattttaccctgcataaatattgcaaaaatgtaaattatggttttttgagaaagggaaatttaaaaaaaacacaaaaatcaattatttaggttaaattaaagttaatttatcacacatatataaaaagtaatgaactcacaacacgccactcagcaacgggtaaaggcccgcaagcagtacatgcgggtccttcgtggcacgaactttgtcaaaaatgtaaatgctctccaacagcaacacctaaagaatgggggtggtcatcaccttttagtgagattttttccgaaaattttgttattttttaaacagaggatccgatatgataatcaaacagttataaatttagaatctcacatactcaaatgtgattatttttcattaaattcgagacaggcattttttccaattttctgtcaccaatttattgtttaattaatttaaatttgtttgtacctcttcaaacacataatgggccagtcggttgagaaacattcggactttctgcaaaatgatgagcatcgagtagaaagaggaacgatattctgcaacaaataaaaaatttagttaaaatatgccagtttgctttataaaatttttttcctgtccttctccactacgcgccggacgacctctccccccccccgaagttttttttttaaatcaaatttacaattagtacttttcaaaatagaaacctagaaaaatttaaattgaaaatttgttagcgattttttcaaaattttatgatgacaaaactatgtttttctacaaaagtttcaaaaaatctcaaaaaagatttaaaaaatttttttttgattcgagggggagggggactgtgcaccaaaacgcaccgctccgtgtggccaaccgctggcgcacaacgcgtaacaaattctgtcccgtgtagtccaactgagcccgctgcaactgcaggttggacacaaagccgaacacgcgtttgtacgcccggagcgcattggtggagaaaaactcagcaaccgcttggaattctgttgaaataaggcaaaaataataattaaagaaaaaaaaaccgctcaaccccctaaattcctagtaaaacaaattgttcgttaggtttttaaatttgtcaaaaaaaaaatttttttttttttgaattttatttcatgttaggtatttttaaaacacttttggcttcatagaagcgttttttccagaaaattaacttaagaaaagtttgtttttcaaaaattttaccgtttcgttggctttgccgaagtcgacttttgagcatgaatttttcggagaaaattttgcacttcatttgctcgcgtttggtcagtttgacgccgcacaacaagtgcatcagatccgccacatttgcggtcggtgagcacattgccaacgcgtcgttcacacatttttccgcaatttttgtcgaatgggacacatttttgcgcgacgaaaatggcggtggacacttttttggttgcggtcggtttggggggttttgatactgc

SEQ ID NO: 21422 - DNA, 1014 bp, Heterodera glycines
ttattgttcttactatacgtcatggtttctccagacgaagttgctgaagagtataggttcgtatttaaattgaccaattcgttcggttttcttgaaaaacaaatactaattcagggcagcgctgtcggagctgacacgcaatgacaagactcagatcaatctgctcacaattttggccgaggattatgcgtcatatgccagcgcaattgttgctgtgattgaggaacgtctcttcaaggttttttgaatgggactttatttttgcatttctttactgaatagcattgcccgttcagtgtccatcaccgatgaaaatcgtcatgctctatgtgctcgactcgatcgtcaagaacattcccgcgacaagcggcgcctaccgtgacttatttgcgaaaaggattgttgacatgattgtccatgtgttcaaggaggtggtctcgtcaattcgcattcaaagcattccaatccgcccaaaaagccagaagtccctaaaatttccaccacaacctctagtcttaagattgttgtctttcataatcatttttatgtgcgctgatctctttctcacctttgccaaatacactttgctctgccgctcaattttagttaaaagatgaaaacataagcaatcttagttgctttcttaaattggagtgcttcagctaaagactattggggggaaaaggagttggggaaatttgattcgtctttactgacgacggagcttctttacattatgttgtgaactgttggccttcatcaacaaaacagtgtcttgattaaggggtgaattggtgtaaccaaattcacacaatcaagtaacagaccatccaaaagtccgtgctccgaataccagcccaaaaacatattaagtgaatgatattcgtgtcactcaatttttagtaattgacagcatttgtatcgagttaatagccggcaatcaacggtaaaaattctaatttgacatggagaacgtataaaatcacacaatttttcggacgatttgacatccat

SEQ ID NO: 21423 - DNA, 2479 bp, Heterodera glycines
  misc_feature (48)..(48): n is a, c, g, or t
tatgaggtgtgtttgctttaataaatcacattgaataaatatcatttntaattccattttttccctttaaaggttttttacttagacgacgtggcggccattgagcgcaatggattgccccaccgggtgtcttcgccggtccggaccgcgacgtggtaatcgacgggacggcttatcgaatggcatttgggcagcacaaacaagttctcatcgatggcgacctgcatacattacgttttggcgcaccttctcgcgagctgtttatgggcaattttccgttcaaaggcgccttcggaggtccgccaatcattgcaacgatcaatcaacgaaggcacgaaattcgcctttgtggaccgccgcccgaagtgcgcattgacccggagccgagctacgaactgatgcggtacatgccggcagtgcgacaacaacagccgacgatggtgcaaccgacgaagactgatgggacagagggcgaccgcaagaggaagagaggtagagacaggaggctaacaaaacaggaattattgtttcagaatcgccgcccatcgacgtttcacgattgttaaagcgtctgaaggagaccggactgcttacacaaccgcccaacgaagcagagcggaaccaacgtaaaaaacaagtggagatagaggcgaatgcggcaccaattccttccaaccatcgcctagacaatatcgagcgcagggcaacgccgatgtccggcctggagcagttcagcatgagatcactgatcatgtcggtgtttggggtgtggtcagtcctttaaccaaggggtatctgttttgtgcgacatttgtggaccagtcacaattcagttttcaatatttaaggatattttattcatataaaatgacaagcagcctatttaacaaataacacaatgttaattattccaatcttacgattatgagacgaaggaaagaggaatattaattagcatgtttagaattaataattttgctccactctgatttttccggttacttttggcattgattgaatgttcatccccgatttcagtcgctacgattccgtaatcgacgccattcatcgtccacgcgttgtgtgtcagtattgtggaattgcgttccaaaaattatataatgaggcgtatcaacggcacgcggattggcacctgcaaaaaacaattcggatcgaggaccaaaaacttaacaaaggaccaaaagtggtgaagggtacaagctcacagccatggtatatggtggaggtcgggaatgcaactcgaaaatggcgataaacgacaaaatattattggaatttaggattggtttgatttttcggagacggaactggtcaacagaacgcagggaatgggtgagcaaagggggaaatggcaaataacgccaagaatcatttaaattatgccaaggtggtgctgacaaatctgccgtcgaagacgaaaagggcaccgccgcagtttcgcatcaacatacggcggggaccaatcgggacgcgccttcggaattgtcgaatcgaaggtaggccagaagcgcatttgccaatttgatgctaacattgcattctcatttcacaggaatgccaagtttgccatgaacaattcgaggagtattgggacgaggaggaggacgtgtggcgccttccgcactgcttactttcggatgggaaggtgtgccaaagagggaaagaatagatgtcattttgttgttttaggcatttcatattttttgcaaagaggacgtcatccaagaggaagctgacatggacttacgttgttgatttattttgctatgatctctcccccaccgcttttgtccaaattcattgaaggcgaataaatttttaattatttgaacaatttttattacattcattcgttgttaaaatcatatcacaaagttagaattttatatcgtatttgttgaattaaagcccccaggaagttctattcccgacatctcaattggaggggtggctcaattcataaaaaattatatttacgtgccaaactgaggggcataccaaaaatcgcactttcaaattctatatttttaataatgagtggcattcctcgccccctcagttttgtagaggttcgatcgcatgaacaaatcattcggttgatcaatcgccgatcgttcgttcggttggagtcgtcgccctcctcccccgcccctttctttgtcattgctttgtctgctgctgctggtgtcccctggcgccgtttcgcctgtgcttttcttctcttccgcccatcagtttcagcatgggactgtcaatggaattagttccgatgacagacttacttttttaacctgtattctcaaatggtcaattggaaccggttaaacaatgttttgtgtgcccctttttcggaaagtaagtgtaaaccatccccaaccaagcattttatgtacatatggtgttattcgaaagtttaaattcataaagcaattattgccaaaaatattaataaggtaaa

SEQ ID NO: 21424 - DNA, 1542 bp, Heterodera glycines
cttaaattccgcccttccccgcaacaagtctgtcgttggcattggcatccgcggggggcgggggcaacgaaggcaaattcgaccgtctcttcggcaccgagggcggtgccaatggcaatgccaccaatgcgtcggcattgttttttatattttggcaattttcaaaaggacactgtgaggacaaataatcacggaacattcccctgaaaagggcgggtttttgtgccatttgatacatttggcattggctattgccctttctgcccaaaatgctcctgctgcttttgctttggcgtatttttcttctacaaaaaataattggccatggattttcagcttgtcgccttttttttactcatggtggtccaatggtaatgccaattcagacacaatttttgaatttggctgagcggttggcaaaaaaaaaaaaatggaaaatgaaaaaattgaaaatataatcatacaaataaaaaaatatgtaagctgttagcagcttaattaagtttataaaaatagaaatatttccaatttccaaaaatgatgagcagaattcatcgatggcatcataaaggggataaaattggcataaacggccaaaaatggccattgacgcggcaaagtccgcttttaatcgcagagcttaaaactttagcaggaattaaacaacgtataactgccaagcgaataagaagaacattttcattttatcacttccgctttaacaatttccgctcgtctgcagagaaaaaacgttaattagccttaattagccttttctgttcacgactgatcaccttttccgcttgctaatcccccaattcattattatcttatgttattcttccgatcacaattgatcatcttttccgcttatcaactctttctttattaatttctctgatcacttttcagattgctcagcagtttaactgttttttgtcacctcttctgatcactatgtaattatcatcatttttggtaattttccattctgatcattttcgtagatcacttcctccgcttgatcatttcagatttgctgctatttcttctactctttgatctgagcaatcttttccttccctccgtcgaaaatgatccaaaatttcgcccctttccattcaaatgcatttttcatctctgatttgggtgacagaaacgaaatgcaatgcgaaatgaaatgatttgattgattacgacggtaaaacccatccccgccgatcaccgaattttgtcgtcccttccctttttgattttgccgacttcgccaccctttcgcccccccccctttggtcgatcattttgatcattttctgccacctctgcccttttcggggttcgggcggagtttccgccggttcggacacttttcgacgcctttttcagtgcctccgatcacttccgccgcgccgtccgttgatcagtctttttttgtcatcttttaaatcgatgactaattccttctccgatctgtcgcccccgggcgtttttctctgatttttttcccgcattctttgaccttttttattcataaattcgccc

SEQ ID NO: 21425 - DNA, 989 bp, Heterodera glycines
caatttcgcactgtcccgccgccgccacctatgcattacgacgccatttcagcaacggatgaagcggacgacgaacgcagccgcgcacgcgacaattggctccgtgccagccgacgcgcgtcgcaacatccgtcggttcgtttgtgggatattcactgattagaatcagtgaaatggtcagcagcagcatagatgatggagaagattgtgccatttcaggagcatttgagtccccgggcggacgcgacggtgccattggcgatgaacgtgttgagcggcgtgtcgcgacggagttccattgcgaccaccaattgggaaaatgccatcggcggacttggcgtaacgccacaaatgagtgagtttagcgtgattgtgaaatcaaaaaagaaattcagaagagcaagaaaaggcgggcacagcggcggcggtcaaacggcgcatttcttttttggtcagcggagcctcggcagaggtaaagcaaagcaaaaaaaaaaggcatggaatatgagggaattgatggaggaggactgagttaaggcattaggcatgctaattgccccttaattacccccaattaaatccgcccgactcattttgtaggtgaactcaatgaaagtcaaaaggcaatgttcgttggaatgggagttcatcgccaccattttggaccgtctttttctgtttctgtttacactgactgtggtaattagcaaatgattaaattttaatttcatgggattttttaaattttaaagactgttatcactgcgggtattatgattgtcggacgaatagcacaatggcagtacgaacagttgcttcaagaaattggctgattgaacagattatttatataatcaatgaatattttttgttttcgaattatgtataaagaaatttatttctcatttaatcggtttaaccagggctcgcagatctgaggatttatcctcagtttgtggctttttgataggtcaatgcggatttttttt

SEQ ID NO: 21426 - DNA, 1030 bp, Heterodera glycines
aaatttattcggggtctcacctccgtctcgcagacgggagacctaaatttggacgcggttcgccacgatctggactgggccaggggtggacggacaacaacaaatccttcagcgaaaaatgtcaattataaccagcagctccgacgttatttacagatgagaaaggaacatgcggacagaccaacaaaagttgagctgaccaagggaataagtgtactgatgaatagaggtggcgaagaaggcgaagttgttgataccccacgccgtcctcccgctcctccaccaccacctcctcctcctgggagacctcttcgtcgtccaccgccgagtcctccgggtcccggtggtccttcgccaccaagtcccccacctcgtccacaacgccccccgagaccgagcaggacttctcggagaagtggtcgtatggagcaatggcgacaaaggcgatacgatatacagcaacggcagccgccgccgctggtagtgcgagacctcctcgcagaagcagctgctgcgccactgcccgaaagtgacgatgataatgatgctgatgatgagtatatgttggagaacggattcgcgctaccagcaccatcacaatactatggcgatttgcctgtgctgccgacaatgcggaagaaattgaggaaatggacacagctcagcgcaggattgccatcagaagaaaattactcaaggacgaggctgacgatgatgatgatcaacgcaaaaaatataggatttatcaacctccaccactgcctcgcgcaaaagtaaaagttgagccgaggcctcctccagctcgaccacgtactaacatcaagagagaacaacataagccaaagtcagaattcaaaccgtcgctggcaccaaagcacgttgatcaccccacttctacacctagggcaaaaagagagcctgactttaatctcgatccacgaccatctacatcaagacaagccggatataacccgcctcccccgacgcccaaaataaaacatgaaccgacaacaaagagacctatgccata

SEQ ID NO: 21427 - DNA, 890 bp, Heterodera glycines
ttttaagcaaattctggaatcaacttgaaaatgcattctgaaacagttttcatatatgctcaggaacaagagccgaaacataatgataaaaactggaaggcgccgttaggggcggtactaaaacatcaaattttggacccgccacaaggattcggaattcctgtttcaggaataaccgatttctacatatatcttaggcgttgtgcagcattttttcctgccaatgcagagaatgcagacctgttttcaattaatattataatgccaaataatacagaaggattaacaatatggtaaattaagtttttaagctttagatttcagatagatataaaaaagatacccattaaccatcttttgtctaaaaaattatttataggtatagtatcccagctgccgattttcaaaaatttaaaagtctagcagtacatattttgtgaaagaattttcaaaaaccgatgaatatttaagaaagaatacacccaaaaattcttgtcaaaaacagaattcgctttgttcgaacggcggggagggtattttaacactaccagggtcaattcattttggatttagtacggtaaaattttatttataaacttgcaatattaaaaatttttctttcgaaataaggggacaaattgcgcaattgcattgaatctgggtccaaaatcctgggttccatatgggttggatgccagaatagaattgaaacgatttcaatatgccgcttttgatgcacatgaattaacaaagctaaatatgattaaataatatggcggaggaggtaatgatgaagttgaaagagccgaagaggcctggaaattcgtcagaaaagaatatatatatgctaccgtaaagggtttgacccaatttatcaaaccatcaaccaa

SEQ ID NO: 21428 - DNA, 2097 bp, Heterodera glycines
  misc_feature (15)..(15): n is a, c, g, or t
gagaacaggaaaaanccgaattttttcttggcgttgactcaagaccgggtacaaaaaatgtacccccaaaaattgcgtcattttcttacactttttttttcaaaaacagtgagttgaacacccatcagccccaagtggaagtggtgcgctccaagggcaaggagttggccaagtccagcgaaattggcgggccggagattgagcgccgtatcaaagcattggaccaaagttggacacaaatggtcgaattggcagaggaccggcaaaaaaagctgcaggagaggtgggaaaagggagaaaaagcattgaaaatttcaaaattatatgagtgaatttattttctccaattttctaatattttttgaaaaagttattgaaaaaatatctcttcaaaagctacacaaagcgatattttcaaattttatttgaaattctcggtccaaataaatttatttaaatttctgtaataaatctcaaatttttggattttgctttttatttattgcttaattttataaatacctaaaattcagtcaattattttgcgaaatgaacattgattgaattacccaataataattaaaaatttatttttttaaatttctattccctattttttcctccccttcccatcagtgaggagttccaaaatttcattggccgtgttgaggaggaggaagcctggctgaacgagaagcaacagatactcagctcgcccaacgtcggtgagaacatggctgcagtgcagggactgttgaagaagcacgacacgttcgaggtggacctgcagatgcaccagcagcgcattgacgaactgcagcgccaaggcgaacaggtgggagacagaatggcatggcacacgcgggggagggcgaaattgacacataataaagccaaaatttgtcttaaaaagggacatattaaaatatttttattcaaaattaataattttaaagaagctaacatatttgtttccttgggtgactttataaacactgtcgaaaaaatttctcaaaacgaaaatctcagaaaaaagatcagctactttattttattaacattaaattcctttaattttgttaattataattattaattgataattacagctcatcaattctggcaatcaccacgcaaagaacatcggcacgcgcacggaacaattactcaagcatttgatcctgatcaaagaattggccgtccaacgattgcaaaagttgcgcgacaacaacgcgtacatgcaggtagataattgactcgttgttgactggtttctcaagactgaaagtctgtctaataatattgactttttcaatactctcgaaatggtggaaatttttctgattattttaaatttttgcatgaagactgatcagtcattaatataatccggcattattggattcagagacatggcatctaattgtttgaatgacaacttctatttattcgagacttcttaattttgagactccccttaaatgaagcgggattcgaataatttttgtccaccttcaataattcgcatttcttatggcaccaaaccggatttcgaaatgccgtaacccaatggtccaatttttcagttcatgtggaaatgcgatgtggtggagagttggatcggtgacaaagaaccgcacgttcgttccgctgattatggccgcgatttgtcgtcggtgcaactgttgctgaacaaacaggacactttcgacaatgggctgaacaattttgaggtgggagagagcattgtgtatcattaggaccagggctgcacgaaatttcgtgtcgttttcgtttcgtcctacattttcggcactttttgagtttcgtgtttcgttttcgttcgttaaaatttttcgtttcgttttcgattttaaaaatttcatttttcgtttcgtgtttcgttttcgagtttaaaatttaaaattttcgtttcgttttcgtcagatggaattttgacgaaaaagacgaaaatatttacacccttaagaatgacttttttagtaaaaaaaaaaaaaagatttcattgaactgttgtagtttagtcgagcacacttcagaatgtgttgtttttttaatatgggttcgatcccatat

SEQ ID NO: 21429 - DNA, 984 bp, Heterodera glycines
tccttggtccgtgtttcagacgggtcgaacagatgaccgtgcttttacaccgagaacgcacaactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatgcagaccagatacgccagctctgtccgtttccacctcatcggtttcacgtcctctttaactctctcttcaaagtgctttgcaactttccctcacggtacttgttcgctatcggactcgtggccgtatttagtcttagatgaagtttaccacctgatttgggctgcgatcccaaacaacccgactccaagacacgtaaagatgggtaggcaccgccagttggacaggtcttgcaccttctctggagccccggtcaagggaaacttgaacaagcgggccaacccaagctcacggtctatacgctacacctcgcaaccccagaggagctgcgattcagcgctggactcttcccagttcactcgccgttactacgggaatcctcgttagtttcttttcctccgcttactgatatgcttaagttcagcgggtgttcacgtctgagttcaggtcgaaaaatcaaagcaggaatgccagtaatccaggcactccgccacagcatgcaaagcattggtgcgcttgagttacggtccgtaaaacgcgaattagaaccacaaggtcgcgccagcacaccaaaaccccacagccgagctgagcaagtaacgtaagaacacgtacaagtacatgat

SEQ ID NO: 21430 - DNA, 2926 bp, Heterodera glycines
cgctggcgctgtgccggtgccgccaccgctcgcgcaccgttgtatcacattgttcatattggccgaggaagtggcgccgccgacattgatcgttgcgatggcggtgccatcgtccggcgccagtgccgtgcactgttgcggtagattggcaatggccaccaggttggcacgcacattgcgcaggctggccaacagttgcgcgaacggggtgacgatgaagtcgtcgccgtgcctggaaggaaccacacaataaacatcgggcattttaattttggcacaatttttttttttggtgttttgatccaataaatattagaattttttaattttcgattaaaacgtaaaaaaaaaaattacataattgccaaattgataaatgtcgccaaatatgcaaaattttttacattttcaattgtttaactcatttctcagataatcccccgaaaacaaaatatgttgggaaaccctctaatcactacaaaaattgcatgaaaaattaaatttaaattatttgaaaaaaatttacaatttgtctaaaaatggacataatctcgacaaaattgggaaaacaaaaaatatgcgttaatcatggaatagaagaaccaaaaataagggtatactaatcgggataaatccccaagcttcggttggtgccattttggagattatgccgtcgtcttataatttgaatttggcgcaaaatgcttggcgcagcgtttcaaagttttggcaacaagaacaagtgccattgttggcattgtccataaactctttggcaccaccacaactggcgggtggcacttacatagcggcggttgtcagttcactgctggccacagagctggcacggcttgccggtcgttgtaaaccggcagcgccactgtttccgcaaccgctaacagtggcatagtcgcgcaactgcaacaccggcgacgtgtcgtccgtcatgccgaagccgcccgcccggtacaaaaagctttcgcgtcgcccgtgtgcgcccatgccgcccaaatgggtatggtaattgtagctgctgccaccgacggcacccgcgccggtggaacagctgacgctgacgctcggctgcagtcgcccgcgtgtcggcaccggcgccggttggtacgacgacgatgacgacggcacttgttgctgatgatgatagggctgttcctcggacttgttgagatccaccgacgaaagcagcgactgcgtgtcgtcgccgcagccaccagcgagcggcggcggtggcgactcctcggcaaccgttgtggacgcggtcgcatggcgactgttagcagccgcagcgacggcatgatggtgttgtcgccgcgcagctttacgaccatcattgcaaccgcttgaaagtgtggcgcgtcgaaacgcgccgaatccgccgccgcttttgccgctggtgaacagcgagccgaggtgcaagtccgggtgccgcaagcgttctcgcagcgacttcttcttgctgttgccgttgtcgttgttactcgttgtcgtctcagccgcagtcgcggccgacgacgacagcgactgggacgatggcattgttgcgacgacaactgcggtgtcggcgacgacggcgcgggagtcaccagtgtcgcggtgccgtcgcaacagtcgctgggtgcccttgtcgcctgttttggtggccctgccggtgccaaagtcgacgccgcaacaatcgccgcgctcgctgtcgcagctgctgcaacaatcgtcagcagcaatacagcagggagaacgacaacaccagcaccaccaccacgaccagcgttggcgtcgcggacgaccgtattcacgcacaacgactacggtagggctgctcaacgcggcgattttgttggcagagaagagagacacgaggtgtggcagcgacgggagcagcaaggaaggcgattatgctgataatgatgcagccgaccgcacatcaatttgttacatcatcattcagcatatattggtccttcaacggtggtgttacggtcattggcggcggccacacattacggtataagaataataataataataatacagcgacagtaataacacgaatggagataatgaaaatggatcacaatgtgtaaaaaaggcaaaaatatcaaaataatttaataatgggccaaaaaggggggtgagcccaaggctgaatttttttttgggaaaatctgaagggtttttcaataaattttgttactcgagactatttgaaatttccgaaacattggagacaatcaataaaagagcagagaatgcaaaaaaaaaaccgagtttattttttctcgattagaaattcgacaccgaaaccctcgagcagcacttggaagttgtgtgggtgtgcacgaaaatgaagccaaagtgagtgtgtaaagcaatggcgattaagcggaactgatcaatcgatcagtttctttttcattcgataggagaggggagagatttgtggggccaagcaccgattgatcaactgatcagtgagcggaataagtgagtgatcaatgtttatgaagttgaaggcgccgctgatgtgccgttaaattgcaccgttgggacgccacgggtcccagaaggcgaaaaatgcgattgaattgcccaaaaaatttcgggaaataaaaccattttaaattttgtgccacatatttttgatattttaaaatgggcacaaattcggtgtcaaatgagcgccgtactaatttgaaaaaagccaaaacggggcctaaagattaattaaaattctgtgcctataactttttctaattatatttgagtgaaacgaggacaaacacaacatacaaattgatttgttcattttggccaaaacaaattaaaagcgcactaatgagcgagagcattaggggtgcactaatgggacgaggcggaaggggggaagggtgataggatttaggatgaactgatg

SEQ ID NO: 21431 - DNA, 1440 bp, Heterodera glycines
  misc_feature (1412)..(1414): n is a, c, g, or t
gaccgggaccggcttttctggtccgggtctcggtttttgtcaaaattcccggtcccgctcaactctaatagtaatcaaaaatgaagaaatttttaagcaaattgtcatggtcataaattaatgcaatcagtaagaattaagaattattttcttttttatttttgcgaaaattttcccttgtaagcttttcgtggctttcggttctccgtgaaggagtgatctgatcattgttttgtaataaactttttttgatcagcattaaaaaatagattaatgaaagttttttaaaattgtaaatttaacattgagtcaatttacaaataaaacctaacaaagtgtcattttttttaattgattgctcattagtctctatgtcttttggcatttcgcctgcacttgccttaagcattgcgaacaattcggcttttgcgttggcaattttcgcgtacggctccgcagccttttggcataccgccgcggtatatttgctaaatatttgcgcatgttccacaatttgccctattaattcgggtgcgctcattttttgcgcttttttcagcatttgtggcccataaaattcatttatttgccctttggaaaattcgtttttcaattgccattgcacttcgttttttttcgtctgatgcattttctgttcaacttcagcactttgcttgaacaaaagcttcattatcatttttatttcccatgacccaacaatttttgattgcttcagcaaataatttttatagaaaatatttaattcctttgcattaattgagcctaaaattcagcaaatgcttaactggaaaggcttaaaagaaaagtgaataaattaagtttaaatagaaaaaaaattaaatatatttattaacgaatcaaaatgacaatagtggtaaaaatagtggcattttaaaagaataatataaaaatttcgtctatttaaaaaaattaaataataaacaaaaaaaaacaatttttataattgtaaattgacctaattcaaaacttcaaaagcagagaatgatttttaagttattttttaatgtaacattaaataaaataaaaaaaattactcttgattagtatgtttatttcttttaattttcaaaagatgaatttttaagggggagggcggaaattttttcattggcagaaaatggtcaaaaaactcgtgccctataaacaaattaccatattcagacaaaaacgaatgtggtaaatttgttgcactttgatgcataaagtcgaaaaaagggacattcgtttcaatcaaatgtgccattatgcgcatgtgaatttcctcttgggttggtgatgtgccgagattgtttaacatttgctttatcacccattgatcatcacattttggcttatccatttctgtctcagcagtgattgcctgcaaatannnataaaaatatattttaaatttaaatt

SEQ ID NO: 21432 - DNA, 1606 bp, Heterodera glycines
  misc_feature (1564)..(1564): n is a, c, g, or t
atcccccaatctccattaatcccccaatctcccccccccagtctaggaggggtttgaaaaataatccccctatcttaatcccccagtctccaattatcccccagtctacgagaggttgaaaaataatcccccatgggggataattagagcaaatatggtaattaggaatggccaatcaatcataatttatcagtggtaataatgttttttatggaaaaaacctcttgaatatataaataaattgtatgtataaaaatgtacaaaagaaaaattttaagatttgcacaaaatatcaacaaatttctggtcccggtaagtcccgtactatttctttatctatgttagtagtgaaaaactgaatgtgctttgctatgtttaacttttttctatacgttaaatccgtttcaaactttgcatatgatagagaaaaaaataaggaattgttcaatcgctttttaaaaaaaaaatcgctttttagtctaaaatttaaaacaaaatttctaacgcccatatcttttttcgaattcatcaaatcactacgtatttggttagaaaaagcttctcgttaataagagctttcgaatgatatcaagattgtccattttggtgggcaaaaaccttcaaaaataattcccaaaaatcgtcattttttaattttttggacaaaattaaaaaaatgtttatgttgcacaacggattcgaacctccgccctcctcatcccgtcccttcactatcttacaaaaaccacttcaccacacatgcaaatctttttgaaactgggaggctaaatgtctatttgcgcaaaattaacaataaaaataatcaattatgaatttaatatttatataatttcaatttatctattaaaatggctatataaattacaatgggtttaaatggtattaagaaatagttttaaaaattattattcttataaatagagattttttttaaaaagctattcaattttataagcaatatatttagctaattttttgaactttagtgcgctgttataatgtcaaaaactttaatctgagtaaattatgatcaattaattaataaatacttcgaaatatttgaccgaagagcctgaaataagtgttataaaagctaaacaaaaagtataaatattaaacaatcggaataagagctatagtcatggtggaaagaatttcaggatttgttggcacaaatttgctcgtcgtcgtagagatggttatgaaattcgtgcttacgcgtttcttaaattccgccaaagtttagaaaacaaaaaatttaacacataaaaattcataacttggctcaaattccacaaaattaatattctacggtatctttaataacctcaatcgttctctatcagattattattaaaaaagaatttttaaagaaaaagattaaactttctgagtttttgccatgaccttcattatataaattttaaactcattaaaatgcgataaactcatattatgtaattggttgatagcctaagaaactttgttataattaagataagggtttttttttggaaatcatattttgatagagaacaattanagcgattgaatgataccgtgaattcgatgtcatgactagggc

SEQ ID NO: 21433 - DNA, 1669 bp, Heterodera glycines
acattaaataattaaattaaaatgtttttacaaaggcgatgaagagcaggaggacgaggcggcgatttgaccactgaaaatgggaggaaaattctttaatttagggaaatttcaataaattaaaaagggaaaataaaaatgccattttaagcggcaaaaaacgaaagaaaaaaagaaaaaacaattggaaaattgtgtgtttatttcgcaaattttgatcagtgatcaccatgcttcagtgccccctcacaacactcgcgcatttcgtccggcttcggagtgcctgaggaaaatttaaaaaatatatttaaaacattaattagggcaattaccaagaagatcaatcaccatgttaagctgtaaaaatgaaaatttaagaacaaataaacaaagaagagaacaaaaagtacgacaaaaagcacctgatcaattgggccttgggctgaaaatggaaaaaataaaaattaaaaaatggaaaattggagcaaaaattaaaatatttatctgttttaataccttgaaacagaatccgacgggaaagcaactaaattaaagtgtaatgggttacttatttataagatattttggtttttattattcagaattcacctcggcaaaaatgcatccgactgaccaaactgaaaatattttaaaatttcatttttaaaaacttaaaaaaatgccgcagtttaaatttccgattttaaatttcatgactttcccagtccatcaaatgcatacctaagaatggagaagggcaaatcgaacaaaaataagaaataaaaatggaaaatgaaaatccacggttaaatttttttaatatttcaaaagccccgaaaaaatttttaaaaaaaactcaccatcaaccttttcgttgtacctgaaaaattggggacaaattaaattggtcttttctcccaacaattattgcgtaattaattaattcattcattaattaacacaccttcgcgcacccatcagcagttcgggtgccctgtgggggtaagaaaaatttttaaatttgaattttttttaaaattttttggcacaccgatagtattgggtgaccacttcatgtgtcatattctgcacatcgcatcggtcgaagatgcgggccagcccaaagtcgcaaattttcagaatgcaattggaattgaccaacaaattgccgggcttaaaaacacgcaatttttagtaaaattatggcaaaaattaaaaaaaatgccatttttgacattttttaaattattttttggctaattggacgactaccttaatgtcacggtgcaacacattcgcagaatggagatactttaagccgcgcaaaatctaaagcaacgggaatgggggattggttgggtttgaaaaatgcccgaatatttttcagacacgggaaaatgccaggcatccatgtacaatagggttttattccattagagaaataaatttaacaaaaataattccaaattttttgaaaattatgccccctcacaagccccatttttcgacaaaaaaatgcagaaattccgcaataaaatttattccattttcagtcaattcaattttcccataaaaatgggcctctaaaattggacggacttggtagacgaacactttgacctggaaatgattgggtttttagttgtaaaaacagttaatttattatttt

SEQ ID NO: 21434 - DNA, 189 bp, Heterodera glycines
gaagaagcacggcggggaggggaagaagcacggggacgcgagctgctggggggaacctgttgggaaaagcggaaccatcaataagttgaggaggagagtaagaagttcaaaatgtgctgcagcagaagcagcatcaatgtgggaagaggaggagggggagaagaagcaacaacaacgccgggggggggg

SEQ ID NO: 21435 - DNA, 1260 bp, Heterodera glycines
ggttttttttttaaacaattttccctcatctctccccaacttttaggggtacaacaacggcggcccttgcatccgatgcagctgttcacgggctctttaaacctatttttattttttttctatctcttctctgaatggagttataacaattttccacaatttttttactcagttttgcatttaacagacacattctaaaatttctaattagtatagtagtccaagcctattattattttttttgactagtctctgaatggggttatcccagttttagtatcctttttgaaaaacaaaaattttaataactgatacggtagcccaacatccattgccccaatgtacccttcggtttgccaacgggagctaacaattgatgagtttgtttggtttcttttttaagcaattttccgtcattgctcaccaactgttaggcgtacagcaacggcggcacttgcatccgatgcagctgttcacgggctctctaaacctatttttattttttttttatctcttctctgaaaggagttataacaatttttcacaacagttttgcatttaacagacacattctaaaatttctaattagtatggtagtccaagcctattattattttttttgactagtctctgaatggggttatcccagttttagtatcctttttgaaaaacaaaaattttaataactgatacggtagcccaacatccattgccccaatgtacccttcggtttgccaacgggagctaacaattgatgagtttgtttggtttcttttttaagcaattttccgtcattgctcaccaactgttaggcgtacagcaacggcggcacttgcatccgatgcagctgttcacgggctctctaaccctatttttattttttttctatctcttctctgaaaggagttataacaatttttcacaacagttttgcatttaacagacacattctaaaatttctaattagtatagtagtccaagcctattattattttttttgactagtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcacctactgttaggcgcacagcaacggcggcacttgcatccgatgcagctgttcacgggctctctaacctatttttatttttt

SEQ ID NO: 21436 - DNA, 1385 bp, Heterodera glycines
  misc_feature (1343)..(1343): n is a, c, g, or t
  misc_feature (1369)..(1370): n is a, c, g, or t
ctaaaaatcccagataatcttttaaaattccaaatatcttcataacccatagcttatctaggtagcgaagctcccaaagcgcgaagcgctttttcccagctaaatagccgacggttcacgcacccgctagttatatatacgttatattgacaaggggtttcatccttaaaaccgatttctcgggaatggctaacgggacgggtttgaaagttgtgcattggtcttacaacttttcacggcgcatccgggaaaaatatagagaaaaattctgcgcggacgactgagtcccggggaccgatttctcactttttcttgcagtttagggcccgtaactttttttttaaaactcggatcaaaaaattcccgctgtgagggccctaagttgaagtgttggctaaaagttaaaaaaaattccaggcctctatctctaaccccatggcctgtgtgcttctacaaaaattcagtaccaaatttgtccagttcagtccccgttgaataactcattaggctttgacctgagcgcaggggtgccagcggcactattgtagagcttcgaaagctcgatttttccaaattttaaaatttcaaaaattttgaaaatttttcgagctaggcctaaaaaacggttttttggtttttgaattttaagaatttttaacgaattttcccagagaaacggagaccactttcaagcaaccatttttcgagctctatcgattggtgggatttttgaaaaaatgtcgatttttttccggaaatagaaaaaatttttggcctaagcgggacatttgagtcccgggcccataactcgtcaggggttgatcttatccaaaaattgccttagagcaaaattgtagagctttttaagctctatcgaatgatgtactacatgtttggaaaatttcaaaatttttcgagctaggccccctagaaattttcggaatttttttttgggttgaaaaagagtgtgaaaaatttttttctgggtatttttaaggtgctgagcacgaatctgatgtttgttttacgtttcagaatttttggaattttttaaaaattcgaaaatatttttaatttttttggtccttggaaatttgggttaaaatttgaaaattcataactcaatggaggactggtcaatttaagtgaattaaagctttaaaaatagcaaaaaatcgggagaattttatgagatttatttggttttataatgttcaaaagaaaaaaagttattccagaatttctggaaaaattcgaattttcagaaaaaaattcataactcggttctgaaaagtcatactctaaaagtaaaatactacaaagatccgcaattttttgctctnattatataaattttatttcacgaccnntgcaggcccatgcaa

SEQ ID NO: 21437 - DNA, 1882 bp, Heterodera glycines
  misc_feature (36)..(37): n is a, c, g, or t
  misc_feature (45)..(45): n is a, c, g, or t
gctgatggcgcgcgatgcatcgcttctcatcatgcnnattccttnagcctcaattgtgcccatcgcttcgttcattctttgcatgcttataatttttaattggggaaagtgatcactggcaatttgcttttctgtgtgtctctgtttttttctctttttttacattttgtcgatcattgggctgcctttcccgtgaatttgcagcagatataccgattaacttcctcggggaattgctaaaatcttttttgaaattctaattcggcaactttgaaaagtaagtgccagcaggtgatcactgaatgcccccccttaaatgtttttacttttttaaattctttccgtcccattttctctcaccgtccgtccctttcatttttcgctttttcacaaaattctctccccgactgttctctgctgtgttttttccctttgcttcttcctcggctaatccggctttaattccttctagcaaaagataattgacgccggcaaaaagcgattggtggcggaggaaagagcaattttagagaatatgccggcatcgatactgaaatgaatggtgggggaggagaggagggggaggggagggagtggtcaaaaatcaaggtgatcagagcatgaaactcctaatcagaaacaaaaaaaaatcacagggaaagagataagagagagagagagagaaagtgaaaggaagagaaaggaaaaggagaaaaagagagagagagaatagagatggatggagaggaaaagatttggagggagatgagtgagtatgaatatccaatcagaaggctagctagcctcgttttaaattaaatttggtttctatttaaaatgcttttcattttcgcttccattacaaatgctttccttcctttccccgtaagtccgtcggtcggccgtgatgttttgcttttgccttgggcatttgttagttgcgctgtgattttcggcgtttgagcatttggcttgcctgacgcagctcaagcggaacatccgacttttgtcctccatttgagtgaaaggtgctcgaagcggaggaattgacaatgcttctgtgctcattctcgtctcgacaaaaagataaccatgagaagcatttgtccgattgtccccctttctccccctcccccccccctctctcctcccattccaatcagtgcccatgcccaattataattttattagccccccccccctaacccaattatgcttttgcatgcgaatgtccgtcctccgtctctctgccaaccaaattcctcaactcggaccgacccttcgctgcctgactgacccttatgagttgttaattatcggactttgtttttgtattttctttggcctttctgtccaaaatccataattagcgcccttttccaatgtcctcggccttagattaatcaaaatcatgcattgtctttgctttcttaatttactacgcccccgccccccgaagatattagctcaatttgattttatgtccctattcgttagcctggccaaaaaaggagaaaactggttcgattgtcagcagataaagcgaaaattggagaagaagtggatggtcccctctcagatcgcttcattcggagacgattttccttattgaacacattaagtgattttggtttggtttaaagccttcgcttattgattggctttttcaaactctcaatttcctgcaattccctcgcctccaaagatgcgccacccgacgcatctgatcgagctgagcttcagccgactcggcttccaaattggtgccttttctttgcctctcgcctttgccattttctcaacatttccttaaggcaaacacccaaaaatgataatcgccggcggcattctgttcgccattctgtccagcattggtttgctg

SEQ ID NO: 21438 - DNA, 1205 bp, Heterodera glycines
gtgtaaaaaacagtcttaaaaatgtttctttttctttctttgttgtttgtgttataaattggttttgatatgaaaatattgttttggaaagtcccaaaaaaatttttaagtttgcaaagttttggcgttctgattacaaaataaataataaacttatttgcactgggtgagcaaaactcaatgtgtacggattttctttaaaaaatgataaaatatctgtcaattaaaaaaatataagggatcatattttgtcgataggaaaaccatgagtatacaaaaagaaaattcaaaatattttaatttctgtagatggattgaaccagcggaaagaagaagggaaaatcaaggagactagccactaagccatttgcacaattggcataccgggacttcggattaccgggaatttccggcccggtcccgtggcactaatttgacgaaattggtattactttcttccgagctgaaccagcacagctcgcatctccccccccccccccccactttcatttgattacttcaattttcagagtaaaaagcaaattttagttcttacaattagacatttctcttagcttctgtaaatttattttagattacttataatatatacccattaaacaatgagaattttcggaaatgtccagctgtgtgctgtacgtcgtctgcacacctctgttttgcggcgttcgatggctgtgccaatgagtcgttatgagccgaacagtcgccttccttatcaaaagcttgatgctaatttggcagtcattcgaaaaaggtttttttcaacaaccggattacaaattcctgggatatccgaaaaaccaattttaaatcttttctgcattattgaaaatcgagttgctgccaactttcaggttggaccgtccccttacgctggctgagaagatcatttactctcatttggatgacccgcaaaaccaaaaattagaacgcggtgtgtcatatctgaacttgcgccctgaccgtgtggccatgcaggatgccactgctcaaatggccatgcttcagttcatgtcgtctggaattccggcggttcaggtttgaacactcaaaatcagagtcaggcaagaaaggctttctatgttcattttacaggtccctaccacaattcattgtgaccatttgatccaagcgcaagtcggaagtgagaaggacctttaccgagcaaaggttggtcaatt

SEQ ID NO: 21439 - DNA, 489 bp, Heterodera glycines
gagttctaatcccgcggcagatccgcaaatttaaaaattccggacgctctaacctgtacagtgtggtgtgatcacagggctggtcccgcggcaaacactcctcgacggtaccgctgtgctcaactgagttgacgaagggctcaatgttgccgagaatactatacaaaaggaacaaaattattgaaaaaaggtccagggtttaaagaatgcctaagggtaccgtatattcgaacaaatcggtgagtctattttcagggtacggtatttgttgccctttgctaatgattcattaaattaatttcctggctaattggccacctgctaatgtctaattgggccagcaccctttgcaatgtttgcgcgtccattcggtgcagtggcggctgattttccaccggcgacgatggccccgccgcgccgtcactttccatgccgtcctcgtcaacatggttggcatggccatcatcagcggagagacggccatcactt

SEQ ID NO: 21440 - DNA, 898 bp, Heterodera glycines
ccgccccgattcagctgtgtgtcaatcccagtcccaatctcgtctttcttcatccagtcattaaacattggcccaataagcacctcaaacaaatcatgttcattacggtcaaggaagaacttggtcttttgaccaaaatggcgccatgtgacgtgtattctttccctgtcctgttgactttccttaaaacgtatctttttcaactattttaaatcacggcaatgaccgatgttgtgaagattccttctgctcggttccttctttcgtttttgctatgaattggtttggaaagcgtattaaaaaaggcttcgtgaattctggcttcatgtggcctgtatatttcgtcaatttcagcgggtgcttccatttttggtcttctttttggagcaataacaatggaaggtatgaataattgttggcttcgctaataggtgaatttgttggtaaatgaggagaagtccaaatcgccgatttatttttgtgtgacactcggcccaactcaactggttgtgattgtcggataaatggaaagagaactttgactgacattcgctgtttgtttgttcgctttttgtttgtttgttcgcgttgccccgttctgtgccacttttctgacgttttttttcaattcctccaccacctaaggcttcgtcggcaaatgatttttgtttgtatatttctccataatgttccataaatagagaaaatggttcatggtatttaacttcatttagggttggcccgacacagggaccacttgggtactatactgagaaatacggtaataatttgaggaaaaaatttcgaaacgatttcatttgtttgtaaaatattatcaaagtgcggtcgttgactaaagaacaaaaatcacaaactcatttcgcattacattataaaa

SEQ ID NO: 21441 - DNA, 1322 bp, Heterodera glycines
atataacttttgaaaaaaattaatgcttttttgagaggttagtttatttttgcataaaaattgcaatgattaaagagaaaaatttcaaacaaatttcctgccgtttaagccacagattccctaaataactttatgcccaaaaatacagtatgacagcgatacaattagacaaataataatatgtatcaaagggtgtgaactatgaatagattaataaaaatataccaaaaattataaagaaaatgcttttttgaaataaaaaaatgttttttttttaaatcgaatgaatctttttttaagttttagtttaattaaaaaaaaagtctgtactatcgaaaaatgccaagatattcttgaatttgaataccttaccttttttttggaaaaagcaaatgttagtgaaatataagacgaatagaaaattcgcgcgccaccatttgggcgccataaaataaaaattgtagaaattacaaatttttcagcgcatcgcccaaatgacccggccacacttaagaaatgcgccagggaccttttccgttttggtgccgcacctcattttcaccgacaaaaaaattttatatgtatcggtgtttttttcatttctaattgggtgcgacgccaaaacgagaaagtgtctgcgccaacacctgtatgaattgttgtacggacaattcgtcaatggacaatcagtcagtaatggacaatccgtcaggatatttgattttttagatacatagttcacaatttaattaattgtaatattgttttttaaatatttgaaaaaagattatttcctcattttttaaaataattcaattttatcaatttaaattcattttcgattattttatctaaaaaattttgcgttttaaaaaaataatttactgacagattgtttacatatgaactgtccaatgaccgattgtccaatgattgattgtccgtccgggtgccgtagagtctatttatattcgatgttgtctccgtttcatcacaatttggcgagcaattttataaatccatcttcgaagtcccacgtccatcggcaagacgaagtacaaaatggcagcaattaccagcaaaaggaagtaaaacaaatagccctctaatgattcatttaatccgctaattgtttcatgcacataccaccaatgcaatatgtacacaatacagaagattaggaagaacacacaacagtgaatgaaatttggcgtaaattgctctcttttatggcgacgtgatgaatgccgcggcacattcctgcgtattttattggaaaagaaaatgtaaaaagatatatttgctataaaaatatcatggga

SEQ ID NO: 21442 - DNA, 988 bp, Heterodera glycines
tcttattgagtacatatttttctccattgaaaaataaattcaaattaaagtgtaaagaataaatggatttttatgtgggtctttcgtccataggtcttttgtcggtgtatgccttttgtctaagtttattttgcgagtgatcttttgtctgttggtcttctgtcactacgcctttcttgagatgctcagaaatgcaaatgtccaacactttttaagaatgttctccaatccgtcaacccaaatcagtctaacaacaattccctgcgacaaaaggtcgacttatttttagccgaaatggacaaaagcccaattttcaaaaaagcctccgaattttattctggtcagttttaattgtaaatatactttgaacagtgtttgtctatttacccattttaagcccatcgtttgtccaattcgaagtctttcaaacagaaattccattctctttggttttttccttcgtcctccattcgtttgttttgtctcctccatttccccctgttatgtaaagaccaattcaattaagcatttggctctttgatgtgccgcttttcggctttttccggcaattggctttccttcatttcggcacaaaaacgaatgaacgtgaaacgattggtggtggaaagggaaagtgaggtgggaggagagctaacgaaggcatcccttggcattggcattcgccacgatggaatgaattggcgaattgcccccccccccctccccccgaaacccctcaaagttcctcaattttgttcgcgcactttccatttgccccattcacccagaaagtagcattgttcaatgggaactctaattacaggacatggcacttgtagagtttgggggaagtgacgccggaggggcaaacgttgcggccatgcgaggcaatgcgcagccgcagaaacggcactttgcgctgggggacagcgtcgaatttgaactgaccgccctcactttgtgtgcccttttgagaagagaaaggcat

SEQ ID NO: 21443 - DNA, 1485 bp, Heterodera glycines
  misc_feature (86)..(86): n is a, c, g, or t
agagtggcgaggagaaattgtggacggacaccacagttgggtgaggttttacctgcaggagaaggcgggagacatcgaatacacgngatattacgtgaaaccacggcacggcaatttcatcggcaccattcagtacaaatggaagcagtacttgaaaaggatcggcggtttcatgataggcacgtcgccaggtaagcggacgcccctggggcacttttgaaaggcattccttcggtcgaaagagactttggctgaatttagcttccttttggcatttccctttcctttttggcactgtattttctctttttggcacctcccttttttctcgtccagcttttgacttttctctgctcaccgtttgcattttgactgaaccgggcgaccggaagtgcaaattccaactgaaagaaactcctatgttcgtctcctccttcctcgaggattgtgtcatcgacggatccttcagacacaacttttgcattgcgaccgcttatccgggcattggaaattcaaatgaaagttaacggaaccgaagaacggacattttgtaagacaaagaaagcttttgaaactcgcactttataacattcgttctttatttctttttatgtgcaattaaacaaataaataacactttaatttaatgaggggattaaggaaagtgaatggggggagggagagcaaaggtaattaattagtcgatcggggaaaataccggtattaaccgaactaggtttgactgtctttgagaagtgacttattccgctcatcatacatttgcgtctgcgttggtcaacagtggttgtccctcgggcgccgtttcttcgccctccgtttggctttccctccgatttttgtcgaaggcggcactttttgcggaagcggtgggccttttcgtttgctgctgatggaggacagaaggaggaaaatggataagcttgtggtcgattttaagcgatttggtctgcagaagttgtttatgcagcgaagttggcactttggagagattggccatgggagagacatgggaagagaccgccgaagagggcacttggacgagtccaaagcgcgaatgatgctcagtcaagggccattttggtcttaaaagatcataactcttgaaatgccttttaatgctttcgtttgcaaggctattcgttcttttttgccatgccgtggggtgtcggactttttgccggggattccctccccccaatgccttcgccatttgatttgcctatggcatatcgtcgttccgttgtccgtctctgctgcgccgccttttgtcgtccctgccatcccttgttggaatgtcccatggctgctgcttttcactgttattcctttgccggaagcgtcgacaagtcgaagacgcttttcctccaggaacatttctaccagcaaatccagcttcttgtcgattttttccatgtgccgttccattttgatcacgcggtttgctaatgacactttcatgtcctc

SEQ ID NO: 21444 - DNA, 2083 bp, Heterodera glycines
ctctgggaagtaacccagtaccggggcagggctcctcggtttaaggatggcccccaggatatttgaaaaggcttaacaatatcctaaaggggtttagtaccgagtaaaccaacaacataacaaaatggggtgagaaaggacagtacaaagtacttgtgatcaaagaaaaaaacaagggaaaaatgaagaaaaagataaatttgggaataataaaattaattttaaatgaggaaaagaaaaaatttatagaaaaaatagtcaaaaatggaaataatttgaagttaaaaattttaaataggacaaacataatgccaagagtcaaaataatttttaaattaaaaaaaacggaatgcaaagggttgaaataatttttaaatttgaaaaaaacagaatgccaagggtcaaaataatttttaaatttgaaaaaacagaatgccaagagtgaaaataatttttaaatttgaaaaaaacagaatgccaagagtgaaaataatttttaaatttgaaaaaacagaatgccaagagtgaaaataatttttaaatttgaaaaaaacagaatgccaagggttaaaataatttttaaatttgaaaaaaacagaatgcaaagggttgacataatttttaaatttgaaaaacaatgccgagtgaaaataattttaaattcgaaaaaacagaacgccaagggtgaaaataatttttaaatttgaaaaaaaaaaaacagaatgcaaagggttgacataatttttaaatttgaaaaaaatgccgagtgaaaataattttaaattcgaaaaaacagaacgccaataatttaaataaattttaaatttgaaaaaacagaaagccataatttaattttgaaaaaaacagaatgccaagaatttaaatattttttaaatgagaaaatggggaaaataaatgcaagaaattggcaagaaataaatagggaaatttggcacaaaaatgtgcaaaatttggcaagaaataaatagggaaatttggcacaaaaatgtgcaaaaatttgacaagaaataaatagggaaatttggcacaaaaatgtgtaaaaattggcaaaagaaagggttaaaaattgtggcaaaataatgcgaaaaattggcaagaaataaatagggaaatttggcacaaaaatgtgtaaaaataggcaaaataaagggttaaaaatttgggcaaaacaaagccaaaaattggccagaaataaattgggaaataaggggcaaaacaatgccaaaaattgcggcaaaatggcacaaaaaacggtaccataataatgccaatctggcacataaataataaatggcgaaaattaatgggtaaatgggtaaacaaatgccaaagaaggaaaaattaaggcataaataaatgataatggattattgattggcttttccttccgtaaagtgaattaaatgaaatgaaaatgaccaaatggacaaaaaatcaattaataaattgtttattgtctgaaggtgtcaaattacataatgggcatgcgggaaggagggcggcactacaaagtacgcgaccaattaaaaaaattgaattgtttatttggcaccgttccaataaccccgcccccttcataattgatttgtttatttgacccctcctcccgccttctcgccgcccgctctcgccccctgcccccgctggtgacgtcaatttttccctttatgagagcaaattaatgtttattgtccattgccaatgtggccgagtggttagtgcgtcagtctggccgccccctctggggtttgaatccgcttggtgcggggaatttttggagaattttaaatgaatttaaattcaacgtctttgacctttaagacatttaaaataatttaaaataaatttaaattaatttaaataaagtcgcgcagtaaaaaagtcgcgcagtaagaaaaaagtcgcgcacccccctgcaataggtttgggtttccaagaaaaagtcgcgcaataggttttggcttcagtactgaaaagtctggcgctcaaatggcccgcgctcacttggcggcgctcaaatggctggcgctcagttggccatgcacccctcccacgcctatgg

SEQ ID NO: 21445 - DNA, 2983 bp, Heterodera glycines
  misc_feature (94)..(94): n is a, c, g, or t
  misc_feature (2828)..(2828): n is a, c, g, or t
aagtaaatcataaaaaatgcaattaattaattatgtttatcttaattaggtttattgtcatcaggacccgtcacccggtataattactgtaatntaggatataaagcagcgaatccctcacattcaaaagagtttcaaaagcaacattataagtatgataagaggtctaaagacaatggatcaacaacaagcgaaaacagccgaagaagcggcacctcgtctagcaactgtaccatacagtaggaaattggacaattttcagacgatttttcgattttggcgatcatggaaaatggataattttcgtttatgaattgttgaattaatttccgcttttttgaattgttgaagattgttgagtaaatcatttgttgctaatattggtcttaaaaatttataatgcaaaaaaaaaaatccatttggtcaaggaattgggagatatttgtgaatcacattcttagaaatatttttaaaaaatgaatttctatatttaacaagttttagagtgacaaagattataacaattttgttttgcgtttaccagattagaataatccaaaaacaccggaagtcggattcgaattggcaaagtatttttttaaaaaggaaaataaaaatttgaaaatttttctgcaacttcgtacatatgcttaataaatatttcagctcgattgaccaacagaaacttagtatttgccatttttcacttttttcccatttttggcattattttttaaagtaagcatattgcattgacaatttaccacagcagcagataatttaaaaatttgattgaccatttcgcaatggcaaaagaatatttgagcaaatggttgctatacatttatttgtttttaataatttttcattaggtccatttttatgaatttccatattttttcctcaaatattttggattaaatataaattaaaaatagttaattatagcttggttttaagtttttaagtcaggactcccatcggatgagttctagtcaaacaattttgactaaagactttttgaaattttatgactataactttttttttataattttgtaaaaaaaaaattaaattaatattctgataggagaacatttagagctttagaatgacaccatgaaatatgattttttttttgaaattgagccaagatacgaatttatatgttttacattttttatgttcctacaacttggcagttttaagaaacgcccatggtggcgctttttaagaaacgaccttcggaagggttggtcctcaaattccccaatgtttttggaagttcttaaagcctaatttcataaatttttttatatcccaccccccccccccccacaattatataataataattataataaaaaagaaaaataaaatattgtacaaattatatcgtcacatttacgtaaatgcgccggaaatccaaaaaatggcaataacaactatttttttcatttacgtaatttatattaattacaataatataaattacatttgcaatattgttggctttgtaaggctcgacaaatgtttgaataaagcaatgaaaaatggatagacgattttaataatatgttttatttaattccaaactccgattgaacaactaatttttcagatgaagccaatgcaattcgcctcattttcccccgttgccatcatttttttgctgtttttggtcaccgaactttgggcaggttgcgttttatcaacgcaaaaaccgaaaaaaggtgaaaaacaaatattttgttgattatttttgtaatatttattggcaatgataataattttcaaacaaagttatggccaaaagggcaaaggcacaaggtttccaaaaaaatttggccataactttttgaaacttaacgaaattttttgtaattttacagattagtagaaaaaacctattttttttttattttcttgatatcattcaatagctctaagtattttctacaagcctgtaaaatttcagaaaatttcatttgatggtttttttataacgccctttttgatggcgttttttttataacggctcagcaccatacagacagaatatctgtcgaaataaataatttttttttattggtcagttcgctttatgttttattttttatttttcagggaattcggtcccccttcacctacaatcatcgcggaatcaacgaaaagaaatagacaaaatagttaagcagaataaaagagacgtaaagcaaccaaaaaaacgccagagcggaagcacgtctataagcagaaaacccatgaataataaaaggaaccgtgttgttgtttgaaaaaaaggctttagaaaaatgtcaagccttataagcctaggcgtatgcctaactgtttttgaatttgttggataaaaaatatatttgtttctacattatttcgtaatttttcgcaatttaatcaaaatgaaaaaaaaaattaatttatacttttaaaaatttagattaaaaatgtgaaaataaatttatttcgaatatttttttgatttattaaattttgaaaatttcaaaaaatgttagaatttttttaatataaaatttgtttttttaggttatttcgtttcgtagttttatttacttttgtttttcatatttcgtaggggaacagttcaactcgccgataaattgtgcaaaaaaaaattgtggaaatttttaattatttaaagaaaaaatttaagaaaaattttccaatctgtataatgattattatttgtaaaatgctttcaaaatttatcattttttgatcatctgaaataaaaattgcataaaaaaggggaaaatttcgaaaaaagataaataaatgtcttttanatgaaactataaaattaaaataacattactttcacaatttaacattaacaatttagtcgaggcaataaaaagcccacagatttttttttcatattaataatttggaatggcaaaaatgattttattgcatttaatatttattgtatttttcttat

SEQ ID NO: 21446 - DNA, 1224 bp, Heterodera glycines
ctttttcgtcttctcctctttttcttcctcttctgaactttgtgcctctccagatgaggtttgtgcttcggtgtctctgttttcctctttcttttcctctcccttttcctttttcttccccctttcctccgtttcttccctttctttctcttcttcctctaccctttccgtttccctttgctcttcctctttcttcttctttttcttcttcctctcccgttctttctctccctcctcctccctcttgtcgactatcaatcctttctttttgccctccttcaaaacatctgccaattgttcgtccggcgttttctctttcttttcttctgctggggttccccctccgccgtatccggcacctttctgcgcttcgctttcggctggcggtggtggcggcggaagaacgggcggaagtgacgcattcgatgccccatatccggcacctgctgccggcgctgctgcactcacaggaggcttatttgcttcttcatagagtgattgcgcttgatcttttggcggcggatgatcgggcggtggtgggggcggaagtgacgcattcgatgcgccaccttcggccggcgcgcctcccgctggggcactttcagccggcgcagcttcggctggcgctgtgccactggccggcttcgtcttagcttctttgtaaagcgattttgcctggtctttaggcggctcggccggaggaggtggcagcgatgcgtttgtggcgccgtatccggcgccaccagctggcgctgctgcgctctctggtggcgattgtgaagcatttggtgccattccataggcggcgtctcccgcgggggcattttcagccggcgcggcttcggctggcactgcggcactcgccggcttcgcttcttcgtaaagtgattgcgcttggtcttttggacttgctttctcttccgcggccgttggctctgctctcttctctttgctctcttcgtcttcctttttttctcctcttctctcttcgtctttcgtctcttcctctccttttgagtgctctttcttcccctttccttcttttcctccttgcttttgttctttactttcttcttcggagctctcgctctcttctgtctctttgcacttctttttctctgttctccctctctttttgcctgctttctgtaccctctcgtcgtctgatttttctcttctttatctttttcttgctttcccttttcttctatttttttcatccct

SEQ ID NO: 21447 - DNA, 1240 bp, Heterodera glycines
gtagaaactctgttacatttttctcgaattttataaaatttctccagtcgggcaattcccccccccccccccgacttttcttttccgaaggtcggggaacaaagcaacattaaattgccaattggcagcttatttatatctttgggtaattattcgtctgttttaagctaacaggcaaaaacgttctactgacaaaagcaggtttttttccgacagtttcgccaattagcactgatcagtcaccaactgatcagtgcttatgtttttgtgacttttccgtgtctctttcctatcatttagctgatccatttaattagctgtccaattgactacaaatctgcatcataaggaaaatgatttaaagcataaatcgaatgaattgccaaaattgccataatccaatttgcccaaggcaattggagggaggtgaagcatggaaaagcggaaacaaaaggcgaaagggaggtgagggggacgaggagagagtggccgggggacgagaaagaggaataaagagagagaaggcatggagagagagaggggaggagagcaattgtggaacagagagagtgtggcagagaaagaggagagaaacaaaccatcccccttcttttgcggttattggactggattggaagagatcatgcaaaattgttgctgttagaatagaattaaaggaatcgccaatcccaaccaaaccgtccaccatttatcccttcaaaaaatgattagagaaatcccagcgggggatgggggagagatgaagcctaagcatgggcaatttcataagtcgttaattagacggctgatatgatggatgggagagggaggggaggggaaaagccgggagaagccgagggaaaaggaggggataaagtagggggagaagccaagggatgggtgggatgcgcagaaagagagaaacaaagatgggataatcgcgagaagctgctgctgggagagaggacgaatcagaatcaggatgcaagtggtgctgttgggtttgggctggctgatcggattgatcagattgcgcgttcgtttcgcttgaggcattccgaccgcgggggacgccttttgaaaaacacggaaggatatttgaaagccgacaatcaaaggcaaagggaattgcaaaaaaacgaaaaagaaataaatattattatttatttaatttaaattcgaaaaaacgaaaaaacgaacgaatgaatgaatgtttcttttgtcagctcacaaacaataa

SEQ ID NO: 21448 - DNA, 282 bp, Heterodera glycines
cggtgtcatctatgttactagatcggggatcgatccccgggcggccgctcgagcaggacctgcagaagctagcttgatggggatcagattgtcgtttcccgccttcagtttaaactatcaagagagggaggagagggttggagaaggaaaggaaaaaaaaatgaaggaggagaaagggtgggggcaatgaaggaagggaaaaaagttgaaagaggggatgcatataattaaaaaaatatataattattattttaaaattatgtaaccggtaacttgctaacg

SEQ ID NO: 21449 - DNA, 1542 bp, Heterodera glycines
  misc_feature (31)..(31): n is a, c, g, or t
  misc_feature (49)..(49): n is a, c, g, or t
tacattcaaagtcgaagaaaatgatgcgctnttccgtcttcttctttgnccggtacgggatgtagcattcacgtggaacgtggaagccgaggcagactttgcaaaacttctgtccgcacacgtgtggcttgtctttgtgcacctaaaatcaaaaggattgtagtttttttatcctctaaaattacccgagtttggtagattattccgcagtcgacacactttttcgaactcttgcagatcgatttttcgatggttgtcacttcagtcccgcgcttgattttacattgtgacagtttacagtggtgttcgtagcactttcggcatttgaatgtctaaaataattcatttaaaaatacaacggattcattgctttacttttgaacatcccaggcaggtctcgaaaaaattatcgttggagtcaatacaatttcccctgaagtccgatccaacacgctggcagttgtgacacttccatttgcatttagaattgtgctggttttggtggctgtatggcatttcacactaaaaaatttttattatgattttttcctttgtttttaatattactccaaaacagtagttcctcgttccaaagacttttccaattgattttatagggtcgtagtgaccggcgccgtcatcttctccttctgtaaagagcacgcatagctctttttagtagttgttcacgtccgctttccacaaaggcttcatttttccagatgtcccaaaacagaacagacgaaatgtgtccgggtgaagctcggcataatattccttaaaaatactagttaattattattattaaaaaggtgttttgcctggattgtttctccgtattcctcaatggaatagaagggatgctccagattaatccggcaggcttggcacagagttgtaacatcgttcagctgccatccagggttgcgcttatattccgagaatcgttgttgtggcagcacatgtttcattcgcagaaattcaaacgcccgaaagagacaaaagttgtcgttgttcatcagctcgaaagttgtcccatcgcagatgctgtacgggatgttgaagtcgggtctcctccctttgccagccagcttcttcctctgctttccgctctcgatcgccgtgatgtcgatgacgaacgattcttcgcagattgagggcctttccttcgccttgttgctctggtcgacaatctcaaagcgcgtcagaattgtctcagccattgttccgtcgatcttcttgatgtttttgaagtgcacggcaatctcgtagtcaaggtggcgtgccgtcagaaggaagatgaagtggttggccacgatgttcatggcttctgctcccttcattgcgtacgtaagacacatcaggaacaggctcttcagcacgtcttccgggtagttcgagttccaaatgtagttcagcataaaacggcccaagaaacggtatgctaaaatggatttttatttatttagaataaaacgaatacaaaagaacaaacctttgaaccgtccactctctgcttgggcggcatccaaacaaatgaag

SEQ ID NO: 21450 - DNA, 2493 bp, Heterodera glycines
tttgtttgacggacacagtttattaaagccaaacaaaaaaaaaaaattttttttttgattttttttttagatggacgttttgattgcctattggctgacatcgcatgttttctggtcctaccatcagcagtttgagatgccgacagcccaacgcacacagtccgccctgtccaatatttggtggttttggctgtgctattggtcagtgggggcggggatgtaccagggttgcatcatcgggtctcgagaatggtgccggattttgtgtgcctctagttgtccgaaaaaaatccgtattggattaaattttgattcggctgtaccgaccggtttttcaaaagacttgaactagtgtaaatcgtctttttatgcccgaaattccgtttttcaaaggtttgaaagtgaggtgcccgacacgggtcctatcgtcaacgattggaattggccgttcgcgcagccgcacttcatgcacacactgatggccaagctgaacgcgaagctgcaataatgatcccaggtgggtgacgggcggattttcgcttaaaaacgatctgggtaaggtttggttcgagaatggaccgtggaaaattcccgttttcatcgatacctatttatatttcgttatgcaaaaaacagggacaaagattgggttcggtaaatgagacgaaattccgggctcatacaaaaaaattgccaagccttgggtgatttttaaggaatgtcgcatatttgttgttatttcttttcagaccaaaaattgccaatcattcccagacaaaaaaaagaaaggaggagagagaaagaaagagaacatagcgttgattcattaaaccgtacagtgcaacaaaacgccacaacactccgtcgtcttcagccagtgtttggacttccttccctttcttcatgccttcctttgatgatgtttttttccttttcttcgtcatatacctataataatattttgttgctgttttttgcatttgacacttggaaacgcgccattttccactgacattttgatattttgttcctctttttttctcggccggtgcatttttgacacccacctccgactccctctcaaaaacactataaaaattttctctctctcatcatcattgttttgttaacccgcctatatagcagtgacacttactacattttttaatgattttttgattggataataataattgtgcaccaaatttctaaaaaagaatttggcaccttttgcttctagccatttcatttaaaaaaatccccgataaaagtggtcacaattttattttattatttttgttgtgcatatattatattattaccaccgccacaatttactcatttcggctgatattttctcctcttttgtccattgcattttttgccaggatttattattatacccaattgattgaccatctgcaaggaacttttttgttctattttttttgtaattttaataaaatacgatatttctgaccattgtatatacatatatacctatttcttttgaatccgcgatccgcgggattttgttttgcgcggcgcgccgcggattttttggtacaaaatttttaaaagaaaaatttattgaatatttagatttgaaggcataaaattttgtaaactttactaaagttccaattttctagcgcatttatatggaatacaatcagaaaatatttatacattcatgattcatttttttcaaaattttccccccgcgggggcctgtcgggaccgccggacctctccacttcctccatgttctcaaaactttttgaaaaaatacgtcgcaaaaaaggtgtaatattctcttctcaaaaatattcttaaaaatgtaaaatgacatgaaaaagttatgatgaaaatcattgaataattttttaaccaaatattcaaatataccaaaaatattttttgaaatcaccttttacttggttaagaattaaaaaatttagtctagtaaaaatatttagaaaatttttattatattttttgaaaaaattccgaattccgacgtttttggggtcgtaattccgatttccgaaaatttttggggcttcggaatgccatccttgtttgcatcactgggaaccttagcaaattcccccccccccccctattcagtccccctaagtattatatgcatcgtgattttaattaatttttatataaaaaataaaaataaaatttaaaaaatggtttaaaaaattaaaaatgcgcgaccgcgatccgcgattcgcggcaatgtttttgcgcgaaccgcgatccgcgaccgaggcaaattgaatccacgatgctcgatccgcgaccgcgggatttttctgtgagccctccacccctgttagagaccgagatttccaaatatgccgagctgggctgacattttcagaagcaaccggtttccgggctccgactctcaaaaatcggtgaaaacggattttctaattgccgggcccgggaccggtttccgggttggtaacaatttaa

SEQ ID NO: 21451 - DNA, 1912 bp, Heterodera glycines
gggctgtcattataatcctcaaggagtggtccaaacggcacggcttgttgcagataaatccatttaggcacgatagaatccgaccgttggatggacgaattatgcctgggtttcagcactgatcaccgagcggcacctttcccttgtacaaagccccactattttttctcattcaaattttctcactaaagattaagccgtaatgctcggaggattgtaaaaatgttaattgaacattagcagtggagcaaatgggacaaatttctcgagtatttaaagggggagacacaattcataaattcattttccaacttttcgtactccattttaactatgtctcaacagccccaatactctgttccccctcccgctccatactcatatgcataatgccaccttacggctatatgccgcaaaatgtcccacaaatgggatatcagcaagcgccactcgcgccgccacaagtctcggtgccccaaggcaaaaccggtggttacaaaccatcatgtgctggccccgcaccagctccggtgccatgtgttgccgaggtgttgactcagcttgtagccgacttcaccactttcaccactgagttcaacaacaacttatcagcctttagcaccgagttcgcgcagctatccaaatggctccgtgagaatgtgggcgtcgcttaactttcctaaatcttttttaaaaataaatttgccgttcaaatatgatcccaagaggatttcagtggggcaaattgccctttctctaaagtttgaaattgggtggtcatcccattccctaatcccttcgccttttcccattttttgaatcgtggcggatttgtgcgcacaacagcttctcaaatgctcttctgatgcccgacctgatgttcaacagctccgcccatgatacgagaagaaggtgtatataaagaacagaagaaaaacagaaggcacctttttcctccaattccctcctaccaaacgatcttctgacttcaaaattctctttaacgtttttgaaattacccaaatttcgcagtgatcaacgttttcaaatttgtcttcgcatttctcgtatttttggttttgtgttaaaataaagattttggatcaaaatctttcgtgtggattattcacggtcttagaccccgaagtccagagttaacagaatttttctgagagcaactcgctcaattatcctttcgaatcgtaaggataaattttgtcaataccaaaaggtgaaacatttcctttttcgggaatttgtcttttatcacatttggtccacacggagttgtgtctcacacaactgcccactgtcctttccatttttcggattgttgcaacaattaataaagaattaattatcggaagcgtaaaatgaaaatatgaatttaaatatactattaactaaattaagaaataattaataaaaaattatctgtataatttttaatttaaattaaaataatcgatagattatataaattgattaattgagatattagtaaaaaaccgaaaatattaaatattttattgttgtaacgaatttgacgaaaaattttaaaatttcggcttatactaaagttttggaaaatgcagctcgcatatgagatgtccacttcattttggcccggccatttctaaaataaaaataaatttgtttttttaaattgcgagccatcacttttataatttcaaaacattaaattttttaaactaatgctcataaattaattaaaaagaccaatttaattggaaattcaaaaaataataaacaaaaacatgaatagaaaacaaaatgaaattttgcattacactgacttatctgctgcaaattaattttttttttagaattgtatgtgtgtgtatattcatataaaatattaaattttataaaataaaattaagaaaaatta

SEQ ID NO: 21452 - DNA, 1427 bp, Heterodera glycines
gggggctctatttttcaaccccccccctcaaaagggggggctttatttcagaggggggctctaattcaggggggggggctataattcaataaatactgtatattaattcattcattttttttaatcatttaccaatgcatatcaaattccacatttactgagcgaaattgaatggcccattcagcgttttgactggtacaattcgcttggttgcttctgcaatgatatatttttttttttttaatttggctatttacaatcaaggtaattaattcatcataaaagtttgaaaaaaaattgctgaattttttttcttttagttttcttattcaaaaattttctaaaaattttttcattgtaaaatttctgtttgaaattttttttttccaaaaaattttccggcgactttttggggtgctcgtcaaaattcaaagcctccccccccctcacgtcttacttggccatgccagccaatgcttcgcatcgtttgttcgccttttcggcatccggaaacacgtgttggccacatttgagcaatgttggtgccgcgcccgcataagtcatgtacaacatgttgcccacctgtttttttcccaaatttaaacgaatttttttttaatttttgaaaaaccgtatcccctgcaaaaccatgtttggcgaaaaaatacgaaaatttcgattttttgaattgtaatggggaaaaatttgcgaattttccctaattgatagtttgttctaaaaaaaatgagggtgaaacttcattctacctgagccaggataagtagttcagccagcagacacacgactaaaaaattttttttaaatatattttatacatgaataaggggtgttttcaacttggtaacccccccctccccaaaaaaactttttgtaaaaatatcgaatttttttttcgattttttttttagaaaaaaacgtttaaatttaaatttgtttaaaaaactcaccatatgtgtacctgcccagctggtagaagtcgtccaacttcactgtttcgtccaccattttgtctgttgcggctgccaattgggcgggcgatgcgccggctggcaccaaaccggttaccgcggtctgcgcatggcgtgccgtttctgtgctcggctcattctgttcctgttccgcaaccttttccgtcaacattgggtcggcttcagaagccgtaggagcagacattttcaagacacactaattatccttaattaaggcattaatgaaggctattaaggtaaattgggtatcacaacggcagattatttaaacgattttaaaggataaaagcgaaattcgaaaattttaattttcgactttttgttcgagttcgggtctggggttcggatttggttggatcacggattcgtggtcagcgacaacggaaacccacttggaacatatgttttcgatgactt

SEQ ID NO: 21453 - DNA, 1383 bp, Heterodera glycines
tgtttacattttgcaaaatttgaaaaaaaaaatcattactgtaccaaagatatggcgaaaatcataaaaaaactcttaattttggtagttttggcactgtgccgtttgggtttaaattttttattttctactcaatttcacgtttaaaaatgccattggaaggcgtgtcgatctatgcccatattaataagcttaacattcgtcaaaatgtaattgtccacgatctttgtactgaccactcgttttcatggccacagtgccggaaattctttttttgtcaggcggttgtataatttgccgttgccgcttttttgtgccggtgccatcgttcgccggcggcttcgccggtgccatgcgtaacaaaatgggaaacatgcgcacttgccagcagctgaactctccgtcgacaaaacggtctccgatcaaccgccgcattgggccgtcggtaaatattaatctgagggctcaaactcaaaattgcttaaaaacagtggatgtcggtttaaaccgacccgaaaagtggaaaaaaggattgatctgtgccaatgacttttttcacagaatggcacaactcttgtaagtgaaattatgtaattggaatttccgattgtttgtggattcgtcgactttcgctttgagcaaatgcatgacccaaccgatagaagaacagaacgaataaataaatattttaaatattaatgcaatccttttttcaattcgataaatctgaccatcgcggggaggagagagcaattagctaattgttgcgattttaatgtgaaaattcgcatgaaaatattgtttatgtaaaggcgaatttatttttaaattgtctacgattttttgaaaattcaagctcattttgaaaactctgctgattgttactccaaaaacattaaaatggaagagttttttacattttgtcttaaaaaatttatacgcaacaaaaactaatattttttaatcaacagatttatttaattttgttttttaataaaagttatttccgttaataattttaatagaaattttagccaattttataataaatttttgtgataaaacaaacaattttaatttaggctttgaactaagcggcagggctgcaattgacataagaatttaatcaattaattacttttattaattagtcactataaaataaaattaatttgttttttaagagaacggatcggtttaataggtatattaaaaataaataataaaaaatatctttcttttggttacataaaataaattaacataaattatttgtccaattagtccgatccaactctcaaaaaagggacaggcatttgttttgagcaattcggtctttccatccgtttcttctgctgatgatcaacgaatgacaacattgat

SEQ ID NO: 21454 - DNA, 1313 bp, Heterodera glycines
  misc_feature (1288)..(1289): n is a, c, g, or t
atgcaaagaaaatgaacaatcgaattttgaggaaacctcccagtttttggcttaataatttatgaatttcattttaaattctctcaaaatatttttcccgcattttaagttggatttgcactgatgttttgatggacattctgccattttttgaccatgcccaacttggcctcaaattggcactgatttcgccacgtttcgatgttttagtggacacgcattttgatggcaaaagcgaatggcccatttggaaattagtcgaaattcacaaagaccgtgggtcggaaccaaaacttcgtctgtttaccagctatgccgattttaccaatattctgaattttccgttgcccgaccgtccgctgcccgagaaaacacgctttaagcgtcttgtgatcatgtaattaaattaaaagcattgttaactgataaaagcatcccattttcaggtacattgatcattcagtcatcgcatttctccgctcaaataaacaaattttcaatggaacacgattcgcattgagtttgtcagtgcaggcgcccaagaacgctgcccagccgatttgggatgttttggcacgtgaaatttggtcaattattgcgccaaacattcgccgtttgtacgttcccgatgctgaccatttggacaatttgcgcagtcgcacttcgccgacaattctcacggatctcaacattaattccatcctttctggtcatctgttgcccgatgtgctcggtgattttgatgggccaaatgcaactgcttctgctggccaatcgttgtccaaatggttgcacactccgaccaccgacgggaagccgaagcgattgcgttgcgatgatttcaacgggcaaggaaacgccgaatgggtccacaatttcaaggaaggtgctccttcttttctcctattttgtcattcatttgcatctttttcggcaactaaattttcaacaattaatgcgatttgcttttaatgtgtccgttttcccattgtttagccgtttctccgtgccacttcttctgtctgctacataattcaattctttgccttctcatcaacgccaattgcgccatttgaattgttgaacgaacggaccaatgagaagttgacactgacaatgagcacgaatacatatggcttctgatgcggtgccaaattgggcagacgtttcaatgggatgccaaaaatttgaactttttgtcggcattcatttgtatggttacaaaaaatgcattgggtgagcatgaaaacagaattttttaaaatacatttaaaactcgaacttaaannttgataaaactatgttttaaattt

SEQ ID NO: 21455 - DNA, 1484 bp, Heterodera glycines
ccatgtccgcgctccaacaagtcggctatgtacaaagacacaattcgctcgctttatttgtgtgcgtaattatcccttgagggcactttggtggcgaaggtccgtttggcgtacaatgcgacgccacaaattgaagcgaaaaaggcacaaaaagaggcacagatcgaacggacgacgctgagagaattggagggaaagcggcggacagacgaatggtcggtcaaccattagcagcaaaacaatccaacaacgaatttccatttcatgacggactccgattttgccaacttttcccattgggtcgtcgagcagcgcaaagacaaatggcacaggagagagtatttgccgtggctgttgtacggtgaatggaaaaaaacacgccgcaattacaacaaaagaacatgaaattccattccatttcagaaaatgaaatcggctgcattcgactgactttcgacatttgccaaagacagccgcaaaggacggacggaggggggcacacgtgcatttgagaaagagaaaaggaaaacgaacaaattgacagagggcgaaatactgtggcgaatcaattagtcctaattgggtttattccttgtcctctcacaaatattacaactgaatgggttggtggtgcgttcgttcgtccgtttgtcttttgtccgtccgtcggtcattcgtcccattccttcgccctcactcagtgcgtcccctcttcgcttctcttcctccccggcacccatccctccacttttgggcgtgtggtcgaatagggcacgtattttttgctcattacaatcgaattgttcggctcatgttccaacatccatttcttgcgctccggcggcggctcaacagtcggcggtttgtcgcaaatgtggtgcaaccagcggtgccattcgggcgggatttgcgaggcgtcgtagtcgagccaaatcctctcggcgtagacgacgtagcgattccggggcacgaaataagtgttgtccttaagatttggcatttactcccaaacaatcgaaaatgcaaattaacaaacatcgaccccaccttagccttcgttcgtaaacgccgccctttttaaacacattcccgtcaattttctcaccaaatgcgggattaaaaatacactggtacaaatagattcttttttggtaaactaaatattttagattgactccagcgaattttccaaaatttctttcaaagttttagtaaattattttttccgtgtatttaattaaatttacgaatataatctttgtttgtttacttcgaagtatcggttgccaaactgatcctcgcctatcaatgtgccagcacggttctgaaattcgttattaaagtaattggaaatcctaatttaaaaaaataataaatttcattcatttgaccgtgtccatcaaataacgctgtttaatggctgctcggatgcccccagtttgtttcacaatattaaacgcttttgccaatttgtcgagaaaaaa

SEQ ID NO: 21456 - DNA, 1720 bp, Heterodera glycines
caaaattaaagcgaaatataaaaagagagcggtgaaacagcggtggaaaaagaaagagaagcgaagacccaaaatggcacaaagcgacgaaagcccgatggcccaagaaaagtgagttttttcacacgcaattttttggattcaatttggaaggtgctaatttttcaggagatgaagcgttgcattccgtgtggcggcgacttgagcagctttggaagacgatgccggacgctgaacaaatgcgccaacagctggagcatcatttcgtctcaaattggttatggacaccggcagactcgacgaattgaagctggtgagttgatggaaggggctttaaaatcttatccaactaattaagagggaggaggaacaacggtagcaagcggaggaagacaaaacgaaatgaagaaagtgatcaagaagctgacgtcgatgtcgttgactgatcgaggattaatggtttttattttcattacaagcggtagataaattttttaaaaatttgtaaacaatttttaaatcattttggtcacttttccttttatttattcattaaaatcatcgaaatacatcaatagcatgcactgggaatcgaacctgggacccccccctttggtgaccttctcacagaccacttcgccacacatacaaatcttttttggtacagcagctcagtttccggacgccgtgtacagttatggcaaaaagtatagactcaaaaatttctttttcgaaaaatacgattttctaaaaaaacgaatggaggagaaaaaagttttgtttacaccaaaagaaacgtcatttagtacactaataaatacacaaaaactccctcggtatgtaactttgttgacgagaaaatcggcccagacccaaacaaatcccctttttggtgggcaataagtatagactcaaaatgttaaatagaccaaaactcagagataaattctgaaaaaacttcttcactttttgatgctgaccaaaaaagttttttatacaaatttgatcagaaaactccttcattgtgatctgaacaccccaaaacacactgaaaatcggtaaaattttcaaaaaaaaaactcatggggattcggaacatttttctgggaaatttgattgggcctatcagaaggaggacaaaattctctgccggattgcctttggggtggcgggcctacgactaatacccgcagagcaagagagcgtgaaaaaatgattaccataaaaatggcctattttctaccatttcccttttgagagaaacctttccagaataaaatgcataatatgtttattcaatcctttcacaggatgttaaaaaaagaaaatataggctcaaaaaaatacaaatacaaaaatttaggacacagtttcatgaacaaaaagcacaaaaatttccaaaatcttcgaataccattcatcagcagatcaataaatgtaggcacctaaaatgaaataattggacatttaatatttgtgcatttatttaatcatgcaatatttatttttattttttttattactttcttcggcaatttgaacgagtttttgccattttccattcccgccagtgcctccatcaaatagcaaagcatccaaaaaattttggaaattctttgcttttccacgtcctgaatcattggcatttgtcaaaaaatacttctttacaatttacatcaacataagcatgtttataggtggtaagcgtggttgatcgatc

SEQ ID NO: 21457 - DNA, 953 bp, Heterodera glycines
aatgaaaagcggcaaaaatggtcccgaaattttgggcatttattcgggaaacaaattgtggaataaaaagctttatatttttgaacccacaagcaatcattacgatcgttgttccttttggtttaatttctgatccttccgagaattttttgatcaatcgaattattgtattaatttcggtaattagtccttgaatcgatcccctcccaattatccccccatgctaattttgtgcccaattgttcgcagaatcgccggtcctcccatctcaagaaagatcgcaaccatttgccggtgttcaccctgagacactacagcacgcagcggctcgcctgcgcccgacccagcaccgtgaatcgttattcacacatgaacggcaacaatttctggacggacaaggtgatcagaaagatcacggcacaaagcaccagcaaaaaaggatcagagagagtgagagagagagaaaggagagacaaagaaagtgagagagaaagcgtgatcgggggtgagagagagcacaaaaaaaggatcagggagagagaaaacgagaagtaagagagaagacataattgagaaagaaagccgcgaccagggatgcgaaagagagaaagaatggaagagagaaagtgcgatcagggtgtgattgagagagggagagagaaaacagaccgagtgaggcactattctgatcaggcttgatcagcggagcagatgacttagaattgtggcgagattcttgagctctaagcttattgttagctgaaaatgctaaccgcaaaactttataaatttagaaattcaattcattaaaaatatgccccctcccattttctgatcaattggcttctgggcgacattggccggatcagtcgcagcatggtaaaagcagcaaataacattatattctattgtttcttaaaattctcatttcctccacagaatcgttggccaag

SEQ ID NO: 21458 - DNA, 1873 bp, Heterodera glycines
aaatttaagttagatagaaaaatcttagaattttttttagcttttggtaacttttttaaaaaaaatcttggtgtgggtacggggaagtgaagagcacctccatataaaaaatttcatgcatttttcaccaaattgaaaacttttacagttaattgcgttggtctgtctcatcggtgtgctgatgttttttgcgcattctctcagagatgagccgttgcccactggtgctgtaaaaacgccaacagcaccagacgagaacactgttgatgcatattacaaatcgcatgctgtagcagaaagcagcgacatggacaataattttgcataacgtttttctttgctttcgaattttttgatattttattccctattttcaattagctattacattgttctcctgttttacagtataaaaaatgcatattatttgctagggaattgatttttatttgctaaaaacactcaaagcacaaaagtaacgcaatttgcataaaaatgtgtgttaaatattcgggacaaattgcagcacaatattaaagtgctcgagaaccgagtttagcaacttggggtaactgacaattgaatttacgggttcacttcattccctccgtcccgaaaatttaaattaaattttgtatataaagtgtatattaacaaatattaattcatatgcacagtaaattataattaatttaaaaattattgtcgcaacaaatcactgttgaaaatatgtacatggcaccgtgaaaattgatcaaaaaaaaaaatttagattttgttcaactgtattgtttatttaagtctgacaatgggaatttcttatgaggatggacaaagaattgaacaagaatttaacaattttgtatatgtaatgtttggttccattttcttcatcataagccaacggatgagatgaattccttcagctataaatttttctccattgaaattttaaaaatgttgtccaacttgattgtgtctcaagaattcgggccaatcaacttcttcgctgtaaaaaaaattgaaaatttttaaatgttgaaaaggagtgacgattttctcacatacatattcatgctaaaaatgctgctgttggtacaggcccaatttgtcgacagatgacaactcttatggcatgccattcggcaatctgtgcgagacggcactcattaaataacacaaaaaaatatttttttgaactcagacaggagaagggggggatctgctggcccgttttcaataatccaatcaggatttccttctaaaagctcaatgaacgatcaatgagaaccaaatcctgtttcagtccgtttttccaaaaactcacttctatgtacatgtattacttaccccgacattggtatgcctgtcttgtagtaaaatttccgccaattttctttccgcaaactgcgcacagtacacgcctagtaatcggcatgatgtattattttggcattatgcactcttcaaataagactgggcgcttgacatttggactaatgcttacaattagatagaagaactgagtaggacataaaatgttaatactacatttaatttattgttccaaaaacgattctggcacgccaatcataaatttgacggcattttcatgtgcccaaatgagcatcgacccagtaaactgtaccctcttggttttactgccacaaaaatatgccactcataaatgtgcaattttttcccgctttgcatcagtttgatcactgctggctccgactgcacttcgaaaggtattgcataatatctgatattttcagtttaaattggggtacgagatttccaatactaatccagttctcgacaccacaccttggtttctcctcctcagtgccaactagctctaacactaatt

SEQ ID NO: 21459 - DNA, 2024 bp, Heterodera glycines
tgtaataatctaaatttgaatgtccatggctaatctttttgcttttttagcttcatttgcggcgattgttggttggatttgttcgattttctgccgccctctcagcttggcctcgaaattgcgctgatcagtcgccgatttgactgcttcgttgaggaacatttcaaaacgcgcaaatggacattggcgaacgaaattaaaattagaggagtaattgggcagaatggtgcaattgaaatgggaattgtcaattccgatggaaaagcattgccaatcccacaaattccgttgccgaacaaagtcatcggatttggaagcatttttatccagtaaaaaaatgaatttttgtaatgatttgtgccaatcacaatttcatttaattttcagcttcatcgaccaaaatgtgctcacttttcttcgccgttttcaccgttttttctccgtttgtgcaacaaaattgtacattctcactgagaatgttcgcatttcggagtttgttatgcgcaacatttggccactgttcaagaacaccattcatgtgatgtgtttgaaccccatcgcttttcgtcaaatgcgtcaattggccccgtcaatgctaaacgattgtccatcacttcgcgttgtttttttcgatggtggcattttgcccgaatttccgcccgacgacagcgccaatgcgtcggatggccaagcggtggccaaatggctgttcacgcctcgtcccgacttaacgaagatactcggcattgagaatttaactgtggaccaattgttgacaacagtggaacaaatcaaagcggtgattatttgattactcaaatttaattcattttttaaaatatttttttgtcttctttttaggctttttcctctgcttcttctcctgtcaatttcagcatttctgttgactttccgtcgtcctctccgattgattctgttgagccatttcaattgaccaacgaattcaccggggagcaattggtactgttacaagaaaatgcatatggttttgtgctcatccgttgtccaattgtgcccgatgataagaaacggcagaagttcaagaaggaattgggcgaccgatggaaccaaatgaaaattgccttcacagaccaattagttgacaacgggtgattaacaattttaacaaatccaatgtttatttttgtttttgtcttcagtcttctcggtggttcctcacctgggccgaatggtcagcagaaacagcaaaaaatgaaatgtatgattatttgaagtgatgttggaacttgccatttaaatgtaatgtagtcgtacataatgtatttgactttgctcacaaattcataaaatgagtttgttttaccaatattttgaaaaaaacgcataggaaacggcccccatcagttaaattggcctttttgactccctaaagaccagaaaattttccaaaaaatgattttttagcaaaattttcatgaaaaatattgaataaatttaaattttctcaaaaatggctaatttatgtcaaaaataagcgaaaaatttagtgtatctgaggaatttaattttaagaaattatacccttaatttggaagaatttatatccatatttttgccattttatgtccatatttcacgattcttggtccagattttatggccatactaaatatttaaaattctcacttttgttcctaaattgatcaaaaaaagctaaatttagtcaaaaccattgaaatatcaaaaaattgtaaaatgtaaaaatatttgaagcaattttgcaaaatgttcttatttttgacactaaaatctaattttttggcctttgttcttattttgaaaattttgagatagaaacactggattaatagacaaaaaacccataaaaattgactattctggcataatttataatccctaaatttggtcatttttagacaatatctgtgcaattataccaaacacatcattcaaaaaaattaattttttgtgagactttttggagctatttaaaagcaaacccccgtccccgtccccggggg

SEQ ID NO: 21460 - DNA, 2087 bp, Heterodera glycines
taaaaaaaatggataaattttaaaaataataaatgaataccttgtcaaagtgttacacgggtccgggactttgggaagcgagtccggcattcaaaaaaattcaataagaatgttgaacatttttaagattttttaaattaagtcgggtgttcggggctggaccagggatgacattccgaggccccaaaaattttcggaaatcggaattccgagagctcaaaaacattcagaaatctgaattccgaagcccgaatttttcggaaatcgggattccaaccccaagaatgtcagaaatcggattcgtgccatccctggtatggacccggtcgaaaacccggatttgtgtattcccaactccatgacttatctatatattttcagacttcttttttttaagaaaacccaaatcaagagtttatgcggcacttacaatagtgacgacgtgtgctgtcgagctgcctaccgtacttcagaaacttgccaaccgaccaaatgggacccagaaaaacaggcaatttacgacgcattgcgtgccgcaaatccagatggatacacatatgcctatgacgataagacggcaataaagaagtgctcatcatcttctgctgcgatcgtgggcttttgcaccaatgtgtgaatttgaaagaagagggagttttgaaacgaatgtttttggcaaaaaaattttcttttcaaatttcctgattttttctgtactgcttttttttctaaaacaccgacaaaaaatcgtcataactttctttaaattttaagtttttgaaatttgttccaatgttatagacaaagttacaaaaacaaaaaaaaaattgtaacgaaattttttgaaactttatctaatgagaaacgttatgacaatttgtttttgtcagttttccgaaaacagcctatcatctgtcacccaatcgttttccagctaaactttctatttcaatttcactaaccaaaacatttcttctgctgctggtaaaatttatatgtgaatttcatttcactttttggggagtgcaaatttgttcgaaaccgatttacattttcagaaaaattcaggtatattttattagaaaaaaaaccttgaaaaatttttactcttgaaaattttgtcagaggggggctgggatgggctgattcggcggatgaggggagggtaacggtttgatgccagaacgtaacgttttgcatctaaatttgacatattcaaataagtcgaaatgttgccaaccctggaaaatgccaaaattcaatggccaagcaaatccaatttatttgcattgataaatatgcaacattttccgcctgtaatcattgtcattttcacgaaaattccgggttttcattctgaaaatattcccgaaaacagcagttggccttcactacgcacaatcataaaattgaatgggtgatcggcaatgaattcgatcgttggtggccgtatgatcagcagtgatcgctccaccatgatcagaccggtggctgcagccgcttcacttccagcctcattattcttaatggaaaatcagccaatttttgatactaaagttttaaatggcattaatggccatgtgttttaaaaataacaaaaaaaaagttttaggaaattctgctgttttaaatcgcatttttttaaaatatcgaatctttaaattcgaataattccgaaaataacaaaatcagcgcaaaaaacccgcaattaaaaaataaattccatttgaacagattttttaatgtgtgagagaagatttcaaatatttaattaattcaacgttttgatcacaacaaatgattattgctgtgcatggatatgtcttcaatttgcgatttttatgattaatgaacgatcagtataatcaaatcatccgtgaaaaactgtgccgaaaagcatattggtattatcatcgccaattgccaagaaagcgaggaaagggtgatcagcgatgaagcgatttggggaaatgttggcactattggccacaacatgaatgccagtggcagctgcagcttcggtgccctgctcattgacctaagtgaggatcgattggtttatttggcagtgtgatcaaggcccgtgt

SEQ ID NO: 21461 - DNA, 1898 bp, Heterodera glycines
ccatatggggaaaacagcccattccacgttccgtctaggcagagaagtctcgctagacaagcttccaagcattccgcttgaaagcttctttgcccgacggatacgtgaggcccaactcatcatcattgatgagatcaccatgctgcacaacacggtgatagaggtcatcgaccgagtgtgcaaagaaatggcaattccccagcacaaggacctcctcttcggaggaaaaacggtcatattcagcggtgactttaaacagtcactgccggtcgtgcctcacgaaggcctaactgcacaagttacggcctgctttcaaaccaatccactgtttggtcagtttaccacaatgaaattgaccatcaaccagaggttgggccaagggcagcaagcgtacttgcaaatgtgccgccaaatcggcctcggagagaccggagaacacttctggattcctccgcagttcctcgtaaagagcagggaagagttgatagactttgtctatccaaacttccaacaactccttggcaatgacaaagagctgctcaatcgtttgattctcgctccgcacattgacacgtgtgatgagatcaacgaaatcatgatggcgaatgtgcctggtcaagtgcgcgaatatttgtcctcggataagccgcttgacgagcgtccactggacatcgatgaaatcgagtccgaagtggcagcgttgaaccggcgcacagactctgggatgcctccccaccgtctgcgactcaaagtcggaagcgtcgttgttctccttatcaacaaaagtgataaagaaggactgatcaacggcacgcgcatcgttcttgaagaacttggtgacgatcgcctggtcggtcgagtaatcaacagcaacgctgttggtggccaagttaagttcttcattgaaagaacacgtaatgtgtatgaagacaaaacgcctggcggcttaaaatatgagcgtttgcagttccccataaaacctgcattcgccatgaccattctcaaaggtcaaggccaaacaatcaacacggtcggaattgaccttgaaagggatgtattttcccatggtcaattatacactgccttttcaagggcaacggacggtaacaacgtccgagtgtacgctcccagaagggagaccgatgcacaaggtcaaaccaaagtgttgaacattgtggccaaaaacatgctcaaattgcaataaggcaaacgagttatagtccagcgtgtgtggcactttactgatgtcgccccgttctcatctgcactttaaacgcatacacatacaaaaagtgctgccacctggactaagggagggaggagggatgacgtgcgagttagggcacttccggtttccattgcactgataaatgcaatgtgtcagctcatcacgtgagtgaaaccaagtgcatgtcggctgacgcaaagaccctaacacaaggcctaggtagcgaagctcccaaagcgcgaagcgctttaagcacccaagaaacatgtaagcacacaccggctagttactatatatgttatattgacaaggagtttcgttgctaaaaccattttctcccggccgaaggccgggagcgccctgaaagtagtggaagggccttacaactttttgaggcgcatccgggaaaactatagagaaaaattctgcgcggacgactgagtcccagggacggatttctcaatttttcgtgcgtttgacggcccataactttttttctgaaactcggatcaaaaaattcccgctgtgagggcactccgcagaagtgtcctctataatccagtattttttattttttgatcagaccaaatcccggacctgtacagacacggagactcagttaatttttttttcccacttcagtaccaggcgaatagctcgtaagggtttg

SEQ ID NO: 21462 - DNA, 105 bp, Heterodera glycines
tataataacgctgcggacatctacatttttgaattgaaacatattggtaattactctttctttttctccatattgaccatcatactcatactccccccacccttt

SEQ ID NO: 21463 - DNA, 1080 bp, Heterodera glycines
  misc_feature (64)..(64): n is a, c, g, or t
aaaaatgcattatttataatagcaaaaatgagcgcatttaatccgtttaaaatgttaatacttntcatgaaaaatatttttgacgtgtatttggctctgttcagtttatgagtctaatcagtgaccatcctcacttttttagaccataacatttttggtacttgctcaatccatacattcttaatatgaatcgaaagcttaaagtttagagaagcttttgtatagtaaaattctgggataaaggcaaaaaaaatcattcttgaatatacgcgaaaaatgataaacttctgttacgattttttttcttaatataaatatttgttcttttcttgtatttataaattctcggaactttaagcttttgattgaaaccaagaaaattttgtgttgacgaaaaaaagaaaaatgtttatgcttttatgaccatttttgacaaaaaacttcaaattattattttttttaattcaggaagaaaagtttttggaagcaattcgccatgaaaaactcccactaaaaaattttgaggttcttcttagtcaagaaaatttttctgaatgggaatttaaacatcggatggattttttcatcacaaatacgcaaccttttctcgatttcccaattgttgagcaggaaattgcaaaagaacattcaattaatcataaaaatcgtgttatttttattggcggaatcacaatgccaaagggggcagtgccatatttgagtgaggtaattttgcaaatactgaaacaaaattggaataacccaagaattcataaaaaaaaaattaaaagataattggtcttgaaatggcgaaaatggtacctaaattaattgctaaatacattcgaaaattccaaaaaaaaacaaaattgggaaaaagaggaagaaaacaaaattccgaaaatgtctctgatagaatcgttaaaaaagttcaagctccggcgaaagtttttgaatggtctcgagtttttcatatgcaaattacttgctcaaaaatagatgtgaaaactccgtaaaaaaattttttaataatattttttcgagcgattggatggaaattatttacagaaattatccaaa

SEQ ID NO: 21464 - DNA, 1080 bp, Heterodera glycines
attcaattgatatggctaaagaatttttgacgccatttcgccaactacgaaaagctcttgagaaagaaaattagaaaaaatttattcaaaaccactatatatcttagattgttcgcctagcttatccattatgctgtaaattggccttcattattgagtttcaaaaaagttatggataaattattgtcgaaattttttggttatattattaaaattttactagattttttaaaagtaataaatattagaggacacttagagatacttttctaaaaacccaagatttgatatttgacgaaatttaagctaagttatgatttattatttagcaaataaaattaaaattaaaatttctcactttattatcattaataagttagattataactttctggttttcatctttggtttaacttctcttctcttcaatcaaaattaaattttccaaattttacaataaattttcctcccttcttcaaaccaaacataacattcattatgaatgttttttgcacaaaatgttttagcaataattaaccaaaattacaaaattcaattgcgtgcctccatataaaattcattaatattactaataaaattcattaatattacttaattgtgatttgtaaattttttgatatttttaaatgtttattcaattatttcactttacataaaaaaaattaatattttagtcaattttttaattaagccagctgtgtaaaaaaacggcaatttaagcattaaaaaaaaattgaaaatggcaatggcaataacaaattcagaatttttcttttcaattaattcacgaattttcattcattcatcagattagagagtttaattctttttcgcatattagcccattgtttgtgcatttttgccctaattgtgcacgttcgcccatccaattctatttttgttttgatgaaaatcccataacatttctcattggtaaataggcaaatattatgaaaaacaacaattaaattaccaaaaataacatatactatttaatcaaatatttatttaataacatttaaatcccttctccaacccttgtgtaaataaattgtgtgt

SEQ ID NO: 21465 - DNA, 978 bp, Heterodera glycines
ggcccacaccagggctgggacgcgaccgcgatccgcgatgcgcgatccgcgattcgcggcgttttttttgcgcgatccgcgatccgcgaccgcggcaatttgaatccgcgatgcgcgatccgcgaccgcgggatttttctgtgcgcggcgcgccgcgcatttttcagggcaaaatttttataaagaaaatttattgaagcgattttcttttttgaatatttagatttgaaggtataaaattttgaaaacgaccaaaattccaattttctcgcgcatttaaatggaatatgcaatcagaaaatatttatacattcatcgttcattttatagacaattttcctctttgtaatttagaccaaatgaccaacgaaaaagactctatttggttttattttgacaaaattcacaattcttcttatgccaaatgtaagattgagcttaataatcgcaaaaaccaacctttttttgttgaaaatctgttaacaaattgcacccaaatttttaaaatttcccccgccggcgcctatcggcaccgccggaccccttctttcccaaaagttttttgaaaaagcgctccgaaaaaaagtgatgtgaaaatcaaatctgaatttctattaatattcgatgatttagtccaaaaatgattgtttgaaataattgaagaaaatttgtttgaaaattttcattaatttaatttattaaataaaaaaccaaataattttgtattattttcacttgatataaattaaaatttgaattttttttaaatttttaaaatttttttgaatttttaaaatttcccgattcccggtttttcttgcggtcccggtcccggtcccgaaaaaaaatcgaggtcccgaagccggcttctcacgtcccggcaagtcccggtcccccgaaagggaaaaatttcccggtcccgtggcaccctccttttttggttgcaggattttttttggaatggcctcccaaaaagtc

SEQ ID NO: 21466 - DNA, 3090 bp, Heterodera glycines
aattttctttttttcttttttagaattcatatgattactattttatatatatattattttattttttaaattgttaatttaaataaattgaaaatatattttataatacattttatttttaaacttttgatgacttttgctattaaataattgattttaaaattaaaaataaataaataaataatttttaatttttaatttttcaaaataaaaaaaacattgccatcgcggcacagatgcgcatcagtgccatccatgaagcaattcgggacgacgatcagatgacgctgaagcagctggtggacgattgggacacggccacgggacgggaccaacacgggcggacaccgctgcacatcgccgtgggcatgagggagcgggggcgggagagggctttcggacaatccgtcattggacaatcggtcatgggacaatccgtcattggacaatcggtcatgggacaatgcgtcagtagagactatccgtcagcgacaattattaaaatcttgcgattgcgattattcaatttaatttttaaaaaattggatttcaatttaaattaattttgacattatttatataaaagcttaccttataaatacagattgtccactgacgaattgtccgggagccaggggaagcgcgacgagagtctcgactcggtccctacgattcgagaatttttcgggaatttttttatcttggtctcgggttttcggggcaaatttacattgtctcaattcttggtaaaattcatttcctgcacctttctaaggagggggaggcggtgccgttatggggaaaatgccgtggagacggcgcatggactacgaggactctgattttgatgaaatgccctccaaataatccaaaaatcaaaaacatatgaaatattaaatcccataaaataaaaaaaagaaaagaaaaaacaattaaattttaaaattttaattttttcaatttaaaatattctgccggatcctgtaatattgactccgaaaatggttaattttcataattttgttaatgatacgtgctgtgccaatgaataaattggcatgggatgagcgattaaattaacacacaaagaaaatcacttttcaatttcaattaaggtgttgcacggacgggcacgtgcggcgcgttatttgctgctgatgttcccgcgttgtgtcaatttgacggacaaggcaattaaattaattggaaatagccaaattaattaaggatgaaagaatttttatactagaataaaaaaataaattgttattaaattgctaattaataaaattattctaatcaaataaaatttttattgcatatatttcattattctaggataaaattcaactttcttaatatgtattaatccaatcatatttatattcatattaatttagatttaaattttaattttaatttaatactttaaagcaattatctttgactctttaaatatttaattaacttattactcatcttaatgctcccgactttttttttacaatggcattttctgccggttgctatggcaaaatgcaatcattcaaattcatatgaagaattgagctgttcttccattttttctcatctacatatttacacaaaatcaagagccattttaattaattaaattaaattttatttttattaaattttaattattttaggcctcccgttctccgcttcattacgccaggcattcattcattttttcaaattttctttatttttcgtgtccagttgtcttacggacgatcagcaacgtgcgcaaatgacgcgcattttgtgccgtgccggcgctgagtcggcggcgacggcgacaaaacggcacaatgaaaacgccgcaggggtaaaaaaatggctttcctaaaattggggcacactgaaattgcttaattaccacacacacacacacattaataatggattatgaatttctcattccattctctcccatcagagaatcggatcctgcttttctgaggcccttctaacaaattcccgatctcgaaccaatgtcgagcatcttgaaaatccgagatttcaattcatccgattcaatgttcaaaatgtaattcgcttaaagtctcaaaataaattttctggcggttggaatttcaaaatttggtggcttttttcggcaccaaggctggacgaatcaaacgaaaaaaagcctaaactttcgaacccaaaacgccctgcctgattggcactctcgggctcccagttttttcctaatttaaaaatgatatcacttatatatcatataggacgaacatgcaacgaaaaaggtaaaaaaaaattttttcaattaatttaatcccaaaaatgtgtccccccccccccccccattagcactaatggcttttggtcagaggcgttaaatcccccccccccccccaaagtgctaatgcctaaagcattcataaattatcggaaaaggaggcaatttttgaagagagtttattaagaaaatcgagagggaaaaatgaaaataaaaaaaaatcctttttaaatttgtcatacaatttaaatgcagctattaattaaggtttttgaacattcttcagttttacaaattcacaaaattatttaaaaatatcatttcggaaaaaataacaatatttaaattaatattgaatttttatttcctgaattttatgatttgactggagcaattataaaagcaaaaaaaaaattaaaaaattaattttataattaaaaaaaaaataaatttagcgtcacactgaagaagccgatgacatgttggtgttgaacgaacttcatcgacgcgacggactgatcggagaagaagcggaggaggaagaggatgaagacgatggaggaggaggagacgttgatcagtctgcggatgagatcgaatttgggcatgttgcggcacggagattagcggcgaaagcgaaaaacgcggcaatgatcaaagggtgggtgtgggctattcggctgatcgatatttattgattgattggttgagtgatcggtcaagctaatgattggttgattaattgactggttgatatctgttcacattcgctggatgatgagctgatcacgatttatccaaat

SEQ ID NO: 21467 - DNA, 1723 bp, Heterodera glycines
tttttcagtcccgacaatccgccgggtggcgtaactgtcgcgccgtccccccaaacaatgggcaaaggtcggccaccggcagcttgccgggacagaaaacacttttgcgccacttgggccaagtccggcttttgccgtggcattttcctctcctacatgaagaagaattgcagtgcctcctgtggatggtgctgacagaaataacaaaacaactcattaaatggcctctttcttatttattgcaaattttattatttatttttgataaataaaagttgaatgagagtgaatatgtatatatataaaaaaagccaacataatttacaatatacagagtaaattgacttgaggtttgaactggcacataatgatcaataaaaaggaatgaaagaccaatgatcaaaaagaaacggtcgaagaagggaaaagagacaaaaatgatcgaatgagtcaaatacccccgatcgatccctctcctcgaccatccattagcatttctgcccgctcttaatttgggttcctccgccggcggtgccttcgtcgcatttgtccatcgcccgttgatgaacccgttggtacataatcggcttgtcgtcctctctgcagcccaggccgaccatcagcaaaatgcaaaagctgttgttgcacatgccgctcgtcaaagagcgaaaggcgtcgtccaattcgcacttatccatccccgcagggcaatgcaaatcaatgagggcaacttcgaattccatcagtgttggggccaaatgggcacacagcgaactgagctttactgcaccgtccacatctttgagcacgcaactgatcaaatggaacaaaaaagcattggtcgaagcaaagagttggaaaaacaaaacactacttttcatttttttgaaagaatttgtccatttttcttccgaccaccagcatctttttgcctttccgtcccccgtgcaccgacttgaagcaatcgctcaatgtgctcgttttttgcattgcgttgtcaattcggacagcctcgcttcaaagcatggaattatttatttagatatatattcgaatttaattacttgaaatcaaaaaacgctgctattgttgcttcttcgtctgctgttgtgctgccctgcactctctgtctttgtgtgcttctccctgctgcctctgtttcaaccggtggcacactcttttcttttccctctctctcatcacaatttacaacttcactttcgcttatttcaactgtcttttcctctatggttagactcacaagttccttctctttctctgctgtgtcgtctgtcagttgactctcttcgtctccccttttctttcccttcccttcactctctgtttcttcattgccatcacttcctttttcctctggcttctcttcctccagtctcttctcttccgccctctctttttcactgtcttcctcaactgtttccatgtcgaccaaatctaatcggaaaatctcatcaaaattaatattgctaaaatttcaaactcggattctgctcctcttcttttgtctcgatagtctgctcctttttctcaagccttgtcccgtgtatggtcattccgttgtctgccgcccattttgcaaaattccagccgagtgccacattcccaaacaccaacctgaaaagaaagggcgaataaattaaacaataaataatggcgatgtttttaatttatagtaatgaatcaaggaattttaaaatgccaa

SEQ ID NO: 21468 - DNA, 1502 bp, Heterodera glycines
tttctttgagttttttaattgtttcccatttcgcactcatgtgatttctgaaagaggagagtgggaagagagaagacaccataaggaatttcaggaagatagacagtcgattttcattgaaaatccacacaataaaaggaatgtagcgagtagcgtgcgagaagatgggtttaaaaagatatgtgaggagttcgaaaagacagctaatgaattcggcctaccattaatcaaggaagtaaatgtccttgaagaattaggaattgatctggaaagggaatgggtagagaaaacggcagtctcatctgttgagaaaagtgaattgttagaacgagctaaccaaagtcgagaggctgaagagctcagtgacgaaatggtcaaattgaaggtcatcttaaatgaacccgtgtctcaacacgaacaaggtaagagaattgagaaacctggttctaaacaccaccaacgcatattttggaaccaaaaattgtctcaacaattttttatagttctaattctgtccatgataagtgcaacaatttcaaatccaatgctttgtcatcatagggcacagaaaaattatgatgtcagaatagatagagacacaacccaatgcaaactaattgccaatttgtttgacgaaccccaacgggaattggaagttgacatctatcaacccaattcagaaccgttcacgtttaaggcacatcggtgtctaaaggtcaaacaaagtcaaaaattttggaccaatttactaaacgataagttcagtgacccggttagtgtttccaccctcccaacgacaattgaagattgtcaagaaatgatcaattatgaaaagtgtgaattcggacctctcagtggtcagtcaaatgaacaatttcatacaaaccaagaattgcatatagactattcctggtggaaattcggaaaagacaaatccgaggtaaataactgttatcatgcgattataaccttactaggaaaaccgggatccgagagtttgggctcacccacagaggaagtgagcaaatgcaaattttcaaagggttcatgtcgattaggagataatgcgattctaatttggaacctcgattccactgagcatcaaagagcgtgtctttacaataaagtaaccacagaaaatgggaaattcaccaagagaatgtggatatcaaaaaattcacagttcgctctatcattccaagaaaatgctaagagtgtggaatcatgcggtcacacgcttaaattaagcgatcaaggttttgcagtcccctcgtggcaatttaggataattacgggtaagacaacccataggatcaaaagagaacaatggtggccaagggaaaaacctttagaccagaacgagaaagctcaacagcagctgcacaattgacggcaagagctatttaccaaaataaagaaacgaaaggaatatttcaaaaatggtgaatctgatttgtgggtatttgcaaaatgccaatcaaagcaagatctcagtcacttaa

SEQ ID NO: 21469 - DNA, 2009 bp, Heterodera glycines
gggggattgtattggattgtattgcattggattggatggattgagttaggttgggttgggttggattccgctgccgacccggaggattggatttgtgcaccttcgggataaattgggcgcaggagacggacggcgttggatcgtcgtccattcttttctcccccccccctttccttttcttccattctctcctaattcggtcgcttctgccaatttttcatcggcacgtttaaaattcagccaactcatcagcatttttcattttgcttcttctgctgccgtttctgagttttgttctgctgcttctgcttaattctttcagccagaaataaatgagtctgtccattagaagcagaagcatttccctccccctcctccctcttcccgtccctcctctcctcctttctctctccctcgtgctcttccgtcgctgctccttttcctcttctctctcttcttcttcctcctccgttctcttctgtcgctactcctcttccctctcttcctcttcctcctcctttcttttccttcgcctgctccttcttcccctcctcctctgccttcttccgacttccttttgctcttccttcggctcgaccaccgcccaatgccccgacggccatttcctctcgcgcttcagctccgcctttgacggaaatgaacgcttttacaagttcagctgcgccaaattccacgggggatggacggcggcgattttagaggaaaaatgcgaagcgacggaaatgacgcggatggacgacgggggcgacgcgtatttgagctgcggaagcgaaaaggtagggtaggaattgaactgtaacagtacgcctggctgatctgaaaatatgggtgatcacagaaacaaaacgaaattaaatcatcgaataatcttttggttttctcttttaaatcgatttaatctaatttatttttaaataatttcttaattgtccccttttagtacaccgccggtgtccgcgtggtcgaaggtgcattgtccgtcggtgaccaccaccagcagacagctgaatggtggcaacttttgtgctgccaaagtgactctgttcgcgttcgagcggaggactgtgtggagacgaagttcatcaacgactttcggcgttcctcctcgttcagttcgggcgctcaagtgatccgcagatggcaggcgatgttcgaaaacgggtggcgaaaagcaaaattaattaattaatgaattaatcactcatttgggaatccgctttttctgaagggaccgtcggtggtggcttcaaatttgcccggtggacgtggcgttgcccctcaaaaaacataaaattcgctcggatggggcggaaatgcgcgcgcgcagagaaattccgttggaatggcgacggactcgctttccgaccacgtccattcaggtgaccgttttggcattggcactatgccaccaattcggctcgccatgcattttgttttgatcatttagcatttccatcactacactttcgctgacgaaaatatggcggcggactttcgccgacggcgtgcagaaattgcaaatgcaaaagtgaattcatatgcggtgccaacagttaacgtggaagaaaatggaaaacggcaaattatgacaacaacaattgggaaaaagtcggaaaatacgactacggcacgacggaacagcacatcaacggaacatcaaccacaaaaagttaacggataggagaagacgagggggggggggggatttaggagaaaggacaattgggacaaattttggggtggacaaatggacaaatatgggcgtggacaaatggacaatcgggagagaggacaaatggacaattaggagagtggacaaatggacaattgggggagtggacaaatggacaattgggggagtggacaaatggacaattgggggagtggacaattgggacaaattttggggtggacaaatggacaaatatgggcgtggacaaatgtacaatcgggagagaggacaaatggacaattgggggagtggacaa

SEQ ID NO: 21470 - DNA, 1149 bp, Heterodera glycines
atatattttcaagtgggagaaggaaaggattgctgaacttttaaaaaaacaaaagcagttgaagatgaacagccaagttacggtttgaattaaaaaaattaaattaattttattaaaaaatggattttaatagaaaggctctggagattttgttaaaaatccaccggcgacgggaagtccaataaaaaaagttgtaagtaaatttaaacttggcatttttatggtttcgaattttttattattaaatattcctctaattatgcttatatcattttttctaattatcaaaaggatgtaaatgacgtttttctgcgctgttgcagagcgaaaagagttccaaaaagttgtgaaagccgatgtgtgggttgaaaataaaattttatttttttttcaatccgatttagaattttgatggattaaacaagaaagttttgactggaatgtttttgggaagagataaatgtccgacggaaaatggtagaaataatctgtaaaatgaaaattaattcaaatgatagaaaattttattctaaaaaaaaaaaattaatttttaaaaggatgatttttttattacattattatcatagggtttataaattgtatgattttgcattttttttcggagcataagctatgaagaaaggggttcaaaaatggggaccggtaaattggacaccaagcggaaaactggacaccgccggaattttggacaccaaaggaaaattggacaccggaaaactggacaccatcctaaaataaacccaggaattgagttgaaaaataaatttgggtagggtaaatggattaataattaaggcacttagaagtagatcaggcattcaacatgcaagatgattgatcaatgtgccaaaaaaatgcaagaaaaagggcaatgattggtcaatgtgctaaaattgcataaaatatgggaatcctatccaaaaaaacttttttctttatggatgttatggttgttttcttttgctgaagttttatgtaataaaaacattatttatttccgttttattacgcttataaaaacataagtatgtgcagactaaaataaaatcttttggccaaaccaaaattttgttttatttatttatttttatacgatagtgtccacttttcggtgtccaatttaccggg

SEQ ID NO: 21471 - DNA, 2395 bp, Heterodera glycines
atttttgatatatttttggaaaaaaatcgatttttagggatacatttcaaaataattttttttaattttttacaaaaaatttctataattctcaaaaatcctcaaaatatgtaaaaaaaatgaaaaatatgtacgaaaaattgcgaaatatgtacaaaaaagtccaaaatataaatatgtacatatttaatatgtagaaaaatccgaaaatatgtaaataaataacttttgttcgcaaacacaaaaaagaaagtgtttttcctactaattaaggctatagagaatccaggaaaaaaaacatgtatttacataaaattagcagccctagccatcaaaaaccaacttattatcgataataatgaatatttcacgtctcaaaatgataatttcagtgcactagatataaaatttctgaagtggaaaacttgtttaatggctttcacaattttaacacaaattattaatattttggcccatcaattaagttaatttaatcactcaaaaatggacatgataattaattatttgtgagatcgcgtcttgtgctgttgcggttgcttttcgccgcttcctcctttgccgttttcatctcgcggctcgcctctgccccggcaattggccaccagtttctggaactcctcctccaatgtccgtcgtgcgctgtcactgtccggaatttgtaaaatgtgtgccattgcgggcacatcaaatgttccgtcgagggccttaaagtttcatgaaatccggataattttccctttgctaccattagtgcgccatggacgcccgagtcgacggcatttacaacaaatgcgccaaggccaatctcttccagccatttaatgacccgctcatttgaccagaccattagatctaattgcaaatcgccaattattaattgcatttcattgaattccctctttttcacctctgttgacgttttccgatgcgtttcgccgttcttccaattgcttccgatcataattcaatttcttcaggcacacaatgccgtagtgtaagcttgtccttgaaagaaccatcaaaataagccaatcaaaataatgaaaagccgaggataatattttttgactttttcattcaaattcttttcccaccggtgaaaactgtcgatcattttcattttgctgagatctcttttgctcaaatgttccaacattcgcgcatcaaccttgaaacggaaaaattgatagtaaaaaacaacaacaaaaaaacgattgaaaaagatgtcgtccccgggggatttgagtaccctaattttacatgaccgggtccgatttgggcttctgagtcccatacaaacgcgaccctcaccagacactccatgaactcggtacggtatttgccaagaccaagtgaaggcaaccattcgttgccaacccattcgtggttcatttcgccgaatgccatgccaaagcgcagaatttgcggggacgagggcgaggttaaagcaaccttttttgaaaattggaacgaattaggcaatagttacaaaaaaaaaatacaattaccatttcctggatggccaagcgcaattttaaactgaaatatgaaaaaagttacattttttgtcgggggagggaatggatgatgtgggaaaacatagggaaaacataccttgcgcacccccccccccccccccccccggttacgctcccgtgagataattttatgaccacccaccgatgcagcggatttgatacaccgatttcgcgttgaatctcttggtcagaaagtgcagacattatcgaaccactgttgtggacataattaaatggtaattaataagatttgtcaaaattaaaaaaggagttttaccttttgacattggccctaaaattaaatagtcatttacattacttttgttctctaaactctgtcaaatgcacctgcacgcctcggtgtaccaacttggcattccgacccaaagctcgagccatgccaccactgtaggcccattccacagcgcaaacggagtacgggccttcatagcctgaaaaaaattgtaaagaattctaaatgtgccaatttgttgactaattatatgcgattaaaataataatgctcgagatgtggttatatggattctcagaaatcagagattgaaattaaataaaaataaagaaatataattagtttattcaatgtttcttttttctcgagtctcgactcgaggaaaaccttacttcctcgagcagttcatgctttttcctcttccgcttgtcataatcggacagtgatgtcagtcgatgcatcgattggctcattttggcgcctccatttggcattctgtcgctgcttccgcccgccatgccattgaattccgtgccgccgccacattccgagtcggacaacgacacattctctcctccgtttg

SEQ ID NO: 21472 - DNA, 2867 bp, Heterodera glycines
aaataaaggcaaaatgccaacggacgagaatggggaagcgaagagcagcaatgagggggagggggagcaattggcacaacgacagcagcaacagaataatgggtgagcaggggaaaatgggggcggcgggaggagggggatcccgaccacgggatgaatgacgcaattcattagaagtgttcatttaaatttaaaccactttcctaccgtattcccaataccataatccttttaccgactgtctgctgatactgtgtcatctcgtcctttctcttttttcttcgctttggtcaatccgttcaaaatttgagtgtctctttttcattttgtttcttttttgtaatatttttaagaattcatttgctttatccccgcagtgaaaggcttaacgcaaacaaaaacggatcgccggtctgatgcgctgccaaaagtgtccctttgacattcacttacgcattttcacacttttaattatgcttttcgtttcattggctaattaattattccattaatggcaattggataaattgagcttggccttctccgccatttcattggttttttttgcgttttttcatttctaagagacgaaggagtgattttgctaatcagcacaatgtgccaaccattgctcacttctccattctgaagaaatgttaaaaattaaagagaaatgcccaaaaatcagtttttctccactcatcaataaatctgtcgagaattactactacaattaagcaatcttcatgctgtcttttatcagtcgttctgttcgtgtccccatttggggcattccctccccctccttttcttccctttccccccttatcaccgctccgttcgtctcgtctccccccccccctttccattcatagttctgcaaattcatttcattggaccatttttttttgcctggatccaacattaaaaacaatggcaaatcgaagtttgtccgcgtccattgagccattggtgctaaaatcagcggacactgacaatgaaagcgtattggaagcaattgaaaacggcactcgatgtcaaaggtcagttgtgattttggcattttaatttggcactttctaaagcattcggaatgccaatgccaaggcactcttcgcttttctgctttctcttgtgctactttccctcggcggtgttctgctcattttgttagcccacgccccaaatcagaactaattggtaatttctatcaattttagtctcctcccttctctcatcaatttgctaattcaattctgccaatttaaacagcaaattaattatccaattagcgaattaattaatgagacgaaaattcgccaacaattcgaagaatttgaacaaaagtaataattagcagaaaaccaaagttaaaatgaaaatgaaaagttaagctttgcaagaaaatggaagagcgaaagtgagcgaagggcgaagatgggaatttttggacgaaatttgcgtcaaattgagcagcttaacgtaaaggcaaaggaacgtgggcaaaatgttacgtatggggtgaacggattgacagacattggggagaaggaatggcaaaaagtaattaggggaggtgcggttagcatgccaaaacaaacattaattatgaattgatagagcaattaatgaaacgaagggagggggaactcatttggaagctaattatctcatcaccaaacaaagacgctttgtccgcttggtcccgctgaaagagccgaattcatccgaaaaatggaacccgccttgaaaaggactttcaaaaaaggcatcgattacccaacgcacttcgactggcgcgagaggggcgtcgttacgccggtgaaagcgcaaggtaaaaaaggagcagaaagaaattgggatgaacagctgccaattcgcaaaaaatatgccccgaaggtttgtgcggctcgtgctgggcatttgcgtcggtggcaaccacagaatcggcctacgcaattgcgcacggggagttgcgcagtttgtctgagcaggagttgctcgactgcaacttggcgaacaacgcatgcaaagggggcaacgtggacaaagcgttcaggtcgggttggacaaacaatactctttggaaaagcaaaaaagcacaggttcatccacgacatcggattggaaacggaggatgaatatccgtacttggcacaccgacagaatgtgtgcatgatgcacgaggggaaccgaaacttgaccaaaattgatgtggccgtgttcatcaaccccgacgagcagtcgatgatcgactggcttattaatttcggaccgataaacgtgggtctgtgtgaattagcaatgtcagttcaaaaagcaattccaattatccccttcaggaatttcggttcctcccgacatgaaaccgtacaaatcgggcatttaccatccgtccgatttcgactgccaatttaaagttcgtcactctgatgaaacttttagttttattttcatatttattaggtggttggcctccattcgatgcttgtagtgggctatggagaaaatatttatggagacaaatattggatagtaaagaacagctggggacaaaaatgggggcaggagcacggatatctgaactttgccagaggggtcaatgcgtgcggaattgaggacgaaccaatcggactgatggcgtaaaggaacggacggaccaaaacatttgaattgaagagaacagaaaacgaacaaacaaaaattgaagagaacagaaaacgaacaaacaaagttaatgacaaaatttatttttgtattgaaattttaaatacgaaaatggaaattaattggttctattgtattacacgtccaatcgatgacctatgtagtttcttaggccataacttttttcttactttgtcaat

SEQ ID NO: 21473 - DNA, 2380 bp, Heterodera glycines
tttttaatgacattaatgagccttcaagaaattttatattaaattctttagcacattttaccgtgatagggggatgttctttagcaaattgccttctcaaagccaaatgaaaggcttcttgtgcattgttagtacgtgccaaatttgcaatgattgaatcgtgatgattccatgaagttggcacaaacaatggatctgccccatttggccgaacgacataagttcttaaaggactcattcatttttccaacctaacctagattttatttaatttcctaatatcagtggacctgccaaaatagtcaaagattgaatccgcgttgttttggaattgtaacaggttcattcttgctctcaaaaggttgaaagcaggttgaacctgttcaacccttaaaaatgagagtgcagtaagactgcgaactgcttgcaaaaacgcgtttctggcacctattattgcataaaacaaatacatttgattacattaccaatttcgaaatccaacatgagggtttgtggtgcaatttgaatgtgattgtttaaagcctatttatgagttttttttgcaaaatttgttctacaccaaaacctgaaaagctctgaagtaagtattttgggccttattttgcattaaaatgtaagcgcttgcaaaactagctgtttcaattaaaacatttatggtataaagttgcaatagctgattcggtacaactaaagcagaattttgtattattattcattattgttattattatttttattatttttttgattttatttttttgattttatttttttgattttattcattattgttattattatttttattattattatttttattattattatttttatttttattattcattattgttgttgtgagcaattgccacccaattgctaccctttaccaagccgccaaaacactaaaaactctaaagagtgcgcatattttaacaagcgcgacaatcggtgccctcggtggagcaataactgcacaattaatcgaggacttaatcgagatgctagtcgaaaaatttgaaaataacggtattataatcataaataaacaacattaggttaggtattgtttcagacgacatggatttgattgagccgcttttcccaattcttttcactctcgaaaagaatgaatttttgctagaatccaaagacttcaattattcacattttttttcaatgattgaagacataaccggacggagccatgttaaggaaatttgcttttacagtaagaaattttggaataattaaatttaaataagtaatttagctaaagatggtggggatagaaaaattggacgatcacgaaaagcaatggctatagtgcttatgtatggtttgatgaatggaaaaagtcttgagttatttttatgttcataagttgtatttgtagaagctgttgttgggccttcagcaagccaataaaataaacatattatagctttatcatcctatgctttgcttttttctccttaattgtgctttctatttgttatttattaatttattgctgtgagctttcttatttggtgtgtctacggaagggccgaaacacacttaggatttcaaatttgtaatacggaagggatcgtactgacgaggcccacccttccagttaattttttggcaaaagtatggtccgcaaaagtacggtccgcaattgtcgtccgcaattgtcgtccgcaattgtacggtccgcaattgtcgtccgcaattgtcgtccgcaattgtcgtccgcaattgtacggtccgcaattgtcgtccgcaattgtcgtccgcaattgtcgtccgcaaaagtacggtccgcaattgtcgtccgcaattgtcgtccgcaattgtacggtccgcaattgtcgtccgcaattgtcgtccgcaattgtcgtccgcaattgtacggtccgcaattgtcgtccgcaattgtcgtccgcaattgtcgtccgcaattgtccggtccgcaattgccggtccgcaattgtcgtaccgccgagaattgtgaacctttaatcaaataaataaaatgtataatttttaatttattgtttaatttattaacatataaaataatgacctctgcttcctgctgagttccccttttatagagagatttgatgttttgattaatttccaaattgttttataaaattaaaattattcctaccataaatcttaaattttatttaattatttatttttattttctctcttgccataaatttttctttattcgaatttaaagacgaattgaattattcaataaaaaaatttaatcaattcttttttcttccttttcgaaaaattaagaaaaattatttaaaaattaatataaataaagagataatatgttttaagttaa

SEQ ID NO: 21474 - DNA, 1999 bp, Heterodera glycines
cgaagtgatgcatcctcagatgatctcaatggctgtcagcaacataaggcattgaaattgctctttcgtgatggaatcaaaatcgaagtctttcagcagcttccggtgtaggttaatgaactcgccgaaaatcttcaccattatcggcgagctcgcctcgaggcactcgtatcggtcaatgaacaccgattgaggccttgcaaataatttttccattttcaaaattgtctcgtcataattgaaatcggtgacagcggatgggaggacggagcggctgtattcgcagaatgcggactcgcgcctcgctcaatttgttcacgaggcatttgacttttgttgcgtcaatggcattcggtgccgcgcagtccagtgcgaatttgaagcgggccaaccattccgaaatcctgcttttgtcgtccgttggttcaaatggatgaacatctggtagtgacggaattgtaattgtcggtggagcagcagcaggtgcagcattttgcggtaattgattggccaaaagttgttggaccaattgctgctgctgttgaaggaccgtgatgagctggtccaatgtcggagggttggcgtttgccatttgatatttgacgaattaaaaactgcacatagcagaaccaattccaacacgaggaattaagttttttgatgaatcagcgaagtcagaaatcaacacgagatttctgaacttcccaaaaatgaatttattcaacacgagaataaattccaatggacgcgatgaatttgcgttgaaaattgttcgattgaataaatggtcgaacaagttcgaaataatgacgggcgtcggcagtgttaggaccacaagtccaaacaacaaataaatttattacgcaaataataaattacaaataaatgcaaaaaaacgggggagcggagcagataaaattggggaaaacaaccgaatgaataaagccatgaatgggtaggaataattgggaagggcaaaggtcaatcaataggcatgcgtgtgtctgtctctagcacgaagagagcagacactgcaaaaacagtgatgcaaatgaagaagggaaataaataaatcgggggcaaaatgtgcctgcccgaacacctccccttttaggctgatcagttcatggcccgggtgaaaagcggttcggtttacgacgttggcgttgaggatagcgtcgttgaattgggacgtcctcaattggagcagccaaattgtcctgaatgggttctgccacctcgttttccaattgattgggccctaaattggcattttctgcgtcgggtggttgattgggcagggccggaggcaatggcaacttaaatgcctcatttaatatggccaaggactgatcaaaattgtcggctgtttttctgttgcgcaattgattggcgtgaaaacggccgaatgatccgtcgggaaatttgacttcaaaaatcactccagatgtgccgctgatcactcctgtcttccaatgttgcgaggagcgatggcgagcgaagactttctcattcaaaataaatcttcgatttttggtgccaaatttcttgttgaattgcctttccatctccaaatcaatttcaaatggttagtgtggtggtggccgaagcagatcaattgttgtccttggccttcgaccgagcagcagttcagcggggcacttcaagtccggaagtgaatcgtttggggtcgtccggtaggtgatcagaaaagtgtcgatgatctccttgtttggcttcccttccccttttaattttctgaatgctctcttaaatgtgtcgacaattctctccacttgtccatttgacattggattatatggggccgaaaataagtgtgtgatgccgttggccgcaacgaatttggcaaattccgaactggaaaattgcgtgccagtgtcagaaacaattgtttctgggatgccatggcgcgtaaataaataacgcaatttttcgattgtggccgatgctgttgaatttgtcatctcaaatacctccg

SEQ ID NO: 21475 - DNA, 1334 bp, Heterodera glycines
ttttgaaccttaacgagatttttcgaattttgcaggctaatagagggcacttagggctatcgaatgataccaacagtgttggatttgattgacaaataaaaaaaagttatagctaaaaacgcgggctcgtatgaaaaaatgggtgtcgcgcgcgatacgtctcatcctccgttataacgacgtcaagaacaacattgtccctcaaaaagaccaaaattatttaaatgtcaatgtgaatcccgaaaacgttatcaatttccttgttgatattttccgaaactaagaaatgcgacctttgtttattccagagaattttgttgttttctattaaattatgaatttttataaaattttattttattttttattcattcgacgaacatccgatccatttcaatgcttaacatgcacttacgcgaaaacaccccatgcgaaaatgtcctggcccgaacaaaatgatatataccaagctttttatccaatccccaaaaatcgttgcaaaaatcatgaaaatgcacccccctaaaaaatgaaaaattttctcaaaaattcatctccaaaaatttatttttttaattaattaaaagcaaatttcaatttttgctgctttaaatcttcatttttgataaatattttcttaaatattttgaaaaatcgcgaaataagggcaaaaatagggggcgaaatgtccaatagggataaaacattttaggggcaaagtcaaaatagggatttctagggtcggataggggcgttaaaaccaaaaattcccgaacaaaaaatgtgcttttcgtgcatttctggtcgagtttaagccgcagaaataagtaaaaacctaagaatcctaatcctactcatatgtaataagaaatacggcaaaatttaattacatttttagcgttaaaatacattaatcatatgacctaatcaagacaaatgaactgttgttccttcatcctccatgtctctatgaattttatatttttgccaagatttcactggctgttattttgcccacaaattgctaatttggaaacgttgaaaaattaatttgttcatttcataccgtacaacaaatcgattagcaactcattaataaaacagccatgccaaattggtcagactagtgagaaagcattgagttaaattaactaatagcaaaagccaacggcaacattttccaatcgatagcaaatgaccccaaaaaaaaacaatttcacacaataacaaagcacaaaacgcttgtcagtgagtgagtgcttctgctgctgatgaagtgcgactgggcggggggggggacagggacgggggacgattgagaggggggggggggg

SEQ ID NO: 21476 - DNA, 1173 bp, Heterodera glycines
ttttcgacaatcaaaaattgcttttgctgctcacccaatgcaataaatatcccacaacttaaaccggatattgttcaaattggcacccgaataattggcatgccggagcttaaatctgatattcaaattggcacccgaattttagcggtctttccacttaactggcgccgtctccgtctccccaattgggcaccgttttaacagccaattatacaatgatccatcattgtattcttcgctatatttcaatgtcagcttctcattcgtcatttcgttcaccaattcaaattgttcaattgacgttggttccataaaaaaataaagttgaatattgtaactgacagaagtggtggcacggcgaaatgtctaaacaaaattggtaaaacaaaaacaatttaacaaaaatatggcggcacacctctttgaagttgttgacccattccagtttcagtggacccacataaccattgcgatacaatcgcttcggttggccattttttgttggagtgtgcaaccatttggccaacgcttggccagcagttgcatttggcccatcgtcagcaattccatcggggaacagataaccagaatcgatcgaattcaattgaacaagatcagcgagaattgttgatgaaatgcggcgacgcaatttgtccaaatcagcgccacaaaagccaaaatggcgaatgttggtagcaaaaattggccaaatttgatggtcaaaaacatcccaaattgactggtgacaatattttgacaattccaaattggtgctaattctgtcccaaatttgcttgttggaatagagaaattcaatgacggaatggtcaatgtaactgaagaaatataaaaaatgctttaatatatacaaaagtataaaattgctttatctgaagcttcttaaagcgaattttgatgggcagcggacggtccggcaacggaaaatccacaaatttgccatccatccatacagacagttctgattttggtcctttgcccttgtgaattagtatccatttccaaagtgtcaattccgttttgccatcaaaatgtttgtccaccagcgcatcaaaacggggcgaaatcagtgccattttgaggccgagttgaggatggtcaaaatgagggaaaatgtccatccacacgtcgttccaaatccagctgaaatgcgaa

SEQ ID NO: 21477 - DNA, 1893 bp, Heterodera glycines
tttacagtaccaactttgcccagttcagtccccgttgaataactcattaggctttgacctgagcgcagggtggccagcagacttattgtagagctcggtgagctcgatttttccaaatttaaaaatttcgaaaattttcaaaatttttcgagctaggcctaaaaaacggtttttgggtttttgaattttaagaatttttaacgaattttcccagaaaaacgaagaccacttgcaaaacatagtttttcgagctctatcgactggtatttttttcagaaaaatttcgattttttcccggaaatagaaaaaaattttggcctgagcgggacatttgagtcccgggcccataactggtcaggggttggttttagcgaaaaattgtcttagaacatttttgtagagaattttaaatgctatcgaatggttactacatgtttggaaattttcaaaaattttcgagctaggccccctagaaattttcaaaaatttttttggggtcgaaaaagggtgtgaaaaatatttttctgggctattttgaggtgctgaatacgaatatgatgtttattttaagtttcggaaattatagaattttttaaaaattctttattttttgggaaatttttggccctcgggattttggcctaatatttgaaaattcataacaaatcgaagggttgatcaattttaaaggaataaagccttaaaaatagagaaaaatcatgagaattttatgcgatttatttggttttataatgttcaaaagaaaaaatgttattccagaatttctggaaaaattcgaattttcagaaaaaattcataactcggttctgaaaagatattctggaaaaataaaatactacaaaaatccacaattttttgctctattttataaattttatttcacatttttatcacttttttgagagatgttacaaaaatttttcagaaaaaaattcgtagctgccttctgaaaagctattcgggaaaagtaaaatactacaaaaatccgcaatttttttctctataatataaattttatttcacatttttatcacttttttgagagatgttacaaaaataaaagtgattttggggttcgggccaaaggggggtgaccaggatttttgagtgaaaaaattttttcgacaaaaatcttccaaaaacatgtcattagggctaattgaggctgctgatcactaatatgacatcagatttcacttctgacatcgttaagacctcagaatccctgtgtgattggggattctgaggcatcattttgaggggggggcggcaggttcgaatccggacggtgtaacattatttttctgtgcattttacgttatttttaatgattttaattaatttaaaatattttggttgtaaattatttaaattaatttttttttaattaaaaattttcattatttattttttgaatttgcaaaaaaattaatttcatttcaaattaaataaatattcaatttaatttcatttcaatctaaataaatttaaattattataagcttcaaagtttttttaataataaaaataggcatttattttacaattttaaaaaattattaaagcatttttgtacctcttctaccatttgttgtacctcttcaaatcgctgttgtttttgggccaaaattcagatttttaaatagggcaagttcgaacccggacggtaacacattatttttatatttatttttggcttattttaaatgtttttaattaaatgaaaaaccttttgtaaattataaattattttttgatgaataaaagtttaatttaaaaattaattactattttttaaataaagaatttcgtgtatttatataaattattttttgatgaatagattttaaaaaacgggtgcgaagcgcccgt

SEQ ID NO: 21478 - DNA, 1224 bp, Heterodera glycines
aaatttaaaaattcttgggaacaataaaaatgggccttgcttttccccccctctgctcatgctgcagagcatttgtttcgatgcaaaatttctctcaaaaaagaggagccacttttctggcctaatctggaaatttaaaattctcggaacaataaaatggccattgctctccgcccctctgctcatgctgcagagcatttgttcgatgcaaaatttctctcaaaaaagaggagccacttttctggcctaatcttgaaatttaaaaattctcggaacaataaaatggccattgctctccgcccctctactcatgctgcagagcatttgttcgatgcaaaatttctttcaaaaaagaggagccacttttctggcctaatcttgaaatttaaaaattctcggaacaataaaatggccattgctctccgcccctctactcatgctgcagagcatttgttcgatgcaaaatttctctcaaaaaagaggagccacttttctggcctaatcttgaaatttaaaaattctcggaacaataaaatggccattgctctccgcccctctactcatgctgcagagcatttgttcgatgcaaaatttctctcaaaaaagaggagccacttttctggcctaatcttgaaatttaaaaattctcggaacaataaaatggccattgctctccgcccctctactcatgctgcagagcatttgttcgatgcaaaatttctctcaaaaaagaggagccacttttctggcctaatcttgaaatttaaaaattctcggaacaataaaatggccattgctctccgcccctctactcatgctgcagagcatttgttcgatgcaaaatttctctcaaaaaagaggagccacttttctggcctaatcttgaaatttaaaaattctcggaacaataaaatggccattgctctccgcccctctactcatgctgcagagcatttgttcgatgcaaaatttctctcaaaaaagaggagccacttttctggcctaatcttgaaatttaaaaattctcggaacaataaaatggccattgctctccgccctctactcatgctgcagagcatttgttcgatgcaaaatttctctcaaaaaagaggagccacttttctggcctaatcgtgaaatttaaaaattctcggaacaataaatggccattgctctccgcccctctactcatgctgcagagcatttgttcgatgcaaaatttct

SEQ ID NO: 21479 - DNA, 976 bp, Heterodera glycines
aaaatgacaaattatagtaaaatgacgatacataatcaaatgttttaattatcgaattgattttctcctccgtttagcccccgttccggtccaaattcggcccgctcgccgtcctccgcgcacggagtccttcaccaatacgctgatcagccgcaacaccaattggactccgcccgttcgttgagcattgaattggcctctgccacccattcgctttcaaacgctgtccaaatggcttccaccgggtcgaccaaaagtcggagttttctttcaatttatgcttcttccttcttactgttgctgtccctcttcagagatggctttgcatgcctcggaatgcattgaggagatgacacgcgcatgtgacaaattgatcggcactcggcaattggtcagtgaaattggctctgattttcgtaagggtttaagcagttgtttgtttacttgcacttttagataaacaacgaccccgacatcagcacggacgaacggcgtcttctgctggagggtgttaaccgtgccatctccgccttccgtcaacggcttcattctgtccttggcaacggtgacgaaggtggcgccgggatggacgactgccaaacatcagcgactgctcacgtgggcaaatgggacggggaagaaagcggtggcctgagggtttgagccaaacgcggaggcgtcgtactgtataatatttggcgggtggacagaacgccaatttttgtgtttgaatctgtgcaactccaccatggttgtgtgtgccctcctctcccctcttattacatttctttgcattgtcatgacgtcgtcgcaactgaaattccaaaccctgtcgcattatgtcactcttttttccttctgttgctcatttttctccccttttgcgcaactgtcacaaattatttttgctcccttccgcagtgaccttcaccaatagctcgatgtgccttatgttttatatttcgctacataatta

SEQ ID NO: 21480 - DNA, 923 bp, Heterodera glycines
cggtgactgaacattttcgcccctacatttgcgccccaaaaatttgcgcccctacgtttgcgcccctacatttgcaccccaaacatttgcgccccgattgcgaaccaacaaatttattcgtgaacttgcttgtctccccggctactgggagtgattttatctaagagtcatcctgcacttcccccttcctcttgtcctccttctcccctgagctcatccctcctcttaaggccgcgagccgcctttgaatatttcaattgtccgctcaccatcgcgttggcgatgaaatcccactaggatccgtgctgtcagtactgctccaatagacgcacagcttcagcgaagctccaatatctgctggtcaggaaatgggaacatatggctgaccatgtccgaaggtgccattccatgctaaattggcaaaacccttggtaagacctcatttcggcctgattgtccaggctcgaagcgcggtagatatggtaacaccgtcggaacacttggcccgcggtacggtcgagcagccgagaacctggggacatttagcgaattgcaaattatcatggcgtcggcttacacatccatggcctgaaaagcgtcgagcgaatgaatcggatccgttctctgtgcgcctctcgcgtttcagtcgccgtcgccgcgctcaccattctgtccataaataaatggatgaaaagcaaatcggatgaaagacaccgtggcgcctcgtcctcctccaactgataggcttccgcgaaggacagccaattctcccctcaattaaccatttaattaatagttgaaatcggtggccaatttcccacttatttgctggtcttcagcgtgagagaaagcgttctgcttcagttcgatgccttaaaatgcaaatattgtaaattctcaaggaagacctcaggcagcaagct

SEQ ID NO: 21481 - DNA, 1300 bp, Heterodera glycines
atttgttagtaattgttatgctttctttttttgacaaaaaaagcgattttagataaatcaatgaagagcgacagatcatcatcgcagcaggagcaaatgcgaaagcgtatgcgtcaaaggaagcagcagtacaacaatgaaaatcaaattggtaaattaaaattgttaaaaacaattgttgaatttctttttaaattttctttgtgcttcttaagacgagaacataacgccccgaaagatgggacctttatgctccgatttcccttcgccttcaaccgcaccaccgcttaaacgacacattgtgcttcataattgtggtcggaaggtgcaaagtgctggtcgaacgacgagacatggggatggagaagctgctggcaacgaaccgagctcgtggctaaatcggaaattctacattgtggtgaacagtaagtgtagcgaatttttcattactctacttggaatttaaaaaatcaaaaaaaggcccatcagaatgaggttttatgcctaataaatttagacgggaaacccatcgaagtgtactgcactgatctgatccaccgggtgaagcagtgcccgcagcgacagaggctgggcgtggaggatgggcaacgatttctgcgagttgtggacaggtggcgggaggagtggaatcacggcgtgcagatgccgttaggcaccggcactgacacctttttggccgagcccaccaatctgtttcccggattggccaggacgaaaaactttcaactgtacaacacatgcattcctttttaagatttaatatgatgtttattcagtccatcgaaattggtcgccatggacacatccgtaaacaaccggtacatcgacgaaaaacactttcactttgccgcgaaaccgcccaccctctattacaacttggacgaggaggatattttatggctgaagaagcgaccaaccgcagttggtgctgacaaatgtaaagggaggacttcctccattgctccgcggacattcgttgatgcgatgaactgtttcgaactgctcacttacaaggtgggagaatacatatattatcgtgattataaggccgccgcccccccccccctccttaaaaaattcaaaaatttgtcgtaaaaacatgttttaaggggttttctgaccgctgatcatgaatttgacatccattattcgggtccgcggttcgaaattgttcaaaacataagtagaggcgtgatcagcggtcccaaaacccccgtaaaaggtttttatggcataaaatttttttaacttttttttcacaaatgcggggggggggggg

SEQ ID NO: 21482 - DNA, 761 bp, Heterodera glycines
ttattcactataaaaggtttccatagcaaaaatatattcttaatgatttttaaaaataatatcgtgtatcagaatgacacaataaatactgcagattaaatgcggtgcctgatgaacatttgatctggttcatattattattaactctatttctcgttacaaagaaatttttaaaaacgaaggaccaggtaaattcaaattttttactcttttctaaaattcacgacaaagccttaaatcattttagaaaattaattgatatggctgaatctgttgtcgaagatagaattaaaaacaaaattatttctatatttttattcactataaaaggtttccatagcaaaaataaattcttaatgatttttaaaaataatatcgtgtatcagaatgacacaataaatactgcagattaaatgcggtgcctgatgaacatttgatctggttcatattattattaactctatttctcgttacaaagtaatttttaaaaacgaaggaccaggtaaattcaaattttttactcttttctaaaattcacgacaaagccttaaatcattttagaaaattaattgatatggctgaatctgttgtcaaagatagaattaaaaacaaaattatttctatatttttattcactataaaaggtttccatagcaaaaataaattctaaatgatttttaaaaatcatatcgtgtatcagaatgacacaataaatactgcagattaaatgcggtgcctgatgaacatttgatctggttcat

SEQ ID NO: 21483 - DNA, 955 bp, Heterodera glycines
atcattcgcgcatcagatttgatttggcactttcccattcacgaactcattgaaatacctaagttaactaattgcttacaattcagagacaaaaaaaataaaataaaaccgctcaatgccggcctcctatttgtccgtgaaagccaaaatctccctggccaagcctcgccgatgtcaagacagtttcaatatggtatttgaaaccattaccgacaatcaaataggacagagcgccatcccttcgacaaacagcaatgcgctccatttgcacacgaaacgccaaaatttccgccggcaagccattttcttcataaaccttggccgcgaactgctgttttctacggcttgtgccgggctagcactcctccaccgcttgctgggcctctcctgcaccagtagttctgtcttgctggggcctgctacagctgctcattcagaaaagggatgcccaaacctcccgaatcccagactgccgaccattttttgtcgtcgagcaaatacgacagcaattcggcgtagaatttggccgccagccaaaattcgtaagttccaagcatagttccaaatttttaaattacccattacaccgtccccatacccaaattccatcaaattacacaattgaaaaatagtcatttatttataaatgttaaaaaaaaaaaattaaaaaaccatcaaatacaaatgtattttttcgctcttccatttttctggtctcgttttttttcttccttttttctcgtcttcgccgtgtccgccattcaatttgattcatcaaaattgtcgacgcgccattcaccggaaatgacataaaatgataatgaaatattagcaaattaaaaaaaaataataatttttttgaactgcttgaactctatatacagctcggaccagatgccttgctgaaaaccatgttactattttgtccttaccataccaatttttaaatctaaaa

SEQ ID NO: 21484 - DNA, 997 bp, Heterodera glycines
atttcaaaaaaataaaacaaaataaatatataaaaagtttataaataattaaaatttaggtagattttaacaacccttgtgctcaaaaatttctatattattgaaaattaaaaaattaatgtatggaaacctgacattcttattatttagtcaattcttatagctgtttaaacgtagaattaaagtgtactatttctgtatggacttagacctgaataccggcttagttgggcccgaaataacaagagacccgtctaattctatttaaactcataaatttttaagtattgaatagaccgagccttgtaatgttataaattctaaataatacatatgtatggcatatatagaatgaatggtaatgagtttagcaaaatagcatgcttaatcgagtggatattcgttaaaaaaactttctattcctaacttgattaaatttactatgcttttaaattagatggttgcaatttagagacaattaaaaatatttttattttttaaatccttaatttggtgcccaaacttcccggtgcccaaatttctggtgcccaaacttcctggtgcccaaacttcccggtgcccaaatttctggtgcccaaacttcctggtgcccaaacttcccggtgcccaaatttctggtgcccaaacttcccggtgcccaaacttccgcccccccccctagccatccctattatatagtattcagtttatataaaaatattaaatttggtggttattttaaaaaatttttagccgatcagcacaaaaggccagcggcttcaatgaacgctaccatctttgtgccggcagccgatcattgggtggacttgaagtgtttttttttttactttaaatcagggacgtaattattatttattaataagtgtgaaaaatattatattttaacaaatcgatataggattactttttctttttctataaatttaactaaaaatatttatcctaattattgaaaaatagcaaaatttaacctaat

SEQ ID NO: 21485 - DNA, 1786 bp, Heterodera glycines
ttaaatctattatattttaaaatctattaaaaagtcagtctccccatacaatattaataaaataaataaataaatattaaaattattgtctgcaaatttataatttataattttagcaatagcaaatgacaaaaatttaattctttctccataattcctcatcaagctaatgtagaatttatttaaaaaatctaaatttattacatcaaaaataaataaataaatattaaaattatttgcattttttaaaatttttagcaaagacaattgataaaaaaacaatttcttctcccaacattcattctgttaattaaaaattcgaaattttaaatatgccgaatttctaaaaacctaatttattacaatattaaaagtaataaaaataaaatattgtctgcaaattaataatttataatttttggcaatgacaaatgacaaaaattaattatttctccaacattccctcatcaggctaattcatatgtgcagaagaattaatgcacgcacatataaattttgtaaatttatttgaataaaaaataatatatataattaattaaaacattgttgcacttagttaaaaagagtgaatttttttaaacataattaagaaatcattaattggttggttaattggcaaaaaaaaaatttcaatttatttttccaaaaattttgccgatgatgtctccctgacgaccataaaattgggggattacaacttatgaaccatgaaaaagtcacggttttagcgaacttttacaaacattttccccattttataatcaatccaattttaattgcaaaatataaaaaaaaattattcaaaaactcataaaatattttaattaaattttccccgcataaatttagccgccaattttggcaccagccaaatttgccatacaactctttttacacttattagcgcggtaattcagcaacacaacaaaacacgggcctgcacacgcggattgcgcagcgcatttggaggcgcgacaacagcagcggaagcggaagcggtggagcaagcggagacggaagcggtcgggagcgttatcctccgccgcaaccgcaccagcggaagagcaacaacaataacaacaccaagaacaactataacgacagcaacaatgttgcgggaagcggaaacggaagcggtggcaaaacatcgacggtagcggcagctgcggcgatggcacatggaggcgacctcaacaatggcacggacagtgaccgtcgaaaagcggtcggtgcttggtagagccaggcccgggacggatccccgcgccggatttttcaggatcctagtccgcaataacgcattttttggaaaatgtgggatttgcgggattaatcccgcgggatcttgttctgcatcagcgggatccgaaaatccttgcatccaaggacaaatgcaactttcaaattttagcaggacaagcgcaagcggagtgcgcacagcacaagtggtggtggcaattgtttgacgcgccggggaaattcagcatggcgcttcatcgcctcaaaatcggtgatcccattgagtcggtgagattttctggaatttttttattactcataaaattttggaaatttgttaaaattccagtacattcatattttacatttaacttttaaaagcataaaaaataatttgtgtgttgtgtttaaatgagtttctaagtccttgttttattttagaaaaatttctgtaatttttttttttttgaaaatttcctcccctacaaaggcattaattaatacccccggcattttttaaaatttt

SEQ ID NO: 21486 - DNA, 1125 bp, Heterodera glycines
tattctcattcacatcggcactaaatttttattacagctcaactaggccatattaagcttatttccagaaaatctcgcatgaattctcattttaaattttttatagatttttaaatgtttggatttttttttggcttaccaaaattcatcgaacctggctctttctattctcattcaaatcgccccaaattttttttacagcttaactaggccatattaagcttatttccagaaaatctcgcatgaattctcatttttaaattttttatagatttttaaatgtttggatttttttttggcttaccaaaacttcatcgaacctggctctttctattctcattcaaatcgccccaaattttttttacagcttaactaggccctattaagcttatttccagaaaatctcgcatgaattctcatttttaaattttttatagatttttaaatgtttggatttttttttggcttaccaaaacttcatcgaacctggctctttctattctcattcaaatcgccccaaattttttttacagcttaactaggccatattaagcttatttccagaaaatctcgcatgaattctcatttttaaattttttataaatttttaaatgtttggatttttttttggcttaccaaaacttcatcgaacctggctctttctattctcattcaaatcgccccaaattttttttacagcttaactaggccctattaagcttatttccagaaaatctcgcatgaattctcatttttaaattttttatagatttttaaatgtttggatttttttttggcttaccaaaacttcatcgaacctggttctttctattctctttcaaatcgccccaaattttttttacagcttaactaggccctattaagcttatttccagaaaatctcgcgatgaattctcatttttaaattttttatagatctttaaatgtttggatttttttttggcttaacaaaacttcatcgaacctggttctttctattctctttcaaatcgccccagaattttttttacagcttaactaggccctattaagcttattccagaaaatctcgcatgaattctctttttaaattttttataaaatttaaatgtttggatttttttt

SEQ ID NO: 21487 - DNA, 1414 bp, Heterodera glycines
  misc_feature (1202)..(1202): n is a, c, g, or t
cgcgatccgcgattcgcggcgtttttttgcgtgatccgcgaccgcgacaatttgaatccgcgatgcgcgatccgcgaccgtgggattttgttttgcgcggcgcgccgcggattttttgggacaaaatttttaaaagaaaaatttattgaagcgattttcttttttgaatattagattttaaggcataaaattttgtaaacttgactaaaattccaattttctcgcggatttaaaatggaatattcaatcagaaaatatttatacattcatcattcatttttagacaactttcttttgtaatttagagccaaatgaccaatgaaaaagactcaatttggttttattttgataaaattcacaattcttcttatgccaaatgtaaggcatgcaattataaagttgacacagagccgaaaaaacaaacatctgatttgcatcggcatctaaaattgaagtaccctgaatctacaagcaaaaggacgaagctttacgtaaaaagaaggaaaaaattgagaaacacgacaattctcaaccgaattggtatttttgaatgaaaggaagacaaatgaatcaggtcccggggcaagcaaaaaaacaaaattcagcacaacgcccattaagaaggcttttagtaagcaaaaagtttaaaaaaaattttgttcattgatttcggcagaatgggatccatcagctgataggacaaaggacatggaaaaaacaatattgaacaaatgaaggaacaaattcgcgaatggatgagagcggatttacaaaaaatgttttcagagtttttaaacacgacgttggttcgccaatcaagtacatcgagtagttgttccgtggaaaaccctgttttttctggccttttaaaagttttaattttattattttccgtaaagattttaatgattttagtcatccagtgggtcatcaaatctctcaattaccgccgatgatcaatcgaaatcacaaaatgaattttaagatgcgcttcatcaaattgaaaatatttgagagagccgcgagtaaaatacagtgttgatccttttcaatggtggaaaaagaatgaagcggaatttccaagcttgtgacggcttatgaaaaagtatcatagttcgccgccgggaagtgttgagtcggaacgcctgtttagctgtgcaggatttattttgaatgacctccgaaaaagcctctcgcatganaatctcgaaaggcttatttttcttcatcataatattgtcctttacaattttgattattgataatatgggaattttctaattatgcttttacaaatgtgcgatccgcggcattttttgcgcgatccgcggcgttttttgcgcgatccgcgaccgcggcaaattgaatccgtgatccgcgaccgcgggatttttctgtgcgcgccccacccctg

SEQ ID NO: 21488 - DNA, 1889 bp, Heterodera glycines
acggcttgaagaacgatgaagccaagtcggagtcgtaagtcgtatgcaatcagtcgaaaagtcaaagttgaaaaccgatgatttataaaagacaatccgaagaaaaatgaagaacgtttttatttattggagagaagacaaaaaaccaaaaaaaaagcgagagagaagagagatgaataaaaaaaaacaataaaacataatcaaatttgaacacactaattaaccgcgaaatgtaatcgttttaaaattagtcaaattaatgcaattcccggcgcccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataacctttatattacccgttgcctaaccttaggcccatccgaataataaaaaactcaaattcgagacttggacatttcgtggcctggacattttgtgggtcagcgcaattcccagcacgaatttgacttcaaatgacgcttaaacaatttgtaccaacagaacaccgaacggttggtgtaacaatttgcgcttcccccactacggcagttcgttcagtccgctcagacatttgttgccgcccgtttatgacgacggtacatactagggttcagccccgactccgagccccccgacccgagacgttttttggacctattccccgacccgacccccgacatgtgccccccggcggtccccgacccacgactttttgccccccccccgacccccccgacactaattcgggggattggggactccgagcgttgtaaaaatttaaaagttagttcatccacgaagggggaaaatattgaaaatttttgagtttttgaacaattttcttaataaattcattaaaaattccgaaaaacttttcggcggcgcctatcggcacctcctgccaccaaaaagtattaatttttcttaataaattattccaaaatcgcaaaaattggtcctttttggacaaaatcttttaacaaatgtcactcaaattttcaaaatttttcccgacggcgcctagcggcaccgccggacccatttgttcctccaaaagttttttggaaaaagcacgccgcaaaaaaaaaaaaaccagtttttgaaaagcaaaaaaaggtcgtcatattcgacgttcagaccccttcgcaaattagcaaatatttcgatggattcctttctatttatggtaaaagccaacttggacgcactcttgctggcgctagctaacctttgaatttgattaataaagtgaaaaaaataaaatttatgagcatttaaaaagaaaaattggatttttcgttaaaaaatttgttgatcactacccgatcggggtccccgaccaccgacaattgagctccccccccccccgactcgacccccgacatgtgcccccgatggtccccgacccccgaaatttttgccccccgagggctcggggctgaaccctagtacatacgcaaaaggcttacgtttcattattttaattaagtaattaaactttaaacatttttctttttttggttgtaattgttaaaatatttatctttgcgattaattttaatttattcatttgtttatatttaatttaattatttaaaatttttaaaacaatttgccttcatttttcatcttttaaatcctttttaatattctgatttttgatttataaaaggtgtcgacgcgcctcgttctcgtgccaaaagcggtagccttttgccgtccgctcgtctcatctccaatgccatccacctcgatcaggtaatcgctaaaatgatcatcgttttgaatgtgctttaatcactcgaaatgaataaaaag

SEQ ID NO: 21489 - DNA, 1269 bp, Heterodera glycines
taagccggtatttaggtctaagaccaaacagaaatagtgtttgcttaactctacgtttaaacaaccgtaagaattgactaaataataagattgccaggttcccatacataaattttttaattttcaagaacatagaaattttgagcacaaaggttgttaaaatttactaaattttaatgatttatataacatttttatttatttattttgttttattttttcaaatcgctctctctctctctggtgcccaaacttcatgtcacctacgacccgataattttcaaaaacacacccctgagaaatgtaaattttctaaaaaattcacctccaaaacctatttatttattcacatattgataagaatttgtgaatttaaaaatatttatctcaatactgttttgttaaagcttattttgttaccattttggataaaattttacgatttaacactccgctaaaattgaaactttttggcacaaattttcccatttttagcacctattttcggggtttcataaacctacctattttagcagctttcagcacctaaaaatcgcatctctaattattaacgggtagttttccagttcaccacgaataattcgcgatcccgaactgcggcaaagtgaatccgcgacctcgggatttttctgtccgagccccacccctgactgggactcaacctgcagaagaaatatccaattatcagggctgtcaaaaatatgtaaatgcatattttggcctggacctggacctggatccaggaaaaatccaggcctggatccaggtccaggccgatctctagaaatgtctttaaatgagtttttaagactttttgttctggaactttttcttttatctttttccgactttttatgaaaattttgcccccgacaaaggtgtctgcccccgacattttttaattttctccagccaacccagacaaacttagtcgaccccgaaccccgacttttccaaccccgacgtcgggggcccaaccctattatgcacctattcttatttttatcggaacttcaatctcgccaaacattggcatttcattttcattttcacaacctcggtactcaaatgtacgcaaatattttagtgtaaaattgccattttttctccttttcggtagttttagtttttctttttaatgccaaattgctgttttatgtacataaataactgttgtaaattttgtgttctttttgctctttcattttcctaattgtctatgctttaagttaatcaaagttttttttg

SEQ ID NO: 21490 - DNA, 3472 bp, Heterodera glycines
  misc_feature (1068)..(1068): n is a, c, g, or t
  misc_feature (1115)..(1115): n is a, c, g, or t
  misc_feature (1223)..(1223): n is a, c, g, or t
  misc_feature (2822)..(2822): n is a, c, g, or t
tcactccgttgcattcggcactgatcagggtttccttgatcgctggtctgatcaatgccgatgatcaccaaaatgggccttaaaaatatgccatgtcatcccaattccatcacttcttcttcatcactttactttatctgctgatctcactgttgtgccaaccatattcaggtgggaatggcatcggatcggttgcgataaatatttaaaattttcgctctttcctctcataaaaacccttggtgccaccggcgcagatggtgccattcgaaatattaggcatttcatttctctaaaaattttttcaagtccatgccgagcctccgcttcgtgtcaccgacggcgccgatgtgccggcacagtcgcctattgcttcccctccgggcgctgaggacggcggcgcccaaccatcacttagcaacagcaacaataacgacaatgatgtactgcttgaaccgtatgggccctcggcattcccggccggtgatcagcaacagcaacaacagcagcagccgaacggcccgaagaagaagaagcagaagcagttcccacaactgatcggatgggttgatcggcccggcgaacgcatcggcgagcaatgcgatccgaggatgaagccggcatgcaccgtgccaaactcggagtgtgtgggcggcgtgtgcgagtgcttggccatgtgagtttttgatggtggtggatgtactgtttgctgtctgtacaaggccataaagtcgacacgaaattacgattacaaaacttaatttatctcattcaaattttatgctaattttcccccgttgttaggtattaccccgacacaccctaccgatgcgcaccaattgacacaggtgaaaactgacgactaattaattaagcaataaaattttattttcttaattttcacaaaacccgaatcttttaagcctatgttttctttttctcatcaatttttttgttggcatttttaaaaaatttttaattgtctttcttgatttaaaggattttttggcatgtttaaaattttactttcacagatttaaaattttaaatttttgtggcattttttanattttatctttccagattcaaaaaagttttttcgtaatttttcctanattttcttgcaaaattagattttttgcaaaaattacagagggttcgctcggccgactgtgccgtcgtggcgtggactgtcggggcaacggcgagttctgccacacggnccagcgcaagtgcgactgttgtgcgaactttgcggctgtagactggcgatgcttgccggggcatgcgccaggcggaatgtaagtgccaaaatttaaatttaaaaaaaaaaaaataaaaaatttgggcgcccaaattttcaaaatttggttttctttgggaattctttttaaaaaagggatccaaaataaaaacaaaaaaaaaaattttttgggggggggaaaaaaaaaaaaaaaattaaaaaaagggggcccaaaaaaaaaaaaaaaaaaaggggggggggggggggggggggaagaaaaaatatttttttttttttttttaaaaaaaaaaaaaaaatttttttttttttttttttaaaaaaaaaaacccatttttttttttttaaaaaaaaaaaattttttttttttttttttggggggaggaaagaaaaaaaaaaaatttttttaaaaaaatagtgttttttgtttttttttttttttttttttttttttttaaaaggaaaaaaaaaacacccccccctccgggggcccccaccccccccccccccaaaaaattttttaaaaaaaaaaaaaaaaaaaacaaaaagggggggcgcctttttttaaaaaatttagaaaaaacaagggtgtgggggccccccccaataaaggacacaaaaaattcccccccccctttttcccctgggcaaaaaaattcccaaaaaaaaaaaaaccccccccccccccaaatttttcccccccccccaaaaaccaaaaccaaattttaaacaaaattaaattttggggggccaagggtttttgggggccccccccccccctaccattgggaattcaattttggagggtgggcccaattccttgggcccctttttggccccaaacccgtgttttggaagagggcaaaatacaaataatccctttggttgaggggacgcggcgcggcgcatcagcagcaggcttcaatttctgcttaacatcatcatcccattagctgaatttgggatttatatgtctgtctgcgcgtgccagttctaaatcgggggaatggttcagttcatccgtatacttcagcaggggtgggctggcccggatgccagaaaaaaaaattcagaaacccaaaaatttgcggaactccatacctaataaagcttagttggtgctaagcaagcccttactgctttacacatatacaaatctatcataatttgtagatcaagtaccctttttggaaggttagttaatttaaccatttcccatttaaattagtcaaggaaatgccatttggcgaatgaaaattaaaaaaataaatattttttctaaaaatatttatattttgaataattgcttgtaaaataattcttggcgagcattaaaattctaaaataacaatacataattgttcagactcacgcattccaaaaagctcaaaaagaaacccattatttaaaccatgccaatttcctttattgtttttgtttcgtttctcatttcggccttctcgaacagttaaggggatattgtgcttttctcgagctttagcggacacataaacacactgatggctgattatgatgagaatgagcacctcttccccccccnccccccgcccccgccccactaatccgtgccgattgccccccccccgcccgccctcatcagtcgctctttaatgtcgtgccccatggggccgactgggccacccgtgcacccctccctcaggggacagattattgcgcggccaacccataaattgtacggttgcgcagggcacggatagggaagagtctcccgccggcgttgtcggcggcactcccgggggcgacaaattgaaatttgaaggggtaaaacaacaattcattgatgtgaaaatggggggggggagggcacagctcattagacggacggacggacagcagtgaaagcgatgaaacctctgctgctgagcgacggggtcagccgagctaataacgaagaagcaagaagaggaagaagccacgggcaacacaaagtgaagggtgccaaagtgcgacggtcactcacaatgccaccaactcactcactcactctcaatctcccccattgtgaatccctttaatcgaatttgaataagcaaatccaagcgatatgcctgagctttcgtaagccttactcgggtaatgattcaaaaaattttctgattttgtcggatacataaattgggttatgccaaccgtaattattggcaaactattccccaatgaaatgctaat

SEQ ID NO: 21491 - DNA, 1323 bp, Heterodera glycines
attttgagctattatgtagataaatttgccttcgctatttgaaaaaaatggtttcgaaattccgaaaattgcaccaaaaattcaagtacgatataaatagaaaaccgaccttgaaggccattttaggaagtgtcgtgccttctaaaatttaataattcttattaatttccataaattattttaattttctaaattaattgaattaatcttcaaataattcatttgtattatcgattgaattaatttgaaaattttttataaatgactatatttgttttataaattcttgattttctcaagtcgaaaataatattgatataatatattttcaaagacatatttttattttaaaaatatatatttgatgtcttattaatatcttactttttttgtgtcattagaaatatgtgaaattatttatttttatgcatttattcatttttgattacttatattttaaattgattttttaaattatttattatcttaacttttaattttatttttaccatcgtcttctcttttaaatttagttgcggcacataattagttataaagctttttaatcttttgatgctgcatagtttttgaaaaaacttgaaatgtgatatttttgttaaattttaaatgtttcttgagtattttctatttttttattaatatattttttctttatgatttctcaaccttaattatttgatgatctgataccctttcaaatatttataataaaaatcaaatttaatttaaaattaaaagcgaaacaaaatattttttaattatatgacttatattatttatataaaccagataaaactcaccaaattacattgaatataatatcacaactagcgggtgcgtgaaccgtcggatctgggcctgggataaagcgcttcgcgcttcttgagcttcgctacctaggctgtgaagcgattcaaattgatagaagatgttagggataatttatcggaattttaaaaaattatcagcgatttttaggccgcttcgcggccttaaagggcggattcgagcccgttgtaagaggtaaaacagtgattagaagaggtacaacagagattaggagaggtacaacagagattataagagacctttctcgaagtaggactcgaaaattgaaagaatggaaaaatttaaaatgttattctaaataaaattttcaaaatttaattaatttttggcttggaaattcagatttaaacagagggttcggaattagattatgagacgcatccgaacaattttttagtttcaaaaataccgcaaaaaaactctaaaataaatttggggcaaaaatcataattt

SEQ ID NO: 21492 - DNA, 2547 bp, Heterodera glycines
  misc_feature (1631)..(1631): n is a, c, g, or t
aaattcatggattttaaaacttatttattaaaaaatctttgcattttcttaaacaaaatttgaaactagctcggaataaccaaatgatggcgtggaattggtccatttttatggaacattctccgccccaaatttatgcgccataaaattttgacgaggcaaaaagaccaatttcaacgcgaaattaatggaaaatgaaggtcattctgcgcatcctgatcctagcgaattgggaatttttaaggcattttttgtaataaaatatgaaaaaaaaatctttaaaaaagtaattaatttaaaaatattatttgaataatgttataaaaaaattttaatgtagagctgatgactttcgaaggtagactgaaaaaatagattaacatttgcaataagcattccgttttcatattcctaaatattttcaagaatttaatttttttaatgatttaattatgctttctaaaaatatttaaaaaaataatattgaaccttcgctattagccgtcgccttaaaataggctttgcccgtgcagaggacacccccaccaaccttgaaaaattttaaactcggggccagtaggattagggtcaaattcgggaattgcacctcggaatggtgtttatgattaaaaatctcaggatcagaagcaggatcagaaaaaataaatatttactggtcatttcccgagcactattgcaacaaatccattaattatgtaaatttatttttatttttaaaattttaaatatatgtaatgcactgtaaacaaaaaactattaaacaaagcctacacattaattgatgatgactcactcccaattttcattatttcattcatcggtcaccgaggcttttccatcgtccgccgctgggagcggaggaattggattcgtaaaatgggggagaaaggagatgagacggcgaaagtaattaagcagatgcagcggcggtggaaagcgaatttcgcaacggagagaaatgacgggaaacaatttttttttttggaattggattttgcattaattttggagacggactttggcgatggttgtccaatcgaatgaaataaatttaaacaaaaaaaattgacgaaaaattatgaaatggaaataatttaatttattaaaatgatttaacaaaataaacatgacaggaacaaatcttagtaattaggacaattggcagtcgacaggacccaaattgcaaaaagctatgctaagaatttgtctaatcacccactgatcggaccgcctttcccggtcgctttcatgtgcaaactgcaaaaattatcaaaaaattatgcttacaaaagatctgatctctacaggtctacgttaaatggtttagtttaaggatttagatacaaaaaataagaacaactcatagaaataaggacattttgtagccctgtcgttattgcaaaaaattatgcaaaagaatttctctgatcaccactgatcggacacaatttccgattgctttcatgccatttttcaattcattaaagcattgaacccaagccaagttggcaccatgccatcattaccgatcacagcgatcaaaacttcgcaggtgccattgcaaatgttgaggagcagcatcgacaaaatggaaaaacttaatttattanatggatataaaaatttaatttaaatttaaaattattttagtttttcaatttccattcatatgatcaattttgtaatggccaaaagcaatgctaattgagtcaaactcaaactttttcttcaatctgatcaattgaaagagttttcttttctgtcatattaaaagttgatttttgcaaaactttttttttaggaaaataatatttattactacaataaaaaacatttaaaaagtacaagagcattaaatgggtctgaacaacaaatacagcaaatggttcgaattagaagtagtttatgattgtattaaaaaacatttaatgaggtaggaaaaattaataacaaaaattaatagtgaggtaattaggggagtgattaaacaaagtcaaacgcattggacagaaactgcgtttttttaaagatggaaaatgataaaatgtaattggacgacaatttattcttaattaattgcataattaatagagccaaggaaaaaagcggggtaatgagtttttcgataattttttaaaaattacatgggatctggaaactaacccaaaaattaatttggtgttattttccgagtcgacttaagattttgtcaaaattccatgcttaaatgaatctaagaatttccagaaaatacattaaaatttcgtcgtttataattgttaaaatcccaaaaaatttttaattagccttaatcatgtccagaaggtgagcttccgaatcctaattgttattttttcaaaattccaggctctattaattaataaattaaggggttgatttttgcaaaaaaaaatttaaaaaattcctcatcgacctcggtaattgttgcctccatttggcctaggcttttccacaaattttttgcaaaaattgttcttcctcctcaatttgttttcgcccctttcg

SEQ ID NO: 21493 - DNA, 2430 bp, Heterodera glycines
  misc_feature (2320)..(2320): n is a, c, g, or t
  misc_feature (2370)..(2370): n is a, c, g, or t
  misc_feature (2389)..(2389): n is a, c, g, or t
  misc_feature (2402)..(2402): n is a, c, g, or t
cgccaaattcaaaaattttgtttattttgcttaaaaatttttacattctttgtatattgtttgatagcccaattttttctctattagcctagaaaatttttaataaaattatcaaatttattctaagtagggatacgatttttaggtgctaaaaactgccaaaataattagtttttaggttctaaaaaaccccaaaataggtgctaaaaatgggaaaatagatgccaaaaaatttcaaatttagggcgtaaaatgacaaaattttattcaaaaagcaataaaattatgccaaataagcagggatcatttttatgtaagaaaaatcgcgaaatatgtaaataaaatatgtataaaaaatgctaaaatatgcatgaaatatgtactaaaacttccaaatatgtactaaaatatgtaaataaaaaaatttttaatggttatttttttggaaaaaaattcctcgtaaagggtgaaataggcacaaaatgccataaaaataggcttagaatcactttttagtaatttaaattaatttttaatatctcattttttgaaagaaaattgcacaattggcatcgcctaattgaccttctccgtgacctgacctctcttcctttctctacctacaaatgggtagtggaaaaagaaaaggcaatttatgaaaataatgtatgggaaacgacattttctgccgtccaaaataatttgaccaaaaaagaggacataaacttaattaattaattagtagcgcaaattttctcatttgtataacacatacatatatatgaaatattctttatttatttgttttgttgagcaccaacaacagcagttttcaacatcggcatcaaagacgacgaaattttcagtaccagtcccgaccagccctagtaaaaattaaggaaaattataattcatactttaaaagtagaatgacatcaattattagggtaacaattcattactcaaaagtaaaacatttttaaatgcaatttattttatcatttaatctttcaataaaaatacgaattttttatttaaaaattaaacaataactgtatttttattaaatttataaaaaaggccgcggtggttaaaattttttgaatggcccaaaaactgagaccaattcatgttttcatcacagacagacacatcggatggaagatattatgcatataaaaaaacgatatttagtgtgtatatatgccatttaaaatgccattaatgggccggccatgtgccgttcgacgggattttgtttataggttttcttagtccaatccgacacatccgggattgctttcgttgtctttgtacgagttcattcccgaatcatgggaaatgttctcgtcttgttaaggccctcggtctcgacatttaataagacttcattcccgagttttggtagaggctcttcagcaaagataaatccaagttatgccaagaaagtgctacaattgccccgattttgtaagtttgaattcttttaaaaatataacaatttttaaaaaaattcgttgaaaattccttttctcggagatgccttcggggccaaacctaactcctctaatttttgttaaattcccaaaattttcaacaaattgttaaaaatttttgcatttatgagactgagttgtgacaaaagaccgaaagtcgttgctgtagaatggactccgttttccatgcattttgccaagggctaattaatgaatgccattgcactaatttttggtgtccatcggtcgcgtcgcaccacggcattttacatcaaaggccaacattctctccaccaccacaatcgtccatccccattgctcctatacgtcctctgccgttcatttaaaaatggcgtcgttttatgtgtcctttgatcactggtcactaattggccctaattaggtcatttatttgccccccccttccaattacaagcccatcttcactaattgcctatcacagcccattagtcacagtcattccttcttctgcccactatattcagtcttttataattttttaatttgggtaattatttttaattgaagtatattcattaaaaagatcatttatttataaatttacctactgtaatttatactgtaaaatcgtgcgcattaaaattgtattacgtaaaagaattggtacttagttttattaatattaatgactcactctcaataattagtgcccccattttcctcggtttatcaaaacaatttttaattttttcgatttaattttactttataaaaatttagctttttcattttttcattggacttttctaacatttccgcaaaaaatgtcttcttctgctganttcatttttgagctccatcaatccttcaacgacacaagtacaatacaatngaaaaattaattagcattnaattatattattnattaattattgcctaattaagtttggcc

SEQ ID NO: 21494 - DNA, 2175 bp, Heterodera glycines
  misc_feature (2023)..(2023): n is a, c, g, or t
  misc_feature (2092)..(2092): n is a, c, g, or t
tcaattaataaatggatacaatcggtcgttaatcccttttttggtactgatcatttgctgatcaattactttgtctcatcctctctactcatttcttgccaaatgactcactcactaaaaccatttgtaatgaatgcgaataattcaggaactgttggacatgattctgcttgcttttggcatgactggggaaatgatttattccgtggccggcttactcggcctcaccggaagtgcccggacggaggagcgaaattgggagcagatgacgctgattcttcttactgtaagcgattcttttgttgagcatactgtatctaattgtaattgtatccatctgtaataattgtgccaaaaatgttttttaggttcatgtcacgcgaattttacaagtaaatttgaaactcaagtttaaatataatttaatggatctaaaggttgggctccaaagctgccttatttatattgcggtaattttgcattttctgatcagtgacaaaagcattcaaaaaattatttttttagggaaaacttcgcattgggaatgaccctattttgagggaacggcagccgggtaaaaataaaataaattaaaattaagtttaattaaaataaataaataaaataggaaaacaggcgatcacttttcttctgttggccaacatttcaatgtttctgatgaatttgctggaggcggaaaaggcgggcgttagcgatacggtggtcaatttttatgggaagagaaattggtaagacggttagtcggtaattgatcgattaaaaacattttcagggtgtttttggtacggtcattctccccactgaccattttctaccgtttccacagctcagtttgtatgtgaaggaaaagccaaataaatttcagagaattttgaatatttgaaaggtctggcagaaatatggaagagtacgtattcgtggaaagagtgaacaaaaccaatcggaagaaaagaacaacacatttttgtaacagttcagagctcaattcaaattaaaagtgttacggtagaattatgtattgtatatttaatgtccattttttgataaaatatttaaaaaaaagttaattgcatccatattaagagaatcatttcaaaattacatttttaatttaaattttggggtaaaataatcggccgaattaaattttatagtttgtgatggttttaatctttcagtacgaaagattttaatttgttgacgacatttgaaacgaaaaaagagataacatttcaaatataaactgaaaatgggccattaataaattatttaaattgtctttgctcattttattcaactttttaaattaattttattttctgtctgtcaaatgcttttcttctcccgacttttctttttgctaattttctttctctccaccacaaatggcacaaccgaaacaacaaaaaatgcacaatcggcgccggaaaagaaaaagctcaaaattctcgtctattcggtaatccccgcgcacagtcacatgcaatttatgggcgcaattgccgactcattggccgaggcggggcacgaagtggtgaggaacggcggaagacggacggacagaatgttgtaattaaaagcaattaagcatttcatcaaaacaatgaacgacgagttgcaatggatgagcaaagccgagagcaacgagaccaaactgtccgccaaagtttatcgggttgtgctcaagtcgcgcgaagcgactgtcgcgagttcggatgtgctttatccgttcagtgggggcaatgcgtggccaatgctcaacgcatgggacaacagattcgctaggattttcgatttgtggccatatttttgcaaaggcaattaattattcctaattaattgttttacattttcttaaatggaattcactgacttttgcagaaattgccttccgtcacgaattgctggacgaattggccaaggagcgctatgatgtcgccatttatgaactgttcgatctgtgcggtgctgccattttcgagcgcatcggtgtgcgcaccanattggcaacacttaccgtgccaatgtatcaaacgaatgccgcccattttggcatccaacatttgccagntttgcgccaagtaaaaaaagaaactaatcaaaatgaggagaatcacaattttcctgttcaactaaatttaccttaatccgcta

SEQ ID NO: 21495 - DNA, 1139 bp, Heterodera glycines
tgcactaaggaagtgcaagttgctttgcatatcgctcaggcaccaattgggtttgatctgttgtttggaacgaatgctttgagttctttgggttttaaactttttgatgacacaacgaacacaaaaatcaattttgaggaagtccagctaagcaagtcggactctctgactgtcatataccagacaattttggccccaaagtcaactcaaatagttgaattgggcattaaggaagagtttgaaggcaaaaacctttttctctggtctgaaagccaccaaaattttcgaattgagccaacagttggaattggaaaggacgggaaagtcattgttccgatgacaaatttttcaagtctgtcagtcaaattggaaccagggaattccatcgggaaaaatgaagtcgtgaatcatgtcgaagaatgcgaaaatttcctttcagcttcgaacgaatgcttcagaattaattgtgttgcaactgatgaccagaatgtgtcaatcgacaaaattttgatttaaattctggaaaaagggacatttccagattcggaaaaacaaaatctgttggaattgctttcgcaattcaagaatattttcgctgtttccgattcgcagttaacccaaacaacccttgttagcatgaaattgagacaggaattgcaacaccagtgagatcgaaaatgagaccagtgccttacgcatatagagaaaaagtggccgaaatgttgaaagattatttggaacgggatttaattcgtccttcatattccccatgggccagcccaatcgttatcgtaccaaagcgcgatgggtcgctccgtttttgtgttgattaccgtgccgtaaattcggtgacacgaaaagatagtttcccattgccaaacatagacaatactcttttgttactgggaggcaaaaaattttttacaacactttattttatgtcaggctattggcaaattcggatgaaagctgaatcaattgaaaaaacggcgttcgtaactgaatttgggctccacgtgtttgtggtaatgccattcggtttatcgaacgcagtggccacttttcagcgctttatgaatcgactttttgaaggaatgatcagtaaatttctatttgtttatatcgatgatgtgtttaat

SEQ ID NO: 21496 - DNA, 642 bp, Heterodera glycines
ggtattcttggcgggtaatacgctgccaccctcaaaatgaccccagcaaatcccgaggggttgggtacccaccaaaaaatcattggcccacgtgcttcgtgttgtcggaatggtgcaacactttttttgaaaagcggcacgtgtgtaagaagtgcacccaaaggtcgatgcgcacgccgccccattcccgcccccacctacagcctgaacatccccatcaacctccaacacaactgacggtcgcgaagcgacgcacgcacgcctctcctatgcatcacccgtctgcaatgaactattttctgatcaaaaattgcttaacttccatagaagggctgaatgaagacaaagaaaagtgattcaaaacaaatttacaaatattaaaaaaaaaacaatcattgtattcaaatttgaatgataagtaaaaatagccaaataaaaatgaaaaatgtctgaccaaattaaaaaattaaaattgaaaaagtgaccaaaaatttaaaacattttcacaactttcggtttcaaaactaattaatcaatatttagttggtgaaaaaaacattaattactgattacaaaattcttaggcaaatatgaaacaaagcattcaatgccggcataaaaaaagacacgtaaccagcgatt

SEQ ID NO: 21497 - DNA, 2143 bp, Heterodera glycines
attcgcctttatcgccctttacgcccggccacgcggtgacgcggcgtacgtccgcgtcggaaaggccagcgaaagtgccgggggcaccgggcggtcccggaagaccaggcggacccgggggcggcatgcggcactcggcgatgcactcaaatgttgaaaagattaaggaggaaaacccatacaaaaatggcagactcactgtcccgggcactcccggatcgcccttttcccctttgggtcccggtgtcagctgagcgccgccatcccaccgcccgtcggcttcggacggcggccacgccttagggcgcatttgcgtcactagcacattttgtgtttttgccggtggtggcactgtcgtgtacgctattgtggtcggagttgtggacagaagcggtgctctttctgcgtcggatggcaccgccggtcggtcgccgtcctcaaagggcgggccaatgccactgccgtcgccggcggcgtcactttcggtgtcctgaaaaggcaaaacatttggtaaagccgaagctgcagcagctgaacattgtggaaaaacagaacacgcaacaaaagccgacagaacgactgacaaattcggacgagcaataagcgaccaattaattgatcgtttaaaactggaaaccgatcaaacaatcgattggcccgatcaatcgattggtaaaagaatataccaatcaatcaatctggactggtcaatcaattggaagagcatcttcaaaatgattattttaacagaacacacaataccaaaaaagctgctcaagactcatgattaattctcgaacagaactaatacacatcaaatgaccaaacactgcttttttttcgcatttctcttaatttcaaattatatgcttttcaaaaaatcaaaaatgtttttgcaatttgaaatttaattttgcaaaaatattttctttcgtttttgcttttcaaaatttaattaagcacagaaagcaccacataagcacatcaatccgacaaatgaccagtgtttgggctgccccgttcttctgatagtctctcctacgcgttttccactaaaaatcatttttggcacttttctttggcattttcccatttcttgtgccattttcttttccaatacccaattctcattgcattggttcgccgcttctgccgggtcgtcgtgcagtttcaactcttgaatggccccctaaactcgtgaatttgtccctctttttgctcacccctttttcccatttgttcgcctccgcttcagtacaatttcccattttgccatttccgcgtgtgccattcccttccaatttcattttggcattcaacgctttaagaatgggtaaaatggaaacggggctcaattgacgtgttgtctcctttatggcagagttgttcgacttctcttcggaacttttggcattttgtcccgtttttcgcccatttgtctctttttcatattcttctgaacttgactctgatgaactctctcgagctttagagacgttttgtccatttttggttggcacttttgttgtggcgttttgtccgggttttcgcccatttgtctcctcttcttcttcttctgctgaactcgattccgaagaaatctctcgttctttggtgacattttgtccatttttggttggcacttttgttgtggcattctgtccagcttttcgtccatttgtctcctctttctcttgagatttagttgcattttgcacagttcggatgatttctccaacaattttatcatccttttgttctgacttggtgacttttcgtccatttgtagtgatattttgaccattttctgtgatattttgtccgctttttgttgcaattgtctcttttcgcccatttgtccctcgtttttctgctccgtcttcctctttctcctcccctttttctttcccttcttctctttgttcttcttccttttccctttcttcttcctcttcttttcctccctctctttttttcgcctccctctcctgttttcggcctctttcttctcgccctttccttttcctctctcatcttgttcccctcccctccttccacttatttcttttccttttattctccttttttcatcctcttcctcatcccccttttttttttccttccttctccttttttcgttctt

SEQ ID NO: 21498 - DNA, 2548 bp, Heterodera glycines
ttgggaaagttgagcagatcttgtggccatgtgcattgcacgaagcgttggatggtctgttcaagaagggcacacagttgcagcgtattggaggagggacacggggcagcggtgagaggactccgtactaacgcctcaagcacctgggaacacggaacaatgcaagtggaaaagagacccgagtaaataagacttggtaaagaaaacgagaacgcatttcgatgctccacttccagccaaagacaatgttttggaggcgaaagttgtgcagttccaaaaagaccttcaatttgagggaaaaatggattcgttgtaaaaaaattgcacggaccgctaagaagtcaattcggacggggtaaagtttctgttcattttcattcgttggaacgttggtggcataatgaagagcggagaaaatgtgcgtgtaaaagatggtgccattaaggtcgatctgacatggttaatagcagaatttggtaatagttgaaagaaccgaaaaactgaccaattccgtgctcaacaaaagtcgtgccaaactttccacgagtgccggggttggcaatctgaaaaaaactttataaaaagacaaacaaaatggagtaacatttgaccaccttatcaatgcaaaattaggtgtcgcatctttatagaataattggctgtagagacgaaatgttgacttgtaaatttgcaatttggcatggaaagtaagtgagtccagaaaagtcaggtctaatgcacgcaaattctgttcagttcgccgtccgccgggcaaaacccaacacttttcgggttgatgaggctaaagaacaattgaatgaaaagtaaaagagcctttgtataaataagcacttgctgctgatgaacaatgctctggccaagaatccgaaacaccgcggagctgacgtgttcctcgaacacctcgcgattgttgctgtacgaattggcaatgaccgccagaagggccaacgttttgtccagcggtttgtttgcatccaactgtttttctgtaaaaaataaaaataatttgacgataaataatgttcagtttaaaccgatgaaatcaatgagtggtttcagtttctccggtggctgaggctgactttcttccgaagtggacgcaatgggcaaagcgacaggatgcaccaaattgatccaaatggcggcaggagcaaaaaatcggacataaaattaacaaaaagtcagtcaagtcaatggccaataaatgaagaaaaaccatattcagagggttctccgtggaacaggtggtagcccaattcatgttcttgtcggtgtacaaaacctgataagcaattggagtggaaaacccaattcttgccaatttgtaaccaaattacgttaaaaatgtccaaaaccaattcccggttctgtgcgcccaacccaacgacggagagcatttgtgccccgctttggccattttgttgctgctgctgttggaccaaattcttctcgcgagaacgggcgtaggcaaccaattggagcagaatccacatcaattcgtccttggctcgcaaatactattaaaaggattaaataaacaaattcggaaatggacgaaattacttgacaacttctcaactgtggcagcaacattttcaacagctcactgaaattgaaaaaataaattaagaaaaataataaacgacacaaaatttgacctcaatgtgcagttttgcatgtacagagcatgggtgaccaagtgggaaaggtgcagccaattgtactggttgacaggcgccagcacgggctgttccgagtcctccatggcgcacatcgcctccaaaatgagcagttgaatgacctcatcacattggatacgggaacacggagtctgtgaagttgacgagcggagaatgtgcttaattggagaggagtgtgaacaaaactcactaaaaactggcgattacattcaaattgtcttggccatggggctgtttgaagagaatgtactgcaagtaggtttgtggggtggaattttcactaaaaatgatttaattggaaatgttgagttccaaaaaactcagggggattgttagagttgagtgatcacctgctgtacggcaagtgcgtcttgaagtaaagtttgcattgcttttcgtctaatttccacgcactgcacgtcggagaactccaagagaaggagggcgaagcgggcacgggccacatccaggaacggccgagcatggaaccaatttcggcgagggggcgaaaagaagcgatcatttcgcggattttccaagaaacgcgctaatgatggaaaagacaatgaagggtgcaccccaaaatctcgccgccgaaatctcgccgccgaaatctcgccgccggaatctcgccgccggaatctcgccggccggaatctcgccgagacaaaatatcgccgccgaaatctcgccgccggaatctcgccgccggaatctcgccggccggaatctcgccgagacaaaatatcgccgccgaaatctcgccggccgaaatctcgccgcagaaatttcaaaaaaaaaaatttcaaacttagaaattttcaagg

SEQ ID NO: 21499 - DNA, 2177 bp, Heterodera glycines
cccgtttgggtgactgagtcgaaaagattttcggccccttttggtggtgatactgacaatgagcaaaaaggcattggcttgcgactggacaacctcagaccggaatttttacacgtccttcaaaagtccataagcttttggttccctgttcaacgatttgttcttccgactctgcttcaaatggccaattccgtcctgcccccacgcgatttggtcatttgctcaccaaccggtgatttcttatattttccctattttgatatttttcccacaaggcagtggaaagactctttgctatgtgctgcccattttaaatgctttgcgaatttgccccttttcgacttcgtcagtttttgctttggttgttgctcccgtcaggaatttggctgaacaaatatttaaagttttccctcgtcgcaaaatccctgagaatttcgcattgttttttaattaggaatttgaaaaactgaatctcttcggtgctgccattgcgttgcttggtcagaatgactaccgaatcgaaaggcaatggcaccgactaaaagctttaacagcaattcttttagaagtgttcttttcccaaacggaatgaaaagtagcaaagcacacgtaatagtgacaacgccgggacggtgagtatttttcattccgtttgccaaatagccaatctcctacagtttcgttgaacatctcatggatgagaatggccatttggacctgtccatgctcagataccttgtagtggacgaagcggaccgaatgcaggacactgcccggatggaatggcttggctttgtcgaaaaatatgcaaatggtaagtttattttttctgattttcatacgatttaaattcatctctcttaatcagtcccttctgtgtgcactttgaatgtatcttcgcttacggataattcctacaacaattggctccaacgcattttggtctccgctacgctttccatggacgtccattccctccacaaatggaacctccgatgtccaattctgttccaagctgagaaagagataaaagtcaaccaacaaactgagaattcggcggaacctgccgttcttctgccaaattcactcactcataaactcgtccgttcgcttttaatgatcaaaaaatgccctcttggttttcagattgtctgtaagcaaaacttcaaaccattgcttctcttcagagagatcgacttaaattttgacaaatggaacagaatcattgtttttgtcaacaagaagtttgtcgtatatctgacgatggaaatgattaatttcagacaaaccagtcgaaggctctcctctctcttggacgctttgagcaaaaaaaagctaactgtagccgaattctctgccgatttgttcaaaagccgcagaaaaaaattgttgagagaatttcaaagcggtgcggtgagtgccgagtttatcctttggacacagcgtccggaaacagctcctgtaccaaaaaagatttgcatgtgtggctcagtggtttttgtaggaaattcaagggacaaagggcggaggttcgagtccgttgtgctacatgaatatttttatttatttttgtgcaaaaaattaaaaaatgacgatttttgggaattatttttggaggtttttaccaaccaaattggtccatcatggtatcattcgaaagctcctggtgaggagaagctttttctaagcgaatgctaaccattttgaagcattagaaaaaagttatgggcgtttgaaattttgttttttgaataacttttctaatcgacccattttcaaattaatctgacctatcattagatgcagaaaatttttctctgtcgatatataaaatttggtttggatttaacaagtagaaaaaattttttaaacaggatgaagcaaattcggtttttctctattaatagagatgaagaaatagtacgccaaaaagagagatatctttttctctgcactctctatttattggtacacatctcgctttttcggacggtgtgtggaggaatcatatcattcttaaaaaatcaaaattcccaggtccgtgtgctgatcgcttgtgatgtcctttcacggggcatcgatgttttggacgtcgattgcgtgatcaattacgacctgccgataaacgaacgcatttacgttcaccgagctggtcgtactgccagagcaagaaagaa

SEQ ID NO: 21500 - DNA, 2588 bp, Heterodera glycines
  misc_feature (76)..(76): n is a, c, g, or t
  misc_feature (2544)..(2544): n is a, c, g, or t
  misc_feature (2555)..(2555): n is a, c, g, or t
cctttcccctcccttttccaaatctctcactttctttgccgatctttcccccgattcgaaatgccttcgctttctnttgtccgtgcgcggcctttgcttcgcttcgacccctgcacaatttcaaccccaaacagctgaaaaacaatcagcagcagaagaaacatcgcgaaaagtgcgggcgatcggaacattttaagggactgaaaaaagaaaagaaaaaagggggagaaagaatgagtgaaggaagggaaaggaggaggaggaggaggaggaggaaatgaatggaatgaaaggagagacaaattcaatttggaaaaaaagggggggggcggactgccaaatgaggaacggagggagaaacggggctaataaatgaatgagcaaaaaaataggggcggacggacgaagggaaaaggaaaggaaagactaagaaaagatactcctcccccggggggcgtgggaacgcatttaattgagagaaaattgagaaaattgaaaggggaacggagagggacaagtcatttgacaattcattgcctcgagcagagaagaaactgttttattgacggaatggcaaataaaacataattggaaaatgataaaatgacacataaatttatgattatttcaaacaaaaaattcgactgaatttgtgcgtgccgcgggggttaaaaattataaaatggaaataaatgggtgaagggggggggggggaatgaatattcaccggcggattggctttttcttttttttgcgttttccgattcactgattggccaatgtttttgcttctgctgagcatttccttctccgtattcctcttcgtctctgcccctttgtttctctgttagtttatctctcgtcgtcccttttctgtttccgtttccaatgtcatttttctgttcccactaccgtagtccacctttcgaccgtactttgaatgaaagcttactgtattttgctgttttcgccccgttcgcttccatgaaaaaaaggaattaaaattaaattgtaaaaaataatggggaccatcacttggtcaaatgaatagcattggctgtacgggggaatgtacaggtgaagggtcaccgtcgggtcgacgtgcgagggattttccatccgatggattccgattttgtctgaatttatccgtttttccggttttgtctgaatttcatccgtttcctttgtgatttattcttttttgttcaattttgcctgctttatctcttcaaccaaccactgatgtagctgactccgttcgttttgaacagcgccgtccctgtcgccctcatcggtccctcttcttcttccttctcttcttcctcttcttcttccttctcttcttccttttcttcctctttctcttctttttccttctttggccatgcaaatcgcgtctccaaaagttgcccatccaaaactttgacgaagcattgcgcagcactgtggtcgtggatgctgaaaatcgttggagttaatgcgctttcggttagccgacatttgcggaccgacatttgcggagaccgacatttgtggcctaattgtcaaaaaaaatatataatgctttttccaataaattttcgtaattcccaaaattgaaataatgactgaaggtgataattaaatagtgcttcttgctctaagctatgccaatttcggcataccttttttctttaatcggaaaatttacccacaactaaacgaaattattacatatagtttattgggcaaattgataaaaaaatgctttatatacaaatcatatcacaaaatatataggacgcaaaattttttgtgtttcacctactagccttagtctaaagagcttagattttgatcaggcatacctaacaattaatatcaagaacaaataaaaaatataaaaatatattttatatctttaaaaagcaaaattaaaatgaattactcacattatctatgacaacataattcttgtaaatcatgaatttataaactaatgcattgcacaagttgatcagatcactacttaagaatgatcaaaatattaaaagaaattgtttccggaaaacacaaaccaaaacagaaatagtttttcggaaaaatacaaaaaacagaaatagttttgtggttaacaaaaattaaaaaagttttggggaaaaataataattgttgcggttcgttttttaaaatatagaaaatagtaacactaaaagagaatatcaggttttgtggaggaaattatccgataatgttgtggatggttggaaaatattaaatgtcgagagtgcgtatttttaacaataaaaatgggtataaatttaattaaaatttataaattatgaatttatatagaaaatatggatgtacaaaaaagatttaaaatgtttgggttttaatcaaacccaattattccattaatattatcataatttaattgggtaggtaaaaagtaaaatgaatttttacagtaaataaattcaatttaatttttttaattaaaacagaaaaacaatttcttttgtattgtttttttgacttaaaaatatttaatttaattanaaatgcattanattttgttgaacccggaaatcatattatatggc

SEQ ID NO: 21501 - DNA, 2394 bp, Heterodera glycines
aaccattccctgttttgaatacgtaaatattttgttaatgcttttccttcaataaatatttctctctcttcaaatggtaatttgaatggcttaaataaagccttaaacccggggacaacagcaatgctgattggtgggacaagcaatgggtggcaacaggcaacgggctacagatggatgggccggcgatggtgtggcacaaaatccgggccgtggtgaggaagggtgagcagggccaagaacgccaagccaattctcgattttaatcagcaattcaccaaaatcgcctgtgcggattgaagggaagaaggggcaaatggtgggccgagcccacggattagcaattgaatatttatgtgaaaagtgggtccaattgggataatccgccgccaaaaagaatcgagaacggagactctcgcacatccctaggtgggacgtccggcggtaccgatagggcgccgccggtagaaaattttggcatttttaattacattggcttttgataaagttaaaaaatgttggaaaataaaaatgtttactaactttttacttttgttcataagcattgacaaaaaaagaaaattagtaaatttttcgctttatttttctaatgctaaaaaactggcgagttttagatgccctacaaaatatttttatagatcagaatcaaataaaatcactgatcaaatggatgagagcattctttttttccattttctcatcgttgcatatccaattccaaatttcttggcaattattttgtcagtcacttttgggtttgcttcttttatttcataatattgcttcatcttcatcaatttgtcctcattggaatatttcggtggtgctttaatataaaaattaaagtaaaaatcgaaaaaatgcacttacttttattgtattttggtgccaattcttttttccactttcgaaatgtttgtttagaaatgcccaattccttcacgaattctttctgtttgccatgggcatataaatctttaaattcatcaaatcgttcaatgaattctttctttttgtcctcataaaaactcttttccatctttttatttaaattcatttcttttttccatttgtatatttttttgcgatttgtgcctaataattttgcaatttttctctcaattttgccataatctttccttttgtattttcctttttgcttcaacttttctttaattgcttcaaatttcaaaattatttctctctttttgtgatcatttttcatttgatcatttcggtcatttcccatttcttcacccatttgatcaactgctgctgattgtgagttctcatttcgttcattttgttcaattttcactgtttgctcactttcttttttgtcccatccgttgccaaatatttcatcaaaatttggtcgaattttgtcggagtcaattacaaaaataaagaaaattgtaataaatattaaacacaacaaattcatttttacataaaatggaaatatttgtttgaaatattctataatattgtttttttatattaatattgctcaattttttctcattttattgacgttaataaacaaatcgataatgctgaataatatgctaacattggcttttttcagtccgttgcttttcatttattatgaatgagtggcgagtgattaatttgttatgtaatgacaatgtttttgcttctcatccgctggcggggcaaatcatacggaaaaatcaaaaaagaaaagaattgcccggagatttgcagggtggggctcttggtgtcatggcccggatcccgtcaatttttttctaactttgtcagcattcctgctccctgatttcttactcggggaggaaaggataaccgtccagtcttttaggagggcttaggctttgctttttttatgcgagagcttttcggcggcaaggctaatagaccccagggaagtagggtcgttctcggcaataaattggaaccgctgcggagtcggtccgcttgcttagcacgaccctttcagagtctataacaattgagtaattatgatcaattagggagaaccaatcgactaagaccagggcgctaccccggagagaccattaagcgaaatattatcatggattatgtgcgaaaaagccgcccaaaaagaggacaaattcccctcatttccattcatggcccggatataaagcattttcctgctacctgatttccttattaaccgtccagtcttttaggagggcttgggccctgcttattttctgcgagagcttcttggcggcaacgctaatataccccagggaagtggggtcgttcggcaatacatcggtgccccctgtattgagtcggtggaaatggcggtcaaaagagcgcggagtttctatcgaataatgtgcacggcatgattaagag

SEQ ID NO: 21502 - DNA, 1274 bp, Heterodera glycines
ggggtgagtcggtcgtcgggtggttggtgtccgtcggaaaagcaagcggcagcaccgcacatcggcacactgcctgggctccgagttgggcacgggcaaaggcacagaaaattgtctgatcctcggcctgtgtttgtcccacaggtcagccaggactccaatttttcccaccaccatgacaatgacttcgacttggagcagcgcaatcgcgaggccatcaaaagcaacgcggagcggcaggcggcgcaacagttggaaaatgccaaagtcagcgaagggggggggggcacggcacggagaagcaaaacccgacactctttaaaagggattttaattaactactctcaatcttgggccatttaatccgggttctcgattttgaggcattgaaaaatctcgatgggtagcactcccgacccgattctcgatattctccccaggcaaaaataacttattcattttccttaaacattgctcggggtaaaattttcgctcggtaatcgatcgttgtaattgatccataccaattaattatgcttgttgattgattgaactgactaattgtgccaattatccccgtccagtacaacccggtgctattcgccgtgcagaccaacgtcgactttgacggcaccattgacgacgacgcgccggtgcacggctgtgccgtgtcattcaaggcaaaggagtttctgcacattaaggcgagcaaaacaattaaaaccgaaattttaatcgggtgatttgttgcaggagaagtacaacaacgactggtggatcggcagattggtcaaggagagctgtgaactcggctttatcccgtcgcccgccaagttggaggcggtccgccaggcgcagcagggcggaaaaggcgccaaattgtgagcattttttaaaccccgcgacgggacaatggaaacacacaattatttccaaattcattcatatttgtgtagccagatggcctaataattatttgatttagctttgtgtttaatttggttatttttctgatcagagatttgcgtgacttttagttgatcagccagatgattaaaatctcgaacgaatttgggtatttctgatggtgattttagctatcggatctgctacttattgatccagctcttgctttgtcctttctgctgatcactaattagaaattctcaaaaattttacccacgactgataaaatgattagattcgatcaaatcaaccatggtttgaaaaattataattagtttatgctaacaaataaatgcactaattagtgc

SEQ ID NO: 21503 - DNA, 2067 bp, Heterodera glycines
  misc_feature (46)..(46): n is a, c, g, or t
  misc_feature (2049)..(2049): n is a, c, g, or t
ttgtttagccatttctccgttcgaccactctttctgcctgctacanaattcgacttgaactttttgagtcaacggaaattgcgccctttgaattgatgaacgaacggaccaatgaaacgttgacattggataaagaagaaaacgatgatggatgtatcgtttgggtgttgaagcgttgccaaattggggggacggttctgtgggaggacaaaaatttggataatttgaacaatgtcgactttttgctttttgaatttgggtgagtggcaacagcacattttctttgtttaaaataattaacattatttcacttaatttaggccattgtctccaccaaaggcgggccaaatgaacgcaaaaagtcgtctgaaaatgaataccgggccaaacgggagaaaaaagttgatgaaatatgtattgggaaatgaccgatgaatggaaactgatctgataattgctcttatttttaatggtcaaatgttgaggcaaaaaaggcaatgatgagcaaaaggaaaaggacaaattgcatttaaaaataataattataataatattattagagcccggacgggaccgggccccgcggggatttaaaaagttttgttatgtgacggaaaaaatttatgattgaaattcatcacattccatttccttcccttcataagcatcttaaattcataaagtgatcacaaattaaagggaaatgaattatttatatgtttaaaaaaatttccacatactcaaacaaactttgatttacaacgcttcttttacgtctgattttgctttttcaacaatgttgactttgcattgtgaaaggaattattttgaaattgaagcatcattaatttatttgacgtgtttaatcttaacttttatccaaaaatctaaaattaaatttttttatgacttttcaattccgagacctttgcatttatttttaataatgacttgaaatgaacataccacattgacattatgaatatatttattcgacgcctcatcggtcttaaaaacaaaacccaatttttaaaaaaaaattacgaaatagaaaaatgaaattcaatttcgcaaattacgaaatttgatacaatttcgtattttttatggtccggcgtgaaaatttttatagatttttacattcatatcaaaattttaaataaagacatttcgccaaaaaaattattaattttttcaaatttggggcagtttcactggtgaaatttagtcccgtttttccggcccaaattcccgggatcgggaccgggacttggaaaatggacccggacgggatcccggcaccgggactcccgtttttccgggactcccggtcccggcggtttgcccaaaaaacccgggaccgggaccgggagtcctggcaaaatcccggcgggatcccggtcccgtccgggctctaataaatagagacaaaattaatagtataagaatacaccaacaaaaaaatttaatttataataatggaattatatataaataaatgtttaaattattaaaatttaaaaaaataaaaatttctttttattagcgacataatttttaaatcctaaattaaaacatttattaattatcttataaatactcagcataatttaatttagattattgaccatattatatcagtttttgtattataaagttttcgaaattaaatgtattagtgaaacttttgaatatttttacttgatagtatttgacacattcgaaaactcgtgttagaagcgtaatgcacaaacattgatattgattggtcaattttagttttgtttttctttgttattatttaatttcttttagttaattacaataaggttcagtttaattttatgtaatttgatttagattatttcgtattttatatttccttcgtaattaaaatattttgtagtttttatgaacgcttgaaagttcattactttggcattcggcactaattgaaaaaccaccagttttgatgccgttgaagtttgctaattgttattctgactccataattacatattattagagcatgatgttacttcctgttgntaaagtttgtttatatgt

SEQ ID NO: 21504 - DNA, 1617 bp, Heterodera glycines
ccccccgtgtccatcgctttcgttcatttccctcccccgccttctcatctcttcgcccctccttgtcccatcaccccctctcagcaaattatgcgttgaatggccaaagtgtccattacgcaacattaaagtgtaagggatgagaacggccgcagaatggcaacgccaacggcgaggattggctgccgtaaatcgtttggcgctacagtggcttggcttctcacgcccatccactggcgtccccccccaagccattccctctgtcattttgttttcattcttcatttctgctcaactctactccgccgtcagccagccggcacttcaatcatcggcttccatcaaatccccatccaatttcgtttcatttttgaaattcgaatcatttccctcccccatttccatttctgtttttgaccaatttgtccctcatttattttgattagtccaccatttttcattgaaaattggccgtctcctacagttcgcctctgaacggcccccaaattttacccaaattttcccttggccaatttcccccatttcattttaaccgcatttatttctggtcaacacttttcactttctggtcaattagccccttttcaattctggtcaaatccccattttccatttccctcattgctcaaaaatgccccttttaattactgagcattccatttccctaattatccattatttatttgcgcacttcgtctgatcgtgtcttccctcatttgtcattgatcattttgcgtgtttttgagcacttccatttcccctcatattcatccgatcaattatcccatttctcttttgatcagtgccgcccccgcccatttattgatcaaatgacacaaatttattttggttaatgccatccctcaattttttttttctcaaattgcgcgcaattctgagcagcgtatcccttcctctttaatcagtgccattcttcccccccccattttcttttgatcaattttccctcattgatcatgtgtccctcattttaatttgatcaattggccctcattgatcaattgtctcccatttttatttgatcaactgtcctagtcagtcccatcccgcatttcttctgatcagtctcccacccctctattttcttttgataatgaccctatttattttggtcaatccccgtttttggtcattgtcaaattgctcaagtcttccccagttcgcctctgaacgaccccattaatcccgaatttttcccttggccaattctaccccaaattactttaatctcttctatttctggtcaacaacttccctcatttttctggtcaattaactcctttcaattttggtcaaccccccatttctcatttttctcattgctcaaaatgcccttttgcgggcaattctctgatcagtggcatcccttccccatttttcattgatcaaaatgtcccaattttttttatcagtgtcattccccattcttcattgatcacattgcgcacatttcgcttgatcagtgccattcccccattttcattgatcaggcacattttattttgatcattaccttccccatttttttttcttttcttgaatcaaatttcgcatggcttttggtcagtccccttc

SEQ ID NO: 21505 - DNA, 1738 bp, Heterodera glycines
  misc_feature (127)..(127): n is a, c, g, or t
  misc_feature (133)..(133): n is a, c, g, or t
tggtcgagctggagtcgggccaagccctggaggagatcatcaatttttggctggttgtgttgcatttgtgtttttcttttgccttcattatttttgaggtcgccaacccttttgttggtcttatttntcattntaattggaaaaaggggtgtcgtttccgcacgactcggcttactggtgaagcggcgattaattttcatttctaaatattaaccccaaattatttactattttggcaaacggaaatgaatggagtaattatgtggtgacgatatgtgctttatacgcatgtttatttgctggcgaatgggaggagaatcggaaaacaaggtcatttggccgacggccttatgcaccaaatgaatttgccgcttttattggattagcatattagataatataagtagataactttttatttaaaattactgttcctaaaaaggcggaaggagtggaaggaataccaaatcatccaattcgttatgtaatcaaatcaaaaattatttgagacccaaaaaaggcaaattactattattgcacataaatcggaaaccaaatttattaggagacaaaataaaataataaacattactgtaatgacgcataaatcggtaataaaattgagagagcttatgttttaataatacaataccaagtctatactgagccacacacaatccccaattcgtacatggtagaacatcgaaatgtatccaactttcttcatgagatttgaattgtagaggtgatagacttcgttttcatctgaacggatttgaggatggattccaccgcgcaccatcactctcgccggctgcttcagacatgcgggtagatcggttggctgcattgtgcccaagctgatgcgtttgcggacgctgaatgggtttgatgacccaacgacgtactcaatcacccgcccacataattccgagaccgcagcgcacttaaaaattcaatttcaaaataatatttatctctcttccttacatcattatttgtcgtatgaattaaaatgtcgtttggagccaaatttttgttgtattttccaaagcataaatactgtagaatttccataaagaattcggccgaaaataactgctcattgacagggaaatacgccgaatccaaatagtcttgctcaaagttcaaattcctcacttcacaagcagaattgaatttcgcattaatgacagacttaaaatttttttcaaaaatgtatggaaactaatgattaaccagtcgatttttgaatttattgtactccttttctcttgattgacgcaaaatctcaaatttccaattaactgggtcaatcttcgaggaccatcgatttttttctatataattaattacaaaaaataaaataaaaagtcattaatacccgctattccgtcaaaaaattgcatcattgggaggcacatgatcagctctgagactaattcagtcggaagtgttttagacgggaaaccatagcatttcattttgacaaaatattataaatgattcttgatttttgctgattgccgaaaaacgtcgagactggtacaaaagtgtaagctcggagggacctctagcatgaaaatgggcgtggttatctttcaacacaagccgttctcgaaactcactcattttacacaccttgtctattcgagaaatcattctatttttttacacttgctcccgagtcatcttttattccttccctccctctttctcatctatttatttaattatt

SEQ ID NO: 21506 - DNA, 2152 bp, Heterodera glycines
  misc_feature (619)..(619): n is a, c, g, or t
  misc_feature (889)..(889): n is a, c, g, or t
  misc_feature (1759)..(1759): n is a, c, g, or t
  misc_feature (1764)..(1764): n is a, c, g, or t
  misc_feature (2123)..(2123): n is a, c, g, or t
  misc_feature (2145)..(2146): n is a, c, g, or t
aaaaaaaaaaataaaaataaaataaaaaataaaaaaaaaaaaaaaaaaaaaaataataaaaaaaaaaaaaaaaaaaaaaaaaaaaaaaaaaaaaaaaaaaaaaaaaacccccccccctccccccccccccccccctcccctccccccccccccccctctttcttttaaataaataaataaaaaaaaaaaaaaaagaaaaaaaaaaaaaaagaagtggggggtgtttgtgtggccccccccccccccccccccccccccccccccccccccctccccccccccttccccaaaaaaaaagaaaaaaaaagaaaaaaaaaaaaaaaaaaaaaaataatagggggtggttttttttccgcccccccccccccacacacccccccccccaccccccacccccccccccctcttttttttttttttttttttttttttttttttttttttttttttggtggggggggggggggaagaaaaaaaaaaaaaaaaaaaaaaaaaaaaaaaaaaaaatacgctcgccccggtttcgtctcccctctcccctttttttcttttctttttttttttttttttttttttttataataaaataaaaaaaaaaaaaaaaatctcgttgcctctncgccgcccagggggggggggcgaggggaggggggggggggggggcccgccccccgcccccccccccccccccccacaaaaaaaaaaaaagaagaagaggcgcgcggggggggggggggggggagaaaaaaaaaataaaataaacaaacccccccccccccccccccccccgagggaaagaaaaaaagaagagaaaaaagaagcgccccccccgccccctcccctccttctacttttattttttttcttatttatataaataaaaaaacanaaaaaaaaaaaaaagtgggtggtgtttggtgggtgggttgaaaaaaaaaaaaaaaaaaaaaaaaaaatctctccgcccccccgccccctctttatttttggggagggggggggggggggggtttttttttttttttttttttttttttttttttctcaagaaaaaagaggaggggggggctcccccgggggcgggtggtttaaaaaaaaaaaatatttgtgggcctcaaaaaaaaaaaaaaaaaagggggggggggggggggggggggggcccccccccccctatataaaatttttttttccccccccacaaagggggggtttttgggggggacccccacatattttcaggggagaaaggaaaagaagatttttttggggaaatttttttttttcccgggggggggggggggggggggtttttttttttttccccccgtttttttaaaaaaaaccgccccctttttgggggttttttttgggggggggggttttttggtttttggggggggggaaaaaaccctcacaaggggggggggtttttttttttcaaaccttcttggggggggtactcttgggaaggggttttttttgggggtttaaaatttttgtttgggaaaaaaccaaagtggggggggcgggaaaacaaaaattacaatttttgaaaaagggacgggggattaaaatgtggaatagcgggaatcagggaggggcattgcataatgcaattcttttcccagggaacaaacggctaagttcgggtttttgcggcgaagcaaaaatgaggggggaagggggagcaaaatggaatgggaaggggacggacgcttgggcggatcgaagttcagtgggaggggacgatgggcgagancaagnaagtggggagcatctgcatctgctggagcgtatggcattttgtgaacgaacgatgatgatgaatcggatacattggaagatatgtgataattgtttgattgttcatctctgtacatatgcccgttgtaaatatacatatatattgtattgtgctcttattgtcctatgtccggtagataaacgatatgaattcactttacatttttagtgccagtttctagtcttataaaggccatagaaattttgaattctgtaatttgacactccgtctgcattctcccttttgcgaaatttattgaattcgatcattttaaaatgtatgaaccaaattctccccatttttcttagttttgaaccgngttcaaaaatttaggttgaccnntgcagg

SEQ ID NO: 21507 - DNA, 2364 bp, Heterodera glycines
tgtcgggtccccaaaagtcgggtccccaaatgtcgggacttccaaatgtcgggatccctaagtgtcggatccccaaaagtcgggaaagtcgggtccccaaatgtcgggatccccaaaagtcgggtccccaaatgtcggaatccccaaatgtcggaatccctaagtgtcggatccccaaaagtcgggaaagtcgggtccccaaatgtcgggatccccaaaagtcgggtccccaaattaaccctgcggcattttttgtcacatatttgcggaccattagcaaattctcgaagaccattttcatgagtctctagacagttggcaaccattagcattaattgctatgagatagatatatcaatgaccctggggcattttttatcacatatttttgcggaccattatcaaattcccgttgcggaccattatcaaattcccgaagaccattttcatgagcctctagaaggttggcaaccattggcattgattgttatgagatatcaatgaccctgcggcattttttgtcacatatttttgcggatcatatcaaatcacgaagaccattttcatgagcctctagacagttggcaaccattggcttgattcctagccgcttgttggaattttttgaacctaccaaatacgcgtcccgaaaaattctgagctgatcgggaaacgcaaacccaattcgtcgccttttcgtctaattgatttttttgtagtttggtacacaccttcagtgtctgttattgactgctgatcgattcttcctcattcattaactcattcttcgctcaacattctgtgaaagtgttccttcccctccttcctcctcaacggttcattcacaggacggggaatgagaatgaacgactgactaattgaggaaattagcggaagaaagtctgctgacccaagcacaaaaggagagaaggagcctttctttctctctctctctctttcccttttcaatcgcctttaatttttcgtaaatttcatcaaactttgccctttcgtcgtctactgccaatgtttcccccccccctccgtttttttaccatgaaaaggtcattcaaaaaatcaacccaaaagacatttgcatttatttgtctaccagtttaaaaataaataaatgaattgattgttatggatggggtgcacttttcaaatgatattatattaaattgaaagcattttataacttatatgtacatattaggtacatttttttatttatccactttttattggtcccttccttctcacacttcttcctctgacttaacatatcactcttttcgccgtttccttctgccgatggatttggtcgcttcgtctctgcattatgttggcagtttttttgacgtggtatacaaatcaaatcattcaaattcatcgtcattttccctctcaaatttcgcgtttccttaggtcgatttggttgtgatcggtgcgctcgctgtctttgccattgcctattatgtcagaagtcagtcgctgtccgcgcacaacaaaatcaaattcccggagagcacgccgacgctgcgcaacggcggcacgctgcaggacagcggcaggacggaccgttcctttttgggccgcatgaaatcggaggaccggcaggtgcattcttttttgtttcatccttgaaaagacccctaatgggggtagtgaaaccctggttacagaatccatttcgtccacctcccccatttttgaaatttcccttaattctggcacatattttatgtcaaaaatggaagaatttaatttttgcttttgatattcgtttggcaaaaataaagtaacgcaaaacaatccactgaaaatgtttgccaaatttaatatatttcatcaatttaaaatgctccaaaaagatcgtttcggcacccttaaaatttttattcggctttttttgaaaccgattatgctaatatatttcttctcaaaagcatttgccttgtattttttacatccccccccataaaactcagattttgattttgttcggctcccaaacgggcaccgccgaggaattggcaggccgcatggctaaggatttgtgccgatacagcaaaaagtcgttgctgatgcacccggaagagattgaggtggacgatttgccgaaaattgtctgatctgtccgacccgacgctgctgctgctcgatcgccacttatggcgagggcgacccgacgaacaatgcgcaggcacttcatgaattctttaccaacgccgacagcgaactgaacggactgaaatatgcggatagagttttgtaatttcaggaagaaaccaaactggggcggaccattctcattgggtgattagattgcggtccctaattatacttttttctggggttttc

SEQ ID NO: 21508 - DNA, 1658 bp, Heterodera glycines
cttatgctgtgacaatgaacagttcgatattttgaaagagcaattggaacgcgcgcgtactattctctggcattgtccgagctgttacgcaaattttgtcaacttttggtgggtttgaatacatttttaattttacaaatggtactctctccgtccaatttaaaattgttttatgttgataatgcaggggtgcgatctgttctgatttgtcagaaatgttctatttggagcgtccaaaaattttttgaaaatacgcgccgcaaaaaaagcgtttttaaagtaaaaaaaaaattgttgcttggcttttatttgcaaaaatcggcttttttgatgacaatctgttaagaaatccgaacgaattacaaatttttccggcggcgcctatcgacaccgccggacactctcccatcgcccatttccctaaagttttttggaaaaatccgcctgcaaaaaattcttaaaaatctgattttttgatcagtgcactgaaatttacgaaataatttttgattaaataaatagtaaaaataactgatttgaagcaattaagcaaaatgttctggttttttatcccaaaatctgatattttttgcaggataataaaaaaactcatagagctctcgaaggataacaaattcataacaactttgactagtaaagaatttatatctcagaatgctggcttggttatatttttgctcaacaggtgccaattcgcgtgttcgccgtatcaggcacaatttgtggaaattgttgagacgcgtaatgatgccaataaaatacgtggcgatgattatgtgtcagaagtcgattattatgtaatcaatccttttttgcggataacaaatgtttttatatgacactttttaggtaaccaagcgctatgccaacgaactttttgattcatgcaaaactgtaagtccaaattctaaaaatcaataaataaactccaaatgaatgattgaacattcttacccaacacattcatttttccaatacttttcaattttcccattttatttattcacagtatttgttcgctctaatcctcccctttttctcttgttttcaaaggtgcacctttcgacccttgacttttcgttgagagttctctgcggcactgatattgacctctgcacgccggaaaagttgtaacatttatagttgctaaaaacttcaaatttaggggtgtaaaatcgtaaaattttaccaaaaaggtaacaaaattaagtcgaaccagtattgagataaataatttttaaaatcacaaattcatgtcaaaaaattaataaataatttggagatgaatttttgagaaatttttcatttcataggggtgcatttttgaaaaaaattttgagtcgattcttaagcgtttatttttgaaaattttcaaaaagttgatccttaggggtgtattttttctttttattgcatttttgttaacaaattttgggcataacgtcaaaatagttgaaaatagtttttttcaaaaaattttatagttttttagttgctaaaaataaaaaactataaaatagttgctaataactcgaaaagtagcttaacaacagccgaaaaacatgtgtttttcgtgaatttcaggctacggggagctcaggaaaaaaatagtgaaaaaactataaatgttatcccta

SEQ ID NO: 21509 - DNA, 2004 bp, Heterodera glycines
cgacagataatcgttttgcttagaccattggaactgtcctcctcagggacgaggactcttttggaccgaacgcaattgtctaatattttacgatggacgacggcgaaggacactttgacgtggaaccattcagcggccgagtgtttgtgcgaaatgcgcgactggccgatctgctggagggggcaaaagggcaaaatgggcacgatttttacgaacacggcaagtgaaaaggcaaaaaaatgtgaaggggggggggaagcgaaagattacggcatttacaaatggcacaaatgggggggggaaaggtcaactgtacaaacgaaggtagtttcagtgctggaaattgtcgcttctgacatggcaattcatcccgagcagcgcaaaactgcgcgacaacattttcggattcgaatccgcgacgtcaacacgcactcgccggtgttcgaccagtccggctaccgcatcagtctagctgaagttgtgacatcattgaaaatgatgacatatttggatttctatttttgatgtaaatgcattttcgtcagggcaattcacccggcattgaactgctccaactccgtgcgtcggacggcgacttgggtaaaaatgggcgcgtcgagtttcgacttgcggttgagacggaccttctctcggtggaccccgattcgggactggtccgggcggagcgcacttttgaccgggaggagttgggcgaccgcgtcactgtgccggtgatggcattggaccggggaacgccctcccgcgcgacatttgccaatctgaccattcttctgacggaccaaaacgatgaagcgccccaatgcggcaaggaaacgcatcgcttttccgttgcggaagacgcgcctaatgggcaattagtgggcactttcaacaattttttggtcaattacattcccaaggtcggctgtttggatgcatatgattcggatgagtttggcacttcgaacagccaaatccgtttcgaattggcacaatccgatgccaacgggccgttccgagttcatgccgagactggctgcctctttttggacctccccggccttccacttgactttgagcagcgttcgacgtacaatttgagtgtccggctaaaagacatgggaaaaccgccgcttgaagccgttaagccttgccaagttcgtttttctactcccatttcgatttaattaaggtttaaggtccaaattctgctcgaagatgtggaagagaatgcgtttccgcctcaattcaacgccatggcacttgaggcgagcgtggaagagaacgcgccggcgcacaccgaagtgatccgagtgcatgccgaggaccccgaaggggccgctgttcggtaccgactggtcgccggcaacggactttgctgctttcaaatcgaccccaaatcgggagtgatcagcacgaaaaagggtgagtaacagacaaacccgagagagagtgatagcaaacaatatttgcagaacttgatcacgaactgcaacagcactattggctgactgtccgtgccgaagacactccgttcagtgccatcggccgaatgcttcgcgcccatcttcagctgtttatccgcgtgctgaaccaaaatgaccgactgccactgttttctcagccaatttatcggattggaattgcggagaattcggaggaaaataaggcaaaaacggcattaatgcagagatgccagatcatgtttttgatcatcaaccgagctctaaaaaatcccatttcataattaaaattcgcaaaaaaaaacctcaacaggcgatttctgactgggaaaattttgaaaattaaaccctcaaaaactgcaaaatccgtaaatgctcattttcaaaagggcctagtcctcatatctgacactccgattatataaattgacatcaatcaagaaggttttgattaggtggtattgaaagtggaggccacagacggcgacgatcagtgggcgaagccgagtcagcagagtgatcggctgagatactccattct

SEQ ID NO: 21510 - DNA, 2380 bp, Heterodera glycines
tttaattatatatatcccttccccaatgttcttcatttattagctaattcaaattttcatatttaagaaagataaaatttaaatttatcttatgaaaattttatcaactctaatcctgtttttcccattttcgtgtttttgcttatttattatttcgtgatttgatatataaaaataaataaaatttgtggctttcaacgcaacgcccttgttgtgatgtcatgatttttgcgcatttcgcgcaacgaccgaacaccgttcggttagtgctcctggaaccgtaattttaatccagatggatttttacgagattccagacaaacgctctcgctcccgccaatttcttaccaagttttcattattatttttgctttgtttaatgaataggagtttttttctttatataaattattttttctagtaattttcattttttaaaatttaattattttctaagtgaattaaattcaaggtcacattattcttgaagtttctgctatcatttagttcatttttctacaataaacagtcatttttcagcttaaaatttataaaacttggaaatttaaagaacgaaattacattaatgaatttgatagtatttttatcacataaatatatttatcaacaaataaaaatctcaacaaaataaaaattaatcagaaattgttgtttgaacagatgttccagattatttgcagtttaatttaaccaataaataataatcaaaaattcagaaaacgtaaagagaaaagggacaaaaaggcgtgttgagtcgatccaaaaaaaaaactcagtgaattaaataaataaatttaataatccaattcacaaaatcacggtgctgtccggtctgagggtccttcggcagatgtgcccgacccatgacgtgttccaagtgaatggaccaagaaaaagacccggcctgggagataacccttgaaaaactgaataaaaaattgttcttaaccaggccggtccggattccggatcaggcacttttgatgccccggaagaggtgcgatcggcttccgggaaaacgaccaatcaatcattgagtttttttttggatcgacctagcacccaaaaaggaagcgaaaagtgacggaagagaacacaaaagtgaaagtgatcagagaattttataaatgataaattgaaaagaacgctttaaaagcgaaacagaaacaaaagttcaaagaatggaggagaaattgaaaatttagggatatatttgatttggataaattttaaaataaccgaattttgcaaaatttctgatatttttgacctattttcaaatattcaattttcacgtgaaggttttcagtttttggcacatttatttgtgcctttatatacttcgtggtgaacaaaaattttcgttttcatacttttcgttcataattagtggcttaatgccgggatatttaatgccattaattgacagctgctgaactgcagtgccatgataagcactaaattatgcggttttaattattttttgcataattattttttacccaaaaaatgattcaccaaaattcaaaagaatttaactgttaactgcccagcccaacaaattattctgtgaatcattctgagaaaccacacaaaaattgtcactgctgttaaaccaatccaaatgcttttggttaaccataattttaagccatttaatccaatcattctcattttaactgtggtaaattgtaaaaatatttaattaatttatttatttattttttaatacagcatacactgaaaaaaaatgttcaaacaaatgaaccttttcgttttattttttattttttcatcatattcttttggcactgtggagggatcggcttttacggatttttttactgatttgggcaataaggcttgggtgagttaaagcgtttattcctttgcattttttttgtttctaaattaaaaaaaatatacatttaaggaaggattgaaagaagcaggagaagcaatcttggatgggataaatgaagcaacgaaggcgctggttatcccagggtgggaatgtgggccaaatgatccaaaatacctcgatggaccgtcacacgtacattaattcttcgaacatttattcatacatacaactttttaagcttgcaacgcaaacaatggttatgttcacaacctgtgtcttcaaaatgagttaatctatttgaaaattcacaaaaaaaaacaattgaatttagctgaaatcaatcaaatgttgcaagaccacgacaagtatgtttgaaaaagataggaaaaattaagctaaattttattgaaaatcaatgaaaaataattgaataacaactcattatttaatgttttttttgccccaaaacataaacccgaattaaaattaataaaa

SEQ ID NO: 21511 - DNA, 1833 bp, Heterodera glycines
atgaaaggtaaattaaaaataccttctgattttgctatgaaaatcagaatttttccggttattaagtttgaaccttaataatcagaattattctgacatgaaaggtaaatcaaaaatacattctgattttgcagtgaaacccagaacttttccggttcttaagttgaaccttaataatcagaattattctgacatgaaaggtaaacccaaattattttgtaatgaaaaccagaattattccggttgttattttgcacctcaatgtcagaatattctgagtcatcagaatactactgaacatgaattgtaaatcaaaaatacattctgttttgctatgaaaatcacaactattccggttcttaagttgaaccttaataatcagtattgttctgacatgaaaggtaaattaaaaataccttctgattttgctatgaaacccagaacttttccggttattaagtttgaaccttaataatcagaattattctgacatgaaaggtaaatcaaaagtacattctgattttgcagtgaaacccagaacttttccggttcttaagttgaaccttaataatcagaattattctgacatgaaaggtaaacccaaattattttgtaatgaaaaccagaattattccggttgttattttgcacctcaatgtcggaatattctgaggcatcagaataagcctttgattcccgaagattgcaacggtcggttcgaactgcgcgggtgggcagggctcagttgagtcacaaatgatgggtatattttaaaaaatgcccaaattattttgaaaattaggttgggaccggtaattttaaaaaagccggacatagaaatgccgaaaaccaaaaaagtcggcattggcattccgatttttaaacataccctcaatttgttgtcgataatcaatgttgtagcgaagaattccaaacagactctggtcctgtcgatggcaagtcaagttcggaggaatgggcatataaacgcacttaatcgtctgtccaattggcaccatacagtcgggctcggcggcacaaagcaaggccatgcaattttaaattattttatttatttcaattattattgatttaaaatctttattggtctgggatttaaaatacgagaattcttataaaaaaaaagaagcatttattatgcttaagactgggtattttcacttgtcaccctctacccccccccccccagattctttaatcatcttttatggtaatttgaaggctgaaattttggtggactctattttaaccaagctcaaatgtcaaaagtgaaaatacattgttgatcactaaagatactcaaaataaatatttctaaaaaaaggattgttaattcggcgatgttgctatcgcgccaataaaattttaaaatttttaagagattttaatagttttttgccaaaaagaaaattaacaaaaatcctcaaatctcaaaaaatcacaaaacacataatcaaatattcttgttcaaatattagtcaaaatttgacactttaatgggcggggttatgaagaactacaatttttactaatgttcgagtctaacttttatcccaagtttcattttatcgcagaacttaaagccgttttttatttattttaaatttgggcagggggagtcccaaagcggtgtgtaacatttcaaaattgagccatttgttctctctaaaaagcctcgccatttcatcgtccgccgctggggttttccaaaaaataaaaggcgacaaataaagtttagtcataatttgagacggaaaatgttaaggaaaatgaaaagtgaaagaacaaaatgacaaacatcccagccccttt

SEQ ID NO: 21512 - DNA, 1904 bp, Heterodera glycines
taaaaaggacgcaccagtcggcccttcataaaggtgaacaaagtgcgccgaaagcggctcaacgtgcacaccaactccacgtggaggacagcgacacccggacgcacgacccatgccaaaattcggtccaacgggcaaaagtcggcaacgaatttgcgacattgcaccgcgagcagaagcgcgtcgaacggaggcaacacgtctttgttgctgtttgcggtgaagaaaaagtcggcggcagcgtccaaatttggcggtggcaatgtcgcggaatgcgactgcggcaactcgctctaaaattgttccgatccgtcaaaattatgtgaaagtcaattgcaagaatttgctcaccaaaagttgggccaatgcccctacgtccagcataaatcggcaagtaaagtccgctgggaacacgcccgacccatccgcctgcacattcggaaatttgtgcggagtttttgtcgtctcaatgtcaaaggcattgctctgtaaaaaaaatttgttttattgaacatttttcggcatttccctcccatttctgctaacctccgtcagtgccgctgttttcgcgttgggctccgtgccgagcacatgcgaccgaccgatgatagcgcacagtcgcgcgtcgtcttcgccacaacttccgcctttgttcgacatgaacaaacgtctcccaccgccgaagtcgtcgccattatttccgtctttgtgcaccattgacgaacgtctcccaccgccggaatacatttttaagctgccgataaaaacaaggcttttgtttgtagtgttttgagagccccgggcccaactccatctagtgaaattgcgaccactcattagagcagttaattatgtggagaaaacaaaactgtaccgcaagaaaatgacttcctccggcggcacgtccccatcgtcttcaaagcgttttcccacgacggagacaaacaaattgaacagtaacacactgtcgccattgtcggcgaagaaaaagtaaacggtgacatcagaaaagtcggcagtggcatccaattcggacggtggcaatgacgcggaaaagaactgcggcaaatcgctctaaatgtttggatcagtaaaaatgccaaattgcggttggggttttcttaattccctgaaaaatcccacgatttcccgtccccactttcgtcacatttctgctgacctcagtcactgccgctgcttttgcgttggcttccgcgccgagcacatgcgacagaccgacaaaagcgcacagtcgcatgtcgtcgtcgccattatttccgtctttgttcgccatgaacaaacgtctcccatcgccggaatacatttttaggctgtcgatataaaagcctttaaaaagacaaatatcaaaattttcggccaatgtaaaacaaatgggttgtgctttatacgttttaataatataattaaattgctaattagataacaatacattcatgtacacttttatacaactgttcttcaactttctgttttgtccactagttttaatacacgcaaacacatgtgtagatacgcgaaatacactccttaaaatcggcggaagtgaaagtgtgaaaggcgtataaaaatcgatatctcattctacagtatcctttttatgtattggttgctgcaggaggtagagaaaagatgaaaaagaagggagagagagagatggacaaagacggagaaagcggggaagaaaaagaaatagagaaatatcagctcactcatttatacctgaaaattattatgttagtaagactaaaaaaattattgaaatttattagagtcaattaaaggatatttgttaaaattttattggttttaataaagcatcaattacaaaaacaaatgattaaatttaaaggtgtcagcgtgattcaaaaaaagaaacattaaat

SEQ ID NO: 21513 - DNA, 1998 bp, Heterodera glycines
cgaagcaccgtaatttgaggacaaacagtcgaaatgaatgaatgggccaaatgaatgaattgagtgaattggacgaatgaattaataatttacggtccgtcccatcgccgaccgatgaatcaaaagccatggattgcctttgactgtaaaacgggagaagcaatgtgatggtcaacagaccaaaaaggggtaaaaaggagaagcatttggcactgtccgtgccgaacttcgaattcgtcactctttctctgatttttgctgaatgccttttggtgtcgtcatccatcggcttacctccgccattaaatttggcttttcctccgccattaaatttggcttttcctccgtccattcgttcgttcaattggctgaccaatgagtttctctctgatgaggcgacagatcatcccttcccatcatttgtgtatgttttcgacagatttgttgcacaaaaatgggaggagaggacaaatgacgcggtcgagagcattgggcgatcggtgtcatggagggattgcaccacaaatgccccaattcgcgccaggacaccccaaaatcccaacaaatccctcccctcagcgaaggccatctcaacagcttaaaaaatgctgcagcaaatgcataactttgaattgtattccgtcccattgtttgggtgaccaattaattaattgacctttttttgttaatcgatgataacaattaggacaccctttagagcagagatcgcatcaaaaattttccaaaataagcatatcactgatcagagaccaaaaataatatttttggagcattaaatgcggtgattataaataatttgtaaattattggattaaaccaatttatttttgatttaaaatttaagcttttgggccgacggtgtcgaaaggcgccgcagggaagatttttgaaattaatgcgatttgttaacaggttttcaataaaattggcaattttaaaattaggtaaaattaatattttttaaaattatttttataccaaaaccgaagaaatatgtataataagcacgaatattccaacatggatccaggtcaaggtttttttttcaaaatgtaagctctacaaagaaatacaccccccccccccccctctccctaaggattgattttaaacgtatgaacttttctaaatcaattttatttatttattaattctgcatctcccgtagttttataatatttgtgtgtgtattttgcattttgtgatttttaaaatgcaatattaaggctttttgtttaatatacaaatgattgtcctaatgtttgcaattaacaattaacaacaaattgctcacttccgaatttgacttggcattgtgtgcagcgaaagcgccgaaagtgcgtttgcatgcgatggcggctgagggaggacgaatgacagaactgtttgagacaatgggagcagcgaaaagtgcctgaagaagcggcaaaatgaggccaaagaaaaaagcattggcaaacagaaaaactgagaaaaacgaacggacgaagcgaaatggccaaacctttcaaatcgggacgcttcaggggagaaagaacgcccgaaagtttacggcacggccctccgcccttttggcattccatcgcagtgaaaagggcgaactcagtggaggacaatgtcagctgacgagtccatcccaatgggtaaatctgtgctgatttgcgaatgcgcttttgctgtctaccatcgcttccttttaattcactcgaaatgccttcagcaaaagttcattttggcgatcggttgcgcaaatgcttctggtaattgcaatggaagagatgggcggaagaagaggaagaagaagaagagaaagaagatgagcttggagaggcgaggaaggcacttccaacgaccgaccgacagatcaacgggtcccttccccccccccccccaaggctgacccgaattcaatcgcggaggactcgtccacccaatcgacggcgctaaatgcactcacctcctaatgaaaagaaaagg

SEQ ID NO: 21514 - DNA, 3363 bp, Heterodera glycines
aagccactttcaaattgcaatggttatcggacaacgcccatatgatgagcgcgccaagtttggccccaacgggatggctataagcgaacatttattgttagacgaatgcctgaccttggaacagggcatgtaaaacatttttgaataaattttcagcgatccatttttttttgcttgaaattttgttagaaaatttttttgcagaacaaaggttgccgataaattttttttaacttaatagccgaattctgaattttatttttaatgcaatcttaggtttttcttggaatttcttgaaatttttacaaaaaaattacaaaaagttcgattaaaatttgtttttcctggtgacgttatgtttcggcgaaatgcatttcagcagcaacatttatagtgcaccgttccgacccctacgaatttttttccccctctgatttaatggaatctcttacttttgttgccgttcaaaaatgagacgatcatgttatagctgagcgggctcaatttgttggcatctttcaacaagccgttgaactgtttcagcgcttcattcttaaaagcagaaagaattcatggtggtcaattaatttattctattcgaaccctgccaaaaaactataaatataattttgtgttttttttttcttggtcatattcctgacggtcaaaaattaaaataaattaaaaaaaaccgttacattgaaattcgtctccattctgggcatttgttgttgttgttgtaattgctgttgttcagtgcttatctccgcaaacaaattgttgaaacatgcgctgctcgttgacgacgctgaggaggaggaggccatcattgtgctgcttgggttggttggaaatggatgcgagccaactgaaagaggggacaaaatgatattaattgtaagaaatatggtttagcttaattagttcgaacaattaaactgccagaattgtaagactgaaactttaaaaaaaatttctggttggggaggagaatcggcgccaattgtaaaaaaaatcgtggggctcaaaattttttttgttttttagatccaagttcgaatccattactatgtagtaacattttattttattttttaattaatcaactgttcaagtccctactgatcaattgagttcacacaaattcattaaaattccccacccatcggtcgaattggaaccgtttgttgctggtgctgttgctgattgacaatggcattgctgtactgttcggaaatgttgttggtggtgttgttgttattgatcaagcagagttgtgcagccgatggatgaggaggaagtgcaccaccaacattgtcaccgtcattaaccaagccaacattggcaccaccaaaagtgccagtaattggaaccagaatagcagaagctgaaatgaaaacagaggtatgaatgtcatatactgtattataaaaaagaaccaaaactttgaaaaaaaggtacgccaccgccaaacgactgaattctattttttcaaaaatagccacaaaatagaatgatattttttgacgaaaacaaacaatgtttaactctctcgaagtgcatggaaaaaatgatttggacccgaaaagaaaaaaataaataaccgggttgccatttcacaaattttcttctttttttgtttgttacaggcatgcgcaaacaaatatcaaaagcccaaaaagaaaccgtcatttgcgccctccggcattgttttgttttcgtctccctctttgtcgttgatgttgttgcattcttctgcctcatgtttgcgctgttgtcgtgccgttttctgtggcgatttagccacagttgcgcccaatttgttgttgttcaatgacgagtgtctctggttgttgttggtcagcgaacccttctataaaaaaatttaaaatttatttgtataaaattcttaaacaaaattgtttaaacttgaatggatatgaaacactaaaaaaaaaaatttttttttgccctacaaaaacttaaagtagtttacttactatttaaaaaataattttttttttaaatttcttttaaatgatcttctagaccacgagatctagctctctacggatggtggtataacccgaattggaaatcagacatttacagatcaacaaatgcagtccggcatttgcacttcgaacgtttgcggcacatgacaaaatcggattttgcggtcaatgaaattttttttggaaggggggtcccaggttcgaaccctccccacgacattgaatattcttttctttatatattttcctttcggaaattactaaacacaaatacatatgaacacgatcgtaaaacaatttcttcaaaccaaacgagacaaaaaaaaatacccgtaggttttgttgctttggttggtcccccccatccgccattgttgccaattgtgtcgtttgtggtgcccccgccggtgccgttgatgatgatggcactgctgttgttgctgcagttacggtggtccgccggcgtttgttcggctgtggcaactcggcaatgtccagcaattgggcaccgccagcccgcttcggcagtgtccgttgttggaactttttggagtcagtggtgaacccggtggaccattttcaacgcattggacgatgacgaaagacctttcattggcactgaatgggcgaaaaattttttttttttttttgatagacacaattcatagatgaagcggtggggggggggggactcgctggcaaagggcggccacaaaatgagggaccctaaacacgcattaaaaatttcaagatttttcacgcgacccgccccactggtctccaaagattttttgtcgaaatgtgtaattttaaatttttttttcttttcaattttttttcataaagcgacaaaatttgatatttattgaactcttttccaattccgcacattatcaaaggttaaattttgataaaaactgcctgcaaaatgcggttgcaccgaaaataaaaaaattaattaaaaaaactgacaattattatccaactttttggcacagttccgtattttgattggaaatgatgacatcagcacgccgtgactcttccgatttgccgggttactttgctgttcagcagctgaagacaaaaaaaaattagcaaaaaattccaagcaatttataccccttttgaatttgcaagaaaaaacattggatcggaaaaaataaagtaatcgtccaaaaatactcaaattttaaatttaggaataacgatttttccgggagaggtggacaaaatatcgccgatcaaaacaaaacaaaaaaaatctttttttttaattttcgcgagtttcatttttgcggcttttttggcgtcgaatttttagcgatgcatcggataatttcattac

SEQ ID NO: 21515 - DNA, 2609 bp, Heterodera glycines
gcttacattaaatttttggaatcaggtgaatttccggcaggttttgatgagaatgaaaaagagcaaatgaccattttcgcaattaatttatgtttaaattctggtatactgtactttaaacctcatggacataaaccccgaatttacataccaatttctctcagattattagtattcgaatcttttcataattctccactgggaggcggacatatgagcactaacaaaactgttaaaaagtgccggacacggtactttggccaaaaatgcaccaggatatagcaatttggacaaaagcatgtgttaattgtcagctcagaaataatccaacaccggcttatagagccgaaatgtcaattactccggctaatacactctttgctaaagttggattagatttagctgggccctttccgttaacgataagaggcaataaatatttattaaacattgtatgttggtttacgaaatacgtgatatcagtcccattacctgatgccaaagctaggacgattgctcgggcatttctgactaattgttatttaaaatttggagggtgtaccgaattggtaacggatcaagcaacctcatttacgagtgagttctttcgagaactgtgcagcttgctttacattggacaaaaatgcgcgacacctcattggtcccaaggaaacgctataactgaatgaactttcagaacttttcacaatattttggctatgatgaatttattgaaatggcaaatttttgttataacacctcagttcacacatcaacaaaagaatcaccatttttcctcatttttgggagggatccaatatttagtgttgaccaaattctattcccgacaattagagacccagtagctttggatgattcatggaatttaagcaaaaattggtcaccactttaaggactgcctggaaatgtgccgcagaagcgaacgaagaagcacaattacggatgaaactacagtacgacagatttgtgcgcccgtcaaaaatcatggtaggcgacagagtccttttacgtaattatgccggaaagcctggcacttcaaagaagctgaatttgccatggaaaggtattttccgtgtcgtaagtttggacgggattcacgccataatcatttcctgtctatccccccaggcaaacccacgaaaagtccacattaaccaattaaaactttgttttgaattgccaggacctgcctgtaccaagccaactcttacagaagatgaacaccaagcccctgacagagcggaagctgaggagctcaccaacatgcccgggtattatcatcggcctcaggcaaatgcgaccgaacaaaaagaaacctccgaaaaagcccaatcagaagtggacgacactaaccaagaaacaatggacaacaacaaaaatgaagaaacaacagagaaatcaaggcgtttaagagattgaacaacaatacaacgaccgaagcgcttctcagattgaaaaatatgttaatttaattttttttttaaatgtagaaaatccattagtggaataaaaccagtgacataaaagccgtaataactttactcagacttatcatacagatctgttttatagttcattcgatagcatagagtctcatgaacaatcctacgcgaccagaattttaaaaattttcagtttttaaaaaaattattatgtcttaaaattttgaccaagaaatttaaaaaataataattattaatctttgtatattttaaaattttctataaaattatgagaggtaattattttttaattaaaacctgataaataataaagtcaaagttaacaaatttttaattataaaataacaaaattcacaaatggtcaaactctttgcattccggctggatcagtccaccggacatctcaatcaattctgcacatttggcacgaaaaaatgggccatgatcatgctttgtgctgctgccagcacgcggccactgtcttccctgttggcattccaggaggtgaagaccctcgtgcgcgacagatgacacgagtcgcctcattggcagcgaatggtgcagcgggtgcaggccgacttgcgccggcagactgcttgcccatgccgttgcgagttcctctggcttggtcaaatagccgaaagtcactggccacaattccccttaaagccggaccggtaaaataacctacagtaacctccattttttcaacttttcctttagccaattatttaaggacatttcaagtacaatttaaacccaaacaattaatttaatttgattataatttcgaaacttttcctcaaataaataaatatatatatttaaaatcatttttaatcattttaaataaaaacattaattgcacacatttatgcccctcccctaatggctttctcggccattacaccgatccactgatagtcatctcgcaatttttctttcccattttttcccttttccatccttacaatcattcatttttgcatttggccgtttttctttccccatcttccgccttccccataccaaataaggcaaacttacccaagaattggccgagaattgcccagatttgctggcaaatctcgaagaatgccggatcaccattcttcgccggcacat

SEQ ID NO: 21516 - DNA, 2079 bp, Heterodera glycines
ctcgtcagtcgttcgggtacacttttttgtgcctgaaataaaaaatgtgtatattaaaaattaataaaataataccaataaaaaatttaattttaattgttaccatggcctcgatttgtaacaagtgccgtcgaaggactcgaagtaatgtttgaccaacgggtggacaatggcaccgctggagagcagcacaatgttgcgctcgacaacataggcaatttgtgggatcagacggtctgaaaaagaaggacaatcaaaccatggaaaaatgaacccaaattcttaatgaaaagaaaaaacaaatgaggcgaatttcacaaacgaaatgccagtcaaaaaaaattccttaaaattcaaagtgaattcatgaaaatggaaatgcttatgtttcagggaatttcaggacgactttttaggcaaaacagaattttctcaaaatatttttttcgcgaaaagacgaaacttttatacctttctgaaagaatggcaccaaaatgcgtagtttcaatattgcatattcttctgctttaccccgagtgtcgatgagaagtgtgtagttgggctcgtctaccggcacatcgccgtgcactttctttatccaccactcgggcgccttcgccttctcatcccacgcgatgatcactccgcgatagttgtgaatccgatgccggaccacctgaccaacgcggtattttatgtgcggaggccggggatgtcgtggctcgtcggaacctaaatttaaagatagtttgaaaaaatccaaataaacagggaccaaaattcggactatcaaatatgaaaaaatccaggtccaggttaaacatgaaaaaggctggattttggaaaaaaatttagaatttattatcaggtaaccaatgtattatttgagttatcaaaaatgattaaataaattaaaaacacataattattgtaaattaaatatttttagatttttaagcaattaattgattttttcaaacatttatttgctttttaaaataaacttcaaaaaatccaggtccaggtcgaggcttttttcaaaatttcgagttttaatgatttatttaattctcaaagggtcatgttttgatatttgaaatatttcctactatttttgcaatttcgtacaccgtcataaaaaaaattaaatagccccaaaacggaaatgcatttttaaaatgataaatacctccgaacagatccctgctgacttcgcccttctcccccaaactgtcctcgtccactgtgtcttcttcgcctgcgtttggcatttttccgtggcccatttcctccatttcgtcctcctcctcgaaaaggtcccatccgccgaaaatggcgctgaaataacggccatacacttctctgacttgctgcacaaatctaaaccaattttagaattttatttcggtatttaaatttaatgcaataaaattaaagataatttgctgactcgtgcaggtaaaattgtgcgtcggaggtggaccgagcggagagataaaactgcagaggggcggaaaaaagaatcgccacaaaaaccaaagttggcgaaagttccaccataagagagtgaaatgggaggagaagagaaaaaaaaagaaaggaaacttcgctaaatggtgggaaagatgaaagcgaattttaagtgccaaaaatcaaaattaaaacaaacgtaagcaaacgaatcataacaaatgaacaaaaggccaattcacttattttagccaaagaaattaaacgtaatgtttggcgaaacgtttaaaaacaatatttgaaaaaatggagtttttaacgaccacaacagcacgttaagaacttgcttcttgatttgattcgggccattcagtttagtgattttactcagtgagataaattaagataatacagatagaaaggaattttggcatttgctaatttattgttaaacaaaatgaaataattgagcgaaacaattgaacaaatttttcgtttccttcaaacggaaaaacaaagtgactgataaatggtcaaataaatcgtcattggtggtccatcgcaattcaacggaacgtctcttcattcaacaacccaattgcttgtaca

SEQ ID NO: 21517 - DNA, 1644 bp, Heterodera glycines
ctcgcacatccatggcaattaactatggaaaaaaataaaaatgatgcattcaaatatttgtttgcatttgtaaacaaaatgccattaaaaatggcagagttgaatttgaatttttcaaattttctcttggcgaggccctcgccgtcgtccttcccattctctcgcgcgtctctttgaccgccgcgcgacagagaacggcgctggggaggaggtgttggatggatgggattttccaaaggtatggttggggctgggctctgctggttggcttggttggctgtgataggctatgggttgagcacacggctcaatgaattggcgagggggggggggacaacgccgggggggtaataatgggcatcggcgacggcagaacgaaccccgtgcaaaccgcgcccgcctttttgggccgacgacaacaccctttttataatggaaatggacgctgctgaaaaaggaaattggggggcagagaacgttttaaaattagaaaaaataaataaatcgattaaaaggttaattatatttaattagctatttatatttgataatatcggcggatgggagcggtaaaaatggcacgaattcgatttttctggtcgggccaacaaaaacgcaagggattttgtagaaattgaagtgctgtacagtttaaaacttaagtaatttaaattgaaaaataaatttcattattttatgaaatttaaattattaatttaaaagagcatatttatttatttcaaaaatttttcagaaatcttcgaaaaaatcataattattcatatatttacaaaactttagtaattaatagggccgcaacttttagtgaaatctttttttttgctcaatttttggctgaaaattatgtcactatttgtcactatttcggactttttgtcactattttgtcactattttggcatttttaattttagttaactattttgggatttttcgtcactaaaagttgcggccctagtaattaaccattttttaattgtttaaaagaaaagcaaaaaaaaaaatgtaaatttttgtggcagcgcctcaaaaattgcgcagtttcatatagcgcagcaaaagatctttctttttcttcttttagccctctaaattagccctatttgagcggcggggagagaatatttgcatttttggtcggccagccaaaaagcgatgggaaaatgtacaaaatgtttgtggcaaaggtcaacaaaacggtggccggccccacagttttctccatttcaccacacaaatccatcggcggacggatcaatttggacacagcaaaatgcgcaccgtttaattgagtccccggggctgaattgcgcggcgaatggacggatgagaaatttctggatttttaataattatttcgtgaaaaacattacaaattttgtaattattatgcgaagttttatagatttatttaatgtataaataaaattcttaaaaatcttatgacaaaacttagcaaatcgttcatttcctgtgattggctattttaaaataaggaattttatgaaaattcaactcagatttcatgcttttagataaattatgaaaaaacattacatctttaatgtttgggatgaattagaagcaagaaaatttaaacattttttaattactcatttttct

SEQ ID NO: 21518 - DNA, 2444 bp, Heterodera glycines
tcaaatttcagaatcgagtgattaaaaacaaaaacattttaaggaggacacgcgaaaaccgcgcatgaatttgctgaagcagcgaaaaaaggtgaaagaggaagaattataaaaataaagaactgtaaaattattaatgagtagaaaataaatttatattttcaactgtatatatatattttttgtacatttaaattaaaatttgcttaattctccaaactgaaaattaatttttagttttctaaatttcttagaggcttctttctagtaaaaaaacttaaacttttttgaatttaggaccttttaaaaattgtaaaatttcctgaaagaaattcttttattgaaaaacttaagtgatttttactagaaaaatattgtaagaaatttataaaactaatgtatcttcatgggacggtgcagggggggggggggcgaactgctcccttttctagcgcccaaatgcccgggtcccggccaaaggatcgggaaaactcgggtccaaaatttgcacgagaaagttccgacattttagtatttagattaagccagggtgaaaatggcatttaaccgggctcccatccgctgttatggcacaactccttcatccccgatcgccatcccttggtttttttcttgagtctgatcacttacgggcgcattagtgtctgtgtggcatttcagcgaatttttgatcatcgggtgatgaagagcaatgatcaggaggaagaggaagagaaggaggaggaagaggatgatggagaagaagcacaagatgaagcagaagaggaagaagctgttgtagttgttggcgaactgatcaccacaaggaaaaggtgaagagtttcgtttcaaaaaagtttcaaatttttatgtcttaaaattggtaattatccccctacatttcgggagaaaattgttgagggagagggtcgaaaaatagaaaatttcgccgtagggtgggtggggggggctgaaaaatcggcaattggtacctagttttttatttgacattagataacccataaaatccaaaaatcctggaaaaattgctgaagatagaccctaaaaaagagtcgggaatttgggatgacgggataaataaagactaacgccgtccggtgacctaaaatgccgctcttggtccggaaatttggccaataagttgttaaatccataaccgatcaatcatttgtgatcagattaaggcgcaaatttcagaccaatttataatcgtaaagcactcacaaatcgttacgactacaagcatcgatcactgcttgatgcggccgactttttgttggaaaaagtggcataaaaaagccattaaaaattaataatttgcccattttagcatgactttgatgccgcattgaaacactatgaacaaattttggccacaaacgaacatagcccaaggcattttaaatggaaaaataaataaataaatatttaaacattaatttagagcactttttggccgtggacgtctccaccaattgaaggccgaatttggagctgaacatgatgatgattcggagaaatttattaaaatgtaaaattaataaaattatttaaatttaaaattttttccagggcattgcccgattacaattcagtgctggaaaatgaagacacacctgatgaactattcaagtgatttgtgattatgtacaaaattaaaaagtgaaatttaatttaggaaaataatttaatatcaaagtttgaaatttctcaaaaaaaaacctagaattatttttacaagaaaatttcaagaaaaaaaatttcaaaattttttgagcggttttttcaaaatttaataaccatttactaattttttttttaattttcaaaaaccgctgaaaaatttgaacatttttttcttgaaattttcttatacaaaaaatttttttgaaaaatttctgagtttgaaaattaaaaaaaaattgacgtttgagaaacaaattggacgaaaaaagacagagaaaatttgttcccattctaacgatgtttaaagattaaatttccgaaaatctttcgccctagtcagaaaaagtaaggattttttggcaccggttttccgaggagttaagcctaggccttggaaaaattttcaattctcgagataacaaaaattaaaatttaggatgactgtgcaatattttgtggaatgtgcaagacaaatgggtggctatcatcataaaattttgcaggtaaaatttttttaaattctctaaaaatttgaaaaattaaaaaataggcccaaagggcactggtggaccgatttccggacgacgcggacataaaatgcgattttggcgtcacatggctgggcatggccaggcccgagaaagcagcggacatttttcgaaatgtgaggagaaaaaaattttaaaatgcttaaaaacagaaaaaagacttaattaataaaaaaactaataaaaatt

SEQ ID NO: 21519 - DNA, 1611 bp, Heterodera glycines
aaaaaccatcaaatgaataattttgacagaaaattattcataatttcgtctaaaatggatcaaattttataatattgatatttttcgatagccctatgtgttttctattatcctgcaaaattaaaaaaaaattctttaagtttaaaaaaagttatgacctgagaagctcaaaaaaccaagttttttgaacatttttaatcataactttcttgaaacttaacgaaactttttggaattttgtaggctaatagaaaacacttagtgctgctatttaatgatatcaagaattaaaaatttagttgcttttgggcaaagttatatcaaaaatattttcatttgatggtttttgactaatgtcatagcaccaatgataccgtacccatccacaaggaccacaaaagtggcatggacaatgaaaaagttcctctgcgggtagagaggttgacaagtagagcccggttttgggaaaaattaaaaataaaattgaacaaaaaatttgtataaaaattggaattaatcgaaagaaaatttataaatggaaaaaagaattaaaattaaataaaaataaaagaaacttaaagcattattatgaaaaaagcaggaatttattgaacgaattgatgaatttaaaagaatgcccaaaaatggaaaacagaagcaatttgcgaaagaattgggcattgaaattggcaaaagtgaatttaatttaatttttaattttaattttaaatatttcagggtattctaatgaaaaaaaatgaacaaaatgattgattatttgaaaatgaagaaagcaaatccgtctttgagtgataaagaaattgccggattattgaaaatctcagtaacaaccctaaaaaatggaaatataaacttttataaatttttctattagtctttgtgatgaattgatgtttttcatgcttaactaaaatccaatttatttttcgctcttcatctgttaaagagttttcattaagactgatctgaccgcaatcgagacaatgatcgagatcagtctcagaaccctggactattggcattggtatactcttttttttgtctgcaatttcattttcataattgttatttatgtgcgaaaaatttgggtcttgaaaaatttaattaatttgtaaacttaaaaaaaaattcaatttttctcaaatttctctcttttttaatgatataattaatttaaaaataatatatgtaattataaaatacttaaaaattaaaatcacacaattttatcaaatttttatattaaaatgttcattatttttctattttttgggctgatttcctcacttttttgccccaccggcgctgggtgaggcgtggcgtccgccagccggccgaatgccgccgactggaaacactcgcattggctgtgccacccacccaccacattcattcttgtggcattcatccattgtgcccattccagaagggcataaatgatacggtgctgggacgttagtcaaaaaccatcaaatgaataatttttgacagaaaattattcataatttcgtctaaaatggatcaaattttataatattgatatttttcgatagccctatgtgttttctattatcctgcaaaataaaaaaa

SEQ ID NO: 21520 - DNA, 1919 bp, Heterodera glycines
ttgtgaaaggtgagtcaatccctcccgaaatttaaggaagcgtcaattttgggcacgtatttcttgccaattgacgaatccatcgacaattcgtacattcagcgtgagaatatttttgtgggatattaccaatgggtaatgaatgatggcatgtcaagtcgaattagtggtcaaatcaaatggttaaaggtgccaattgtgctggcagcacaagcgttgctcttttaccttccttcgttcatttggaagtcgtgcaatttcagcaccggtaatgaatccgttgcgaattcgcccatttgtccgtccctttcggttgcccgccttaggcattaacgtgaaaagtgtgctgaacagtgcggcactcgtcaaaaagaagttcgacaagggcacgcgaagtgcccaagtggaaagagcagccaaccatttgacggtccgtccgttcggtgccaattaatggcgaattaatcggtgaccgtttcaggaggcattggacatgcaaagggaactgaagacatgtgagtcgatgctgctgtgcaagtgctgtaccgcttctgttcagctgccaccgttttgtcccgccttggaaaacgcaacggcgttttccttgtctgtctgatatttgttcaccaaattgttgtacgtcgccaacgtgttcctgcaatttgtcattctgaatgccttccttggccctcagtacactttctggggcattggaattctctctgacatttggaacggaagagaatggagcgagtaaaaaccgaaagctttgcgattcgcaaacgcaaacaaataaaaaggtccggccatttccctcgcgtcacaatgtgcgatttcaatgtgcgcgtcctcggcaacattcaccggtggactgtccaatgcgtgctgatgataaacatgttcaacgagaagatcttcctcttcttctggtgggtctgccgttgttcggcactctttcgtccttccgtttaggttttggttcatttttgtcggccttctctctctgctcagccttttttactgggcattcgccactttggtccccgcttttcagaaggcctatgtgtgcaaatacctccgttgcgtgggcattattgcccattttaccactcaccgagaacagcgcttaatcgactctttttttcgagactttttgcgcactgacggagtctttctgctacggatgattcaggcatcaactcaaaatttgcatttcgtccactgataacaatccatgaatttgaaacacagacaaacggaggcgatttgttagtcggagagatcgttgccgcactgttcagtcgttaccaaacaaaaattgaacggcacagcgacccaacggcacagacagccgtaacagcgggcgttgaaacgcccgggtcgactacactttaatccaaacaattatatgacattttagttcagcgatacaattatttaaaaatgaaaatatgtattaatcaactttcaatttttctatatttgataaaaaaaaatccataaagagcggatttctaaaaattaataccgtaataaatttaaattttattgacgttgacatttaattctgccttacatataggaatgcaattttgaggcttaaaaaccgccaaaataggtaggtaggctttaggctcttaaaccccaaaaatagccatttaaaatggaaaataggcactaataaagggatcgagccattcccctaaccagccaattccctaccggccaattccctaccggccgattccctaccgccaatcccctactaaggcatttgggccatttccataccaaaagtgttgaatattgataaacattgagattaaaacacacaagaaaatttattcactgctttttagaaagctcgtcaagagctttcggatgataacaaatttatcaagattcgatcgttttaaaaa

SEQ ID NO: 21521 - DNA, 1208 bp, Heterodera glycines
  misc_feature (109)..(109): n is a, c, g, or t
  misc_feature (123)..(123): n is a, c, g, or t
  misc_feature (151)..(151): n is a, c, g, or t
aaagttaatacatttttttcaaaaaactgcaattaataattgacatatgcatctgttatactcagcctttaattattgtttttatttcatatataataaaaaattcatnaatcaagcaatacnaaaacgtggacaattttcacatgcatgnatcttaattcttcaccgaacgctgatttaaaatttgcttattttttgtttatcttttattttctttatttttgaataaatttttttcaaatacaaataaatttatgtacttgcctttttattttatgaatattccatcaatttcaacatcgcgctacatccatatcaaattttttgagtaataatgaaatatttaattgatattgttcaacttggtattattcgttaactgtcataaattttctaaatgtgcacataattgcattataatataatcaaataaatatgaattgtaatattaaataaaacacatgaatttaaacggtatcaattgatcattctttcattaaatgaaagttttattgatatatttattattttcttatttcatttatcaatatttttaagcgtttcaatgattttgaatagtgttgatttagagcttgacagcttaatattattatactttcgatattttcttatttaataactaagatttttatatttcctatgaaaatactcaaaatataaatatttgttttaaataactgaatttaagaattttttaaattctggcctatatttattacattatcaaaaattatttccaatctcttgtattttggcttcaatatcaacaatccatttttcgatttatctattaacttcattattattgttattaatttttaataaatttaacccgtttctgagacgcatgattttaaaaattttaaaaaacaaaaatgtggaataaaactgataaggtctttgcattcctgtcgcaaagaaataaattaagtgttttaagtatgtttggttttggaaattcagtatttgggtccgcaatgatgataatcaccgctaggaaatttttaaaaaatagataaataattattttttgggttaatttttgtaatgatggagactttttagggaattttgttacgattaattttttaaggctctaattaatgtatttataaaactaggtttacaagcggtcgttgcaccagtaggggaaatattccacatcttttgtaaatcccattaatgaa

SEQ ID NO: 21522 - DNA, 1853 bp, Heterodera glycines
tagtgcgccattagtcgccgctgcggtcacgtcgaaaggcggcagcggaggcttcgcggggatgtcttcgacgtcaatgggtcaccccccgggggggcgtcggcgacattcgccgtccctcgagtccccccgtgctccccggccttccgctgattgaaattcgtcgtccgtcggcactttcgcaggcaaaaaccctttcaatattcgattgcttatcaattgttcagcccttttcattcctttgctcattcagttcgagttcggttacttcgtcaattcgcctgaaattgtcagtgccagccgaggcggaagtggggccggaagtacggacgactgcgccccgctgctgctgagcgggggaagcaccgcacaaatttgttcccgaaagtcatccgacggtcagtctcatttctccttttcacagccattcaaagaagcattctgatcaactaatcattttctggtcagctttttctgattctgatcaatcaatcgttctctgatccggccaatttctttccaattttccattttctcttatcagtcatccttaccaaatcatttttgccatatgtgctttgtcccatcagagtcctccatgtgcgggtggagttctcgtgccagttcgcgcatgtctcaacgttcttcctccgggggtcttcgtctgtccactttctccggcggcacttccattgcctccgacaactcgggtccgttcatcttcagttttgtgcttcgcaaacgcgcgtccaccatcggcacgcgcattccgctcccaaagcgtgccatctcgcgctccagcggagacagcctccgcgtgccggaaagagaagtcgtcgccgtttggtcgttcgtatttcgcttctcttttcagttgctttgtggcatcgaaatgagcccggaattccaatgcatgcgccaattgttgctcaatttgctgtgcatgtacagcaacaaagactccaattttgtgaacactttgcgcacttgttctgatgtgctgtgccaggcgttgaacactccgcaacatccgacggtcaaaaattggtttggcatctgcgaattgaagctttacctgtgaggatattcggataaaggtgcgcggacattctgaatgtgatcaacggacaattggagacggaagcggagtgcaagttggagagcgaggagcgcagcaacgacgagtatttggatgtgagtggttgggacgcggggaatgacagtcaattggggggccaaaccccggcccaacaacagacactcaaaacgaattcgaattcacacaccaaaaagcctcatgtttcagctccaagaccaaatcatttcgggctcattgccatgtccgaaggaggaggcggcactgctggcggctgtccaactctgtgtggaagagaattggccgaacaacaaacggacccaaaccatccgaaggcatctcctcaagggacagttcggtgagtgcctttccactcacattccttgtttgtttttcaaactcaggtcggattcgggacctcgcccagaaaattatggtcactccatgggaagttgaccagagtttgtactgcacgccgccgcgggcactcagtgactcagccgcgacgaatcgaaaaacgtcgacgaacccacgcacaaacagccaaacggaccgacaagggagacgacgctcacttacgctgttcagctgcatgtacggcatgcactcggcggggaggagaacattcgatgccaataccaaaccaatttttccatcagcagatcgaagtcggagcaggactcaatgctaagcaacgaagcgcaggcgcaatgcattccgctggactttcgcagcgatcgccgaaccataaaactga

SEQ ID NO: 21523 - DNA, 1665 bp, Heterodera glycines
gcaatccggtgggattttcagtttttggcattccatccaacgggctggggatcggatttttttttcaaaaattggaagaatttgcctttttaaaattcaaaaagttgttacatttgtgggagcagctcgtcaccaatccatgcacagttttcctggcaaatggaaaaattcttgaaattctttcaatagtattgaggaactatagtataatatttttaatcatttttagggatgaaagtgggcgaaattctccgcttggccaccaacggagacaacagtgatcccgccacacgaacctcaaatatcaatgccctttgtgtgcatctgcaaaaagtgctcaaattccatcaccgactttatcaggtggacaaatattttcaaatggaataattttagttttgaattttaaaataaaatttattttttaaaaatccattaatttggcttacggctaataatttgggagaggctaattttttaaatttaatttagaatttatttaacgggttttttatttttggaatattggttaataccaaacattggcacaattaaaaaatattccgaaaacaaaaaaaaccgccaaaaaataaacgctttattaaaaatacagttattttccccatttttcagaaacacatttcgccccacagtttcttccgtttgttgaacatgaaatactccgcctattatgtgactgttgtttacctcttcaccaagtgcctgttctttgtcaatgttgctgtccaattgaacgtgttaaatcggttggttttaatttggccatccatttttatttatttttaaatttttatggctcagtttcatttccatattcccaaccatgccgttgagggtcctcccgccctacttatcctatttttttcaaaattattgaatttttttatgttttgcccaaatttattgtccgtcatccatttaaattaaaaatttgactttttcctctataatattttgtttgaggcctccaagttcatttctgaggctcggtgcatatataaaaatcttttaacgggtttttttagaaaaaaaatgttttatttatttattttttccaacaaatttcttaaattaaatttacaagggaacattccgaggcacgcttattgagcacttcttcatcagctgcataagtagctggtacaattttggtcacgcgcctcgaaactattctgtttctctttttgaaattcagaacccattttgcggaggcctaaagtaatgttacggtagtctcatccttgagggggggggggggctataccttaaattcaaaatcaatttctcgtgcctttaagagggcaatggtgaccaggtcctggtcatgaattgcttcatgtctgcttcttgcctctgcaaaaactgccagcacgtgttgttcgattttttcgaacttttcatatttggtgccccctttctggatgtagtgtctgatcctattaaaggcttataaaattggatgggaaggccgaaaaaccttgaaatttcttcgtcgcttttcagctttttaaaacgggttctgattcttttatatgaagtgccttcgtccagcattttggagattttcaattgggcttcaaagggatatttgccgtttgtcgggatccgtattcccaaatttatccaaattttgctcgtgtcaga

SEQ ID NO: 21524 - DNA, 1655 bp, Heterodera glycines
ggagagatagatactgtagatacgctactataaacccggatacggtatatgaataattttactgttacacgtattaataagttcaccttccaatagcaaaattggagatagtgaaatggctggcgtcgcatcaaaaactcgttaaacatttttgacgggtcgcgtaagtgaggacgacgatcggtgaacttgtccagacgacacctaaacaatgaattcaacccatccaattttcaatgggaaattggactggaagaccaatttccatgtttgaatttgtcaaatttttggtcccattgaaattccgattcccaaaatttttgtgcaaaaccgtcgcctcttaattctaatgaaaataattagggtttattgggtcataataaaatgactcattgcaacaaataatcgatggtgtgcataattctaatgacatcatttagcctcggcgtttaactctctaattaagccccggatgcttaactctaattcctgcaattagtgccatcgctaccttaacatgcaaagtgcccgctttgcctctatgaacattgtgccatcggtgaacgccgtcgtttcgtcgtcatttaaaatttgttcgctgttcattttgtgccgaaactgctctttacattttctattaaaaaaataattggccaaatcgctgcccatttgttcacacagttgaacttttatgacccaattcttcaagcgagcaacccaattgttcaccaattactcaattgttcacaaatggtgacccaatttcccaccaaaaattcaattattcactaaggaacccaaaaactaattgctcatgaaatttgggccatttttctcaaaaaacattggcctcgcttctcttcttgccttcggcaccacaatgtttcggccacaaagaagcgaaagtcgtccaatgcgcgtaacagaaacgccacacagtccgaccaattctcggcggtgtattcatttttggcaaatctgcaagtgccaaattcaaatgttggcacttagtgggaaaatgaattttaaatttttaatacttaggtattaagaaaaaaaaatcggttgatccctaaaaagcgaatcccgggcctggacccgaaaatcccggcctaattacggtgatcacttcagattaattaaataaatcaaacttttttaaatttcgtatgaataagaaatatttttttacaaactgataaagttgctcaaatgtcaacgacgggtcttcataattggcgttcaccgaatgcgtggcgagcagcccaaaatgaagtgccaacaaaaatgtttttagcataatgccaaatatagcggaaaatattaaaatttttcaaatctgttgccccaattttcaggggacactttgataaaatgggaataaaaacgggccaaatgatgagatggtttgggacatcgtcggtttaatcgatcggaatggccgagtgtgggagagaattgagagggataataaacccatcaattctttggccagatggacaaccaaactttggccatatgttcggcgccagatctgacacagaattcctcttttttgaatctgacacttttctgaactcataatttcgcgggagttttacgcccaaaattttgagaaatcccggaatttgtaatcaatttttccaaatcgtaac

SEQ ID NO: 21525 - DNA, 1059 bp, Heterodera glycines
ctttgtcagttgcttttatattaaaaattagcgaataatcttatccaaatttccccctattaatactgaggcatcccccgggggttgttctatacggcttgtatgcgtctctaattataacattcctcgtatgaacacctgtgaactctgctttgacattctttcgtcaaactttgtcaattgctttaatattaaaaattagcgaattatcttatccaaatttaccactattaataccgaggcatccaccgtgggtgtctgttctatacggcttgtatgcgtctctaattataacattcctcgtatgaacacctgtgaactctgctttgacattctttcgtcaaactttgtcagttgcttttaatattaaaaattagcgaattatcttatccaaatttaccactattaataccgaggcatccaccgtgggtctgttctatacggcttgtatgcgtctctaattataacattcctcgtatgaacacctgtgaactctgctttgacattctttcgtcaaactttgtcaattgctttaatattaaaaattagcgaattatcttatccaaatttaccactattaataccgaggcatccaccgtgggttgttctatacggcttgtatgcgtctctaattataacattcctcgtatgaacacctgtgaactctgctttgacattctttcgtcaaactttgtcaattgctttaatattaaaaattagcgaattatcttatccaaatttaccactattaataccgaggcatccaccgtgggtctgttctatacggcttgtatgcgtctctaattataacattcctcgtatgaacacctgtgaactctgctttgacattctttcgtcaaactttgtcaattgctttaatattaaaaattagcgaattatcttatccaaatttaccactattaataccgaggcatcccccgggggtttgttctatacggttggaatgcgtctctaattataacattcctcgaatgaacacctggaaactctgctttaacattctttcgtcaaactttgccaattgctttaatattaaaa

SEQ ID NO: 21526 - DNA, 2115 bp, Heterodera glycines
tgttgtgaaaaattttgcaaatttttttcaattccgtctaatttcccttctaattttgagtcaatttccagcaaaatttcctgtaaatctttgatcaattcattgttcggcgtgtcaatttgatcaaatttaatttcgtaaatttctaaattgtaaatttatacatttaaaaattattttgtattaatacctttttttgcaccatcaacagatttgaaacaattaaccgaagtaacacttttaagaaaatgaaaaagaaataaaattttataaaaataaattttcatcattttacgaggcgttggataaatttgtattatttttttttcaaaaagctaaaataatgaaaaaattttattatatgaaaaaagtaatagacatcaattattatatttattattttgataatcaattattgatttgggataaatggagagagaaataataaaacattcattgattttcacagcatatattactaggactggatttttaggcataaaaaatcgcgaaaaaggaggcagaaaaaaaatcgtaaataagcattaaataggcacaaaaataggcaataaattttttattaacgcttcttaggtagtaaaacacgtaaaaacttaatcaaaacacttaatcttggttatatttcaattgtaaattaaatttttaaatattttatgagtttagttcgaatacggacaaattttaaatcaaaaacttttcaacaaaaaacaataattattatatcgatcaatttttcagaaaattttttaattcttaggggtgtatttttgaattttcgcgggtcatttcttaggggtgtatgttttcttttattgcatttttattattgtttattcacaaatcctgaaaataggcaaaaatagggattgtaaaagtcatcatagacaccccaaaccaagcggaaaatgcgttttccgtgcttatcagagcgtattaaatgcgcagaaatttaggcatttgcctaaaaatcgcatccctactcattatggacgagttataaatcttagtttttccagctaatttatcgatgcgaaagtaatgaattttcgctttaaatttaaaataggaatttttataaacaatttttctttcttttttgctgtttcgatatctctcaaattgtcagcggacaaattaagtcccataatataaaaatgaattttgtagaaaatttagtctacataaacaatggacttgccgcgttgattttgtgtttcgggagaataattattaataagttgtttgatcgtagggtaattaaatgcataatcgttcattatttagaatggggctttaaaagaagaaaaatgctataattattcttttattattcaaaagttttgcgattaaccgtcggaaaagatctcgtcaaagtaccaagaaacattacattatcactcgtcatctgtgttcccaatttgaaccgtactcgaattgtccgcgtcctctgtcacagctccaccgtagtcgaaaacgaatttcgattgtaattaggccaattaacgaatttcgcccttttaaagcattgttagcaaagagaatggcaaatttttctcctctttctgacaacactgccccaaaaaaatttttatccgaccttgaccaactacaaatccccaaagaaattgacacagacaactccattcccgactacgccaagttgcttattaagcagcttcactcccttttgggcaccgcctcggccctaattcattctcaggttgtggcggtggatgcggtcgaagaagaacgacgacagaactgtcgttgtgacaaatgtgcccgagagcaaatcggacacagcggcggagagagcccgggaggaccgtgccgttgtggacgaaattttgaatgccacggacgttgatcaggcaccaattgtcttccgtgtcggcaaacgaatggatggtcgaccgcgccccctcaaaatggaattcccgagcaaacatgcagcgcggcacgtcatccgcatgcgcggaaaggttcaagcattgaatggtctccacaatgtccgcatccgcgaaagcatgaccaaggagcagctgtcgtaaaggcggaaaatgatcgaagaatgcgcgaagaaaaggcaggcgg

SEQ ID NO: 21527 - DNA, 2341 bp, Heterodera glycines
  misc_feature (71)..(71): n is a, c, g, or t
  misc_feature (100)..(100): n is a, c, g, or t
  misc_feature (159)..(159): n is a, c, g, or t
tgcgccgcttctcatattcctcgagccgtttacgttaattttctcttagttttctctgctactcttcattntgccttcactcttcttgtctcagtttgcncctctcatgcaattgtggcgacagaaagcttaccgtttggtacacggaaacggtatttncctgctgctgtacaggcgaacaattacatattgtgggttccgtgtacctaacttaacacaaaaaggacccaaaagccatgtttttccccgcctgttagggtaaattatgcctgacagcccaaacatccaccggcccctttgaacaccaacttgtttggcaagtgcactttgagtttgttccttttatttacaacaaagcctgcgtattgctcggcaaaattacaaagtaagagtttatcatttgaccaacaagtataaatttttcaaaaacgtccttatattgtggtgtgccaactcggttcatctttcttcatccttggtccatcggattccaaatttgatggaattgctctggtgttattaaaaagagaataattatctttagcaaatcaatgcgagttttcagcgaaaacaggaaacagggaaaacgcaaaaatgagagggtgttaaatcttaaattcagtcccagtcacacaaaagcatttttaatgaagaagaataagaaaaattaatcaaaaatatactctatatttaaataattttctctatcctcctccatcaaaactattttgtatgactgggactgaaatccagcattatctcatttttgcgttatctctctccctaaatttattattccgctgaaacaaattttaaaaaaccatttaaaattgtgttgatatttgcgtttaggcataatttatctatgcattagatatatttataactttttagttattttaaatattaaaaacaatttgcttaaacgactttaagaaatagagtaataaagatttttgaattatgttgaaaatatttagtttaattttatttatttatttttaattttctatatctatgctttttcttattatgtttgttttaaatctttaccctcatttctgactgggacaattatttcccattccaattagatttctgcttaataagtgcattttaattgtataattatgttcattattataaaaccataccaaattggtctagaaaagttgtctgtgtgcattttcaggttgacattttttaaaatttattatcttaattattttatttataacttttttatacttaataaatattttttaataaaaagaaattattcttaaatttgttttgagtgttatgtaaaaaaccaacctttgtcctattgaccttgacatattatgttttttaatcaaaattaccgattattattttaaataacgttaagacaactttgttaattagtattattattatttgctgcacacaccactttgtaaacagtttcttaatatcgttatcaataataatccagtaacgtagaatggtttatattcgctttttaataagtcgcgtcatttgttattactttgtataatatttatcatatttatggttttaaattttatttattttgatggaatatgaaattaataaatattgaaaaattaaaattatacttcattaatttttaaaaaatgtaaactctttttttaattgacgttttaaacgcatttccaattagttgaaattatcaattctcgctatttatttcgagaaaatttttatcactaaatagctcaaaagtttttttgttacaatattaagttctatattttattaaaaagtttaaaaaatttttataatttgtctaaaattcaatctaaaaatattttagttctttgtaaaataacttttaactaaattggtctaaattctcaacaaataataatctctcattactaaaacagccaaaatattcgtttttctaacgaacttacgaagttccttttcctttaattatgtaaacaagtggttaaagtcaacatattaaaaggttaattaatttaatatttatttattactatgaggatggatggtgtttagattgaggctttacaccacatttcaaaaataattaaaaaagtttaataattaaccaaaataatttaaaaactttgaaaacacataactagaaaatgatttaattttaaatgtatcttctaattttaatctaatttggaaaataattcattcgttccattaaatttattttaaacctgattattatgtattattcgtattgttgatgtcgaccgtacaataacaaaaaaaaatatttaaaatggtaataaaatctgcgaaagaatttattcgtttattttactgttgaaattct

SEQ ID NO: 21528 - DNA, 1761 bp, Heterodera glycines
agagggagagagagagagaaatagagacagggagaaagagagggagagagagagagcgggagagagagagagaaatagagacagggagaaagagagggagagagagagagagcgggagagagagagagaaatagagacagggagaaagagagggagagagagagagaatagagacagagagaaagagagggagagagagagagaaatagagacagagagaaagagagggagagagagagagaaatagagacagagagaaagagagggagagagagagagaaatagagacagagagaaagagagggagagagagagagagcgggagagagagagttaaaaccgaaaaaatgcaaatcgacaatataattcgccaaatgagttataatagaattggggaaaaagtgaaagtgaggttgacagaaatttaacaaggaaaaggaaagagaagaaaggagaagagagagagtgggggggggggggggagggtacggtaccaaagggcggaaagaacaaaggaaaatgatagccgaaatgagaggcgaggaagtgaagaagcacttcacattaagctgaacagaaaccctctaaactaaacaaaaagcacattttcttgctttctctctctctctcttcccccatctctctctctatctttctctctcttccccctctatctatctctctttctcttccccactttttttctttctctccgtttcactcttttctcactcttttctttttctcttttgcccttttcttccaattggcaacattttgtgttggctgaatagaatttggcgaaattaaatggaaacgaagggaagaaaatgagacggatgaccatcaaaaatgcacaagtaatgacgaattgggggggggggggggtggtcatcgaaataattgggcatggcccgcaaagcaaagttttgggttttcggtttctttccacgggtacagtataattcgtcggatttccaattaacaaatattacgctttttctgctgcttcttcgtcaaaatattcttctgtttttcactatcattttcactttcgatggcacttttatctttttaaaataatcattatttcttattttcattttttttctttttgtttcttttatttgcattttcattttcattttccctctttcccatattaattaatttgatttctttcaatttcccctttctctccccctttaagccctctgctttctgttgctccccatgccttcgttggggtgtgtttttaatttgtttttactcattttcactcatttgccattttgccattttaccccgtacaatttaatccccgattccgacaatgaccccccccccttttccctcctaatttggctgtttactgcacagtttcgtcattcatttgtcacttcatccatttgtggctgtttttcactcaaacttcgaaaggagtacaatttgtggggaatgagctgaattatgagtgaacaattataattcccattatcaatgtcaacaccgtttttcttcttttcctttcttttttgcctttatcaattatttaaaaaataacccaaaatgtaataccaaatcattaattaattaattcattaattatccttccttttgcctaatcagcaaaaggaaaaagagacgaagcaatgaaatgaatgaatgggtgaagaacgatggtggccattccaatttctgctgcaaaatgtgcactcattcagtcgccctcgggcgccgtcgtttgggtaatttatgctc

SEQ ID NO: 21529 - DNA, 2970 bp, Heterodera glycines
tcgctaagtgagcgcagccgacttggcgaaattccgcaacatcaaatgtaccgtttttcagtttctgcgcaaattgctcgtccgttttgatcagtttgatcagtgtttggccatgcatttgcctcatccatgccccatattcggcacaatgctttgccttcgcaatttgttgcggctttttgctgcgcttcactccggcaaagttccgtcttcgccactctttgatcagttccgtttcgcttttcatcggctgatggcccaccacaatttgctctatttgacttctgatcgccatgatcagatccaccaactcctgctcgtcctgttctaattcttcaatttgctgatgatcaaacaatcggtcgtaaaaactatccaacatttttacgcttaatggtaaataaatttgcacattttccaaaacttttgccgaaaatgattttgtgagcaaaaattgaccgttaatccaactgataaataagcaaatttcggctttcattttgccttccattcggataaattcgttcctgtcgtcgttcagcagaacattctcataatgggaaatcagctgctggttgtcctcataatcttaaaatgcatttaaattatcagaaaatatttcatttaaaaattttttcaataatttttgcttttccataatcattttgaataaactttaaaatagttaaataatggttagtgggctgcgaaatttaggtaattttttagtctgctttagtcatttaagtggtaacttaattctgaatttttgaatcgaatggaaaattttgctttccgtcaccccgtagaaaaatgattggcgtaagcaaaaaaaaaaaaaaaaacaatagtacaaattttattcaaaaccaaaaaatgctttaagcttaaatttatgtttttatttatttaccgataataatatcatcagaaagttccaaagtttcccacaaattggccatttctttttcattttgctcaatcttttggtcgtagttatacaacaatttccaaatccgtgttcttccaccttcaaaatatttattcactcggaacataaggagaacaaagacccgaaatacctcttgcccaactcataaatatccctcataacaggggcgccaaactcgcaaatgccacttaattagggcccactccttaatatacctcgtcatagggcccttaattaggtccaactaacaaatatccctttaaaaaccggcataactcgggtacaattcgctactgtccgctgtgggccattcccctcccacccactaccttgggtccgtctgatcctctgcaccatcaacagttccgggctggccaagctgttcactacaaattgcatcgtcctccccctcatccgatccctttgcattgcaattgccattttcacatttacttcccgctcacaatgtgccatcatcactttgactattaattgtttttccaacaccatacattcaaaaaaatggtacaacacacagaatgcgttgcgaattgattcttcaatgtccggcattttcgtttcgatcaaaagttggtaaaaaaattccttggccatttccacctttttcgctgtgaaaccgtcgtcatgcgcattttcggcgtaaagattcatttcttggagcaatgccggcgcataaacttgggattcggccatttccgcttcaaaagagcctgttttgtggctcagctgctcaacaaaaagtgccaaagtatgtgtgacggtgggcatatctgacaaatgtttaaaaaattaattcatttaaattcaattctgtgcaaataaaatgcctataattttcattgtattttaaaattgattatgaaatattttaaaaagaggggcttaaaaaaagttgtgagagaaggggggggggacgtaatttccacgagcgggaggaaggacaaattgtttttcaaatatgtagatttagtaattaaaagcaggaattttgtaggttttgtcacccgcccctgaaaattttttaaataatttttactaggttgatttaatgtattgctaatgatatggaaatcctttttggtctatttcgaaccccggacccgaactcgaacaaaaagtcgagaatccccaattattaaaaatttgctttttgttctaaaataaattaaaaccaagaaataactaatcacaaaccattacaacaccaaaaataatcaattatgcacagattcaaagataaaagtgaatttctgaagaattcgaattttcagtttttaaaaatgtttgtgccaaaaaatgggggaaccatttaactattattttttcgtttaacttcacgtgagttttcaattaactcactggaaaacatgttataactaaaaataaacgtcagaaaatactgaaaacttttttacatggtttcttaggcgttgcaatattagaaaaaatcaaaaaatgtgcggcataacgttaaaaccttttttggacaggtaatccacgaattgacaaccccagcattttttttatattttaaattgtgccatatctggccgccgcgatgatcttaccgaagtgcataattaaggggtatgtcatctccaacgagttcagcaatgcctccccgaaatggtagctgatgcgctctttgataataaaggtgtcaattcggtctttgggatagcaaaaaaagtgccgaagctcagtaaagcctctcaacagcgtattcaatgcgacaaaatggaaatggtaaagcgaacgcggggttttgagcagtgaattgaataattttgattgcactccttcatcggcacaatcgctttcgtgccatcgaaacccatcgttttccgaggcaaaaatcaatttcttaatgggctaattaataatggcataaaatgaaagtgaagataaagccatttcccgccgaaggtgttaggacattatataaaaaccatcaattacggttgaattttaaaaaaataaaaataagctaagttcat

SEQ ID NO: 21530 - DNA, 2949 bp, Heterodera glycines
  misc_feature (722)..(722): n is a, c, g, or t
ttaggggaatgattggctattgttggccaacgaatgccgaaggaactgaccgaacgcaaaaagtgccattggcggagaccaaagcattgacaatcagcgaaaaatgaagcaaaacgaagaggaagaggtgggaaggaacagggcgaatgtcagaaagctaatgggcagaaacatcggagagacaaagttgagaatgcggcgatgcgtccatctccacagcgaaggccaatggcacggcactcccaaatggccaccccttccgcctcctttcccctcctccccccccccaatccgtgtcccatttaagccccattttccggaatttcttccttttgacggcccaaacactgttaattcagtgcctgtcgtcatggaaacttgtcaaaaagttttcgacacgtatttttggtaaaattcaaatgaattttttacggattttacgaattcgcgacagataaaagacagtaaaacacggcgaattacttactgtagacgactttctgtaccaattggtgtaaacaatgggcggctttttaattgtgtaaataaaggtgattaggaaggagaggcaaatgcacagaaattaaaacatttattaaaatttccgccatttttgtccaaaaaaggaattggacaaaacgtcaaaattaaaattccccgccaatttaataatttcggctctaagttcatttctctctctctctgttcgtccttttccacanaactttttgccctccccccccccccatcgatgaattcgaattcaaaggcttcttctcccctcggcactgccattgctttggccaccgccggtgccgtggtgaccattcaaagcgcaatcattgccattctctacaggaaatgtgccaaactgacgcaaattattcacaatttacagaccgaaaattcgaacacttcgcattcgttgaggtaaataattttatattttattccctgaggcaaaaaaaagaaaaagaaaatggctgaaaatttgttttgagtaaaaacggaaattacatttcaattctcaaaattcccttttccaacaaaaaattctttgaaaatagcgtggcaaaagaataaagaataattagggctgccgaagagcaaaaaaaagaaaagaaaaagaaataaagaaaccaccgcctgccaaaaagcatttgccattcccaatttcttatagtcttataattctgacactgactgatctttccaaaaaggaacgaattggtccttttgcgccgcactgtccttttgttggagaggcgaattgcccaaagtgaggccaatcgtaccgaaatgccaaaaactgaaaaggacgacggattgggtcggcacgaaatgtgcgaagaacgaaaagccattggccgagtggcgtcggcaaacagtgcgtcggagggggaatatgcggacgcggtggacgacgaccccgacttttttaagtacgacaaacggagaaataaccgaagggaaaggggccgaatcggacaaatttgaattcagccgaaaagcgaaagcccaccttttagggcggggaaaaagaggagaatgctgaaaaagttggctaattttcttaaaaaatttactatataaattcttagtttttccctgcggcgcctttcggcaccgccggacccaaaaatccaacaaaatattaaattccaaaattagcatggcgaatctactcagaatagaggtagagtctacaaaattccctggcggtgccataagctttattttttttaacaaaatggcgcaaaaccgaaaaaattggttattttttgacaaaatctgttaataaatttcattttaattttcaaaatttttcccagcggcgcttaacgacgccccaacgtatgatgctcatattggaagcaataaaacttgtgttaatttaatctaataaattgaaatacttggattttccgcggtaattgcccaatgtaccccctttttgaaaaaaccctaaaattgtctgtgaaattttcagggttttccagggtcactgatcaaaaacgagtatacatttcgctcaacttatcatcctgggccccaaattgaacctaaaaggggaaagcctagctgaacactttaaaatttggtcattttacttccaatcaatcgatcgtcggttttccccaattccgcttcttaatgccatcatccgatccgatcaattttcaaattttcatagccaaactctcaaaacccttttcagcacttttattttatcacagaatgagcagcaaaacgaatgggactaaagtgtgttctgcggttgcggactcaaaatttgtgagattatttttgattacgaatttggcacttcccccccccccgccatatttttattacgaatcttctctcctttcccctcccactttcaatcatcatttttttcatttacctataccccttttatctaaagttttttaattttcgcaatttctcaattcctcccttttttctagagtagagcgggaccgggaattttgtgcaaaaccgggacttgccgggacctgagaagtcgggaccgggacctcgatttttgttcgggaccgggaaccgggaccaaccgggaatttttaaaaattcaaaaaattaaaaaaaaatcaaattttaatttatttcaagtgaaaatattaaataattaaatttttattttggtttttattttataaaatccaaaagttaaagctatttaaattaataaaaattttcaaactaattttcttcaattatttcaaccaacaatcattttgtactttaaatgatcgaatattaatagaaattcagatttacatacttttcacatcactttttttcgcgcgcttttccagaaaaactttggagaaaaaagggggtccggcggtgcccgatagggcgcgcccggggaaaattttgaaaattttgagtgtaaatttattaacagatttttcaacaaaaaaa

SEQ ID NO: 21531 - DNA, 1215 bp, Heterodera glycines
agacggcgagaactttgtgccgcttgatgcaattggtaagctgcagatgtatgtcagagtttgactcttttcttaattggactttgccgatcgtgcgaaattccgcattagggcccgtaacaaggtgttcacgctgccgctgcgacacccggaggtgcacgccgccgtcccaagcttggaagacggcgtaaaagaacaaaaggaaatgactcagatggcataagcctggtggaccctcgcccggagaatgccccttcgccacgcggaaccaaagagttgaagaggaaactcgcacagaatccgcttgccagtagcctactcaatcgactgtttgttgggtctgggttcgtcggacaagtcaaacaaacgagaggatttgttccctcaaaatggacaagaaaataaacaaaatatacaccgacccggccaatccgggcgggtatgcgggtgcgagtgccctgtacgcggcggtgaagaagaagcacccgaagttgaagcgtaccgagtttgaagactttttgaagaggaacaccacctacacgctgttcaagccaaagagggagaagttccgacgcctacgcactgtgcctacgggtttcatgaccggtaagttgtactggggcttatttcgcacaattcagggttcagatgttcaggcggacttggcagatttccaggcactttcgcgcaagaacagcggctaccggtacctgctgttggcggtggatgttctatcgaggcgaatgttcggcgcgcccgtaaagagtaagcgcccagtggacatgaaaagggcttttgaagagctatttgagcaaatgccaagggtgccagacacaatgtacaccgatcgagggctggagtttgtggcaaaaccgttgaaggagttttacgcggagaagggcattcaaaagtttgagaccagttcaaagaaaaaggccgccgtggcggagcgtgccatccgcaccctaaagactcggctgtacaaatatttttccgccaacaatacgtcggtgtgggtggatgtactgccaaagtttttgagtgccatcaacaactcggtgtcccgcgcgaccggacttagaccccaacgaaatcagcgacaccaatgcgagggaggtctgggaagaggggtgtacggcgaagggctcgcacaattggaacagacaccaaaaatcaaagcaggggaaacggtcagaattcccgagcctaagcaca

SEQ ID NO: 21532 - DNA, 1271 bp, Heterodera glycines
  misc_feature (1225)..(1225): n is a, c, g, or t
cgacgcgggcattcgaacggtgggagggcccagcggaacgggcgcaattttctgttcctttccggacgaacacatcggacattacacaggcaagcgaagtcaatgctactgctgtgtaatgcacctttcccaacactcattagcgcttttccttagttttctataagcatttttctctcgctctctatctctctctctctcccttctctctttcttctccttccactctcatcattctctctcttctttctcttttttgacaattaagtgtattatatgcttttgcagcttttgtggatgaaattgtcggcactgcgttgctcctcttttttgtcaatgcgctgatcgatccgcgaaatcaagtgccaaaatgggtgcatccgatcggctttgggctggcaatctttctgatcacttcctcctttggcatggtgcgtttgactttggcacgatcattctctcactcatccattggcattttccgcttgacagaatgtcggctctccgatcaatccggcacgtgactttggtcctcggctctttcttctatttgccggctacggatgggaagctattgcgtccgttgttgtttatcccttattaaataatgccaaatgcttcctttctccatttttttttggcattttcaggtggcactcttattacttttggattcccatcattgccccatttgttggcgctctgatcggcacttggctttaccaatgtatgattggccttcatgtgccggacgatgaagctgcacagtcggtgccaacaaaaacaggcgaaaagtcaaatgattttgagtttgatccgctgaatgggccctctgactgattggcactcatttttacctttttgttattactttgacccgttttctttcctataaattgtttttgatcacatatctttgtcaattcttcaattcaattgggcgaatttggaaaaaatgtactcaagaaaaatataatttttttaatgtctcccgcaccataattatatataatatttttaattttactcaaccataaatttttgggataaacccattaattaagaagcaaatccaaaaatttttcctgtgcgatgccatcggcacaatttgctgattctgagttccattttctgttttctagatttgattattttgctaatcatttccggaaattgggtcgtgtggccgctgactgcggttgtttcgacttcgtctgacccggtncaaagaacagacgtcaaccgaggcggctgaatccaaaacttttgat

SEQ ID NO: 21533 - DNA, 1779 bp, Heterodera glycines
  misc_feature (1639)..(1639): n is a, c, g, or t
  misc_feature (1666)..(1666): n is a, c, g, or t
  misc_feature (1696)..(1696): n is a, c, g, or t
  misc_feature (1734)..(1734): n is a, c, g, or t
aaaaatctagtctcctcgagacctggatccaggcctggacctggattttttgaaatttgtattaaaaagcaatcaaatgcttgaaaaaatcaattatttgatagaagcatctaaaaatatctaattaataataataatgtgtttttaaatttatttaatctgtttttgaaaacttgaaaaaacatcggtcacttgaaaaaataaattctaaaatttcgtccaggaaaatccaggttttttcctgttttgcctggacctggatttttttcacatttgacctggatttcctggacaaaaatccaggaaaaatccaggcctggatctaggtccaggccgatctctagtcattactttattattttgtatacaaattaatgactcattaatgctgctgactcatcatatttgattgtttttttgttgattaaagtataaacaaataaatctttaagaaatagatccggtccctggtttttggtaattttgaaaattttttggaatttttgagctgcaaagctttcgaaaaattggaaatttgacattatatattaactattttcaatcataaatagttaaatgtaaaaaaagaaacctttttaccagtgtatttttattcccatattattttgaaatttatatgtttaaacacactgttttcttcgttgataaggcgaaattctcattgaaggaatagaaaagttttttatgaaaatacaaaaaaaaagaaaaattacgaagaagcatcaaacaattaatcagcagaagatgagtgattgattattcatcggccaatttgcgctttctctttttcgtcttccaccgtcaaatcaatggccagcgtcactttgtcctcatttttgtcgtaaagtcctttatccatcatcaattccttaattttagtgctgctcaagacagaaaaattcccgagatgcgaaaccgagacgcaaaaaacgggactaggcgtcgcccagtaaatttcaaagttttagtgcaagttgttacagccaggttttatccccctaaaaatgaccaaattttgcgatttcaaaccgccagttcttttgggattaaaaaaaataaatttgtaatttcctctttatccccttcactacgatccacccacctcttttacaccgcaccccccccccccacctcgctgcgaaggggtccctcattttggggctctctgcaagcgggggggggggggggggagcggtgtaaaagaggtgggtggatcgtagtgaaggggataaagaggaaattacaaatttattttttttaatcccaaaagaactggcggtttgaaatcgcaaaatttggtcatttttagggggataaaacctggctgtaacaacttgcactaaaactttgaaatttactgggcgacgcctagtcccgttttttgcgtctcggtcttgcatctcgggaatttttctgtcttgagcagcactaaaattaaggaattgatgatggataaagggctttacgacaaaaatgaggacaaagtgacgctggccattgattttacggtggaagacgaaagagggacaaagcgcaaattgaccgatgaataatcaatcactcatcttctgctgattaattgtttgatgcttcttcgtaatttttcttttttttgtanttttcataaaaacttttctattccttncatgagaatttcgccttatcaacgaagaanacgtgtgtttaaacatataaatttcaaaataatatggngaataaaatacactggtaaaaaggtttctttttttacatttaact

SEQ ID NO: 21534 - DNA, 2419 bp, Heterodera glycines
cgtaaaaccaaatgatacacataaatatatatataaggtacgcgtaaaagtccacgggaaaaattttcggcattcgaacccggatttggccccatttttcatccaaattcgcatgctaaaacccaaatgagtccatgggataaaatattaggcattcgaaccagaattggttacatttttcatccaaattcgcaaagtaaaaatacgcaaaagtccatcatcgttaggacccgaatttggcccattttagcacatggtaaaaaacctaaaaaaagccatcgaacaagaaatggactcattttccatccaaatgcacatggtaaaaaccccaaaaagtaaaaccgtgaacagaaaggcaacgtgtgttgagccgactgcaatttgtttgatttggtccgctgggatttgctgaagtgcagcggtcacttgctgctcacttttgttccgtttgtccgcacattccttcatcctaaattattttggcaattttaagtaggggtgaaattaatggcatcattttccggtgtttttcatcaccggcattttatgagtcaaatgatgaccatttcattagttttactggttgtttaatgtcaaacactcttggtacccaaataattaagcagtgttgctggctggcttggtgatgcattcttgtactagtacaagaaaactgaaaaaactagaggtggcaaaagcaaaaaagtatttgtttgagctaaattttggtaatttttgctcataatggcaaaaagagactattttctatcatgtgaaaaacaatttttggtctagaattaggatggcttttgaccggtaccaagaatgacatgaattgaacaaccaagaatgttatacagtatacgaatccatggccttactacaaatttgacacataaactgctgggaaaaccgaaaatattataaagttgcggaaaaaatccctaaaaaacctttcaagaagtccactctcattgcccggcagagcttggccgaataaaaacaattgtttctggtcagacatttatgcttctattgaattgaaacaaaaaataaatgttattaaaacaaaaatttgttgcaaattatacaaaaacaaatgcaaaaaaaaagactcaagtacagtttatgcgtccaatgaacttttatgcgtccaatcaaatttttcatccggcggccatgtttcggctagctctatttctgttgacctacaccttaatccaacatgggggatggcacggcttaatcattgacgaaatcggataccgaagagcgaacccttgtcctttttgtgcaaaaactacgataaaggtcgttgtattaacgaatctagctaagaaaggaaaacaacatatgtgtataagactggtaattctgagaatatattccaaattttgaagaattttgtaaaaatagacgagaaaatcttggtggaatatcgtcaatgcaatacaattcggtgtaaaaaatgattggacgcataaaaaagtgccgagattccgggagacgcgagagcaattcactgatggacgattcatcacaaaattctttgtttttcggctcaaaatcccaattttagcagggttacgaccttttgtaaaagtatgggtatgggttaggatttcatttagacaggaaattgaaaaaaaacaggagccggatctaggtaaattcggtaaaaatccgttttttcgcgatccaattcctggcgcagtttttaaaatattcaaatttcgaacccccccctgacccggattcgaacagaaaactttcggtaatagtgccaattgtagcctccctaaaaccataatccagactcgaattcaaacccaaacagaaatctcttggaataagtcgaattcttagatttgctattctttgtttcttgttgaatcgttgcatcatcaatcaccacattcagtttcatcatatccgaatattcaagaatttgctagaaaaatggtggaactggcgatctcaattttttttttaaaccctcgaaaaacctaggaaatttttgcgcgttccaaattacaaaaagtaatgtgtagtgtttttcgcgagccatgctaccaaatggacaaaaagccgtaagggccaattgatgaaaatgaatacctaaacattacctatttttaaacaggccagagaaaatatgtaagcagctaaatttatgtgttatgtatgtctgccatccatcagacggacactctttttctctgcaatgtgtattttctttactatttccatgttttccctctcactgtccaaggaaagagaaaatactattatgtctatcagataactattggtcctctctgacaaatgagcagagaaaagcctgcacactatctcgccgtttctttttttctttgtaatttctctctactttggcgcattctctcttcatttttattat

SEQ ID NO: 21535 - DNA, 1308 bp, Heterodera glycines
cctcgccttttcgaccaaatgtgcaatattttccctgacctttgaatgtatccattcacatcaattgtgtacaacggattaactggtaaggaaatgtttgaaggaaaatttgccggttttccaaacaaaagatggtatggggaaatgttggtcgtttctgacggagttgtattgtatgaaaacacaacaaatggaagacggtcatcccactcccaatttgacgcagttgaccgttttagcattcccaaaatcgtctgattcactctttcagttacgccgttcgcttgtgggtcatatcccgaagtgagggtcttttccatttgcagaattttggtaatttcgttaagagtttcattcacaaactcttttccgcgatcactgtgaatcttctttggtgtcccaaaaattaagacaaaattttttacaaattcgcgtgcaattgtgtctgcgtttttgtttgggattggtgttgctaccaggtattttgaaaagtggtcaaccgcgactaatatgtatttgcatgacgaatgcgcgggtccgatagacaaaatgtcgaggcaaaccaattcaaatggttcggatgttgcaacaattttcattggtggctcgttagacctcggatttcgggtgtgagcacaaattcggcatcgaagagctgctctaacacagtcggaatacatgttaggccaaaaatatttctcagccaattggagaaaaattttcttcccgctcatatggcctgaacaaattcctgagtgtcgctcgttgatcagtttttcgcggtatacggacgggacgaaaagacgacttttaccatctttttcacacttatagaggaggtcgtccaaaacagtgaaattgttaaggatagacatgagtttttggcgatctttaggctcaattggcagcgttttttctgtcaaaaattcgtacaaaaagccgagttcgctttctctcgttttggtcgcccattcgcgatggttctcgattccgtgctgtttttgaccatcctcattttgtcggatttggaaagcgacgattttgtccgattccttcggtgcttctggacattttaatgcctgggaacgcgacaaaacgtcggcaataacatttttcttccccggatggtactcaacttgtaacagaaatttagcattcatttccattagccatttatccacgcggctattcccagtctcttttttacttttaaacatcggtatcaaagcgcggtggtcggtgaataccctcgtcggcatcatggtgataaattggctatattttttcgtgccaaatcgtactgctagt

SEQ ID NO: 21536 - DNA, 952 bp, Heterodera glycines
  misc_feature (830)..(830): n is a, c, g, or t
attagtatatttattttattttatttatttagtattttcttttacttttctttttatttaatagatgataaaagcattcgatgaaacatgaataaaattgtaacaatgtgttattatattttatttaattcttttgcttttagttaattttaaatataaattatggttaacaattatatattttattgttgccgtatatgaattatttctaatattttttgcatttttctattgttgaaaatcagctcactcatttactcttgcgaaagctttgtcaactaaattaaaaatttgattattttattctttagaatatttggcattattaattttgcaagttcgatatgaaaaaatgttttgaatatcattgtctatttttctatattattaatcttctaaaacaatattcatcatgagtgaaattacttttctgaaatttattttttttaattaaaattatgttgcacggtaccggtactgttactgaaaaacccggtacaactgagtaactagtaacggtttttaccggttttcccagccaaaaagtaccggtttttcaacccgaaaattaccggtaccggtttttttacaattaccaattaccgtgcaactctaattaaagtgcttgccggaatccggattctgaccaggaactcaaaaactccgattaagtgtttcgtctttacattttttctagcaatattggaacgatatgagctgggtgttgtgcgaaataaatcagcagattatcagtcatttatgcatttagtttctaagatagattataatttttcaaaataataaatattctcacatttgaagctaaattntcttaagttaataatctttaattaacttgattaatttgttagaaaaatatttttaagactttttatagttactgttgcacatttgtttttttttattttataacatagttttgtttattact

SEQ ID NO: 21537 - DNA, 1143 bp, Heterodera glycines
  misc_feature (73)..(73): n is a, c, g, or t
ttcagttcctcattattgattttttattttaattttttcataattaaattactatataaaaagctatttcttnaaagatcatatttttcaatatttatctgattatttcatataaaattgaataaatggataaaagatcaatcgcaaatttatttttagagcaaataaatggttttatgatgggtgcaaatcaatatacatttagtattgatttattttttaagttctgtcagcatatatataagcagcaaattattgcttttgttaaattgatatggatgtgaaaaataaaaatgtgtcattaatttattttaaatataagaaaaataacaatatttagtagttcttattattttaaatatttgaagtttcctttttttaatagcaaataagaatttggaaaatttattatgaataatttcggtaggagtaaaaatgagaataattggagcaattaattgtttatttatcgaaatgtgtgatttgttttattcaattatctttatgttgcttacaaaatattttggattaaaaaggtttgtataaatttctggatttttcatttttattttttattaagtttttcacattcccatatttgtgtgtatgaagtgtcttaaattaaataaatttattttaatttttacaacaaaagtaaattttttttttgttttttatttatttcttgttcgaatcggaactttcgttaacgaatctcataccttttcattcttgtgcttctttctgctttttgatttaatagaatgtgtttataattgtgctcattttttgtattaattattttcacgccatagtcataagcaaatgcgtttacgaagctgagctatcgggtatcttaaagtttagcgtctttttaaaggattgctttagtcataaaatctttacatatttactttatataaaaatttttgcttgaagatttaatgtgatataagatttgaatgaaaatttattttaaataaatacaattaatttagatatatgatgaaaaattcatgtcttttgcattgaaatttattttgatttttctctcaataaggttcttggaaattgatttaatttattactgatttttgcttaattaaatttgtaaaaaattttaatattctcaggaagaccata

SEQ ID NO: 21538 - DNA, 2148 bp, Heterodera glycines
tacacaccgtttcaattttggccttccagttccaaaaagatttgcatgtgtggaggtggttttgtaagatagtaaagggacaaagggtggaggttcgagtccgttgttcaacatgaatactttttatttacttttgtccaaaaaatgaaaaaagtacgattttcggaaattatttttgaatgttttttgacaaccaaagtgtataaacttggtatcattcgaaagctcttgatgaggagaagcttctaaagaaatcaaacatagaaatcgatgcagaatttttttctctatcggtgttaattcgatttttctctattatcagagacaaagaaatagtacgccaaaataagaatgtttttttttctgtgcactccctatttattggttcatctctcgttttttgaaacggtgtgtctattggtcatccatctgttctttctccgtcttcgtcctgcttcggcttctcctcctccttttgctggtgtccctttttgtgtttgatcgcctgcacattgtccgcaaaccaaagtgtccgtccgcaaatgtcgcaaaaatactcgcgtcccttcgcccgctgctgctcctcctcctccgcctttcgcctgtccaattgttcgtccaattccgctgtcctttttaaattggattataattagcattctccctccgttgcgtccaagcaattccaattgtttacttcttcgtcttccgccacagcgtccaaaatgccatggccatcggcggtcggcacaacggaggcggagagcgggtgcggcattccatcggcggtgaacacaccgtactccatgctcctgggtgggtctattcgtcttcggatactgtgttaaaagggtgagaaatatttttgttactctctctctatctctcctctctctctctgtccctcgctctctcaccattctcttgctttatatatttttccctcgctctctctccatctctctgtctttgttgatctaaaacaatgcctgaagggatgttggaggcgtgcgaatttgatgatcagccgctccaactcgcgacagtcgccgtagtcgtcgctgcgcaatttatgctcaagcgactgcagaaacagcgaacgcacgcgacaggcgaatgccagcgaatcgtcgcaatggcgcgccttcacaaagtgaaactcgacaaaaccgtcgcaacagagcacagacggagagacgcaagtgatctgacagatgagcaagaaaagcattgatcagacgaaattggaagaaaagcataacgaaggacccaaacgccgtccctccccctttcctctttttgattaggagagaaaatcccgaaaaagcatggcattttataaacaacgggaaaacggtcgcacatttctggcgatgaccaacaaaaaggaggcggggatgcggcacgaattgcacaagtacggcttcgtcgtctccaacagaaggccaaagtagatgagttggtgctgcgcggaatggccctccgagtccaaatcgtccgatcgcagcacttcgggccgttggccaagcgcactgttcgggtgcagccccccgaacggcttggagggcgtgtgcgcgaattggtcgtgaccctcctaaagaatgggaaaagtgagaaatggggggggggtactccctaaatttcagggattggaaaaagccatcaatacaatagacagattcatggaattagggaaaccggaagggcaaatttttttgcattttgatgagcagaaactgttccaatgggccgtacgccctattgggtaaccattcgctactcgtcgcactcggaaattgttggtcgggtccacgacgccgaactgcgggtagaggccggcggccagcacaagtttcagttccgtggcgacattgtcgtccaaccgatggctggccaattccctctccattcctttaccgccggtgcccagcgaaaattccaagtgctgaatttgctcctgagcattggccaaaatgtgcgattctgagccacagaaagggaataagtcagagagagtgtaagggaagggaaagcggcctgagagtgcggagtacgagagagagaaagagaaaaagagagagagagagcgagggcgagagagaccttaagagaggagaagagggagagagaaacagaggaagagagagg

SEQ ID NO: 21539 - DNA, 1470 bp, Heterodera glycines
  misc_feature (38)..(38): n is a, c, g, or t
  misc_feature (98)..(98): n is a, c, g, or t
cgatgccgttcaactacgttgtgtgagagtcttgttcnaatctaatatcgggattcactttcatatgtttccatttcagcatgactttggtaggacgnccgttggacaaacttcttcgagaggctggcgaccgtttcagtccgggaactacaattggcatatcgatccagatgctgaacgccatcaagaccctgcacaaagtcgggtttctccatcgcgatgtcaaaccgggaaactcagccattggattggtggagtcaaatgaacaacggctgctctatctcatcgacttcggaatggcgcgtagctacattcgatctgatgtgagagggcggcgggggacatcttggcgattcagaaataacccatccccattttccagggtcaacagcgacgtccacgagccacttcgcagttccgagggacgccaatttatgcaccaatttctgcgcacacaagacgcgactacagccgaaaggatgacgtcgaatcgtggttctacgtcatggtcaaattcttcaaaggaactttgccgtggaaacatattgcgggcggaagggacgaggtaagtaaaaagtgatttgatggaaatgcataatgttcactatttgatttagatcggagagatgaaatgtcgtcgcttggaagggcaaccaaccgaagttcgagaaaaggccatcaacgatctgctgggaggatgtccgcctgaattcaacctgatacttgagcacattgtgcgttgtttcggatgatttctacttcaaacaaattgtaattttttcaggatgccctgcagctggaggaccggccctgctatgagatgatcgagctgctgctgcgtggatatcttgcccaaaacaacatcgaggagcatccatatgactgggagatcggaagacgcaactcggatcgagaaaagacgcaaattgagaaaccagcagagaaacagtgaggaggatgagcgaagaatcacccgcgagatgatgaacaaacggagacacatattcgcgagcctagcatctgtctaatcacatttgctcataattgtatattattgtgatcggtatcaagtcgtctttcattgtatacttggcattgacgacacacggaatgtatgatcacatttgctcattattgtacactgtgatcggtattatcattcattatatacttgccatatgtacatatatatatgtataaaaaactgggtcgcaacaagaaaaaacttcgtttttgggtatttcttgaaaattcaataataaatgtatttttatgccatgaataaaaacaaagaattgcaattcttatctcaaattacttcaaaagtaatttagcttgatttgattgttggcttgtgtattctatatatcatatgtagctatcttctagtttttcgattaatttaaggaatcaaaaaaaccttggaaaattttcccctcagtttggaaaatgtatattcatttgatggtt

SEQ ID NO: 21540 - DNA, 1732 bp, Heterodera glycines
agattgaaagcctcattcaaaatgtttagagactcttccctttttcacatttcggcgttctcggagttggttcgcatgatagcgattgattgatccgtccgagaatttcacagtataaattacgcctttgcaatcacaaattattcctgccctccaattctgggagaggcggtggcgcgcgtaaacggtgtctttcatctgaaaaattcgttgtctcgtgccaaaacgtcgattgaagtgtcgttccatttccgcgtctctttccgagggttgcgaaagcggcggcttcagcaaatccaaagtggtgcgcggtttgcgaccaaggagcatttccgccggggatttgatgttcgggagcgaatcatttggtgtggtccgataagtgaccaaaaatgtttcaatgacgtcctttcctgggactccctccccttttaattttcgaaaagcccttttaaaggtgtccacaaaacgctccacttgtccattagacattggattatatggtgctgaaaataaatgcgaaattccgtttgccgctgtgaatttggcaaaatcgttgctggcaaactgcgtaccattatctgacaccaaaatttcaggaattccgtgtcgagtaaaaaggtaacgcaatttatcgacagtggcagctgttgattttgttggcatttcaaagacctccgggtactttgaaaatgcgtcgacaacgattaaaaattctttaccgtaaaaggggccggcatagtcgacatggatccgttgccatggatgttctgcctttggccacgagtgcagatcagtctttacaggagctttggcagcagcttggcacggctggcagttttggacgattcttcaatttcggcgtccaacttcggccaatagacatattgtccggacaactgcttcatccgcttgattcctggatggcctttgtgcagctgctccatgattttcttttggcagaattttggtatcacaattctgtcgccatacattaggcaatctttaagaatagacaattcgtcttttcttcggctgaacagttggacagtctccgattcctgcttcagcaaatcattgtttggccaatttgatctgatgaatttgattgccttctgaattgatccgtcaattttcgatgctgttgccaaatcggcaaatttgataggcaacttctccaaattcaaattgaaaatggatgtcagatcagattcaacgtccaaagcggcgatcactttctcctcttcgcattctattccttttgcgatgagtcgtgagagtgcgtcggcgtttccaaaatcattggttcggacgtattctattgaaaaatcataggccaataaaattaatgaccatctgagcagccgatttgcgctgcattgtttgactccctttttactgccaaaaatacttagcaagggtttgtggtcagtttgtaacgtaaaatgtcttccatagatcattttatgaaactttttaactgcaaaaatcagtgccaacgcttccttttcaatctgggagtaatttttctccgctggtgaaagagattttgaagcatgggcgatggccttgattgatccgtccgcaaatttgtgcgagattactgcaccgatgccataatcagaggcatctgccgcgacaacgatcgtcagcagcaaatcggatgccaaaatttttttcaattttgaaaatgccttttggcaattttcattccaatcccactccttctcct

SEQ ID NO: 21541 - DNA, 1681 bp, Heterodera glycines
tgaaaaacctggatttcctgttacaattgaccgtttgattttcttcagatcaaagaatgtctcccaaatttgctaccggccctttatgaagagactaaggtcaagcaggaacttgtgcgggaagttgagatgggaccgtttaaacacattgtcgacgacggactcgacctgcgaaaggcggcctttgaatggtgcttaatttgccgcaaaattaatccatttatctttcgattgtcagtatgtacacattggcagaccaatcgttggatcgtgtgaatatcaacgaatacctgacttatgttgaaaacggacttaaggttttgtcctttgttggccaacttcgctttaatgcaattgttttgaggaccaacacgacataaaactgctcacttatctgatgttggtccgattggttcacaaatgcccaattcaaatggcacaacgtctcgatgctttttgtgaacatataaaagtcagtttcgactaaagcttaaactggcttcattttctgtatattaagccccaattgcttttgcgcccaaagcaaaacgccgtaaaacaggaaaatgacaagcaggacgaactgaaacggtccgccgtgcgctcagtgatcgctttgcgcaaagtgccgaacagtgacagatcgcagaaaatgaccgacatgtgggaaccctttttaaaagccagttgtatagtgtgattttagttgggatgtgatcaatggcaatcctgacctaacacagatgaaggaaatgcaggtgggtgggaaaatgttattggcactgatttttgattgcttttaaagacacgcgagcaaaatttgtggtcaacaacgaccaatggatacgaaggtggacaagaaacgatggaattggaataagtgcaaatttatttggaagataaaagtcaccgtccgggtgtttattgctctgtttttattattgacaaacaacaaatttatgttttactatcattgtaaaaaaaacatggccattcatctgcttggaaaactttgaataaaaggcatatttataggtaaataaatggttgggttagcagctaaagataaaaataagttagttatttcgctgagggcggcttggatcttcggtggcaactgaataagtatttaaaatatccttttctgctgatcatttcgctttctctgatcagtcttcggatggaatgacaaagtgtgagaatctccgattttcgctgtttcttccctttgcgcgaccgcccgaaaaccccgcggcgcgcccattctttcgtttcgccgtttcctccctttgacccatttcctttcaatcattttgcgattcctttctcagtttggtgtttcgcttcactcttttcggcatttcctttactttttattccctgggaatgttttgcgtttcctttggctgttctctctggcgcggagattgaatcggcgataggaaagaagggaaaggaaagggcgaagaataaataaaaaaaaagcatttacaaaaagccccgccccctcccccaaatgccatccaatttcacccattttaatggtttaaattcttaattaaaaagaagtataagaagaattcttttcatgacagtccaacaacaacaacatcacattggcaacagtgcaaaaagtgagtcattcatccacacaccacacttctctccctctctctccctc

SEQ ID NO: 21542 - DNA, 2427 bp, Heterodera glycines
tttttaaattttaacttatcttacacctctttacccggccataatttatttatttttaatccataaccaatgctcttggacactgcccataaaaaaacaaaaaaaatttttcccctcacgtaagtccaaacgacaatttcttcaacttcgagcagtacaaaccgcggaacagaacagcaaacgacgggaaacatcaacagcatcgccatttgtggtcaacagcccgccaagagagagagaaaggacaacagaagagaaagacagaaacgacagaaggaccgtcattcagaaaagtcggctcaattgatggacatttggacaatttgagcatcaccaagttagcttcgaaaagagaactctgacaacagagcaactcttccgtcaattacaacatttaaaacagcggacaacaaaaagaggaagcaacaaaaaagagcagagggacaacaaatggacaataattaagagggaaggatgataaaaaagaaagaaaatgtcatcaaaaaaaaaaattaaaaaaaaacaataaaaaaaaacaaaaaataaaataaaagggacagaaaagagcaacagccatccaagctttggttgtgaattaaaaatggggggccattttcattggggagggaggtgtaacatattctaattatcacccatgagcaaagacgaacccttcacacatttccttttttggccaatcgatgttattcatcttttccacattccccccgttcaccattttattcactatttctcttttctctaactctcacaaatccccgcaaatccccgccccttttccgttcaaatgtttcccccaccaatcagtcagtcgcatcggaggagatgagagtcgcgtcggaggagatgagagtcggacgtcggagcgatcaaagacaaattaattatttattaatcatttatttattcacgcatttaatccgacataataaaagagccatacgaacgattggaccctttggacttcttggggatcagggcccgattcctaagattaagacccttcagtcctgggacaatccgtctcctcccatcccgctctggcatggatcctcacgtcttactaatagcaattgactaagctttacacgataaaagtttcaaaagtttaataagagttactgtattcctaattttttccaaaaaataattgaaaaatttttcaaaattggtttttcctgtaattttctcataaaaaatttttctaagattttttcttctgattgaaaattgtcaaaattttcagggggggggaaacgacggaaaaggggcgggctttgaaggaatgcgaccgcgcatatcaaacatttcccctttctttttcagatcaaagttttcatgaaggaggtgcggatcatgcgacagctccaacaccccaatgtcgtccagttcatcggtgtggcggttggccaggagcccctgatgatcgtcatggagttggcgacggaccttcgacgctacttggacatgtcgaggcggcaccggctgaacatgcgcgccaaactcttcatgtgcctcggagcagccgccggactggaccacatccactcgaaggacatcatccattgcgacatcgctgcaaagaactgcctctacgcggaccgcatggtgggtgagaacatgatggacgagggaggggtcagaaaaattgggtaccaaaatttaaggaaattggaaaaacaaaaattttgatttttttttggcaaatgctcatttacgctgtttttcctctccaactactgcagattttgcttctcatttgctttgtccaattcattgagtatgtttaaccaaatgtcttcgttgtagacctttccccacccattttttcagaatttcttcttaaaacatagtcgtcctcgcctatgtgtccttcgccttgatgctgttcttcacactgaaaatgttccggcacaacaattccttgcttcagcaaggagccgtcttggagagagtgatcaatttggttcatcatgagtcatcgtctgaaaacgacaaccaacaaatcgcggcgcctttttcggcgtcctcgtcatcgtcaggcactgaaaatgctccgcaaaatgatcaattgttgctaattacgggaggagaaatgccaagccatggcagtgacagtggaagtgccacagcgggacaagtgccaagccatgtcagtgaaagtgccatcgctgagtagaaacaaaatgggatcgggggtctacgggaatacgaagtatatggatattgtgggggattgatgttgagccaagtatggtgtgttgtccaaatgttgtcaaatgttgggacaaatatttattaagaagtaaattgggaaattggcggaagaaaatggagaaacgatataaaattagaagagaactaaaggaggagattaaaatataaaacgactgaactgactgaaca

SEQ ID NO: 21543 - DNA, 1430 bp, Heterodera glycines
tcaacgcattcctggatccggagcttcacatcctcacagcgtcatcaccattcgcagattgtggaaatttccgttaccattatctgcaactgagccagagcaattggatcaaaatcgacacacgcaccgctacgatccagaaaatcgactccagcagcatctctgagatccacgaagcctctggagacaaatcgttgttggaaatcacgccgctagtttttcatcgatggacgatcgacaacgaaacaggcgaagggctttcgcgcacttggatgaatggctgcgtttggatcaatggaagtcgaaggagaaggagcacaaaacggcgcgtgcgctcacactgggagctctcccgaacggagtgattggcctcaccgaagaatggttcatggacaaacttcggctgctcgtctcctactggacaacggcatgctgcatttacgtcacattcatttttgggcgcgatgtcctgatacccttggtatgggtctacttaatggggcccgtcatcgttaccatccgcaatttggtgacgggaaatcagtggacgcagcggaacagagctactcgaggcacacggcgagcaccggcaatttcaaggattgaggcaattgagctggtatcgcctccaatgccccaggaaatgagagcgaatgaaacggcaagttcgcaacaagaggaccccgagccgtcaccgctggtgatggaactgaaacgacaaatggtcgcgttccgctcaaaacgacgttttcaaagccgtgggaatgtcgcgactgaacgtcagccacgaatgtccgttgagcggacaaatgaggagaacggggaggaatgaacgaagcagcaaacgaggagtgatgaatggatggaaagatgggaaaaatagggcaaacgggaaatgatgaagggaagggaggacaaaaagggggcgaagggagggacggcagcaggcgagcacgtgaatgaggggaaggaaagcgataaaaagcggatgtggcgccttctccgcgtgaaggacgcccgaggcagtgcaaaaacgccgatcggaacatcgcggtgcgacggacgaaacgacacatcaccaaggcggacagccgatgaaaatcggcgatcatttgatggaaaattgcgaatttgcgggagagcaaattcgcccagacccttcccccccgcttttctccggtgatgtgcccccctccccgcgactcaccccacttttgtgccccccaattgtgccatttttccatttgcatttcccctcgcattttgtccccattgtcacaattttccccctttgtatttctcacacatttcttatgtatgggtttaattacccaagtttgagataaacttgcggagtaatcttggtgcaaattcttgggacggcaaattggcaattggcggcagcaaaaatcggaacaaacggcgcgtac

SEQ ID NO: 21544 - DNA, 2053 bp, Heterodera glycines
tttagagcaatcaactgatcagaacactgatcagcactcctggcggatttattcgtcgactcaaagtggcattttctgttgaggacctactgataactagggctgggaattttatgtaagaaaaatcgataaatatttaaataaaatatgtataaaaattgctaaaatatgtatgaaatatgtacaaaaacccagaaatatgtaccaaaatatgtaaataaaattttaaaatggttattttttggaaaaaaaaaatttcgtagggggtgaaataagcaaaaaaaaaaaagaaaataacctaaataagcttagaatcacctcttgctattttaaaaattaattttgatatctattttttgaaaaaaaaaacaattttttatgtgtacattttcaaaaaaaaaatttttaattttcacgggaaatttctctaaattctcaaaaattcccaaaatatgtaaaaaaacaaataaaatatgtacgaacaaaattgcgaaatatgtaagaaaaagtccaaaatgtataaaaatatgagaaaaaccccaaaatatttaaataaaagtcccggtttttgttcgcaaacacaaaaaattaagtgtttttcctaagagcatggagaagccaggaaaaaaatatgtatttaaataaaattcccagccctactgataactaatgcatctgctgacaatgactgacaacagagttccaacccgaatatgacaattaaattaattaatttaaaaaatactatttttacaaatataaaaatttttggcaaagatttgtcctcgggtcagcgcactcctcgcacttccggcactggcacaacggcattggaatgacatgatcgccggcccgaacactttcaacgcccggcccaaccgattcgaccacgccggcaccctcgtggccgacaatcgttggaaatttgacgtttggattaatgccactgacttgcttaattaattaataaattgaggaaaagtgaatttgtggcttttttcagtacaaaaacatcggtgtgacagatggccgtgaacattatcttaacattttacgtataatccaatccaattcaatcgcttcttcgcttgccttaatccgaacttcgccctcttttggcggcgccacttcgatttgttcgataaccaatggctttttcggctcccaagcgaccgctgctcggcatttgattgtctgtgattaatgaaatattaatgaattaatgcttgtggcgaaagaaactaaaaaatgatagtaaatatttaaatttaattattatttcatggcttctgcatactctaattagtaggaaacatctcctttttatggttgctaataaaagtttaggggtttttctgcttataatggacaaaatatgttttattgttttatgtacttcggaaaaattaagatattataatgagcaaaacattttctgaaataataaaaacaataatttaaatatttactatcgatcggactgcttatgcatatgtcttgcatcaataacaataatttttttaaatagggccgggagtccgatggaaaacggcggcggtcaatttggttttaattaataaacaaaattattgtttaattaatactcgcattattatggaagtatttttatttttcgtttacctttccagcggtatccattcaaattttgttgaaataaattggaattaaatggaaagcaaagaatgcggcgattgttttgctttgtctttggtcggtcggtggtccgttaatttgtgttttctttttgcattatcattgccattaatcgcactttttgccgggggaatctcagcagagattgcgaggcgattacttataaaacactcatcgcagcagaagaagagagaggacgattgattagtcaattaataaatatatgcaattagcgaagacaaaaatataattgaacattttaagacagaaacgaatggcaagagataaacaaaaataatttatttgatttgttttcgaatggttttttcgttggagaatggatgtaaaatgaaatattaaagttaaaataaatgatata

SEQ ID NO: 21545 - DNA, 2271 bp, Heterodera glycines
  misc_feature (2230)..(2231): n is a, c, g, or t
ataaaatgaaattgtccaaattccatgaaatttttaaatatcagttatcatttttatgcaaaacttttatgacagttcaatgatttactgattaggaatcatttatttatttaaatgattcaaaattttgtgattttctgaaaattttatgccccaataagtggaagtgaacattggccaaattgctgggcccggctgtgccacccagaccaacaaataccatcgcaaaatgctggacaaattggccattgtgcgggccggcaccggcggcatggaaatgttggcacacacagaaatgccagtgaataagccacggcacaaaatgggccgaactctctacgaggcatggtaagacaggaaaaaaggcataaaaatattttatttaaacaatttaaaataattgtttttttttaatttgtcgattttaaaatatttttaattatttaaatttttgtttaaatgtttttggatttaaaaaaacgttgtttaaaattcaaataggaaattgtttggtgacccaaatgccgtgcttttgttcgtcaatcagcccgacctgttcccgttctgccattttgaacaattgcaattcactacttttgaggtaaaaattataatttgtttattttaattgttttttatttattttttaattaatttaaaggttgaaaaattggcgaaacgtgacggaaacgttgttcaagtgatccgaatgactttcaaggagtgcgcggaacggtaagaaaaaaatattaattatttaatgaacgttaaatagaagaatattaaattaatcaatgaaaatccaattaaaaaaacgaattacataatgagctactaattcagaaaagaaaaaaaagaattaaaaaaaccttataaaaattaaataataataaattaattaattaaaatactatctaataaaattgaataaattgttttaaaatttaaattactattaaattaataattccgtaatttaaaaaaatgaaatatatttccatgaataatttgcagttgccatcttgacgagagcgacttttcgctgtatgtggacggaaagcgagttgcgctggtgcacatggcgtacggatatattggggaacattatccaaccgaagtcaattaaaattttaatttttaaaaaatagtgctcaaattaaatttaattttaattaggcggaatggcaagtgcgcatcgccatggaacgctcaaccgcaatcatttcgccaaacatacgactgcaattgacgggcaccaagaaaatccaacaggtgagggggggggggggaaattaataaaacttccaaaattttatatcttacatcaataaaaaaaacgcgtaaagtccaaaaaaattgaataaaattcattcttggtattgtcgaaatcgctcaaaaaaataaatcaatacttttattagagttgtacgggaccaggacttggtactgaaaaaacgtacaactgaatactcaagtcccgattttgacttgttttgatcaccgggaccgggaaaagtcccgattttttcccggttttcccagccaaaaagtcccagtttttcaacccgaaaaggtcccggtcccgggtttgcccaaaattcccggtcctgtacaacttcacttttaattaataaattatatagcacaaaatgattgaatttggtttttttttttgttcgcagctattaaaaaaacaacaacaatttaattgaatttattttttcaaattaatgaaatttgtcgaaaattactcctagatgacggaatttacgcaatttaagcaacgacaaattcatcaccaaattcatttgccatttctattttattaaacaaaatatttttaaattttcaagaaaaaaaaaattcaaaacaccaaaaactttaccctaagcattttcaattaaattcacaaattttttaaaattaggtgctcagtaagcctggcgttatggagaaattcttcaccgatgaaccgcaacgcgttgccgcactgcgcgatgtgttcaccggtctgtggggccttgagaatgacgacgcggtcaccaacgcggttattgaggtattaaatgaaattttttaaatttttaattaaatttttaaacaaatttttaaggatgccatccaaaggcccagggattatgtgctgaaggcgcaaatgggcgctggcaaaggcaatttctttgacgacgaaatggtggaaaagctgaagacaatgtcgctggaggagcgnngcgcgtacattttgatgaagaaaaattggcctgtcgctgt

SEQ ID NO: 21546 - DNA, 2270 bp, Heterodera glycines
  misc_feature (146)..(146): n is a, c, g, or t
  misc_feature (2165)..(2165): n is a, c, g, or t
caaattgggaaaaatacacccctaagatttaaaaaatttctcaaaaaattgatcgccaaaatttcatttttttcttgataaaaaatttttagattaaaaattttccttattcgaaaaaataataaaatgtttatttaataatcatntaaataaccaaaactaagcttttgattaagttttacgtgttttgctctttaaaaatccttaataaaaatttttaaatgccttttttcatgcctttttcgggatttttgtgccttttctttaattaaatttatttatttcgccgagccaggaattctcccctcctactttccatttttttcaaaaaaaattgaaaatgccattggtgcgttaagcgattttctgctgcccaatcgttagaccaaattatacggcacaaaaaattttgctaagataaacagatgaacaaatcagctaacatatgaattactgctattcacttcaaattaattaaggtcttcagaaataataaaaaatataaaaatatatattaaatatatttaagtttttgcctttgctcccctcactctttcattcccttctgctgctgctaccatccacaattgtcattttccctctcattgtaaatattgcgggcaccgctggatccattcccgtggatttaagtaaatttagccacaaaaatggccgttttgataaaaaaaatgtaatacattttgaaaatacttatttttagggacaaaatcttcgtattggaggctattcgtcccagtgaaaatcatggtcccggtcctttggatgcaaaattgatgattttatattcactgaatgatctctcaaataacaaactcaaaatgctcatcccctggcttttatgactactgtttgttgtgtcctttagttcttttaaagaattaaaaatgcttaatgaaattaatttatttatgttttctaaaagaataaaactgctgcttttaaatggaaaactaaaattaattttaattttttcaaataatcaatttttattttcataattcactatcaaatgagtgatttgcttctcatttcggtccctcttcaatcactttatctccccttttgatctttccaagttccgccattgttccccccaatccgatcgtttcaattttttccagctgatgtttgaacatttgctcataaatttgcacaaattgcttcgctctttcccacgacttcatatgtttttcggacggaaaatcggcgattgtttttttattccctttgaaaaaggcgcataaaaattcgtagaaaagtgaataaaattgcaaatttcgcatcttttcgtccatttcgccaatttctccttcatttttcagaattattttaaaaatttcttccacaaattttacagcagttaaatattttcccggctttttttgtgcctttaaaactgggccaaatttggtgtaaaacggcggaattgtgagaagagacagtgcaaagtgtgccatcactgtgggactcattaagcagtttggcagtgttttttgctcgccgatggcacgacctaaaaattaatttgattgactttttaatgtaattaagtaattacctataattggaatcggggaaacggtcaattcgatgcacacaaaaattattgccaacaaattttgcacctttttaagtgaatttttactgtcgagccaatttttggtcaaatgcacaacccatcgaattgtttctaaacgttttcaattatttttatgcgaatgttgatcattttttaaaaatatgtataatgcttttttaccttttttctttccattttttcttattttttcgcctgaatttatttaaagtaattatttttgtcaatttattattgctaatatacttccgaatatcccattattatttttctcaatttgatcattttcttgtgactccgaatgtttttcaaaatcattttggaaagaatgttcattagtttcatttgtcgatgagctccataatggagaggaactgttgccatttggtggatcaatgatcatctgcaaatcggtaccgtttgatttatttatttgattaattgaggcaattccccgtcggccgacaaatgacaaaaagataaacgataaatttgtcaacggcggatacgtcgtttgttgtttgtcacccaccattcacgaaatganaaaacaaatgatttggtggcacctgatcagcgaattcttcccactgattaatctccccgcacattcgctcgcacattctctccgccgaagaatgctgctgatcgc

SEQ ID NO: 21547 - DNA, 1929 bp, Heterodera glycines
gcaaaagagagacgattgatgattattatcccatcgattgtgccccttggggattcaaaatatatggcggagcaccaacaaacaaagaatgtaagttcagctagttgtttaaagattaataaaattgaattaaattcagttttcctgttcatatttggattacgttttccgaaaggcgcaaagggaaaatcaaaggcttttccaaaacaacaagccacatttggtcatcaaattttcaaaattgcgaagcaaagctcgaaaggccacaaagtttagccatttaaagtgcggcctcaaagaatcgtttgtaaatggaaaattagccgacattcgccaggaaatgctttgccaatcatatacggtaaaagaaaatcattaagattaacattaaaaaaaataaatcatagcgatttggtcactgtcgaaaccgcacggactgtgttaaggagcacgacgttgaccttttactcgatttggaggacaaacgagcacaattgaaaagagaaaaggagcgaaaacgaaggagcaaaaaagaaacagaaaagcaaaaggaagagagtgacggagaagagaatcaaagagaaagggaagagcatgaaaatgagaggggaaaggagggcggaacaaaacggaaatgggaagtgtctaaggtaaaaggaaataaatggaaatttcacaacatcatctcttcccttccctccccccgaaggaaagtgagccgttttttgccgtatcggacgaccgcattggaaaaacgacgaagaaatcaaaagaaaattacaaaaatggagaaggaattgggcactctttcgtggatacactgaccaaaataaatcggacggtgcaaatttggacaacgtcgaggggatgccaccgggcaggtgctcattttttaatggattggttatttttacattaagatacgcaaacaatttaggaatggacgcatttatgactggctttgcagtgcttttcttccaactcgaccatgtttatcggaattcgggtcggttcgatcttcggttggccggttgcgttgcattggcgggaaaagaattcccattactcatccgtaaatcgaatttcatcacccaaacggaaagccaccaattgaattgggcacgggtggagagtcggaggaaggcttttgatcgcgcgaaatattcactttggacaaggggggcccgagggaaagacagcgatggtttgcctcaatgatctcaagaaaaaccaacatatcaaaagaagcgggtcaccacaaaaaaacacgcctaatgaaagcattgtactttttgcacgccttttttcattatttattacggataatattacactcgctctttttatctgttttgcaaaggtaaataaaacaaatccattgatcacatcatcaactgctctctctctatctccattttcgcttctctctctttcaagaaccgctcgtgtttttcccgcaaaaacattagcagtggttcgattcccaaacgatgccttcccgaaacgaaaaacacactttgctccggaaacatcgaaacgatcgctgacttaacctttaagcaaacaactttatttttcaaaaaagggaaaatgatgccatttctccgtccaataagtccgttttgtttatgacaatcgccgcttcttttttgcttagttcgtcgtcgtacaaagtcatttcatgctgtaacaattcgtactgttccctcagatttccttgtgtaaagtcaaggacgaagagcacacattcgcagcgcacaatgtgccggaggaaactgaagccgagtccctcgttgcgatgtgcgccttgcaccaatccgggaatgtcggcaactgatcattttgttagggatgtcagaagaacggaagcggagtgccatgccaaagtcacaacacctgccaattggaagaagtcgccgtactgaacca

SEQ ID NO: 21548 - DNA, 1220 bp, Heterodera glycines
gccatccgacctcgctctcgagagaccatccatcggtctctgttcccgtcccgagctgccacgggtcaatcatcgccccgtcccgtccgtattcgttctcggctgcctcttctttcattcgacagaactgcaggtgctcaagagccacccaatccgcgtgttcctcaagataccgccacgggaaatggccatggcgctgccgagcgcggcttcttctcgaagtgccgacagtacctcccggtatgaaaatgcaggcccaatcgggatgttggagctccctcattcgatgttggctgaaatagcgctgaactgtccatccgggactgatcacttgttgacgagctgggagatgccccaggacgaatggcactggcaccacttgaccgcttctctcgtgcaacatccgccacccgctctgctctcggcctctcaggaagcgctccaccgccgcgcgttcgaatgggtcctccgcccaattatcatatcccaattctgccacttcgtctgccactgttcgggagtcgcttttcggggccaatggctttggctgtcccaagcctcggcgttttggcccgttctgtgcagcggcgggattctcatccccgccttgctcgtttggctccgccctgccgaatccgccgttctcaaactcactcattggggaaattggggtttgagctctgaaatggtgaggagggagggtcccaattttggccaaatgttttgctttgacggatgagtcgggtttgtccccgatggcagaaatgaagaaaagtgattttgctcgcccgtggggagtaagttttggttgaaggggcgggccaaatcccccgcctttcccttcattttggcccagcgctgattggctgcacgtgcatttgtcccttcgctgcgctgtcccttggcccaattgcagtaaacacaaaacgatgagaggcgttggcggggttgggacaaaaggcatcacccgccttctccgtctgatagggcatcggagaattgtgaatagggcgatggccccggcagatgtgaacagaagaagggggtaaacatcccccgtggcccttcttttgtttgatgggcacaaatttttgtccaaatcggagttgttgatgaatggaaaggccgtcttttgttgttggccggtcgtttttggaccaacaatttttgagtaaattagtgaagtgaaaaaatgtgaaaattttggcgaaaatggttgg

SEQ ID NO: 21549 - DNA, 2490 bp, Heterodera glycines
ttagagctgttcaccttcagagaaaaaaggcaaatgtcctccatctctgatctctcttttttcaccgaattttattttttgcttaattaaaaaaaacttttaccgattgagggaatatttagcattttattatgttaaaattaaaaatataaaaaacgcgcagaaaataaaatgccaaacaaatttaagaaaatttaaatttattaaacctgtacatagagttgcctaaattgttattcacttacttatatatcaacacttcctgggtgactaactaatgccagcagaagcacagatttgtgatgttggaaaagaattttccggtgacatcggcaggccaaatttcggaataattcaggcacttaacgcatagacttaatgggttttgtggaattgaactaaaaaagaaaaccaattttaggtgataaagacagccgaccaaatttattacagagacaaaacattgtacagcaaaatgaccattaaaattggaagtgaaatcatccaaaaggacaacaacggacaaaaagcagcaaaaaagggaaaaaacaaaaagaagaaaaaggcgaaaaatgaaggaccactccaaagtgccgaaatttgtccaccgacgaacatggccaccaaacccgagccaattccggatgacaaaagcgggtaatttcagagtttatcgcccgtcccatttttcgaaaaaaaatttgttataaaaattatgaaaacatctttccaagggttttctgggtcgctgattacggatccggaacgaacaattccgaaccctgggttgaactcgaacaaaaagtcgaaaatccaaattttcaaaattctgatttttgttcaaactttgtttggtaatatagtagtaccgatggtaccacatctttaaaaaaaaatttttccaaaagttataaagctgttaaatttatttcttataaggttttcggtgtcgctaagcacgaatatgacatccatttctcccaattccgaacccctaagtttaaatcgaaaatttgagttttcgactttttgttcgaattcgggcccggagtttgggattggaccaaatggatgccggattcgtgactttgaaagcgaaaatggttgttttcatggtcgctgaactcaataggaaaaagttgcgtttactggtcccctggccaaaatgattttgagaaaattgctaacccaatagccttcctcgcccttcctttggttttcaaaattaccctttttcagtagggccaaaatggccgtcaattgcgcaccaattcggagtgacaaaattccaccaaccaacaaatccaaatcggccaaatgtgcgaacaacgtaagccgatcgaaagcaaaaagcgggaggaagtggacgaaggcggtggcttcgaatggtaaatgctttggctcttttacacaaattaaattcggataaataaattcgcgcaaaaatgaaaaagtgaaatacaatattattattttttggtaataagtgctttttatctaaaactaggctagaaatgatagttttcgttaatgcgcctataattttgaaaaaatttttggtgccgaagagaaaggaaagcccttcggatcatcgtcacaaaattttttggaaatttttgacgcgtcgggggtcaattgggctccggaccagtttttgtggtataacgcctttcatagctgtacaatttttcgatctttctattttttgttcgtctgagctggcacttttccccacaaaaatgaaaaaactttttcccaagggaaaaatgcagcgaacgaaagcggcacagagcttggcgaattggtggaaaaagtcaataaaaatgccatcaaatttcgtcgtgtggtggcgcgcactgtgcaaaatccgcatgtgctccatttgctgtacgcactggaaaagcggcaatcgtccatggaaaagctgacgaaggaggtaaatcgcccatctttcaaacagaagaaaaaaggcttgtatcccaaaaaaaaaaatttttttaatttttttttcaactgtttggttccgttttttttctttaatcgcgtgtactaagggccggttaggaagcttttgagtttccttactttattaacaggaaaattattgaaaatttgatgccaatttttctccggtgacgcctatcggcaccactgttccctaaaaatcctattttttaaaccgaccaattgttgtacttctaattttgtgtggcgttttgccttttcagatggccaaaagggtcgagaaaatggaacacaatcagagagagttgctgaagacgatcggcccttaagatggtcgtcagattggcgcctttcgctaaagaattgccagaaaatcgcttaatttatgacccattttcgacaagcagtgttgtgattgacgtattattctgtagggtatatgatctgatcagttttgcctagctttatcacttttacaaatggcgagttttctttctaaacgggaaactttttttgtcaatttca

SEQ ID NO: 21550 - DNA, 2041 bp, Heterodera glycines
tacgccattgattgtgacgggcgcgtgcgcaagcgccccccacgcgaagcgcgcgcggcagccaaattagcgccgtcgcccgccacagttaaaaaccgctatttctcattcgttgtttgtctccactttgtcctattctctcgcttgcttttttctctgcgtcttgcgctaacatacacactctctttccaactctttctctaaataaccactatttccccgctgttctcgttttctctggaatttgaatgaaagacagcaaggcagacagcgttgccatcagaccatcatcatcatcattagagcaacgactaattaaatgcgaaattgtggggtaatgtgtgcgtgcgtgtcaataatagataaattaacagtacgggggagagagagagggagggagcaagagagcagagagaaatagaagtaaagtggataagtacatacagagagagaaagagagagacaaagaataagagagagagcagagagagagggacgaaagagtgagagaaatggaataagagtggatcagcagcacacacgcagagaaagagagggagaaagagttgttattgcgctttataactcagagaaagggaaaattggatagagcgaggaatacagagagagagagagaacagagagatagagtgtttaaatttgttgcataacccataaactaaataatggctataggaggagaccaaatacacaaacatataaatggtgcaattgaaaggaattgttggatcggcaacttcattctcgcacacacactttgtcaataacgcatacaaatgatgctttaagagattaatttcccactctttggctacatccaactaaattgggagaaataatcaattacaggcccaattaaatggtcgccgtcacacacttaatgaagcaattattcgtctctgatcgtttgtcgaacaaaatcagggagccctaattgccttggttgagcgagcacccgcatttcactccaacaacacatttaaattgcttccctggggaaatggggcgcagaaggtcggcggaaatcatggataatcaaacgccgcggcgctattagcataggaaacggtgtgccgtttgtggtggtggctgtggcatgattagccaaattaggacatctcgctgccaattcaatggccttcaccctatacacgcagataacagaaaaatgatttaaatttgtatttacaaatagatattaattggattggttcaatactgaattatgatacacacccatcaaggactcgacaaaaaaaacacgcaatgccaaattaaattgccaaaattgacccatcatttattaatgtgataaaacaacacacacaaaaaaacgtggaaaaattgaagacacacaaacaacgatatacaaaaatggtctttttccagaaaaaaaacaaatgcttgataacatgataatgtataacaataaaaattataatgcaattgataggacgaagctttcgttgtccagaaatcttgaagaaattggtcaatataaatttatcttccaaaaaaagataatataataaattatataaatggatcgacaaaattcggcaattgtcaacagagcaaaaataggcgcaaatgtaataaatgaatacgcattgtcagctgtataaagccgaacaattattggaaatatataaaaaaggataaaagaaaattgtccattagcgtttgcttggcactttttgaaggcgccaacagccatttttgccatcaaaataatggcataattcgacaagaaatgtttttttctttcattaattctaaatgctgttttttcaaaaatggaaataaattttaataaatttaatggacagacgtacttcaaaacaagggcaaataaatccataaaattacgtaaatggaaacaaacaaaaaacgagcgaaaaaataacaaacaaaaattcatggacaatttcttttatgacagtaaaatttgtgcgttgtgtaaaactttgtttgaagatcatttaggcagcaatggcaaagtgaatgattgattttgatc

SEQ ID NO: 21551 - DNA, 1803 bp, Heterodera glycines
  misc_feature (1180)..(1180): n is a, c, g, or t
tgaagccaattagcaattgtgcacgcaacaccatttcgttataaaagggcaaagcctttttctctccaaggatttgatggccaccaaagacattttcgcgctccctccgccccgcgccgacggtccgccgcttttggacccgcgcccgcaacggctcatccgtcgcgtggacatccaaagccaagcggcacaacagcagcagcaaaggagcgaccaacagcaaatggacacactgttggaggaccatttgcagcattggaagagagtgaagcaaaagtgggcatcctttttaagcattactttgggatgagtgtcccattggaacaacaattcgtttttcgcttaaagccatgtatttttgcgagtgcgttttgtgtcctccccctttttttgaaaaaggcataacaaattatcaaaatatgcttccgggattcttcgaagtcgatgaacacgaaaacggcatccattttgaccaatttcatatcccgtaaacgaattagaacaaaaatcccgaataattaaatttccgaatttcgcgcatttttggtctaaaaccggcttaaatagtgggggggcggacaaagtttattattaccgcatttttgtttcaatcattttcatagccatttttagttggtgcgaatatggccgaaagcgtgagcaacgttatgcggacagtttggcgagtgtttccagctgtcaagtgttttcaatttaaattctgtgcttttagcaacttcttcggactgtctacggaattgctcaacaaacgcagcaaatgtaacaacagttggcaaatcaacggcgttcacccgaaaaaaatgattgaagtctcgaaacattttttctttattttcattattttattgttttcacttgctcactttttttatgtaaagaaaagaaatgttttctgtcaaaaagattgtatttccttccttagtgtgtcagtggggccgatttgcggccaatccgtccgtcactctcaacagaccaaaagtaatcggaccacatcgaaccaaatgataaaacagtttgtttcctccgaattccactcagattagaatactggaaatgttttgaacacttggttggtcgagagtgaaatatcgtacagattttcatatcgtaaaaatggtggcaaaatggccagatttaacggaagatggaattccccccnccccccgttcattccctcagtttgtacgccactaattaggcctgtattatttaattgcccttcatcggcgggagggaataaaacgtcctaattgcccctctatgctgctgctgctgctgttcattcacagcaaccatctttcaatttgatgatcgatggcgaagggacaaaaaaaaggggcgggggagggaaaagttcgctcgtccttccgccactgtcctccatttttctttgcatttcatttccaactatcagccaaaaattcttcgcttcttaaagtgaaaggaaagaattctcaccagaaaaagaagtaaaattccgaaaaaacattggtataaaaagggcaaaactccttttttccttcccaaattttctttcatttttggttttctgctgatttggtactttaatatggaaaaattcattcaatattgttttattgtttttttcggacaatgaaagttttgcgtccaatcaatgaccattctaagttgggaaaaaccgaactcgtactgccccaactcgtactgtttttcgacagaaaaaacgtcataaattttgttaaagtcaaccaaattaaacattcttggtatcaagcgatagtacttaatgttctctatcta

SEQ ID NO: 21552 - DNA, 1804 bp, Heterodera glycines
aaaccgcagtgatcaattgatcaccaacttttgacctttagggtccttttttagtgattataaaggccaaatgtttggctgatgaaagtcattttaaagagacaattaaataaaatgcactttatttagcagaagatacaaaaaggaaatgatatgatcgatcgatcgattgattggattgttcgttactcatttcggcatatttaattggctgaccgataatatcgcaaaatgattgttctttcggcctttcttcattacgttttaatttgccgtgtgttctccgtccaacgatcacttcgaccctaattccatccaaaaagttgctcaccgtccaattggtctttgagttgccactccaattcggcaaagtttgtgccgctgaattccgtctctccgtcgcagccattcaccgccgcattcagtgcctcgttaattccattgcattgcgctcgtccgaccacgtgaatttggagccgatttggtcgtgcacagttcgtccgcacaaaattgagaagctgcgcaaaataaaaggcctttccatgtgaaaccatttgattttccattcaaaaacccccgaattcatcgaataatttgtgacatgaatttgcttttttttggtttcccttttcccttcgcttttgctttaccctttcgacggtgctcggcatcaccggcccattgtccaattcgagcgcatatttcagctttccctgctttttgagcacttgcgaagtcacctcaaataaatgtccatttctaaaaagtccccgcattttggtaaatcaccgaaagttccttgagagtgttgtgtcggaagggtacgtttgagatcagagtggggggaagccccgcctgaggccccgttttggtggagcaaagagtcggctgaccaatcaaaagacggcaaaaggcttccacatttttggcgccactgaaaacattcgcaattatgagcagaggaaggaaagaccaccagatgagtacggcggacttcgaactttcgacggacgaaacggcggacaaaccgcgcgaattgtcttcgctactcttacaattagtaaggccggaagaatcattcttcgattcgttggacaaaagcgaagccgacgacacgtccaactcagagggactgaagtgaacattttgaggaagaggcaatttgtgcattttcacattttcagtccattttgaagggatatacgaaaactcataatcgcggtctaatggacgtaccccccagggtttatgttttggacgctttcaccccctaggcgacgaacagccaattccttatgcgatatttcctatttcatttccctgaagtaagcggtacctaatgtgctgccaagcaaatttttaaacgcaaaaacacctttgttttaatttgaatttcgaacgtggcgaaatgccaaggtcacgcagccattcgtcatggtccatgccaatactttcgtctccgatatttgtcaaaaaatccttcgggcaatcttctcggcccaactcaacaaattctgtcgttttgaaaggcaaagtgaattcgatgcctaaaaagaagcgaatgtaaacgatggaatggcttttaaatggggcaaaacgtttttcggtccgttttttgccgttgcgttactttttgtctgtaatatttgccgaaacccggaagttgtcggagtgaccaacgccaccaaatgattcgttggtgacggaacagcagcgaaaagtgcggtgaattgcggagcacaaaggtaaaaagaattgttggaggacgaacagagagaagccggggaagaagaaagggcgcgga

SEQ ID NO: 21553 - DNA, 2279 bp, Heterodera glycines
ttgatggtgattaatgtccgtgtacacaatcatcgagccttgtcaattcggttcgggttccacttttttgggaccaaggaagtaataattcttttttgaccactcctttggttcgcgaaataaagccaccccgcatctccattgaggatatgattgtgtgaggttttgtgggcaatcaaaaggaatctttctccagatttcgttcaccctgttatttggtaatgattgaaagggaggatggtggttgggagcaagtcctgctcaattaaaccgacaaaattacgtccgcgatagaatgtttaatggtctcagatggcttaaacgatccagagggcgaaaattatccgaaaaatccttctcctagcatttcagaaccgcaaatattgataggggtacgcgaattttggcgtttcattttgggttggacggagattcgtccatgcatttttaagatccaaacggtttttgggccagtgtatggaggcgaagaaatgggaatcatcccattgattcaaaatcattcattaacctgtacggttaacagccccgctcagcatgaccggtcggaagtcaaagatttttgggcgctcgaatcaattggaatcacggattgtcctgaaatgaatgatgatgaaaaagcggtgcagaaatttgatcaatcaataaaaactgatcaagaagggagatacgaggtatctctcccttggaaaaccgagggggaacgccctccggaaaacttcaaatttgccttttctcggctcgcggccctcgttcgcaaattgaaagacgctccacaactttttaagggatgtgatgacattatccaagattatgtggcaaaaggcattaagaagtggccactcgcaccacggagcagcaatatttccttccccatcatacagttatgggaaaaaagctccgaattgtctttgatgcctcttcgcacgaaaagggagcccggtcactaaatgacaccttattttctggtccaaatttatacccggacttagccgggaaactcatacaattcagggccactaaatttccaatttgggctgatattgaaaaggcctttttaatgatcagcctgagagaatctgatcgggagttttcgaaatttctgtgggttaaggacataaaagctccactctctggtaaaatatcatagtttttcgtttcaaacgaattacgttcgggatagtttcatgtccgtttttgctggccgcaacacttaaatatcatttggacacgcaccctagcagtctcgccagggaaatagtcgagaagtcattattatacgtagataacctgttgaaaccgagactccgaatgttctcggaatgaaatgggttattaatgaggacaatttatcgctgtctttccctccggttcccggtcctgaagggctaacacggagggtggttctaaagacaattgcttccttttttgaccctttgggtttatgctccccgtgtctcgtggggcccaaaatgttcttccagaaattatggaatgaatcccagggatgtgatgatctaattccgatttctgaatgtacggaattgatgaaaatccaaaaacattgggatagtgaaatcttatcaatcccacgtcactctcgccgagtaggcagcaattcgttgcagttacacgctttttccgacgcatcgcccgaagcttttgcatgtgccgtctaaattagggcagaaatgcaaaataagaatgttgtgtcgatggtgtactcccgttcgcgaattcgtccaaagaaaatggcgactagtcaatcggatggtctaaccatcccacgtttagagctcctcggaattctaatcggaacccgagcaattaaatttgtgaaaaaaacacttaaattacgacatcaaaaaatgctttctttggtcagactctcgcatagcactttcttggttggcttcaaccgataaaatgccaatttttgttgcaaccgggttagagaaattcgttccaatcggctggtcactttcagctatgttcggtcggcggataaccccgcggatttggcgactcgccaaacaacgcccgcagagctgaaaaacgccattctatgggtggaatgggccagaaatggctgtccaaatccaatgaattttggcctaaagagtatacagtgcaacttccgcccgtgcgaaaattgctgggaaccgccgatgagggtttctctggccggtcctgtcattcatggggagaaaaaaagaagactatttacggggatttttcggaaaaaatcttttttgagcccc

SEQ ID NO: 21554 - DNA, 723 bp, Heterodera glycines
gcaaactagtcgttgtacgtgatcaactggcggaccctttttttccattgacggtttcgtgtttttccagacgacggaattcggctcgatgaaggccaagcaggtgaacatgaaggcggcctgagaaccgaagaagataacgccgatcttcgaacccggcgcactacttgtgagccgttttgatcattctcgaggccttttgatgctcaattcttaatttccatgtatttcattcaaggagatcaataaaagggttctctctttatgtctcgtccatttgggatgaagtgcgtggcggtatggatgttgtattctaggttcttggtttcaaaaaggccctcttacagttgttccctactttatctgaacttcatttccgtcatgagtttcctactcttatcttagtaggcaccgccgggaaatttttttgatctttgggtgtgatttgttagcagattttcacaaaaaaatggccaattttttcgcttttgagccaatttttttaagaaaaataggaattttggggtttggcggtgccgccaggcgccgtcggggaaaatttttggactttttaatgaatttggtaagaaaattttcaaaatttgcgacaccccctagctgcgaaccctctccccccacctcttttacaccggccccccttcgctgagaagatcccccccccctcccgagcaggccccctttgcgagcgaggggggggggggg

SEQ ID NO: 21555 - DNA, 984 bp, Heterodera glycines
  misc_feature (45)..(47): n is a, c, g, or t
  misc_feature (55)..(55): n is a, c, g, or t
  misc_feature (90)..(90): n is a, c, g, or t
  misc_feature (153)..(153): n is a, c, g, or t
  misc_feature (158)..(158): n is a, c, g, or t
aaaaaaaaatataataattttaaaaaatattatagctaaaatttnnnaattttanccatgtaaaggtaatttcaaactgtttttagttantttctatatttttaaaaaagatcaaaatattttaagtaatttacattattttgattttttttngggangttacacccttttttgcggcgcgcttatcccaaagagaatttgagaaactgtggggaaggaagggtccggcggtgccgatatgcgccgccgggaaacattttgtaatttttaatgtaaattgttaacaaattttgtccaaaaaatggaaaatttagcgattttgagcaaattttcaagaaaattaagttttttttgagtccggcggtgccgataggtgccgtcggaaaaaaaaattgaaaatttctatgcaatttattaacataaattgtacaaaaattgctaattttttgaaaaaaaactcaaaaaaattccgaaaaattccgacttttcatcaaaaatttcggaagtcggaattccgaggccccaaaaaggcagcaaaatccataaagcacttattttgcgtgacttatacagtatatgagagccttattaaggtaaagtgacctttcattcaataaatatttctttaaattgattaaaaatgatacagcgcaataaaataaaaggagcagcaacacaggacagtgtttttcctgttaagcgtatgttgaagagacaatgtatggatgaaaattcgatttattcgccattttttcgtccaaaagtgaaaattcaataaatatatagttttaatttttcgctttacaccaagaaattgagccgaattggaaggaacgccacggacgtgctcaacttcgcactgctaacaccaactcgggaaaacgatttggcagtacacagaatgaagctcgaagaagtcttttcatttccacttatcccgaaggtcatcccgtataaattcagcttaagaaatggcccagaata

SEQ ID NO: 21556 - DNA, 1767 bp, Heterodera glycines
  misc_feature (1597)..(1597): n is a, c, g, or t
atcaaattaagtaaattgtgcatcatgacagttggtggacgacatttacgctaattgtttaccaaaactgttttatatacatcaaaaatgattcatcaactgtttttttgtaccatttcctttgatattctgggaaaaaaggaaatgcattttgctcttaaaattcgataaaataccattcaaatgttgagcagaaaaaacggaacggaagaaagaggaaaaaaggggggggggtgttgtttccgcgcactattttagaaaaagagcgactcaaatgagtgcgggttggagaggaaaaaggggaagggggaggtgaggagagagagaagaaggagggataggcccttcccttctttttggagctgctgtgagaggtcaaatgcaataaaataggagcgggaaagggaataaaagcaaatggtcaactgaaaatgggggggggggagagaatggtggccaacaaatggaccccaaagagaacaaatgcacacattcggcaggagagggggcacacggcacagcacacacataaataaaggaagtggcgatgggaaggaggggggggggcactgatgagtgatgaaggagcagcagcacaaaaagcccctcgggggcatttggagagagataaaaggcggtcaaaattgaaagggcaaagtgctagtggcgttgccaatgggtcattcaaaatggacacgtcaatgttggcatttggcacaaaacttttgtggtggtggaaatcattaaaaatggtcatgggaaaaataaataaattattgcacattaagcataaggtctatcatagttgattatttaattactcttttccagctcatttcctcatttctctggtgttgtaatgttaggaaataagtgaaggaaatgcgtaaaatatgccaaaattccaatttatttttctaaactgtcggtatgtgcacaattttttaactatcagtgcagcgtttgacaaacttgctccgaccctccgcccaatttaagggttgttctgctttacgttgcatgtactattttgaggtgttttgcaattcggcgaattttggacacactttatattattgtaaagggaatgaatgggggaccgaagaagtgcacacaatcatagggagaatgaatgaatgaaaggaatggagggggaaggtttggccactcactccgttggagcaatgaaagcgcaaccaaaagcgaataagcaccactcatcacaaccacaaacccttttcatagcccagcaaggcttatcctatcaaatgtttgttgaggggataaagggatgtgcttaaagtgaggaggataaaatgggggaatggcactccaaaccggggttttttctggagtgaaacagtataaaacgatgggtgttcagcaaattggtaaaagccaattcagaaaagggtgatatggaattgtaagccgtgttcgggataagtgaaatctcaatcccgtccgggcttttgtgttcaatgcatataatataaaagcaaatgttgctgtagatggcactgggaaaaagaaattggagaatttcatcagcgagggggaggagatatttcggcatggcaaagcgcgcaaacatatngagcggggaggagtaagtcgggatgggtcaaattcatggcggaatcattcatttcggatgagggtcagcagtgggaaggcactgccacacacactccatttataattaccaccacacaactcacagccaaacgaatttaaggcccaaatacagcaaaattgcgcgattat

SEQ ID NO: 21557 - DNA, 1056 bp, Heterodera glycines
  misc_feature (999)..(999): n is a, c, g, or t
  misc_feature (1012)..(1013): n is a, c, g, or t
attttaattaaaattttaatttaaaaaaatattccaactttttttctttcattttaagcatcctaaaaacccaaaaattaatcaattggtctttttttacaaattctgttaacaaatcgcattaaaaaatacaaaatttttcccgccggcgcctatcggcaccgccggccctccttgttccccaaaagtcttgagaaaaacgtgccgcgaaaaaagcggtgttgaaagcaaaaaaggtcattgatttacattaatttacatggccggagaccccttcgcaaaattggaaaattggccgctgatcccttgttttgcaataatctgaattttgaggtctacatctgaattttagtgttctttatcctgaatttgaaaaaaaaacttggtcaccctcaatatacatatacttctgaacaattctaatgctaaaaaacaggcactcgcgcgaaaactgaataaaaattttgtatttgaaaaattttgtccaaaaatttttacgttggaaaattaccggtttttaccggtaccggtaccggtaccggtggaaaaagttggtaccggtaccggtaccggtttttgcattaccggtcagtaccggtaccggtttttttacaattaccgattaccgctcaactctagtatcacaccgtttcaaaaaatgagatgtgtcaataaatagagagtgcagagaaaaatacatttctttcattttgacatactatttcttatagagaaagaaagaaaaaatgacgattttcgaacggtttgtgtatcataatgaaaagggtggcttagtttgctcaattattttctggggcaattaaatattgaatcaatgagataatttgtgcgaaagaatgtaatcgtcacatttgaagtaaaacaaaatttaacaaaagcaaatggtaaaaattaatggatttaattggcgagttaatacaataattggtggttgtagattaattttcaaaaaagtaattattacagagctcggcgaanaagaataattttnnctgatgagtatcatatcattacttttaaaattcttcacttttc

SEQ ID NO: 21558 - DNA, 1334 bp, Heterodera glycines
  misc_feature (1329)..(1330): n is a, c, g, or t
acaaaattaattttgatgactttcggtcgcatatgtgcatttgcctaggacaaccacaaaccctctttccccttcatttgccgagagacaacaattctcgaacttaattaaataggtggtggcaacgaaatgagattgaggaagaaagagagagagagactgtctgaaaagaaacattggcactgcaaaacgaatgagctctgcggggaaaaagcggggtttgtttgctgcagagcgaaaatgtagaggtacatatattcctggaactcatcaatcggactcggcctttccgtgaccatcctcttacagatagataataactctgtgaaaacaaaaatttgcattgtctataaaggcatgtcaagaatcatgagtctctactgtggagttatggcattcctcattttgtgttgccattcagtctcgtttgcattacaagaatggcataaattcggtttaacccggcccgccccccccccctccctctttttgatggatgtgtcgcccgcatgggctactactaattttggtaattatagcacagcaaacacgcgtcaattagcactgcgcaggaagtaagctgggaataaatgagaacagaaagccatccgcctaacacagcacaccaactgaataagcgcaacatcagccataagcctcctcctctcccttctcctctagggaaatggaggcttcacgcactctaattagcggggagatctgtccatcccccccccatctgagcgacctctttagcacaaagccaagcttaatgaggcgacatcaatagtataactaaaatgaagaatgaattcaaaactggaagggatgacaaattcattttttggaagaaataataatcatttttgtttaaaaattataataattattgcgtagaaaattgttgagagagttttattccaaaaagaatggtaagccaatgttaataatcaaagtcaacttaagccctatggcctgggccgtttttgcccgtttttgcctcgagtgaagggacattttcatgggacgacaattaatccccggcagatggaaaaccttcggaaagaaaaaaggctttttggtgggaaaatttatacataaaaaatgaaaaagttatgcgaattataggcacagaataaagcaaaggcacaaataaaaaatttgtaataaaaatttatgtggaaagttttttgaaattattttacactatgggccccaataattattattggtgcgatttttagtgcctaaatgggcaaaatgttggcaaattaattaattatataatgcaccgaattcattttcgtaatgatttatttaaaaagaaannatta

SEQ ID NO: 21559 - DNA, 1871 bp, Heterodera glycines
actgagcacttttggcaattatttgcagtttgagcacctaaaaattgcaaccccactgagcacctagacaataaatcgaccccacaccctttttcctctgtattgtaatacgtttcctattaatcctttattctcatgtcaggcttgggtgcggttttgtggtttctgcgaaaaataaattaaaaatttttagggtagaaaaatgcactgatcgcgaatctagctcggatttacaacatcattgattttatctatgggttttcttgattttctccaaaagtttatgaaaattaattgggcataaaaacgcatacacagatgttgttgagcttaaaaagggctttcgaatgagctatgtaaggtctggagaagtcaagtttttaatttttacgattttttgaaatttaattactggcccttgggtgtgtccgtctgtcctatgcgacggaagtctggatttgccacattttggttattatttcataatgtaccaagaaaataatgaactatatctcggtattttggatttcatagaaaattgtaaataaattgatttttaaacgtaaaaaaatagaacctgctggattagtttggcatatgttaagttgtgtattcaagaagtcaaaataacttttgtcattttaaaaaagggaaagcccgtcgcaaattttaggccatttatcatatttattttacattaaaaaattagattaggtattatgtattaataaattattaataataataggttgcgaaattttttttttcaatttttgtcattaaaaatgcgtccggactcaaactgaaacaaataattgaaaatccattaaaaaaaaaagttaatttctggagttcgagtaaggtgttcggattgggtcaaaaatggatgtcagactcggttttatcgaccataaaactcctaaaataagtttaggaaactcccaaacaagtttatatctaaaatcgaattttttcaaaggaattcaattttaaatatctaaaaaaagaggtctacaaaaacgaaaaatgcgactggataatagcgccaataacgagagatatagataaaaaaaaaaagaagcagctacatgaacttttcaaattttttttttaaatttctatttaaatttattaatttttgtttccccgccccaaaaacaaaataaaaacacctcttaaagtgataggaagcgcaccaaattattaagccgctattaagacaaatgaccggctttacctgaaattaggcatccatttttctaattttttaggaccgttattatgtacaaaaattggaaaatttgcctctcaatttatctttttttttaaatttcgtgcccttttttccatgacattttgaaaatttcttcaaatttttcttgaaattttcttataaaaaatttctaagatttaaaaaaccgagattctcgcttattgtcaacccattcaaaaaagctccccaatcactttaaacatctatttatagattttttcgatcatttctcactttgttaggcgccattttgacgatggacgactttgccaattatcgtgccattgtccgtcccggtgccaatgtcatttacactcaattagaggacgggcgcactatttgcgggcctccgcctccgtctggtgccgcagtgacaagcaattctgtccattatggacgcatcagtgttttgacacatattcctaaacacataattttgattgtttgagggagggtaattagccggctaattaccccactagtgattagttggctgatcattttaaaatttccaatttatgatttaagtggagttagattgaaaaatcgccaatctgatcaagtgggtcaactcaatatcacaattttgcctaaaatc

SEQ ID NO: 21560 - DNA, 1396 bp, Heterodera glycines
gatggcaaaagtgctcctttgaccccttccccgtctttctggcattgccaatttagaaacattccttccttcaatctctgccacttttggctttacgctctcttcctttttttctcgttacaatcctttaatttgggttctttattttactttataagtgtcttgaatttaagcagcagtgaggtgaatatttaatatttctttcctggaaacggagggagggggggggaagtgacaaaagcacagactgtggaagaaaccaacgcaagcaaaagacgaagtggaggaatagaagggaggaagtggcgatggggaaaatggtggataaacaatcagagaggcgggggagggaggagtgagggatcgaatccgaatgggggggagggggtgagccgtttgtgctttctgtgcgcatcaatcgatggttgagaggggaagcgtttccgagacgtgaaattggccctctcttttgtcccaactttctattctcgcgctttccttcggctcgtccccttggatttttcggcaatgtgttcatttgccctcattttcggcactttcccttttgcttcaggtttctctttcaatgtcggcctccaattcccccgtttttcgccctttctttctcctctcttttctgccccttcttttgttccacttttgtccctcgtcgacctcttcttcctctgtcccaaaaaggataaagccgcttccgcctgctgaagaaagcccgaaaagagcgcccgttaccaatcggagcagtggcaaccgaatgtgccctttaaatgaagttggtcaataatcattgatcagtagagatgttctccttctcgccattatgagcccaaataaatagcgttttcctttctttgagcacgtcgtgtgcaacgaaatgagcgaattgcaatcggttcgctgtgtgtgcacaatgttcggctccgaagtaattcctcgaaattagttttaacggattcttcaacatatgccaatttttttaatgatcgctttgtcctttcaaagtcaccagcgccggaacagacgtgcagcaaattgctcaattcgtctctgtacgtcgaggcttcctccgttaaactccgcctcagcgattctttttttcccgccacgccgccttctgctgatgaggaccattcgactgctacgagtaattcggcggacaattttctggaagaaaagttcaaaacacagctggcatggcacttcaaaatcaacaaagtgcggaaaagatatcacagaatgagtcctttcccctcacgcatttcagaaaaacattctgttcctccgattgcgttgccaagaaagacgcaaatgtgtaggtgaaggaagaggcacaaagcaaagcgaaatgccatcattctgatcccaaaacgataaacag

SEQ ID NO: 21561 - DNA, 1847 bp, Heterodera glycines
atttcgactcaccatgtcgaacacttagtcaagaacggcatacattgtgtgccggccgttgtccaatgcgaaatgcatccattcctacagcgtgacgatctgcttgattactgtaaatccgcagggattttcctgcaggtggtcaaatttggaaaaataatctaaaaagtcggaagggtcagtgaaaaatgcaccagggaatcagataattttctaacaaaatttcagacgaattttttcaaattaaattgttaagccaatttgtgttttaaaaatttaccttgcggcacaaatttgcacgaagggcacaaaagccccttaaattttttctaactataacctaaatacttaaaatttcgccaattggatttgaattgtgagtgtctgtttctcatgtttgtggatatggtgctagatggtcctagaaaagtttctcattggggcgagccaggggacaaataaattagaaaatcttttctctattaattgttaacttttaaaggcccacagcatttttgcatacaaagaacaaaaaccttcctacctaaagcaacaccagcgctatttgctgctgaaaagcatagcatcattttacaaaattggcacatcggtgagtgatggatgattggcatgttatgggcatattatgggttatggattttgagttagtccaaatcttggttagggattattccaaataaatattggaatatttgattcagattcttgattcctcaaaataatttattatatttttcgaatttttatttacataggattttttaaaatttctacttgattcttatagtcaaatattgagtcaaatctcggtctcgaatctttgatatatttgttcaagtgttattttgcaaatttttggtgccacggaaaaaaggcggaaattttaactaaggttgaaaattagcaattttttgccaaaaaaaagtccaaattttttacctggatgcaaatttaaaaatttctattagtaaaatagggttagggtccatcaatttctctcccgccatcctcaggctacgagcctttctattttttgcgaaactttctttcccgtacatcaccaagaaccgccccgccccctttaaaagttaagcagttgtcactttgtttcctcatgcaacgcgccccacatgttggagcagtaattgtggaagaaacggatgatttgtttctcacaaaaaatggccgtccacggcgtgtgatgtcatgtcagcagctcaggaaactgctgaacggcctggtggccagcgtgtgcaacaacagcgaccaccttgatgaggctgatgagcactacgattacgacgacattccgccaaaatcccaagaacatcagcagttgagagtaggcactgctttgacaaaaaaaggaggaatgtcacgcaaaatcggggccttcaaaatgtccggggatttccaatctgacactgcgcgcgaatataaaaatgaagacgacgattgagggaagagactgttattcaaaatcaaatcaacggtgctatgtcgatcgacgaaaagtgcaaatttggtgtatcgaaaaaagtgcaaaatctgcaaagtttatttttactgaattaactcataacttcgcaactaaattgcataaccttggtatcatacgatagcccttgaattgcgttattagcttgtcaaatttcaaaaaattttatttaagttttccaaaagttatgaccattttttcctgttttttggcttggacttttgaaaaaacttaatgagttttttgaaatttagtaagctaataacgcaattcacgcgcaatcgtataatgccgaaaattgtgcaatttagttgccgctaagaaaagt

SEQ ID NO: 21562 - DNA, 3784 bp, Heterodera glycines
  misc_feature (87)..(87): n is a, c, g, or t
  misc_feature (93)..(93): n is a, c, g, or t
  misc_feature (155)..(155): n is a, c, g, or t
  misc_feature (172)..(172): n is a, c, g, or t
  misc_feature (3723)..(3724): n is a, c, g, or t
gcggggcccaccaaaaatggttccatcgcgctcccaagtcaaatagttttatgtcacaatctgtcaattcaagttcctgggcgaganaattanaagcgctgcggagatgtaaaaatatttgcggtcactttaccgccagtttttatacacggganctgtcaatcatataaangaaggaacgccgaagccgacttcattcaatttccatttcggtgaggcggggggtcgggggccattcttggcccctcgggggccttgcccaaatattcaaattttttccatcgatcatccggatctgtcaccgcggcacggcagcacggcatggcagtgggaggagccagcagcggcaccatccgcaagttcacttcatttgccactttcgtccgctttcaattttgtcagcagcagaaccatccccaatttcaattctcattgtttgtcagtttcgaccactttcatcatgtcttttattgcccccggcactttcgcgttcctttcaaaagactatggggaattttcgactgggcattttgacccaaacagagcatacgacccaaattcacttgcagaactttcgtaatggcatttattttgcttccattatctttcattttttctttgtagtcaatggagaaaagagtttctggacggccgatacggatccaaacaaccaacccctccttacaccccgcgtgccccatcgcccagcttcccaatcccggtcatcgttggtaattttgaatttgttttttggattttgcaaatatctatcttggcaggaaatcgtccacaggatgaaaattgtttggttttccacaaatatcttgtctgattttttccattttagggcggcagatgttcccaaatgacgatggctacgaatcggaagatgatgaaattctcttgccacctccgccgatccccccgcaacttggccaccctccgccaaatgtgccggtaatttcggtctcgcttttcgttgctttttctcacatttccgagtgcttttttcaggcagttcgtgttcagccaatacatgttgggcagcagcagctgccgctcagagacttgccacaattcgaggaccatccgcaaaatgtgccggtaattttgggtcgattttcgctgcgttttctcaaatttctgcgtgcttttttttcaggctgttcgagtccaaccgatacaacaaccattgccgctgagagacctgccgcaaattttccaccctccaccaaatgtgccggtaattttgagtctcgttttcggttgctttttcaaaatcccgagtgcatttttcaggcaattcgtgttcaaccaatgcagcaacccgtaccaatgagagctgtgccacaattcccccaacctccaccaaatgtgtcggtaattttggctcgttttttgttgctttttttaattcccgaatgcttttttcaggccgttcgtgtccaaccagttcaacaaccgataccactgagagacgtgccgctatttgtcaacccaccaccaaatgtgccggtaattttggctcgcttttgttattttttttcaagatccctaatgcattttttcaggtaattcgtgtccaaccgatgcctcaaccgttgccgttgagagacatgccgcaaattcaccatccaccgcgaaatggacttcaatttggatcaaattgtggttgctttttctcagtctctgggtgtttcttcagggaattcatgttcgacaaattcaacgggaatacgccgtaccgcaatatgcccatccgccgccaaacttgccgtatcatcaaccagaaaacgttccggtagttgggtcttgtttttcgtgcgtttctcatattttcggatgcttattcaggcaatccaaccacggcaacgaccgcgccagctgagagacgtgccactattcgaccacccgctgccaaacggacaggtaatttcagaccctgtcttctacctaacaccgaaacatcttttcttaagcaaatgcatcccaacccccccgagagtgctggaagtgatccgacggctgggcgagtggatagaagaccaagggacccaagacgtccgcctcaatgaatgaatggaatttggattttgataaaatttgttgttttaattttttgaattgataagggttaaatcccattacctaaattgtttgaaaattattaaaattttaagaaattagatgctaaacctaacctttgacaaagattatgaaaaaatgaaaagaaatgacgaatttttttggaatgttccttctttttattacctatggattttttttcacgtgcattattttggtgctagtaagatattgccgaatgaattaattggtttttctcttcattttaaaacatttcacgtccccatcgccctgcccacttcccgcggaattgatcaaggaaataattgacgctctcccccctccaaaaacacatcggcttttgcgcttaaattttgttttggcatactttgttaaatgtcggttctattccatgatgagaagattgtttcgcccagagcatatatcaataccaatggcccgaagaactggaatttatttctttttcgatgtttatactccccctatttattttccactctaccaataataatatttaaataaaattataattttttatttcttatctgataatttttaatcgatatttctgataattaaacaaaattgtatttttcccaaaagaattttctcgcagtagcaactcatcggctttttttactcccttcataaaatggtctcgcttttgccccctcgcccaaatcaaggaatcgggtcggcttaacacgccaaaggggaaatttagtgagttccaaacctaccaaattaaaataaagaattttgataatcgttttaggtcttttttacgctctggaaaatgctcgcaattaccaattgattggaaaggggataacggaaaaaacttttcgttatctcatgaaaacggaaaagaaacaaaggcaattggccatggaattgatggaaaaggcagggataagcacggatgacaaaacttttggtacccaacaccttgaggctgtacaaaaatactgggacagggaattcccggatatgtttcgcattgcggcttttgaaatggtaacaaaattcgcttgaaaaatataaagttacatatttttagaagaccgggcttaggccaattttcaaaggggaaggtgttcgaagaaatgaagtgggtgtgataagagaaggagaccattgggatgggatcaaatcggcttcttggttttttggtgttcgatacttctgtgtcagctgtgaagtaacatttgatggtccagtccgccatagtctcgtatgtaaggaacgctgcaaaaaatgttgtcggatggggttcgggtttccatgtacggatgtctgcgatgagattcactgcggcgaatgcaatctcaagttttacaacccggaatgttttgaagcgcacaagaaggcggcttgtattgagtacaagaaatgtgaaaaatgcggagaagtttaccaaacacgttcgaaacacgtctgcggcgaaaagttttgcaaagtttgcaaagtttgtcacccagggcggcaatgtttcatcaaaaaaattcaagtgcgaccgcagaaagcctacagaattgtggcctacgatctggagacgactgtagatgggggagaacacccggctaatcttgttagtgcggcactttcttgcagcannttgtgcgggagaggagcgggaatgtgagctttgtgaaggccccacgaaaatcacatggtc

SEQ ID NO: 21563 - DNA, 1206 bp, Heterodera glycines
tttttttttttgacttgtctctgaatggggttatcccagtttttagtatcctttttgaaaacaaaaatttttataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaaacctatttttattttttttctatctcttctctgaatggagttataacaatttttcacaacagttttgcatttaacagacacattctaaaatttctaattagtatggtagtccaagcctattattattttttttgacttgtctctgaatggggttatcccagttttagtatcctttttgaaaaacaaaaattttaataactgatacggtagcccaacatccattgccccaatgtacccttcggtttgtcaacgggagcaaacaattgatgagtttgtttggtttcttttttaagcaattttccgtcattgctcaccaactgttaggcgtacagcaacggcggcacttgcatccgatgcagctgttcacgggctctctaaacctatttttattttttttctatctcttctctgaatggagttataacaatttttcacaacagttttgcatttaacagacacattctaaaatttctaattagtatggtagtccaagcctattattattttttttgacttgtctctgaatggggttatcccagttttagtatcctttttgaaaaacaaaaattttaataactgatacggtagcccaacatccattgccccaatgtacccttcggtttgtcaacgggagctaacaattgatgagtttgtttggtttcttttttaagcaattttccgtcattgctcaccaactgttaggcgtacagcaacggcggcacttgcatccgatgcagctgttcacgggctctctaaacctatttttattttttttttctatctcttctctgaatggagttataacaatttttcacaacagttttgcatttaacagacacattctaaaaattctaattagtatggtagtccaagcctattattattttttttgacttatctctgaatggggttatcccagttttagtatcctttttgaaaaacaaaaattt

SEQ ID NO: 21564 - DNA, 2138 bp, Heterodera glycines
  misc_feature (2112)..(2112): n is a, c, g, or t
  misc_feature (2117)..(2117): n is a, c, g, or t
tgttacagtgatcacactttttgacgtatccttgctgtggctcgcagggatagtcaacgaccacctcacggcacccgtgacagagtgaagagcagtttgatgaatgtgcgattttcttgtagtacggcgactcgcaggagagacagtagttctttttgttgaaaaattttgaaagagttttgatgccgtcaaagtggttgttattatggtagagaagaatgggaaactggtagtcggtgatatcggatttggtgattgggcgcatctggtagtcattaaaaataaatattttgtactcaccgggatacttgacgttccacaacccttgcacttgatgtatataaacttccgcgtcgtactctgtctctgttgtagggatccccgcctcgcggagtagttgtagcgccttttgttgaagaaccgtggtttggtttttgttaatccaccgccatctgtcttgggtaattgtcccacgtttatacaaggaatagtggcgcataagttccagcgcgtaaaaaaggcagtagttgtcgttgttgttgttaactttgaagatatgcgactgtgcggagacaggcggtcgcccttttccctttgttgttcgttgtcgcggtagtccattagtgttgaggacggtgacggtaattataaagggagcaccatataagttgacgtgtttggacttgctctgctccactttacaaaactggttgaaaacggcgtccacgacgtttgacgtaattggcgtaattggtaggatgatgtcaccctggtctaaaagttccgaggaaattatagcacccaccttatttgctgcgccaaaggtgtcgtgaccacccgaaatcgcctcctcgatcgaatggtgcacacatgagcgtagctccgcagcggggtcagcacatttgtcaatttcctcaatgacgaacttggattttgagcgcaccagttgatattttttactttttgaagtgaggttatcaattttacgaatgcatttatttggttgggattttttgggaaaaaggaagaattttgagagagggaaaaacgtttcattttatttgaacaaaatatgaatgaaaactttatgatttatggatgatataagataatatgaaagaatattttgaattagaaaaatgtaaatttttatagttgtaatagaaaattattgaatatttttttttataagttgaatattggtaaaatattggatgaaagggtaatgtagttgcaaatttgttagtttaaatattttttgacggagcgcgcaagcaatgaatgtgggtagaattttcgcgaatgaatgggagaagttgacttttgctggtaatagccggctatttataccctcacaagtgggcggagcttgaccttcactcaagcatgtggtcatttggcacattgccaactaaattgttcatgccatggcatatgcgctcaaatggcccctgtatgcgcacaaatgatcactgaaggcgctcaggtggcacgcgcgagcgctcaaatggcctggcatcccttccctccccatagggcacgacagctgacgtccgtccctccaatacgatttgactttaataattatgaagttaatttattttttaatattttatttatttatttatttttattctaactttaacttaaatttttttcatttatttttaaatttttatctattattttaaatttatttattaattttttaactattattattttaacaatttaattttaattaaatttaattttttaattaatttattattattattatttatatttttgtgtggtattagagagagcaagagaaaagagagagagtgagagagaagagagaatgagagagagagagaaagaaaaaagagagagagtgagagagagagagataagagagagaaagaaaaaagagagagagtgagagagagataagagagagtgagagagagagaaaaaagaaagaaagagagtgagagagagaaagaaaagagagagagagaaagagagagagataagagagagtgagagagagaaagaaaagaaagaaagagagtaagggagagaccaagagagagagagagaaagaaaccactttaagggaaaagaganatatnagagagagagagaaagaaaaa

SEQ ID NO: 21565 - DNA, 1193 bp, Heterodera glycines
  misc_feature (68)..(68): n is a, c, g, or t
gagtcaaagacgaaaatggacagtcggacaatcagtcggtggccaatggacgggacaatggcaacaanagccataagaatatcaaaagcgattcggataaccgagacagttccaacccctgcatagcttttccactcaccacgatcatttccgatggagagatcactatgcagtcgctcatccgccttaggttcattcccgcactgcgtttgccaaagctaaatttgatacatttgtattggtgcttatggcattaataatggacaatgaaaaacaggaaagtataagaaaaagttgcgttataacaaggaaggggtgttggactttcctgttttgtcatattttccggcccacttcagtgatatcctttctatatgctttttctgtcttgcagtaacatttgcaaattgtcaacccactgacgatagtcggctcttccgtggctccccccccccgcctcttttggcgccccttttcccattgtacacggttttcatttttatgttttttcttcttttttccataaataattttgcctttttctttagtccacacataaggaagagcgtcttttattatttatatttttgcagccttttctatgaataatcggtcagatggcgatcagattggacggggtttaatttatgtgcaatgactgacagatagaaatgaaaaagggaggcgatcaatagacagaaacagacaaacgatcattcactctcatcaaagggtgggaggatattaaaagagggacaaatttgtaatcgggcggaacagcagcaaaaaaaaaaaaatgggaaattgaaatggagaagcgttttttgggatggggggggggagggagggtaagttgcgcatcattaatttattttgtaataattggagtcgacggacggaatctcgcaagaggggaagggctgctggatcattgtaaaaaaattctcccaaactatttattagtggggtaatttgcacatcattcaacttatattttaatatatgtatattgtagctcatttcttttttgcaccatatccaagtttttatatgaaagcggatccaacattttgataccacaaaatgaatcggcagctcactcgctgcgtcctggccaatcgcactcagtcgacctatccaatcggtcggatgtgctatcgccatttgcttcatcaatttgagtagcgatttcc

SEQ ID NO: 21566 - DNA, 1764 bp, Heterodera glycines
tatggaagtacggcctagaagcttcaaaacaagctaaaatatgtttttcgtacgtttcagatctcccacagtccaggaaaaaaatatgcatgtgcatataattacaagccctagtgataagcagcagaattttggcgagaattttcctgtgaaaacaatgctaacgatttttgcactttcgtctcaaaccgaattagtccggcgggccaattttccaattttaatcatttatgaatgggtgcaaacaatccagggatgtatgtatgcctacgcctcaaagaatttcggcaattggcattcagaattccaacggcacaaaatgcgaagagtttatggacaatgcttacattttttgcccaataaaaatgactagggctgctaattttatgtaagaaaatttgcgaattatgtaaataaaatatgtataaaaaatgctaaaatatgtatgaattatgtacaaaaatcctcaaatatgtaggaaaatatgtaaataaaattttttttaatggttatttctagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaattgttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctagttataaaaaaattccgatttaaaaatatgggagcattttaaatttcatttctatttttttgcgtatgcaaaaaacagatttattttatttttgtaattaaattaaataacccaattaagcaataacaatttacacgacgaaaacaacgatgaagaaacccatgagaaattgctgcttttcacaattcgtcttctgcgaattttgctcggctttttggatgcaccttatgaaagatttgaaaatgttttttttttaaaaataataaatttaaataaaaaattttaatttttaaattttagaaagaaaatagaaaaaaatctgacagaacaacactaacaattgtgatctacaaagccagaaaagaatttatgaaggctttttcaaattcgattaaaaacaattatgcaaaaaaaggtagccaaataatagcattaacggtactgtggtagcgtaacttacggattttcgtctcattatactgtacatgccagtttttgattacattaggtatcccaggcaccatataacattaattaatttaagcaaaa

SEQ ID NO: 21567 - DNA, 2375 bp, Heterodera glycines
tccaattgcattcattttttttgttgttttaggcttcgtcatcatcggtccctgttcttgacctttctgctgtggctgaatcagtccagtcgaacatcgccgcattgttagcagcggaatcggcccagtcaactgaagcctctcattcttcagtcgcagatgcttctcagccaccaaccattgccgatgagcaggttacggtcgtcagccagtttcagctcgatcaacatcaaaattcggccatcgatgaaaacggagtttcgcctatggatgtcactcagtgtttggccgctagtctctccactttcgttcggcctcctgcttctgttatggaacagcaggtgcaaccaatcgaggtaattaagaggttacgcttaatatttgtttaaaatgaaaatttaaacatgggcggcactaatattatcgttctatgaaaattcaattgaaaattgcattgagtttccagaacaattcaagctttattaaagtttagctgcttgtaatctcaggagttacgcgaattttaatagatttcgggggacacttcgaattagtaattttgttgctatagcttatgtttattgtttagtaaagtgctgtaagagacctcaaatgaaaaccggaatgtttaaggtcccgtcggcagcagtggtcgtcatttccgacttttctgacattgccgaatcagtccagtcgaacatcgccgcattgttagcagcggaatcggcccagtcaactgaagcctctcattcttcagtcgcagatgcttctcagccaccaaccattgccgatgagcaggttacggtcgtccgccagtttcagctcgatcaacatcaaaattcggccatcgatgaaaacggagtttcgcctatggatgtcactcagtgtttggccgccagtctctccactttgcctcctgcttttgatatggaacagcagaagctgcaaaccgaagtaaattcggaatcgcaaattttttcactcctttctaatatattttcttgtcaggaggtctgcgcaaatatgccgaatcgaactgatccagctctgctagccaaacaggatgagcattttcttcgtgtgaatggcttccatccaatcggcattctttgtgaacggattgatcttgtttggcagcgggacaaaaaggtgaataattaatcagtttcctcactcatttcacagtcctgatacgccttttattttatttctcattgcgtttttgtgtttcttgtaggctgtggaacgtgagaagcttcgccgggaacgcgaacgtcgtgcagaggcagctgaacagagacgcaaagaacgccgagatgggagtgagggtgtgtggcgctttcttcctgccttgaaattcagtaaaaaagatttttgaaattcattaagaatcgagagaacaccgaaaagagcgcaaaagacagaaacgcgaggaacggcaccgatctccgttaggttagtttgcgagaatttgaaattgtattgaccaatttatttttggttgtttgacggaatacaaagggtgagttcattgtcattccttttcgtttcgaaccaagaaatttttctgccaaaattggttattgtgagcatggaaaggcaacaccacaagtgcagtttgggcacacttcgtcccccggcgcgttgggagtttttttttatgattttgatgtccttaattatttttttgcatcggtctttataaacaaaccaattttcccttaacaactcggaatgttatgacttcgcttacattgagacccatggggactgacgactctatagactatatattttctttctgcgtttcttatttttcttacaattttcagacaaggttcgctctgaagccgttgcgccgcaaaagcgcaacttcaaccggattgtccagtgcagctactgtgaacttattgtacggcatgaccgttttgggggtcgtgaaagtgcctattgctccgctgaatgcatctcacgacgggtggacatggtcagaaaggtctgcgacatttggcattttgtgaaaaaatataagcatttaaatttcattattatacatttttttgtctgtttaagtgtgtcaaggaatctgagcgtattttgatgatcgatctgaagggcaatatttacaatgcctccgtcaacccgaccattgaaacgttggaggcgttcctcaaccaaaatcccagctacaatccaataattgatgacgcacgacttggtcagtcgtattttcaggactgacaaatctcgccatcggaactcgccgcgacaaaatctcgaaaaattttagaaaaaattttttatttttaaattacaaattattttttaatttaaggggcgagattttggggtgcacccgtatttcttatacgaaa

SEQ ID NO: 21568 - DNA, 969 bp, Heterodera glycines
  misc_feature (869)..(870): n is a, c, g, or t
  misc_feature (909)..(909): n is a, c, g, or t
gtaatatttgtgcaagggtccgtcatccctttgaccccccacttctcaattacacatgggaattgcgggtactttagcattatacggtgccgcgagtaataatgggccgcaacgcaaacattgtagggacgcctcaggttaccataagcaagcactgagttggcgccctcttccgtgagtccagcaaagaagagcgtgtgggtgaagccattacggtcgtagtatgtagcagggatgggccgaggtttcgcttttcgcatttcgcctttcgcattattcgcattttttggcgtttcgcatttcgcttttcgcatttcgctttttggcgcgaaatgcgacttttacacccctaagaatttgcggaccgggtcagtttagtacgggccgttttagtacgagcgcacatttttccactataacttttttatttattatccaaatccaactttcttgatatcattcgagagcccttcggatgctctattagcctgcaaaatttcaaaaaattttgtttagtttaaaaaaagttcgagccaaaaaagttggaaaatctggtttttttaattcttctggccataacttttttgaaccttaacgagatttttcgaaattttgcaggctaatataggacacttagggctatcgaacgatactaaaaatgttggatttgattggcaaagaaaaaagttatagccaaaaacttgcgctcgtactaaaacggcccgtactaaaccgaccccgaccctaagaattggattaaattcccataaaatttttcaaaattttacctataaattggctaattttcagtgaaaactgtttataaatgatcaaaatttccaatttttttcccccggcgggcgcctatnncggcaccgccgcgccccccaaaacttcctatttttctcntgaaaatggcccaaaatcgcaaaatttggtaatttgatgaaaaactgttctcagcggcgc

SEQ ID NO: 21569 - DNA, 843 bp, Heterodera glycines
caattgtaatttccctacccagaaaatgcattttgtatttaacaattgtaatttcccgtagtcctgcctcaggggtatacggtagggggaaatggatggcaccatcgtgttccccgtgcccgaatttaacaattgtaattttactaccggaaaatgcttttgatatttaaaaattgtaatttccctaccggaaaatgcttttgatatttaaaaattgtaatttcattaccggaaaatgcattttgtatttaacaattgtcatttccctaccggaaaatgcttttgatatttaaaaattgtaatttcattaccggaaaatgcatttttgtatttaacaattgtaatttcattaccggaaaatgtttctgatatttaacaattgtaatttccctaccagaaaatgcattttgtatttaacaattgtaatttccctaccggaaaatgcttctgatatttaacaattgtaatttccctacctgaaaatgcattttgtatttaacaattgtaatttccctaccggaaaatgcttttgatatttaaaaattgtaatttccctacctgaaaatgcattttgtatttaacaattgtaatttccctaccggaaaatgcttttgatatttaacaattgtaatttccctaccagaaaatgcattttgtatttaacaattgtaatttccctacctgaaaatgcattttgtatttaacaattgtaatttcattaccggaaaatgcatttttgtatttaacaattgtaatttcattaccggaaaatgtttctgatatttaacaattgtaatttccctaccagaaaatgcattttgtatttaacaattgtaatttccc

SEQ ID NO: 21570 - DNA, 934 bp, Heterodera glycines
cccgaaatttccgtaaatcgaaatccgatgccaaaaattttccataaattgttaattggaatccgaagtccccaaaatttccgtaaatcgaaatccgatgccaaaaattttccataaattgatcattggaatccgaggccccgaaatttccgtaaatcgaaatccggtgccaaaaagtttccataaattgatcattggaatccgaagcccccaaatttccgtaaatcctgtgccaaaaattttccataaattgatcattggaatccgtggccccgaaatttccgtaaatcgaaatccgatgccaaaaattttccataaattgatcattggaatccgaggccccgaaattgccgtaaatcgaaatccgatgccaaaaagtttccataattgatcattggaatccgaggccccgaaattgccgtaaatcgaaatccggtgccaaaaagtttccataaattgatcattggaatccgatgccccgaaattgccgtaaatcgaaatccggtgccaaaaagtttccataaattgatcattggaatccgaggccccgaaatttccgtaaatcgaaatccgatgccaaaaattttccataaattgatcattggaatccgaagtccccaaaatttccgtaaatcgaaatccggtgtcaaaaattttccataaattgatcattggaatccgaggccccgaaattgccgtaaatcgaaatccggtgccaaaaagtttccataaattgatcattggaatccgaggcaccgaaattgccgtaaatcaaaatccggtgccaaaaagtttccataaattgatcattggaatccgaggcccccaaatttccgtaaatcgaaatccgatgccaaaaattttccataaattgataattggaatccgaggtccccaaaatttccgtaaatcgaaatccgatgtcaaaaatttt

SEQ ID NO: 21571 - DNA, 769 bp, Heterodera glycines
  misc_feature (718)..(718): n is a, c, g, or t
gaaatttccgtaatcaaaatccggtccaaaaagtttccataaattgatcatgggaatccgagccccccaaatttccgtatcctgtgccaaaaaaattttcatataaattgatcattggaatccgaggccccgaaatttccgtaaatcgaaatccgatgccaaaaattttccataaattgttaattggaatccgaagtccccaaaatttccgtaaatcgaaatccgatgccaaaaattttccataaattgttaattggaatcccaagtccccaaatttccgtaaatcgaaatccgatgccaaaaattttccataaattgatcattggaatccgaggccccgaaatttccgtaaatcgaaatccgatgccaaaaattttccataaattgttaattggaatccgaagtccccaaaatttccgtaaatcgaaatccgatgccaaaaattttccataaattgatcattggaatccgaggccccgaaatttccgtaaatcgaaatccgatgccaaaaattttccataaattgttaattggaatccgaagtccccaaaatttccgtaaatcgaaatccgatgccaaaaattttccataaattgatcattggaatccgaggccccgaaatttccgtaaatcgaaatccggtgccaaaaagtttccataaattgttaattggaatccgaagtcccaaagatttccgtaaatcgaaatccgatccaanaaattttagagagattgatcattggaatccgaggccccaaaatttccataa

SEQ ID NO: 21572 - DNA, 1989 bp, Heterodera glycines
ttagccatgcctgaatgtgttaatggcatattaaatgcttccataattaaaacatatgatatagttgacacattttctgcaaacatttattttttcctattttttccacgttttgaatctattaaacttggaaaaaacataagctttcactgcctgtttttggttttatttcttagtttttaatgaatttcaaaaccaaatgaatattctgtttagattcatataggattaagaataaattgctaatcacagattattgtggatgcttagttgctgttagatgaaaattgagcataacaaattcatactcaacaaacaaacaacaaattgtacaacaaaaaaatgtcaagcgatgatcaatcagacaaggaggtcgtattaattgactttaattgcttttctctacaaagttttttagtgccctctttgcatggaggccttcgacattgatgacatcaacttttacccatgcaattgtcagtatcaaatttgcagattctgttggcacaggatcaggtttcttttttaaaaagttatggaaaaagaaccagacaatgggaggaacgaaacctgttacattttaaagagacatgaaatttgtcagcaaaataattaagggcatcgctccaaatatggtctcaaattcaatttgctcattcttcggtcaattgatcaggaattttgaatatattcggtcacatttttgtcctggttctgtcttatttcacctatctatttaaattgttcggattttttttacgaaaattgcttaaaatataagacgaaattggatgacaaccaacttattgttactcttaaaattccaaccccaaaatctcccccattaaggacaaatgaaaacgggttgtgcccggcttgccgccagtcgtaccccgaggacccggtcaattttcagccgttgtccagcgccgatgtgcggaagatcaaaagtgagaagaagcagaaggtgcagcagcagaagaacaaagtggtggagagcaggaagcacttggccgagtttcgggtgctccaaaagaatttggtgtacgcggtagggctcagccatcggatggcggacccggagctcttgaagaagtacgggtggcactttaagcatttattgtttgtaaagaaatttgccaatgatgtgctttttgcccggttttgcctagaagattcgacatacgtttacaattagactttttgtccaactatggttaggggtgttcgaaatgaaccaaaaatttattccatattgtggtcaggttccaaaattcatttatggtcctttttcggtaatgatattttttggaaaatgcgtgttatcaagttattttcattaaaaattaagttttcttctctaaactttcaaggactttgttatattgtaataatccaagtttcagacccgaattctttggcaagtttggcaaaatcatcaaaattgcggtcggcgctgccccggccatcaacagtgctcagcccgcggtgcacaccgcgtacattacttacacacggagcgaggacgcattgcgcgcaattcacgcggtcaccaacatgatggtggagggccgctttctgaaggcgtcgcttggcaccaccaaatactgctctaatttcttgaagggacaagcgtgccataagccggcaagcttttcaattaagcacatttgggcattttatttaaatgtatagcctgaatttgatggaagcattgcaaacagaaacaattctaactgtgattcagttggtaaaacggttgtatttgtcatttttagtacggttcaattcccgtcggaagtttccctcagtgggcaagagatggtgactaaacaaaatgccaatctctaatcagacacagagggtagagcaaagaggtgttcagagttgatctctcgttgaaccaaggaaccattgggcaatgagttttgtagtgaaccacacaggggggagcatttttgaaaatcgatctaagggatggagttgctt

SEQ ID NO: 21573 - DNA, 1830 bp, Heterodera glycines
ttgtacctcttctaataactctctgtacctcttctaataacttttgcacctcttctaatcactgttacacctcttctatcacttttgtacctcttctaatcattgtttgtacctcttctaatcacttttgtacctcttctaatcaccattgtacctcttctaatcacttttgtacctcttctaatcacttttgcacctcttctaatcactgctgtacctcttctcatcattgttgtacctcttctaatcactgttacacctcttctatcacttttgtacctcttctaatcactgttacacctcttctaatcacttttgtacctcttttaatcagatttgtacctcttctcatcattgttgtacctcttctaatcactgttacacctcttctatcacttttgtacctcttctaatcattgtttgtacctcttctaatcacttttgtacctcttctaatcaccattgtacctcttctaatcacttttgtacctcttctaatcactggaagcggcctaaaaatcgctgatcattttttaaaattcccaattttttcacaacccaattttatctaggtagcgaagctcaagaagcgcgaagcgctttttcccagctaaatagtcgacggttcacgcacccgctagtttatatattttagaacaacagtgagtttcattgctaaaactaaaatctggagaaccgctggcgggaggggctcgcgagtgtggcattgcttaagcaactttttgaggcgcatccaggaaaactataggcattccgttccggaggccaactgagcgccagcggcgctgaaatggctttttggggaaaaatgcatgcagtttttgggccaaaacttttttcagggaagccggagccaaaaacgtctgctgagagggccctaagttggaatgtttgggaaatttttttcttcttgggcgaggccctaggatcaaagccctggcctgcaaaaattcgcaaaaatttttttccaatttttccatttttcggtttttcgggaataactcgctggggattgtgctgagcgtgttggcgccgctgaactttttgtacagctcggcgagctctatcttgtcaattttttaaatttctgaaattttcagaaattttcgagctaggccccctcatcacttttgaggtttttgaattttagtattttttacagatttttacggggaaaacggagaccactttcaagcaaccgtttttgatgctctatcgattggtgtcattttcagaaaaattttttaaaatttttttggaaatagaaaattttggttgctaggcctcaatttcagttctggctcaataactcgtcaggagttgattttatcaaaaaatcgtctaagagcttttttgtagagaattttaagcccaatctaatgtgctttatctcatgtttttatcacgagtttaaaaaaagttatgaaattaattgtgattttgaaattcaaaaccataggggggaccccatggttttgcatttcatgaaaaatttttttgctcctaaattagccaaatgcatttttatggcctaatttaaggtgctgaactcgaaaatatactttatttttagtttcagactttttggtaagtgtttaaaattttttgaaaaatcgtcaaaatttgagccccggaaaatccagtgaaattttgaaaattcataactctcttcgtttttggtcaaatttagtggaataaagtttgaaaaatagagaaaaatttggagaattttatgggatttatttggaatttctatcttccaaaataaaaaagttaaaagagaatttctggaaaatttcgatttttcag

SEQ ID NO: 21574 - DNA, 1613 bp, Heterodera glycines
ccccccccccccaaaactccaattttttttgcaaaaaattgtcacaaaattgtaaaaataggtatttttaagaaaaatctgttaataaattaaaaattttcaaaaaaattttcctcgcggctcccaacagcatcgttgcccatcccccttatgctgtagcccaaagtttttttgaaaaagagcgccgcaaaaaaatggtggtcaaattcgatgttcagacgggttcaaaaaaatttcggttaaacccagggttttaatggtctcactttaaaccataatataaattgttagcaattttttttttgaattcaatttggtttgctttaaattgtttataaattgatattaatttagtataatgataattgttgataattttttttttatataaaatctataaattgtaaacaaattttagatgtttttgatttttaattaataataagaattgatttaaatttaaatttaattacaatataaaagaaaattgattattatttattcattttttaaacaattattttatttactttaataaatactagtttgattattgcaaaagttttatccatagttctgccatctttttatgtgaagaggtagtttggatgcttttttacgtatgatttattaagaaaattattttatgatatttaaattcaaatatttatttaaattaatataagttttctattttgtgtgaaatctacatcatttattttttaaccctattatttagatttctctgtttacatcataactcattataaattaaattttctataatagtaagcttttcgcgcgcgcacctgaaaggcgttaacacgcagatttgctgccattccagggttgctggattacccgattcgggagtgctagtattattattttttgatacttttcataattattttgtttttttttcatttttattatttacgaacgacattaatattttgaaagtcttcgtcatgtataaaaaagatttgtttaatgttactagttttctaatttttaaaatatagatataattattttcaatttttggtcttctatagacagataaatatttacagaaaaaaatcccaattcattagcgataatttttacataataaacacacttatttattatatatattattattttattttatcctctccaacttaataaatttatctttgaaattgaatgtttataatacgaataatgagtgaaagttcgatttacctatttaaattttttctaaaattttaattattaattgttttttcatttttatgatttcaattttattttctgttttggtgctgaatttattttactttaattatcttttatatttattctgtttatttaacaaacaattaagctattaactttgttattataattttaaattgagtatataatcaattatacatgttttagtgcatttggataattgataaaattatatttataaattaaaaaccataatagaaaataaatatgtttatcactaaattttcaattcagaaaatttattttgaaacttcaaattaaaattctttgtatttttaatttttacagcttaattttattctatttttaagtaccatatttttattatt

SEQ ID NO: 21575 - DNA, 1522 bp, Heterodera glycines
  misc_feature (1319)..(1319): n is a, c, g, or t
ccgggaagttttttgaaaatgaataaaatttgttaagagaattttgtccaaaaattgtcaaattttgtgattttcgagcaaattattggtaaaaaaaaatttggagttttgggaggccggcggtgccgataggcgccgccgggaaatttttcggaattttaggaattttaaataattttattaagaaaattgtacaaatttaaaaattttcaagagtccccaattccccgagttagtgtcggggggtcgggggataaaaagtcggatgtagggggctcggggtcggggagcaaccctattataaacccccaaaataggtgctaaaaatggaaatgagataaatattttaaaaatcaaaaatgtagtcaagtaaataaataaataaattttgaatatgaatttttgataaaatttccatttctcaggggtgtttttttcgtttttattgcatttttgttaataatttttttcaaaatagcagaaaatattttacaaaaaattcttcaaaatgaaaaagagcacaaaaaaagcaataaatttattattattaacaggttatatcgctccaatttgattcggttttttttcggtttttcataaaagtcggtcggttgtttcggttttttgattatttcggtcggtcggtttcggttaaaaaaccgaaaaaaaccgaaccgaaaaaaaccgaaaaagtcaaaaatttctcggtcggttttttcggtcaaaaaccgaaaccgaaaaataccgaaaaaaccggaaaaaaaaccgaccggtccgatctctagtactaacagcacgagttggctttttaccctggaaaacatatacactcattgtttgtcctggagaagcaatgctctctgtctgaatgagagttactcaaaagtctcggggcaaacccccccgtcggtcgttgttcccgtgtgcatttgacccgatcccgccttcgccgccgtactcaaccgtccgtcggtcacccggtggtgtccctttgacctcacacaaactttcaaaatttcactcttcgcaaaatttgtccgccccgcctacccccgcggcgtcaaatcattcacaattcccattcattcattcccctcctccccctccacattctctctctctctctccatgttcgttcgttcgttcgtccgtttttgaccatttgcccccccggcgcgaaaatattttacgaacgcggcgaaccaatgcaatgcattcaatgaacaatttgtactaataaaattgaaaattcagaaaccattttcaattttttcttgtaaatgtttccttaaatttatatacaaaaacacatgtactanaaaacaaaataatttaacacagggtttgcatcgtcaaaaccccttttccaaggacataaagggaaattttcataaattaaaggacactagaaaatattacatacctagttaatagaaatattgggagaaaatttcaaaattggaaattatgaatctttattgggggcttatttttcaggttttcttggattccaggaaatttt

SEQ ID NO: 21576 - DNA, 1353 bp, Heterodera glycines
ccccccccccccccctctgtcccacaaaatttttggaaaaagcgcgccacaaaaaaagcgtttttaaagcagaaaaaagtcgtcgtaaatgaagaaaatgataagtgaaaacaaaaaaatgttggaaaaaatcaattccggtgaaaaatacaagccatttgaataaatattaaccattttgcattgcatataataaaaattttaaatgtccttggatttcatgaattttccccactatgtccttgaaaatcggcatacccgtccttggaaacgaagcatggacgatggcaaccctgaataagagggaaatgagggaaaatggaaaaaaatatatttatattttcacttggaaaagaaattagtaaaaatagttgaaaaaacatttaataaaaattggttaaaattaaattgtgaaattagaaagaatttaaagggaaagctaaattattttatcaaaatatttaaaatgaaattaaagtcaacacaaatcttcttttgttcattgttatttatgcaattcagaaagtgaaagtgcgcagagaatgtctgcaaaaggtcagtgcgtcgcacttttgccacgatttgtgccaactcagcgagttaaacgacgcctccgttctcgcggcacttcgccagcgttactctcttcggcttgtccatgtccctcccccctttttccccccaatttcgcccattttcagacttattccgcccttttctgtgtggttgtcaatccctggtgccctttggcacccctttactctgcccaaatgcgttcactgtatgccaatgccaatggcgccactttgccccctcatatttttgcaattgcccaaagcgcttttgaagggctcagcgacggcacttcgcgattaaaccaatccattctgatcacgtagggcaacaaccaattcattctggcacccatctaaatgtgacattttttatagaggggaaagtggtgccgggaaaacggagaacacaaaacgaataatcgaatatttgatggacatcgccgaaaggaatgccaaagtcagcgaatgtgccgatcagcagaaagccgcaacggtggaaaaggcactgatcagtgccggaactgcgctggaggcatttgccaatgcgcagactgtgcacaacaacaacagctcgagaatggtgggaaacgttaactctaatattggcccagttttatcaaagactttctcaaatccgatcaaaatccctcccccttttttcccagggcaaattcgttcgcattgatttcgaccgcgaggggaaacttcagtcggcacagatcgattgttgtgagtttatttttcatttttaattccatcaccctttttcccttttttg

SEQ ID NO: 21577 - DNA, 2037 bp, Heterodera glycines
tttattgaaatttctaaaagtttttattatttttattttattaggaaatttataaaatcttacttttagatatttgattttcgtgataaattgtgttttcgtttcaagttccaaaatattattttttgattctcatacagaaatactttctgtgctgtccaaattacaaaaaaaagaaaagaaaaacataatgacagttcccattgtgtacatcagattaattccttgatggataattaagtttttgaatttgaataaataattttatattttttgaagaaatttattaaatttcacagtcgcgtgagcatgataattgattgattggactgttcaatttgcttaatctgcaaatgtataaaattcggtaaagatcattcatcttcgttgttctccctccattctcattcatcactcgtccttttcggaatgacatttgaatttttgtaaatgaaatcattagggccaaaattcgcttccatttttgagcaacacagcgaaacacatgggaacaaatcgacggacaaaggggcgacaagcaaaatgggagtgactaaaaaggggaaaaattaagtggatttaaaggggaaaaaatagttaagcaattaaaatctaaacaaaaacgaattttaaattttataaaaatttgtagtttataaatttctttaaaaaatttgtttaaaatttctcatatcgcttcaaaaaaaaaaaaaaaaaacacttttcggggtaattttaggcactaatcaagaatctggtgccaaaactgcaaaaatctatgcttttttatcaatgattaaaaaaataaaatacaatgccatatcttttagggttctacgatatctcatcaaaagttatagcccagcaaacattgtgctggaatgggtggatggattttcgaacaaaaaaaaatgagtttcataatttactatagaaaaatttcattattaaatttcaaaaatttgcatttttatatattccattttttgtttgcccacccaatcgccgtccgtttttcgtgtaaaaaatttggcgtgtcgccaattcaatgccgcagcccacgacatcgtagtaaccaaatggtggcacattttcataaaagcatggagcaaaacattgctcatcccttcccgcaacattgtgcccgtacaaaatgccgtgtgatgaataggagtaagtgccccggcattgtcccacccattcgtccaatggcatttgtttggtggccaaaccaatagccgcgcttaaaagttgggaggatgtgagcaatgccaaagcaaaatggggttggccatgcttttcacttaccccattttcatatgccgactcgagcatttaacttcgaagtaaaaggtgcccgtttttggaattggccatttggcaaggacagagaaacactctgagaaatgaaaaaaaacaaataaatttacaaaaatgccaagagtttcgaataaactattaaataagaaaaaaaaagttcaaattttttcataataaattccaaaaaaaaaaatttttttttgaaaatttttcagcgattttgtaatattttttcacgcagcctaatttttaaattttttaagaaagtttcagaaaaaaagcaaaaaagatacacatttggttttttggtccttcgagaattttaccgtcaaccccgccccccaatcggatgcctttacaaaaatttaaaaaatcaccatacattaaaaaggggggtgggtcgggaaaaatttttgcgaaggggggtcggccgccaatgacccttttttttgcttttcaaaacagttttttcggcgcgctttttccaaaattctaaaaaaattttcgggaacaggggggcggccggtggtgccgataggcgcctccgggaaaattttttgatctttgggtgtgatttgttaacagattttcaccaaaaaatggcaatttttgagattttgagccaatttttaaaggtaaatagaaattttggggttcggcggtgccgccagtcgacgccgaggaaaatttttggactttttaatgaattgttaagaa

SEQ ID NO: 21578 - DNA, 2618 bp, Heterodera glycines
tttgtgctgtttggctgctgccagtgctgtccaacttttgtacattgttcagaatcttttaaaaacagccaataattaagaaaaaaattatttagtgaaacgattttgatgtttttttagcataggccccaaatttcctgtataataaaaaaaaatttttttttttttggaatttgtatgatccgaagtgttaaaaagatgcgccagtcgaaaaaaaaaatttgattaaagaaattagcaaagaaaccaatattaaccatttcaagatttttcgagggatatgaatgaatgaaagtgtgtcatatgcaatcatttttcacgccttattcaaaaaaaaaaaattttttttgaacgtccacactgaccgttgcctgcttctgatgctcttccccctcaacaacagtgcccatgcccaaagggttcgaagggagcgtaatttggttaactgtaaggaaacaaaaatagtaaattatttacgaataagattttaatttgtgataccaaaatagaatttttttttgggggctatgaattggatttgcttgaagaaatcaaaaaatgtaaaaattaatgaaaaatgacccaaaaagacagtcgaggagaggttttggtcctaacaggccttttcacggaccagtccgaataacaaattcaacaaaatttacaaaaaaaatttcgccggcaacgcctagaggcaccgtcggcccttggttttttgtcggtgggtcgttccgctggggccaacaatcggccgatcactcaccgatttccccaccgccattcgttgcctcgtccacgtactgcttctgctggtcactctgatccgtagtcgcctcatgttgttgttgtccatagttgtgttgttgctgatcaataacttccttcggtggcaaaatttgtgccaacccgtcgcctcccaaattttccgttggtggcaccaatccgtcgcctcccagtttcaaatttccgttggtgacaatccgtcgtccaacatttgtcctctttattcatatgatttgcattctgtaaatgtttatacctttttgccacaccctaatttttaatcttacaattaatcatgtgtctaaatttactacttaccattttttgatgttgtttcgatggaatatcgcccattgacagacaatatgtaaacatttaaaaaatcaaaattcgaaatccatgaaaagctataaaaaaaactaaagcatttgttataatccaaggttgtgatccgtacttggatacaaagtatgtgcatgtatttcggcttccatgcttggatatttttgcacgtaaaaatgtctatttttatgacaaaattttttggcattctgtctttataaatttttaaaaatttcaataaggatgccaaatatttgattctgtaacgtttcggcgcaccagaccaaattttttgaatttaactttttttgtcgttaaacaaattcaacctgaaaatttttgtattttttgtaaggctaatagtgcatgtcaaaggctttcgaatgatacaaagatttttgggtttggttcaaaataaaaaaaaatatttgggttggtaaaaaaatgtaaaaattatttttaaatgcatgccaaaaggtctcgcgcgggatttacggggtccaagtccgcaatccctgaccatacatgaaagtggggagggtggggtccaaaaaaatttggctaattttctttacaacgggcgacttaggtcaaggaccataggacggggatgattgagacaagggcgggagttccaaatttttctccggctttttttctagtctgcttttctttgtcgtgctttttaaaaaagtccggaaagatttttggaaatttacaatttattaacaaatcttgcccaaaaatgaccaaattttcgattttatcaattttttctagcgatgatcacgaatccggcatccatttctgccagttccgaaccccgaattcgaacaaagtttcaatcctagcaactgccggcggagagcgcgcagttggcttacagaggggtttgatgacattatttgtacgaagcaaatttggaggataattcgacccaaaatttggaaatggggaggggtggacataaagcacagaaaaacaaatagcaaaacacggaagtacctcattttgctgctttcaactggtcaatgatgatttaatttttgagatgatgatttgctgtttttgagaaatttgttgatttattctgattaaattgacctaaaaattgcctattttcgctgaaaattagaatttaaaaaatgctcaaaattttctattttaccgcggcggcgcctatcggcaccgctggaccctaaaaacatgtttttttcttaaaaatttcgctcaaaatcgcaaaaattgttatttggtgaaaatcagttaacaaattgcaatctaatttttcaacattttcccggcggcgcctacctgcatcgccggcgccctaatgccaaaagtttattaagatttttccgactttttgcgacttttgttgacgaaagtcccccgaccatattttatctaagatgctgaaaaatttttaaatgttagggatgaaattttttaaaaatcgaaaaaagtgaaaatttaattttaaatgcatttat

SEQ ID NO: 21579 - DNA, 1940 bp, Heterodera glycines
agtcagttttgtagacggagttcatttaccgaactgacaaatgtctgtgatttgtttcacactttacggcttttccttttcgaagctgagtgttttgataagaagatgggatttagttttcccttttacagatttcgcagtccacaaacaatgacaaaactcagtagggatttgtttcccttttttagttccacaattgtcgagggatttacttttccctatttcaattcgaggccacgtccaaatttatcgtttactgccactgctgagccacctttgtacaggagcgtcacgtcgtaggaaaggagaagccaaataggaataggggaattgtatcccaaatccaaaaccaaaatcgccgtctctttttcactgctttcttttacttccaaaatataaaacccagcacacagcaatcaattacaaatttggagttgaccacatatatcacacaccaacaaaaacaatataaaataaagagtcacataaactaaaacaaaacgccaaaataattcaaaatcaacaatgatatgacacccaagaggagtttttgagaaaagggacattttcagaatttcttacatattgtttgagaaattttccaaatttcggtataggaagcgcataatttgtataataatcacaatatttttgggaattcgtctcatatttcgaaaattatgccttcccaacactttttgtgctttgctgaatcaatagatttccaaagtttcattaaatttattttattaattgattgttatgattaaaaaaattgttgggtactatgcaagaacttaaacaaaacctaataactagcaagcctggttttcagttaatgaaaacatttttcaataaaattttaaacttttttgcataaaaactcaaaaatatatgacattccccccaacagttgtaaagagaatttggccccgggcaatatgactccgccgactcggagcgggacaaagagcgaagggttatctccgttcgccaacggaggattcgacgccccctcccacaatcattgtgcccgccgttgcaatcattgcccacatttgcccgtcccaaattggctaaattcaccattttcagaacattcaaaaacgaaatttctcgaagacgacattcgccgataccaagagaccagctgtctcgactatcgccggcgaacgggtgattccgggcaatggtactgaaagaagcggaggcagaaatttaagcgtagttgcgagaatgcgacgaaagagtggttaaagcgaagaaggccaggatggaacccgaagtcttgctcaaaaatgagctggaaaagaaggggggagcgcaaagcaaggaggaaaagcggaagaacaaagaagaagccaaaaggcagaaggagcggaaactcaaggagctgtagaagcaagccgcggatctgactcatgcttgcagaggaaagcatgaaaacggcgtcaaaaccggaaaaaaatcctggaggggacattccccggggagggccaactgggggagaaagcacagaaactccccgcacggaaagcccaaaagagggcgagttggatgacgacaccttgtcgttgtaggaggaagcagtgccgccgggaatgtcggcaattatgttgccgaagagggcccgaggaggaaggagcggaattctggtctttaacgccgacggcacggcgggggaattgtccgaaggagggaggacattcccggataggggccattgccgtgttaaacgatcccctttttaaatttgtcgacatttttcacccctttttatttttctctttgctttaaatttttcatttcttttcacttttgcctatttacataatgtcttcaacttcaccatttgccttttcttcacaattttctgccagttcacatctgccttcgattatagtcctttttcacactttctcagaatcagacattttcat

SEQ ID NO: 21580 - DNA, 1185 bp, Heterodera glycines
ttattgggggaaaaaaagactacaaaataatacccctggcattaagaagagggaaacatgatttcaaaattttcaattttttctagtctaatctactcaaaccggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagggggaaacatgatttcaaaattttcaattttttctagtctaatctactcaaaacggttcaaaattcaataaaaataacattcacggggcgaaaaatggggtttgaaaagtttattggggaaaaaaaaatttaaaaaaaaaaacccccggggaaaaggaaggggaaaactgattttcaaatttttaatttttttttttaatatttactcaaaacggttccgaattccataaaaataaactttccgggggcaaaaatgggggttgaaaagtttattggggaaaaaaaaatttacaaaaaaaacccctgggaaaaggaggggaaaactgattcaaattttcatttttttagttaatctcctaaacggttcaaaattaaaaaaaaaaattccccggggaaaaaagggggttgaaaattttttgggaaaaaaaaatttaaaaaaaaaacccccgggaaaaaggggggggaaacatatttttaaaattttatttttttttttt

SEQ ID NO: 21581 - DNA, 2049 bp, Heterodera glycines
ttttgccttttcacaagagaatttattaaaaaaggcaaaattcgccttaaattaataaggtgaaagtttgaaaatgtttattaaaaaattgcaggatgaaataaaattaaaataatcaaaaagaaacaaaataaatttatttttctaaataaataaaaaacattgtcagaggcagtgcctcgccgaaaaaaaagacaaaattttttcaaaaagccaaaaaaaattgaaaatttaaataaatttaaaagtgaaaaaaattaaagtaatttaaataggcatatttaaaagagcctatttttttgccttttcacaagagaatttattaaaaaaggcaaaattcgccttaaattaataaggtgaaagtttgaaaatgtttattaaaaaatttcaggatgaaataaaattaaaataatcaaaaagtaacaaaataaatttatttttttaaataaataaaaaacattgtcagaggcagtgcctgccgaaaaaaaagacaaaaaattttttgaaaaaaagccaaaaaaaaaattgaaaatttaaataaatttaaaagtgaaaaaaggaaaaaagcttacaacacattcgattcccaggacgtctccgttccaagtactaagaaggcccaacgttgcttaacttgccagatcggacgggatggcgtgctttcaacgtggtatggtcgtaagcgaaaggacagcaattaaagtcatttaaataggcatatttaaaaaaagcctatttttttgccttttcacaagagaatttattaaaaaaggcaaaattcgccttaaattaataaggtgaaagtttgaaaatgtttattaaaaaatttcaggatgaaatacaattaaaataatcaaaaagaaaaaaaaaatttatttttctaaataaataaaaaacattgtcagaggcagtgcctgccgaaaaaatagacaaaaattttttcaaaaaagccaaaaaaaattgaaaatttaaataaatttaaaagtgaaaaaagtaaaaaagcttacaacaccttcgattcccaggacgtctccgttccaagtactaagaaggcccaacgttgcttaacttgccagatcggacgggatggcgtgctttcaacgtggtatggtcgtaagcgaaaggacagcaattaaagtcatttaaataggcatatttaaaagagcctatttttttgccttttcacaagagaatttattaaaaaaggcaaaattcgccttaaattaataaggtgaaagttttgaaaatgtttattaaaaaatttcaggatgaaatacaattaaaataatcaaaaagaaaaaaaataaatttatttttctaaataaataaaaaacattgtcagaggcagtgcctgccgaaaaaatacacaaaattttttcaaaaaagccaaaaaaaattgaaaatttaaataaatttaaaagtgaaaaaaattaaagtaatttaaataggcatattttaaaaaagcctatttttttgccttttcacaagagaatttattaaaaaaggcaaaattcgccttaaattaataaggtgaaagttttgaaaatgtttattaaaaaatttcaggatgaaatacaattaaaataatcaaaaagaaaaaaaataaatttatttttctaaataaataaaaaacattgtcagaggcagtgcctgccgaaaaaatagacaaaatttttttgaaaaaagccaaaaaaattgaaaatttaaataaatttaaaagtgaaaaaagtaaaaaagcttacaacaccttcgattcccaggacgtctccgttccaagtactaagaaggcccaacgttgcttaacttgccagatcggacgggatggcgtgctttcaacgtggtatggtcgtaagcgaaaggacagcaattaaagtcatttaaataggcatatttaaaagagcctattttttgccttttcacaagagaatttattaaaaaaggcaaaattcgccttaaattaataaggtgaaagtttgaaaatgtttattaaaaaatttcaggatgaaatacaattaaaataattaaaaagaaaaaaaataaatttatttt

SEQ ID NO: 21582 - DNA, 1879 bp, Heterodera glycines
tttaaataattttgcatttaaaaaaaaatgatgaaaaaatacttacggagcatcacatttattggcacatgtggtgtatgtggcacgaacaaactgatcagcataaacacataaaaccttgaattataattttgagctttttttaataatttattcaaacccaaaaaattagaaataattttcgaaaacataaaaatttaattattttcgagagtctcgtgatatttttgggattgtccattctgtccgatggaataataagttaatacaaaaatttctatcgttttttttatgaattttcaaaattttcgtccacttacattgccattcccaatttgcttttcttttcacccaaatctttgcttttaactccactcttaagcttttgttgcagtttcattttgcttccaactttcacaccttttttattcgggttttgccgtctaaaataattaaatttattttttaaataattttttaatgttttttatttttacattttcggctgagctgcgtttaccggtgttggttgatgttgattttctaaattaaaaataatttatttatgaataaataaattcaattttccgaaggctttaccttctgccgatggattgagcctgagattgttaagtgaatgggcgacattcgtcaccaggttgatgctcggattttgttgctgaattggtggcccaccaccattagtcatagaaagcgaatttgacccaccacggaccatttcgccaactaaattaaaaaaaaaaaaattaaaaattcactttaaaaagctaaccatttattaagttggcgaacaagacaagcggtagaacagaagcgaaaagttgtccaatcatttctgttttagttaaaatagtatctaatttggttaaaaacagcactcattttaggaaatcatttaagcatataatacagagattttttatcagcagtcaaaaaatcccgttttcgaggcctcataaaatcaccctgggttttcggttatgggaaaaactttaaaaatttacaataggaatcagcttcgctccatccgatggtgcctaatttaaattcttattttctaactgtttggaatgattcccttgtcaaatgcgtaaagctgaatctcgactctggtcggaaattcgggattttcccggattagtcccaatttaatatttttttaattttcggagcaatttactaataaacatacgatatattctctaattatcgcccagtctctattaatcccgtagtctccaattatcccccccctttctgaggaggttgaaaaataatcccccagtctccatttatccccagggggataaatggaattttttaatttcaacaaaaataataccataatatatcttctttttatgctgattaaaaagtcttttgcattaacttgatcagatcactcgtttatggtaatcttgatcctccaaataaactaaaccgggaaaaaagctcgaaatttgtaccggtcttacgcaaaaaatgacaacatttttgccattttggggtcaaatttaaaaaaatggttcaatggggtccggcggtacggtatcgataggcgacggaacagctgtggcttcctcaataaattgctttacaaacgcagcaaaaagattacattggtaattagggatcattccgagctgtgactaggaatttagatataaacgataaaccattggatagaatcagggtaggcttatagtgtgaatttttaattttagcggtgcattttgcctgcttcaaaagttatagggcctcaaaaatcgaaattttgtgcatgagggctcattttcaacttttttcacattatatacggtttttctctcactttacgaatgacatgattacatttatt

SEQ ID NO: 21583 - DNA, 1893 bp, Heterodera glycines
caaattgaggagtttccgtgtttttctggcccagaaacaacggatgcgcgacttcctatctcagaaaccgaagtcccacttattgctcaatcatttcgtcgcatttgctcggcaacgcaacactcttttctcggcttgctggacgagcagggtgggcagcaaaaattaattaactcaaattttcaaaaacattaggggatgaggcgctgcactcggtttggcgaagactagagcaatggtggaaatgcatgccggattccgaccaaattctacaacaattggaccaccattttgtcagcaattggctttgaagcaggcgagttttgagtggagtgggagggatcgacccatttccatactgccgtttccataccgccatttccataccgtcgtttccataccggccgtttccatgccaccgtttccataccggcatttccatactgccgtttccataccgccatttccataccgtcgtttccataccggccgtttccatgccaccgtttccataccgccatttccatactaaggtatttaggccatttccataccaaaaatttttcgaaaattttcaggtaaaattcaataaatagataggggtttttcaactgtttgatgtttaatatgaattataaattcaatggattctcttttcaacgttatagattggaaaatggaagcaattctaacaaaaaagaaccgtaccaagcttcaacacaacggccattcatacatttttcacaagccgagtgccgatggtgaagttcgcttttgggcctgtgaacaccatcacgcaaaagacataacttgcaaagggcgccttcacactaacctcaacaacaacgttttcgtgaagttggaaaccaccagtgtgaaccaagtgcagctcgaatggaagcacaacgagtgatcactggaatcaaacaccgggcggaacaaacaatggaaccaccagcgacaattcgctcattggtcttaactagagaccggaaatttcaaatttgcggatcccgctgcgggactggaactcaaaattttttgcgggacgggatcccgcaggattaatcccgcatttaaaatttgcgggatcccgtgcgggattgcggattttaggaaatttcaaaaaatgctgtattataaaaaaagtcgggctctactccagtttatgcgtccaatcgacttttatgcgtccaatcgctttttatgcgtccaatcaaagttttgtgcgtccaatcaaagttttatgcgtccaatctcatttcatgcgtccaatcgctttttatgcgtccaatcattttttatgtatcaaattatgtttttttgccaaaataaaggttttatgctttcatgagtcaaaaagtttgccacactttttatgggcaggcgctgcctttttccattagtcggcattgagggcagtcgccgtttttccattagccagaattgaagtcagccgctgcctttttccattagtcggcattgagacaaaatatgcaacagcaatacgatcatcgttgggtgaatcaccgtattcactttgtcgaccctcgtgacagacaagtgcatacccaaggcattgaggctacgtgggggtccctgaagacatctcttcgccatttgcgtggctcaaatgaggaaatgttgccgacatatttgtatcagtatatgttcagacgatttcacggaaattccaaaatatatcagcatattttggaagaaatgagacgcaattatcccgtgtagtgtaagagatttttttgcaaaaactggcaagggataataattttcacatggtaaatgttattggacgcataaaactttgattggacgcataaaatgagattggacgcataaaagtcgattggacgcataaactggagtagagccgaa

SEQ ID NO: 21584 - DNA, 1329 bp, Heterodera glycines
  misc_feature (8)..(8): n is a, c, g, or t
  misc_feature (32)..(32): n is a, c, g, or t
  misc_feature (1269)..(1269): n is a, c, g, or t
tccgatanttttgaaaaactacatgtattttntggataaaacctatagaaaatccaggttgcagaaaaatgcctgaacctaggaaaaaatccaaaatccaaggctggatccagttccaggccaactttaatgaaaaccaatgaaaacaaatttgatagaaattttgaagaaaaaaatttgcttctttgcaggcctcataatttttttaggcgggtctctaagaaattttgacacagtgctaagagctcgctatttcctcacctttttgggttttcaggaaaaacctttaaaaactctgtttttcgcttttaactgactcacaatcagggtttaattaaactaaaaactcgaactcattaaacgagattcccgaaacaggccccatatcataccatctaaaatcgaaaattgccctttaaaacaacctttgtttctccgaccctaacattgactgttttggactgccccgacgtcgattgctcgtccaattcgaatgggcgtcgttcagggctcttgagaaagtcatcccaagcaaattcctcgtcctcctcttggtcgacctcgtaaaatttgttgcgccacacaatgagctccggcctgaattcggtaaacctaaaaagttgcgatgggctattaaacattgaattttggcagtaaaattttcggaattcggaaaattttcttactctggctgttctgtaaaatctgtagtttttgttgatgatgacgatggaccagcttcatcactgatagaagaaggctagaaaaaagcaagattacaattcttctttcaaaaaatgaccatttttgaagcattttgatccttcaaatgactcgtgaaaaggccgtcgtcaatggtatcattcgaattcatattaaatttatttataaaatcgctcgtctgagaagcgtaacaaaattttatgattataaattcagcaaaagttgaacaaaagacccgtaaaaatttaggattttaaattttttttcatttggaaataaatttcgaaaaaacataacaccaaacaaatttaaatttaatacaaatatccttttttcaaaatgatttaggacaccccaattggcagacaaattgcacaagcggaggcaaaatggacaaaaccacaaagagttagcaatgaaaatgggaaaaggagaaaagggcgatgttgtcgacgacgaaatcagatataaaataaaagtgtaattgtgttaaatttgaaataattaggctaattaattaaggacatggataacggtgaacatcanatgcttcggattgatgaacgaacaggagccattttcacaatgcgtccagttcgattatga

SEQ ID NO: 21585 - DNA, 996 bp, Heterodera glycines
tataatttccttacatccttagagatgaattaaatcataagggcttaaacatccataagtccattttaaaataattatccagtattaatgaaagagttcaaacatgttttattatcattaattctttatttgttaaaatatttttcctttttttttgttttatttttttttttcgattcaaaacaacaatagctttccctctttggtggatcatgtgggtcatttttcatccacaaaaatccgtgatttaatcccccatttttttgtgtgtgtattaaaaacaacagcggatcggattggtttttgaatggtgttgtggtcatgccaatcctcatcattatttcatgcctctgaaaatggtgatggtgatgatctacctcctgttgcagtagtacattgtcagtcgtccatccgccacctgattttcttcactcacacctttttgatcgttgtcgcgcgactcgactggttgttgtcgttgctgttgttgttccatcagcgcccactgccagcggttgtgtggcgagggattattgagggatttatgaggtattttatttttgacgattgtgatgtggtgaatgaaatatgtagtcctcattattgttacattataaatgttttgttctcactcaatttcctccctctctcgaccattttttatgccgattttgaatttgtccaacactgaaaaatgatgcgcagaaaatggtgggccgataccgttgaccatttgtagagctaagttggaaaaacgcattttttattaaaaaaattttcctttattgtcatgccgagcagagttattgggggacgagataaatgccgggattcgggtcgggattgtcaaaaaaatttctggtcgggattcgggactcgaaaaaggccgtgattcgggtcggacgacggatcggggctcgggattctgttctattccaggaaactaaaaaagtacaatttaatccataaatctgattggatatttaactaaataca

SEQ ID NO: 21586 - DNA, 1450 bp, Heterodera glycines
ttttgattattttaattgtatttcatcctgaaattttttaataaacattttcaaactttcaccttattaattgaaggcgaattttgccttttttaataaattctcttgtgaaaaggcaaaaaaataggctcttttagatatgcctatttaaatgactttaattgctgtcctttcgcttacgaccataccacgttgaaagcacgccatcccgtccgatctggcaagttaagcaacgttgggccttcttagtacttggaacggagacgtcctgggaataaaaggtgttgtaaacttttttcattttttcacttttaaatttatttaaatttcaactttttttggctttttgaaaaaattttgtctattttttcggcaggcactgcctctgacaaagtttttttatttatttagaaaaataaatttatttttttttctttttgattattttaattgtatttcatcctgaaattttttaataaacattttcaaacattcaccttattaatttaaggcgaattttgcctttttttaataaattctcttgtgaaaaggcaaaaaaataggcttttttaaaatatgcctatttaaattactttaatttttttcacttttaaatttatttaaattttcaattttttttggctttttgaaaaaatttttgtctattttttcggcaggcactgcctctgacaatgttttttatttatttagaaaaataaatttattttttttctttttgattattttaattgtatttcatcctgaaattttttaataaacattttcaaactttcaccttattaatttaaggcgaattttgccttttttaataaattctcttgtgaaaaggcaaaaaaataggctcttttaaatatgcctatttaaatgactttaattgctgtcctttcgcttacgaccataccacgttgaaagcacgccatcccgtccgatctggcaagttaagcaacgttgggccttcttagtacttggaacggagacgtcctgggaatcgaaggtgttgtaagcttttttacttttttcacttttaaatttatttaaattttcaatttttttttggcttttttgaaaaaaattttgtctattttttcggcaggcactgctgcctctgacaatgttttttatttatttagaaaaataaatttattttttttctttttgattattttaattgtatttcatcctgaaattttttaataaacattttcaaactttcaccttattaatttaaggcgaattttgccttttttaataaattctcttgtgaaaaggcaaaaaaataggctcttttaaatatgcctatttaaatgactttaattgctgtcctttcgcttacgaccataccacgttgaaagcacgccatcccgtccgatctggcaagttaagcaacgatgggccttcttagtacttggaacggagacgtcctgggaat

SEQ ID NO: 21587 - DNA, 1187 bp, Heterodera glycines
  misc_feature (7)..(7): n is a, c, g, or t
atgattnccactatcaaccggaaataatggctgttcaccattatccctgattatataggttctaaaacatctaatttaaaacgcataatttacaacattacctccgaaaatactcaaaaacaggacgagctacaattggagcccgtgcatgcaatatgtctagagaaccctcaaccaaattaggttgaaggaaagcgagtgcagctaatgagcgtatatatgttctaagttcttcattagcttcatattcacggataagaccatgtctctgaagtaaaataataggggtaaaaacaggtatgttgcgaagacgggttctaagtaccttgaaaattttgtgtgactatgtaaagatatataataagccacctctaacgatctgatataggtgcttgctgccttattagccattaaaatatatgcgcatggaacagaagagtgttccaacaaaatattaattgtatatagttgcaaaaatgaaggcggcacaatcttaataattttagcctacataaaatttcactgctaatttatatagccaaatagtttaaagaaagaattataaaagtctcaggctgtttatgtatatctcactttaaaattgccatcagcagaccatttgttataagtcgacagtctatttaacccaagttctgtcgcgaagataaaaaaaaacaacctcgtcgggttcagttgcacgagaatcatacaatagaaatctttgcccacgatagtcaagagcaaattcccccttgattaatagaattttagcaagaaaaacagctaatgcagggctcccattagaccttgaatggcaaggacctccttggaaatgagcatttgaaaattatcagcgaattatctttcggcggaaccgcatttcctttatctgacagctgatcagcgaattatctttcggcggaaccgcatttcctttatctgacagctgatcagcgaattatctttcggcggaaccgcatttcctttatctgacagctgatcagcgaattatctttcggcggaaccgcatttcctttatctgacagctgatcagcgaattatctttcggcagaaccgcatttcctttatctgacagctgatcagcgaattatcttttcgcggaaccgcgtttagagtatataaaagcaaaaacattttttgattaaaaacatatttttacttaaact

SEQ ID NO: 21588 - DNA, 826 bp, Heterodera glycines
ttaaactttgtgttttaagtcatttaattaccacaactgtacccattcctgttcatttcttggcccattttttccatttcaataaatgttcttttgtttttgaaattaattaaattatcatccttaattcaaatataaatgacaatttttgttttttgtttttttttttaaaattttaatgacattttttttggaatgttaatggtaatttttttttttaaattagactatctggcccctcctatcatgcctcttccttttctgttgccaatgccttcatcgccgccgccttacttccctcctccgccctattacgattgccaggaggagaaggaggatgatagggcgggggaggggtggtacgacgggtggttgcacttccacaaccgctctttgggaggttgggagttttaggtgagttaaccaaatttaaattaagaggcgagtaatttaagcatagggcttatccgcctatttacatttatttattattatttttttttttgctaatttatttagggtatttttttttttaaatttaatttaagttgtggaatgatgggtgcgcagaacacaactcgtcaacaaacaacgaaagaacaaagaatggaaattgagaattgattgttaaaaaataatctaataaaaaaaattaaaaaaaaaaaagtttttaaaaaaacgaggataaagttcctaaaaaaaatatttgaaatttataattcattaataattaattaattattttttatagtggatggagtagcgataaaataaacgagtaagatagatgaaagaggaggtgggaggaggatgaggaggagtagga

SEQ ID NO: 21589 - DNA, 865 bp, Heterodera glycines
aggaggggaaagaggatgaggaggaggaggaggataagggtgaagaggatgagggaggagtgaggaggagaaagaggatgaggaggaggaggatgagggaggtgaggagggggaaggaggatgatggaggatgacgaaatggagggaggatgagggagtagaaagaagaaaagggaggtcaatgagacaatttgaggcggatgagagagagagtttgtgtgtgtttttggggggatacccaggcaatccatgtatggacgacgacattcacacaggcaactcgcatataattatttattttaattttaaataaaccgtagtaataataataataatattattaattaaataataataataataataattaaataataataataataaaataataataataataatattaaataataataatgttaattaaataataataataatattaaataataataatgttaattaaataataataattagaattaaataataataataataattaaataataataataataattattaaaataattaaataaaataataataataataattaaataataataataataataataataataataataataataataataataaataataaataatgataatttaaataataataataattaaataataataataataaataatgataatttaaataataataataattcaataataataataattattattattattaaaaataataattaaataataataataataataataattgaataataataataatttaataataataataataattaaataataataataattaaataaaaaagtaataataataaaataataataataataataa

SEQ ID NO: 21590 - DNA, 3043 bp, Heterodera glycines
aatcgaaaatttttaatgcagaaatgcgttttttgagctcctttcaaatcaatcgagcaaaaaaaatagttaaaacctaaaattcccagccctattaattaaacaataaatattgcttaataataatgtatttaaactttttttcgtacatatttcatttttttaaaatattttgagaatctttgaaatttttaaaaaaatttttcttgagaaaaaaacaaatatttttttgaaaatttaccctataaaaaatactaaaaattaatttttcgaatactaaaagatgattataagcttaattaggttacattttgtgcctatcttaccctctaccaagaattttttcaaaaaatttttagtatccctaaatgaccctttttgattttcttacttttttaacggcgcgctttttcaaaaaaaatttttgggaaacttggggagggagggggtccggcggtgccggtaggcgccgccgggataaaatttgcaatttttaaagcagtttgttaacggattttttcaaaaaaagacacatttttgcgattttaaccaattttttataaggattttcggggctacctgaaactgtagcttttacaaatcggaattttgatcaaaaaatttgtgctcataagaacattataattttattaaagcatgcgccaaattgaaatgttaagggcgttcgaatgctaccaagatcgttagattttgttgaaaataaaaaaaggtatagcacaatgggctggcgccaaaacgaccaagtccaccttgaactatttatgacatttcgccaaaacattattaatttttcaaatttgacagtttcactgaataaaattatatttttttgaatttttcctaattttttcagacattttgccaaaaaatagtgattaaaattaatacaggaaatacatgtttttaaggcctgtacctgtagttttttgagttcttctagtcataactgtttttaaacttagttaaatttttgaaattttgtacatgattgagaacacttaggctatcaaattatatcaataatttgaattggttgattttgggcaaaaataaaaataatttttcatcaaaaatattgatgtttttaattaatttcgtttatgatattgttaaaataacgattcagcacctattcattggctgctttaataatcttacaattttttgtctattttttaaaaacggcttaaatcttttggctccaatagttaaaatacccaatccaagttgctgcgaaatgtgccaaagttgaacgctgctttcttgcttaatttgtttcaaaacttcaaacttttcatagtcatttaaatttttctgctgtaaaaagtcccattgttctttgtagtcttccgcaacattaataaattcattcaaataataacggttcttctttttatcgttataagtcatttcattaatggacgctaatgtgccttcaaattgaaattatttgagaataaaaaacaaaatgaaatagtttttggtataaattagagttgagcgcgaccgggaccgggacgggaattcccggtcctcctaggtcccggtcccggtttacttttttggtataaataaattatccaagctctttagcaaacaatatttttttaaattatttaaaatctaataatttttatgttcgtcacgttccttcctaaaccgtggcggcgcatttaaaaatgtcttcgaaaattctgaattttcaaatttctcaaaatatgggtcgaatttaagagcattttcagccttgaatagaatttggttgctctgcgctttcttcaacatttgattgacttcatcattttgttcaatccggaggcctttgaatgcttttagccatctgtcaaccaaatcccatgctctctcattttcaaatttgatcttaaataagattttcaaatttttaaaatatttttaccgcaatttttaagcctttcccatttccccatttgaataaatcccgataaacagctttagtcgcttccattgctgagctcagttggagttcgccctcctcaacaagaaagcgtggctttacacacaaacatttcactgaatttccaaaattaattaaattattattttctttatttaaattatttccatattttatttaattttctcaaaaaataattcacattcgtttaaaggctgtcctccttcatcaatctttattaaaagtgtgaccataaaatatttttgctttttcttgcactttaaacttttcacgaatgcatcggctgacaatgctttcattttccaattttcacaaattctttttaattttttgatggatttttttccaattttttgcgggttattatacaaatcttcattttcacattcccattttgctatcatttctcgccaaaagaatgttttgccaatttgaattgcttttttcatgtcctcctcctctgttgtgccatcttcgatcacttcataatggaattgatcagagcacttatcatagtcattattgttctttttcccaacaaataaatttttaattccgtccttagaattggcaattccgatcatgttgatcaacagaatgaaaagttggatgaatggaatccgatgcatttttagaaattaaaaaaaatagaataattctttcttaggggatctgatgggtattgattgatgcacattgtccaaaacgtgtaaaaagcgcttcaatgtgaataggtataacatttcacgaagacaatattcactgtcttaataaaatttggcatctattagcccgaaaatcaattccatggcattttggcaatgtaaaaatggctttgcattacataaaaataattttaaaaaaagtaataaatgaaaggaatctgtacaattcgtagttgtttattcgcaagcacaattagagtgtataaaaaattttttatgatgaacttaagatttgttctacaattaaaaataaacaaaaatataattcaaaaattttttctcagttctcccaataaccaaacattagcaacaaggcgatgctttaaaaactgtattgctc

SEQ ID NO: 21591 - DNA, 421 bp, Heterodera glycines
aaatatttacctcaacacgtaaagaattggcccattcagtgccaaggaaatttgcatcacataaccagcatagctcatcacgaaccatttggtgctttcagtggccccgaattgaattagcaaaagtctcagcgaccaattggacacccagccgaacgtttcaaccaaaaaaatggtcattagtgaaaaaaggactttccgattgactgtctcattagaacgcatttctaaaaaaattaataaattaattaatcattcatttttcaattaaaataatgcctcctgaatcagatgaggacatcattttcacacgaaaccaaagtgccaaataaagaacgactgaacaaatgttcagcacccaactgcaattggcaaaatagggtggggccgggtcggaggtcatacaaagaaccaaactaaa

SEQ ID NO: 21592 - DNA, 1090 bp, Heterodera glycines
  misc_feature (75)..(75): n is a, c, g, or t
  misc_feature (131)..(131): n is a, c, g, or t
  misc_feature (1066)..(1066): n is a, c, g, or t
tgaaaaaattgacaaaaaaaaaaatttaaatcgtttaaatattataaaattatataatatactaatattaattanaataaaataaaatttttactttgttttaaatgtaacggacatcaaaaggacattgnacaaaatcattaaaatggcaattaaaacttttccaccattagcaaccagaatattgtcgaaaaaacgcatttttgttggaattttattttcacactaaaattttattttatatgtaaattgttatatgggaagggcatattttattttaaaaaatcagtttgaatgaaaacaattggaaagtgtaaaaatttttgcgttcaaataagtaaaacactaacattttgatgaattaatatagtcggacttattccaactttccaaaaactggcaaattgtacttttcataattttttatttataaaagaaagaattgggagaaaagaaagaaatctttgcatttcgcacactttctaaaacactttttcactcgcatgtcaataaaaacgctttcattaaaaaatgaattgaaaattggcatttcatttccgttcatcgaacttcaattaaatttgaattttacaagagattctaagaattaaaatattttatgaagacaacagatttttttacaataatccctctttatatgaaagcgttgaaaatgatcagtttgattttcttttgaattttgacaataaaatttaaaaaattttaacaaataaatttttacttcccagaaaagaattaaaggatttttgaattgaagagcaaataacaaaactaggggtgagtttgaaacatttatgtaaaaaattaaaaagataaactaaaaaattggtgaaatatgtatttattcgcaaaaactcaaaaatatggatttacagcttttaaaaagcttaacaaccaaaaatgtcgtgtctgttttaccaagagaaacaatcatttttgtattaaaaatatgaaaaaaatattgtacaaaaaattaaaagtttttgcacttgtaaacttaaaaattcgtttaaaataaatttatatgttagtctaattttttatntgtgtatttagaaaaagattaatg

SEQ ID NO: 21593 - DNA, 897 bp, Heterodera glycines
  misc_feature (15)..(16): n is a, c, g, or t
attatagcaaattanntttttgggctacattttaattttgtcttggatttttatcattgtactaagcattttgtgcagaatgttttcagcattattcttccattaataattttcttgcttcttatttattcgttacctttgttttatttcttttatttaaaacaatccttgtagtgttcaaataattaattttaaggtgttcctcatttattaattttttaattgggacttaaattacagttttgtattttttcatttctcatattattacttttttaattctttcgttttaaaatttaaaaagataaggtgatcttacttaattcttttttaatattatgttaaaaatttataatttctaattagtaaaaatcttaaataaatttttttttctgcaattgttctctattatattttatttattgatctaaaagcaaaatatttggctttactttatacgaatttccggtataatttttaccaataaatcgtttcatattccttccttggtaagggttgattttttctgaggcaattggcagaaagtatttacaatatcaaataattctgcattttaattatttttaatcttaatgaatttgaaaataaaaataaattatcattgataatttaagtatatagtgtttttttgatttattcaccttgaactttcgtctaatatataaaaattattatacttagcttttttgataatattggtaacttagattttgggttatctaatattttatataatcaattgtgatatattttattggttatgattgttaaattttgatgttttgctgtaatttttttcttggtaattgcaaattttgaaattggaacagaatttacttttaaagctgaacatagagacatgaggatcaacctttt

SEQ ID NO: 21594 - DNA, 1886 bp, Heterodera glycines
ctaattagtaaaaatcataaataaaattttttttctgcaatttttctattatattttatttattgatctaaaagcaaaatatttggctttactttatacgaattcccgataatttttaccaataaatcgtttcatattccttccttggtaagggttgattttttctgaggcaattggcagaaagtatttataatatcaaatttttcgttttttgttaccatgtcattgtgctcatgacggatttcttaagtataatttaagtatataatgtttttttttaatttattcaccttgaactttcgtctaatatataaaaattattatacttagcttttttgataatattggtaacttagattttgggttatctaatattttatataatcaattgtgatatatttattggttatgattgttaaattttgatgttttgctgaaaatttttcttagtaattgaaaattttgaaatttgaacagaattacttttaaaagctgaacatagagacatgaagatcaaccttttccgttttaaaaaagggtgctgacgtagtttattattttgtgtttatcgtagaccctttactaactatagtatgtcctagtatctcgtttctgatcattatgctccgcccactttaagtcctttgttgccctccatcacattgtattattcactctttcgggagggggaattggctgatcccgaactcttccaattgcccctctcacccaattttgtcccggatgaatcggttcacccttctccaactaaccacatatattacatatttgtatggatccaccttcggaataaaggttattattccattccactcgtgtaattattgggatgggctacactctctaccaaataatttttctctaattttcttctcaaaggcttttttataatgctacagaatttcagtacactcgtatttttgtgttatccctccctctactaatttttaccctaaaaagaaattattaaatattacaaattacaaaaatagctttgattttaatgttgatgtcgaattgtatgttgattttaaataaatatcaacgtaaatggtcgaaacggtcattggcgaaacggtcattgtcgaaatgtccagccaccaaaagaaaacaattaaataaatttgattaaataaaaaatacaaaacgaataccgtaataaaaatgaataaaaataaatcaaaggttaaacattcacaggcgattaaaatatagtgtaaatgtggcacagaaaatttcctactcagaactcattgcttttagtaaaccctgaattcctttggttatccaaaaaatgagcatagattaatataccatagagaaaattgtttgaagaaaagaaaaagtaaattcgggtgggtaaataaaacaataaatttattttaaaaaagaaaaaatgcttattcattaaattaataaataataacaaaaaaatgaaataaattcaatttgcgaagacggcaaatccttggaaatgtatgcaataaagaaggttaagacaaaaaatggcagaaatatcgatgagaaaaatttgttcactaaatctttgttggatggattgtctaatttagttagctaattaaatttgtttcaatttttttttcgcctcgttaatctgattggtaataaaaagcagaatttttcgatattatctgttagttatcaatgagttcaaaacagcaattctttaaattggaaaaaacacaaaaacaaaatttaaagaggaaaagaataaggaaataggaaaatggcaatttatttgttcaaaaatatattaatttaagaaaattcttttcaaaatcgtttagcttaaagaaatcaacaataatgaaaagattttttttagaaaaaaaaacagttcaaat

SEQ ID NO: 21595 - DNA, 1050 bp, Heterodera glycines
cgtgaatgttatttttattgaattctgaaccgttttgattagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgggaatgttatttttattgaattctgaaccgttttgagtagattaaactaaaaaaaattgaaaattttgaaatcatgtttcccactcccttctcccaggggtattattttgtaaagtctttttttcccaaataaacttttcaaaccccatttttcgcaccgggaatggtatttttattgaattctgaaccggtttgagtagattaaacttagaaaaattgaaaattttgaaaatatgtttcccactcccttctcccagggggattatttttgtaaaagccttttttttcccaaataaatttttccaaaccccattttttcccacccgcgaaatgtatatttttattggaattcctgaacccttttgaagaaaaatataataaaaaaaaattgaaaaatttgaaaacatg

SEQ ID NO: 21596 - DNA, 1929 bp, Heterodera glycines
ttaatgaagtcagtcaaactcaaatgatgtgtgtctcttttttctctgtcagttacgtgaaagcaaaacacaccgacctaagcattatccgtttgctgaaccgacaaccgcccgcttttgaagaagcgttggaatgtgcgaagaatgcgaaggaacggcttatgaacgagtttttgcattcagaaggacaaacgaggcaaaaagactcatcattcgcattggccaagttctaggcgtaattccaaattcagaagttctttttactgtgggctgtcctcttttcatcgccgttttactgccccgtgggtgctgtgccggtgtatttttaaaggtggcgctgaagtggcccaaaagttgcgaaattacgaattcgctgttgaactgctcgaatttcttttggaaactgatcgttagtttttatttattggataatttgtcatcatagcatatttttcgcaaagttcttcgcaatttttgcatgagttctcgcggtaaatggtacgaacgcattgcactcaatttggaacgccatctgaagagtttggacaagtcagcacacttttgtcgactcggcatggcggatgagttggtggggaagtcggacaaactcatcctgcagcatcggctgaccaaaatgaacaaccgcaagaaacagacacaaagccaaacggacttgggatttgttgagttggaagaccctgaaaaggttgggaatggcactccaatttaatgtgccatcgtttgaattacgtatttttagatggaaattaacgggacaactttggccaaaagccttggcgacggagaacaggtcaaccacttttacattccgacaagcgaccggggggaaatcaacaaatgcagcgtcgaggaattggtgttgcaccatttcattacggtggagcatttcacgcacggattccattcggaggtggccaaaatcaaaaatactctgataaaagcccttcactttggttgggcagggcgccgtttggcattcgctctttcgccttttcttcactgatataatttttgacgccgatgttccgcaagtttggctttctcaaattcaggtggacaaacggaaattattatgcttttgcaaagtcacacattttgttcctctgcaggatgacccattggacttgaattttcccgacttttaccgtaatcggaaggcggcgattgaccaacgactccaagaaatccgttcgactcacaatctcgctggcttttcgcgtcacttttctgacaaagtcaaatcgaaagtcgcttcaaattctcacattttgtggcacaatttccaaagtgctgagcaaatcgccgtttgtctttctgcgttaaaatttgcttaacaattgccttttccagacctttttggcctgttgttcgccccttatgctccacgaccttttcaaagagttttgtacaaatttcaaagaaagtcgtagcggatttcccgatttggtcgtttggaatgaaaacgtggcggaaatggcggtcacttactctttggcatttgtgatgcactaaacttggcatttgtcacaggtggtggaagtgaaggggcccaacgacagtttgtccgccaaacaacagcttcggctgcatttcttccgaacccacggcgtccgctctgttgtttgtcacgttgtcggtgagaggggaaaagcgccgggggattatttatcatcgcattttaggcgagaggggggggggggtaaggcgaactgagagcataaggggattatgtaacaaattgaacttgggaaaggagggattaggaatttgggaagggaaatcggtggaaaatacacagacgaaaagacaatgggaaacttaagcacgcaacgatcggatgctttgaacaaacgactttctgctgctgaacgaacacaatgccaaaatgcttccccatttcgtgctaat

SEQ ID NO: 21597 - DNA, 1924 bp, Heterodera glycines
tgtacttctattttgtctgagtcaatttcgattgctcatctattgacacaagcggttccttccacccatcattttttttccataatcattatttctgtaatttttttaaaattgttttataacagtgaaatttaaaaaatagtatcgagtcaatcaatccttcctggtttgggccttctttcatggaggtggaagatgttatattcttttttcttcttttatttaaatgataatatttgttttaaatttcattatttattttttattttgtaataaatattttagtccatcttatatgccatttagtgcatataatgtatgtttttcattatcatatttaaaaatacaatgtatagtaagtattctttatcatatttaataatactttcgtcttgaacaaaggttgcgatttggatccatttatttatatttatttaatttgttttttataaaaaaaagtttattttggcaatttttgtcaaactttacaattgcatagattttattgaaaaataattaatttttttgttgaataaattattattcgttttcaaacttgatagaaatcaagttagagcagcactcctgcgtaatgaaacatttaatttagttcgggatcagtaatcatttctagtaatctttgattttatttattttatttaccagttcgtattttctttcattattcataatgcatttaatttaatttattgggaaaatataatttaaaatatataattatttttaaagcttttcccacaaagtttcaaaagaaactttttttgttgacaaaaacaaaaaattaaatatttgtattttaaatttattgattatattaccaattttttttatcataggtcgcttaagccttaatattcatctcttcaaaccccataattaaacttttatttatttattaggtagcaaaaaagtttacatattaatcaattattaaaattgttattgaagaaaataaaattaaaaatccgcgaattattcaaatattattccattcgttgtaaataaaactttgttgaattaatgagaataagaaatttattttttccaatacatgatgtcgccttttgaatattcacgccatattgatttttttttaaatttttgataaattacaattccaaatttttgtttaactttatattctttttatgaaagattttaatatgttctaacgacaacatttgctgtggttattttcaaattgtaagaccctttccgatttggcagtgctagctgttatgtctttagcttacaactttattaaagcaaagacaaacagaaaaataaatgataaataacaaataaataaatgacggaggaaagacaatcaatgaaatgaaaaatgaaggagagaacggcaagtgacccgaatgagtgaaaaggtcaatattaaataaacatttccaagtgatgacacagggaatcgtgtcaataaataataaaatatatttaaattgtcaaatccacaacatctccccctttaaatgaaattatccctcaatttcatatcgagcgccagcatttgggccgatattcaatcgtttcggcgggcgtcgttcacgctgaggacgtgccaaaacggaaggttgctcgtcatgcgaaccatgaggctgattgttctttgtcgtcggggtctttgttggcgaatttggtctctgctcttcgacaaaatcttttgaaattgggattttgggaataaatgaccgaatttgatttatgtggcgattaaccacaatacccaaagaatggattttgaccttccagaccaaattcttaccatcaacaattttaccttcaagccatgatggcttaccataccgaccataattgagtgttaaattgtgtcaccatttttgaattgtcgatcagaagtgtcatggtgctgatcatactgtcgtttcat

SEQ ID NO: 21598 - DNA, 1180 bp, Heterodera glycines
tctgtcataattgacggtcccatgagatttcgtttattaggggcaccaaaaaatgtttttattcggtccattcccatttttccgaaaaaaatccattcatttttaattaaagcctatctaaacttttgaaaagtgtcggatcggatcggcagtgcacttttcacactcagttacctgaatgatgaccagcccacggatgccaccgccatccaacgaaaggacattgatgaaattgtggtcggacggactgccctcatccgaggacacttcgggcaacttgtccaacacctcgtcatagatgtcctgaacacacaaataagatattgtcaaaaattgaattttcaaattatttcaggccacttaattggctccaattcataatttcttaatagttaagctagatttttcaaaaaatcttattattggaaattttttattaaaaaaaacttcatgaaaaatttttcaaacggggataaattttttttagtaatttatgataattaaaaaaaaaacgcttgaaaattgtttctacttttttctttaaactttcttataaaaactttcgaacaataagttttttgaaaatttcctaaaaaattgaaaaaaaaatcacaaggttaaactgctcccggcatataggaaagcaaaaaataataataacatgcaaaataatgacactgatttttacattgtgctgaatgtccaacagtttgttgaagcggaactggtccttgtcaaatgcccggttctcaaaatcctccaccatcaccgacgtgtagctggccggctttggtgccgttgttgatgctccagccgttggttgtgaggagtttgctggttgggttggcggtgccgtagcagcagcagctgcggccgacgctgccaatgttgttgaactactgcttgacgacaacgacgccgttgacgatgcactcgtcgatgttgaagtggtgttgccggtggcggatgatggcatggaactggtggacggcctcttcagcttgttcaactgcttctcgttgacacaaccggacacacagccaacctaaaatacgggagaaaaaacgaatttttgtatttttttttaaatgacatggtacaaaattcatagattttgtaccttggtgagtggacaacgccgagcatcgcatatgatctaacttttcagcaaatcaaccct

SEQ ID NO: 21599 - DNA, 1047 bp, Heterodera glycines
ggtttgatggcactacaaatgggataattttacatgatacacaaattaccgataaattattcataataaaattgttaattgaatcaaatattattaatttataaatgaattcagcaattttttcaaaaaaccttatttcaaaaattgatccaatattaggtccagagatcaattcaaataacataatgcccaatgaccacacaacatctttttcaacagacgtaaatatattatcctgaattcaaatccatatgttattatttaattataattgtagtaaattagttggattaaaattaattaattccttagttatcactgatcagaattacttttatttgctgtgggctcatatacggaaagtcttttagccaaatgattttggtttgatcagcgctgggaagtgccctctgccgtgggtcttccacgcgttgaatttcggcatcgatttcaaggtgagcatttccgagcagttccgacttgctaaattgatcaccaacacggatagccaccaaatgatcaggtgtcaacacatgtgccaattgaccattgttcagtttcaagtgccgttgaattgcattgatcagtttaagagcaattagtccaattatatgtttcggcactaaattaatttaaatattaaatttattaattatcctgaaaattataatttttattttttttaattatccgcttttttaccataatagttaaaataagcgttgacttcattaaaataatttttgaatgaaattctttgctgtttttcttcatttttgttttccaaatatcctggcacattctctgatgctttgactttaggcacaatttgctgcattcttttggcattgtcaatttttaatggcatttctaaaaaaatatttaaatattttcaatttgttataattaattattcatttcttttaagttaaaggttattattaataaaatttttgaaaataaattttgttcaaagttaacatttagaaacagttatttttcctgacttattttatggaatatttatgttcatttttttaaaataat

SEQ ID NO: 21600 - DNA, 2064 bp, Heterodera glycines
aatttgttaaaaggaatgcttaaagttttcagcgatgcttcattcgttgctgattatgaaaacgcgtcagaaaatagcattagagggaaagtcgtagcgcaattccctctatgttgatcaagacaataatttgcgtcacatttttgctggaatttatacagaaagcagcagcagaaaatccccatcgaaaggataacactcaatttcatgatctgcgatatctcagtgacgaaacgatcagtgacgaaatgataggtaaccaaaagaaatgccactttatgacgcgttaatttatttactttagggacttaaaaataacaattcaaaaatatatgtcaatgcttttatttgtgttttcaatcggtattttgacttggacatatgattatattgtgggaaatgcccatataaacctttccttaattaatgctgaagaaatatttcaaattcaacaatttttgggtggaaatatcggcgactttgtattatattgtggacgaaatgtgagttgagttcttcttatattttataatgtttttttttaaattttgaaggattattttctcggcaaaattacaatgggtctttattttgtcgaaaacataatttgttatgcggtaattgtcatttgtggatataaaatggtcagatttgtttacaaaaacttggacaaaagttcagcaagaagacaacaaattaaccgacaaatcacaatcaatttgattctccaggtaaaattgatgaataatttgaggtgaagttttagattattgtcggtttagtaaattagtatattatgtataacttaattaatacatcatgctaaaatttaattatatttaggcatttataccgttggctatgaatttaataaaccttataatttcggttgaaatggtgatttttgaattccaattgtccccgagttttgtttattcaaatgtgcatcactcttccctttcattggttgcccgtaaatttgtccatttgaatattatgaatttagaaatatttaaaaaatccgggatttatttctacacaagacgtggtttactctacctttcaggtgtatattaggcccctgatcccgaatctgagctctattgagtttcaaatcaattaaaatgtgatggagcagggttaaattttccaaatttcagaccctaaggggtcaacataccaatttccgagaaaatcgacaataactcaataggtattgattgatctgatctgaatataactttttaccatatagatatcgtcaaaatctagcaatttatatttattgtctcatgaaaagcatgagtttaaaaggggaaaagcaaaagtcatgattcgatgactaattaacatttaaaaattttgcagaaaatttgttaaaatagtgaattttttagttttttggtatttatgattattaaatttaaaaaaaaactttaaataaattattttgctttcgtgtcccttatgtttccttcacttttcggcactttatgcgtttagttttcatatttccgttttagcccgtaaaataatgaaaaaataataattagaatggattcttctcaaccaaattaagaataaaaagaaatgaaataatttggtgacgaaaattcgtgtaattaagaataaaaattataatgaatatatataattatgacattataaatatattttaattcaagaaaatgaatgtatttattttaagacaagaaccattaattttttaaaaattttcaaatttccgttgcccaaaatcgcatggaatttgagaaaagaaaaggatgatcacattttaagtggtttgtcaacaaattaaaaagggttttttcctggaattacaaaaatttcagctcgataggttcacggaagtggtccaactcccgaaaaataattttgtgtcattttctattccacaatttgccaaatgctttaaccatttaattttcaaaaactttttgaaaacttggggtgggggaaggggggtggtgtccggcggagccgatacgtcggaatggacattattgcaaaacaaggggccagcagccaattttccaattttgc

SEQ ID NO: 21601 - DNA, 1998 bp, Heterodera glycines
tttcccgagggcgactgcctgaatcgccggcctcctcctcttgttctaaaaagttttttgaaaaaaagggacgcctaaaaagttgtgggtcgtttcttaaattccgccaaggggtaggaaaacaaaaaatgtaagacatataaattcataacttggcttaaattcaatcaaattaataattcttggtatcattcaatagctctagatgttctctaacggaatattaattttaaaatttttttaataaaattttcaaaaagttgtggtcagaaaatttcaaaaaacattgttagtgttgaagcactccaaaaaatacccccctaagaatcgacataaaaaatactccctaaagaatcgacctaaaaattttcaaaaatcactcctaagaaatgaaaatttttttttatcaaaaacccatttttttggcaagaattttaatttaaaaaattatttggcaaaaagtgccgagtctggccccgatcagtagtgatcagagagaagtgagcgagaattttcagatcagacaatgcattggggctgagaagcgagcagcgactcgcggtgactcatttcctccaattcgagggcctaaaaattgggcaaaaaaaaacaatgtggaaattttggaaaattatttttttgtgtacacatgtccaagctgggcagcccatttaaaagcagacagaaaatgattacaaatttgtaaaaaaattttttgctcgaaaatcataaaatttggccatttttgtggactaatctcttaacaaatcgcattaaaaattacaatcaattttcccggcggcgcctgtcggcaccgtcggccccctttgttccccaaaagtttttggaaaaagcgccgcaaaaaccatcttcttttctaacaaaaaatttctcaaattttgatcatggacaatcagaaatataacattgaacattttaagcctgttttgaataaattttgtaaaaatgaggcttttttgcctgccaaatgaggcttttgaaaattgagaagctaaattggtctctttttttcagagaagttccctttcaaatctcacaagcaaagaatttatttatttattttttgctagccatttgtttttaaagaatttttgttgtttttaaggcaatgaatgtgccaaacttttttttaaaaaaaaattctcagtgacgaaacgatcagtgacgaaatgatcggccacctccctgttcattttaatttcctgtcattcaatttttcttgcataattgtcaacatcggcgagtcgtcatattggcgagtagtcggccatcggcaacggcgttttgtagtgtatccgcagttcacattttacttttatattaaaataaaaataaatgccaaaaacatgttaggtatgccaattaccaggactgtcaaaatatgtttcctgggttctacgtagtctaattagtagggatgccaaaaacatgcaaatgcatatattttttcctggcttctccatgctctaaatagtaggaaaaacactttcttttttgtgtttgcgtgtaaaagtcgagacttttatttgcatatttttgcatattttgggtgtttatgcatattttgggtttttttgaatatttaatgcatattttgccatttttgtacatattttcagattttttgcatatttagccattttttgtacatatttttttagatttttttttgcatattttgccatttttcgtcaaatattttccgatttgaatatctcttaggataaaatattgaaaatgcctaaaattaaatccaaatctgaattgatgcgcgagtgggtcaacagcgagtttcactgccgaaaaccttgagaaatttttgtttacaattacaaaaacaaccgatataatttctgaggaataaaattttttttttttattttgcaccccgaattttcaagtttttttgtgcatatttggtgcatatttggcaatttttgtgcatatttggcaattttatttgcatatttatgtgca

SEQ ID NO: 21602 - DNA, 996 bp, Heterodera glycines
  misc_feature (989)..(989): n is a, c, g, or t
gctcagagtgagataagggacgcaaaagagacgattaaaagcgattcgaaaattctatcgactgatataataacgatgcagtcgcggcgttgacaactgagatggaaccaaaagttccatatatctttccataaggttggaaaggcagaatttgaatggccagtctatatttacactgagcacccgttgaagcgggtgatgcgaagcaatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaagttccataatatctttccataaggctggaaaggcagaatttgaatggccagtcgatatttacactgagcacccgttgaagcgggtgatgcgaagccatagcaaactgtatttttaaattctggccgcaattctaccaaaaacgtgtttagaccgcagtaactcggctcagagtgaagattaagggacgcaaaagagacgatttaaaagcgattcgaaaattctatcgactgatataataacgatgcagtcgcggcgttgacaactgagatggaaccaaaaagttcccataatatctttccgataaggctgcaggccnatgcaag

SEQ ID NO: 21603 - DNA, 1536 bp, Heterodera glycines
  misc_feature (45)..(45): n is a, c, g, or t
cccccctcctctttattagtccttcgtatccaattagtgcatacngtatcaattagcgtaccccttaattgcctaattttagacacaatcgacgcgttggcctacgaagcggccaaggttttacagcggcagccttttcttttgtccgccgctggtggaggcggcgagaacggctcagtgatattggagaacggaggacggacagcggcagagggcggcggcactttgacaccgcacgcggcgtccgcgcccgggggaagcacggaccaccagcagcacaataacctgcaggtgctggcccaatcgagagtcttggtcatcgagtggggctttcctctcgagacttttgtggaaaatgtgccgtggcattcatttatatgggtattattttcgcattattcgtgttgttcagccgtttggctcttcactgggcggcggtcgctcctcctcgctgggtggcggttccgcctcttattttgcgggcggaaaacgcgactccaacgcgtccgccatcagcggactgtcgtccggcacctgtggacggatggagcggaacgaactcaccgacactttcgaccgattgaacgtagggaaatggggggggggggatgagttggccaaaccaaggccaatgatcagcaaaaaagggccacccatttttaaggaactctgtcggatgaacaatcagctgctgatcacgctgggcgttggccatgcaaaagtggaccaaatctgcacaatgctgtcagtttttgggcatgggaaatggggggggggcgattagagtgctatgtgaccggaagactttgaaaagctggacccatagtggaagatggaagactatcttgtgaaattgggttcggatcagtctaaaatttgatatatatttttttggactgatcagtgatcactcatatacattattatcacacccaattagcattgaccatcttacagaggaaggtatggcattcatccgaaaatgaccggtgccggcggtggcgggtgtttgttcgcctttctgaagccgggtgagtgatttggtgagggaaagggagtcaataaaaggataagaacggatcagactgatcaaaattgcatttgtcacagcagagttttgttgtccgattaccattccgatcacttcagacacttcccaaacaattctgaacatgatcagggaggagttgcgcaaggagggctacgaaatgtggcagccgacactcggaggtcggttttaaatttgaaatttcactttttctcccctcttttttaccctttaccccccgctgtttaggcccgggtgtgctgcagcatcagcaaaagccggagattttcacggcatccagcagctcagcggccagctccagcacaacgtccagcaccgggcggggcagcggctcctccatggctgtgccggtgaccacggcgggctccacccggtccaacacgccggccagctcgcaccagacaacgccgtcggcacggcacaaaaagtgattactgattgactgccgcgggaggttttggacgggc

SEQ ID NO: 21604 - DNA, 2137 bp, Heterodera glycines
agccccgcactgaacccatccaccggatttctggtcaactcatttaactgcttctgcagcaaaagtttggactgttccgaagacataattaattaagggattgtttgataaaggtcagcgaaacgaacgaacaaaatcagtgaattgaatttttattaatgcctctaaaaaatggacaaaaatacaaaccgtaaacaattaaaacagatcagcgtccaattaatttaaaaaaaaacgaaaataagcaaagcaattccctccccaagacgtgtgatatgtagaataaaaaaaagaaaaaaggtaaggtatgtggatttttatgagaaaaattcaattaatttcgaataaattatattttcaattttaaaatttgtcatctaatttaatgcctttttatcgctttcatttcaaaacgtaaatttttgttttgcaccacagactgaaaagtaatgaatgattccggacgactgggtggacgagctcaccctgcaattgttaaatagcgctgatacgtgcgttttcccagctttctttgaaaatttttatttgtaaaatttaacatttctctccaggtattacgctctgctaatgcccagtttaatttttgtaggtttttctttaatagaaaatgagtgtcaatttcttttttgccatttcaaaggtcgtcgtctttcatttcgtaatgcttgaaattggacttgaattcttcataaataactgatgtgccgagcttgaccgataactctttacttaataacattcgtaatgcattaacagataaattttgtaaattcgctttattatttgcagaaaaaataacaaattctacagcatataaaaagtaacaaattaacaaaactgtaaaaatgataatttgtaaacaatttgagattgattaaggccttttttggttcattccgatgctggttccacggaaattggcaccccgccaaagtcccgaccgttcagtgcattttctgcactgattgtgagtccatcctttcccaccatatgacttggcatttctttgcacaaatgcgcctccaattggtcacttgcggcaagaagcaagccaaggaacaacggacttggccgaaacggagacgaaagatactcgggatggtattggacaccggcgaagaatgggtgaacttaggggaaaatttggacgagattaggtacaggagaagtgcaagtgggaaactactgactgttgcgcggcaactcggccatttccattcgaatggcagtccctccggggaatgatgagccgttggcaccgaaaccacaaattttctcaaccttttcagcgagttcgttctgaaggaaaataaataaatgaaattataggcaataagccaaccaaacaaaattaatacactaaattataaaaaaccgcatcacccgtatttaatttttgcaaatttacattattttccgccaaattcttctcaacaattttcaagagagcagcggacggcgtgacttgcccggcaccattttgttgtccattgacgatgcaattctcatcaatgccaagccctgacaaaatagaataattcaaacaaaaaattaagacactgacagacagtcaaccgaaataccaataggtaattaaaacgtcgtaaaaatgaaaaatccactgaaaaacacactgaccaacaaacaaaaggcccttttctgtcagtttaggcacaacggatggattgacctataaataaagcaaattattaacttatttagaaaccataacaaacaaagcacttgcttcgtatcggtgcctaaaatttaattaaatcattgaaagatttcttggccaaaaaccagttggcaaattcgaaattccgacgatggttagattccgaatggtgacccgttgggacaatgttttgcaaaaaagttggtatacccaatccattaaaagctgtaattttaaattcttcgaatttctcttctgccaactgactctgttaatctttcttcttaccgatggcgttcatccaccgacagtttgtttttgtaaagtttccctcaacaatcaaaattgtgtaagtaattttacttatatgaaaattttcattcactgatcaacgaattttccgccagaaaaacggtcgtccgtttgcccaaacgcatc

SEQ ID NO: 21605 - DNA, 2654 bp, Heterodera glycines
  misc_feature (14)..(14): n is a, c, g, or t
  misc_feature (16)..(16): n is a, c, g, or t
  misc_feature (19)..(19): n is a, c, g, or t
  misc_feature (21)..(22): n is a, c, g, or t
  misc_feature (25)..(26): n is a, c, g, or t
  misc_feature (28)..(28): n is a, c, g, or t
  misc_feature (37)..(37): n is a, c, g, or t
  misc_feature (57)..(57): n is a, c, g, or t
  misc_feature (59)..(59): n is a, c, g, or t
  misc_feature (67)..(67): n is a, c, g, or t
  misc_feature (72)..(72): n is a, c, g, or t
  misc_feature (74)..(74): n is a, c, g, or t
  misc_feature (81)..(81): n is a, c, g, or t
  misc_feature (91)..(91): n is a, c, g, or t
  misc_feature (94)..(94): n is a, c, g, or t
  misc_feature (101)..(101): n is a, c, g, or t
  misc_feature (105)..(105): n is a, c, g, or t
  misc_feature (107)..(107): n is a, c, g, or t
  misc_feature (112)..(112): n is a, c, g, or t
  misc_feature (122)..(123): n is a, c, g, or t
  misc_feature (128)..(128): n is a, c, g, or t
  misc_feature (132)..(133): n is a, c, g, or t
  misc_feature (137)..(140): n is a, c, g, or t
  misc_feature (157)..(161): n is a, c, g, or t
  misc_feature (169)..(169): n is a, c, g, or t
  misc_feature (194)..(195): n is a, c, g, or t
  misc_feature (209)..(209): n is a, c, g, or t
  misc_feature (217)..(218): n is a, c, g, or t
  misc_feature (228)..(228): n is a, c, g, or t
  misc_feature (231)..(231): n is a, c, g, or t
  misc_feature (233)..(233): n is a, c, g, or t
  misc_feature (240)..(240): n is a, c, g, or t
  misc_feature (263)..(263): n is a, c, g, or t
  misc_feature (267)..(267): n is a, c, g, or t
  misc_feature (277)..(277): n is a, c, g, or t
  misc_feature (279)..(279): n is a, c, g, or t
  misc_feature (284)..(284): n is a, c, g, or t
  misc_feature (299)..(299): n is a, c, g, or t
  misc_feature (303)..(303): n is a, c, g, or t
  misc_feature (308)..(308): n is a, c, g, or t
  misc_feature (320)..(324): n is a, c, g, or t
  misc_feature (327)..(328): n is a, c, g, or t
  misc_feature (331)..(331): n is a, c, g, or t
  misc_feature (343)..(343): n is a, c, g, or t
  misc_feature (347)..(349): n is a, c, g, or t
  misc_feature (356)..(359): n is a, c, g, or t
  misc_feature (362)..(363): n is a, c, g, or t
  misc_feature (365)..(366): n is a, c, g, or t
  misc_feature (371)..(371): n is a, c, g, or t
  misc_feature (379)..(379): n is a, c, g, or t
  misc_feature (382)..(382): n is a, c, g, or t
  misc_feature (397)..(397): n is a, c, g, or t
  misc_feature (423)..(423): n is a, c, g, or t
  misc_feature (429)..(429): n is a, c, g, or t
  misc_feature (432)..(432): n is a, c, g, or t
  misc_feature (450)..(452): n is a, c, g, or t
  misc_feature (456)..(456): n is a, c, g, or t
  misc_feature (459)..(459): n is a, c, g, or t
  misc_feature (478)..(478): n is a, c, g, or t
  misc_feature (501)..(501): n is a, c, g, or t
  misc_feature (508)..(508): n is a, c, g, or t
  misc_feature (519)..(519): n is a, c, g, or t
  misc_feature (532)..(532): n is a, c, g, or t
aacttccacttctnancancnncanntnaattaacanataaatttctttttttaatnanactaaaanttctncnatttatnattcctaatnaanaaattcnaaantnaactnttcttctatnnttccnacannaaannnncaatatcctcaaaatannnnncaaaatcncatccataaaccaaatccaatttcnnttctcaatttcccnaatctttnnttcccatttncantnccacatnaatccttttttcaataattttancatnttttaataantncttcntcaaattcccccatnattnaactnctaaaaatttcnnnnnttnnaanttctattcaatnatannnaatctannnnacnnanncatcnatctttcntcnttctctaattttctnttctctatttctcttcacttcttttnatctcnccntatccacttcttttaatnnnatancantaaatttcaataaattctnttaataaattaaaatatttacanttaacanaatatcatttntcaattccaatanactacaaccttctttttggtcaaaaaattagcagtttatctttggcgcttttttattatgaaaaggtaatttatttgaatattttattcaagcaattagcattattattttagttaattaagaataaaaatacattgataaataatgaaaacacaataaattcggacgcaaatggagaggctgaagaatgcccaatttgcttacaatcattagacaatgaaaaaatgaaacttcacgacaattataataaaaattcacaagtaaaattttttgaaaattattaataaacctcatcaaaaaataaatttagcacctttttcacaaaaattgcatcattaaatggtaagaaaatgtgtaagattaataatttaaattattttacaaaggattgaatcacagcaaaaaattcgttgtccgctgtgtaattgggaaccaacattcttaatggtaaatatttttttttttggatttttccagccgggccttaaaaaattcagagtagctgatcacgaatatgacatcacttttaataatccttaagccgaactcgagcaaaaaaaatcgaaaaaatcaatcttttcgatcttcgaatttcattttaatttagctttgggatcagaattggtcaaaattaaagggatccctttttaagaatgttagtggtaaaagccgtttaaaatgaaaacataatacaatataatgcttaaagctaattataatatcctttgtatttggtatttgatagctttaaagatttgtcaaaaacaataataaatttataataaaataaaaaatttatgaaaaaattcagaaagtcgagactcagaatttcagacaatagctttttaaaatgagctaatatttaaaattttagactagcttcataactattctcagaagcaagctaaaaaaatctacttactgtcttccgctagcccttccttagattctcaattaacccataaaatttcaaaaaattcgttagtttcttgttgtcatgcaattacactaaagcttgattttacaatttttaattaattcttctaagaagcgattttttacgtataattttttataaatttagaatgcaaatattactgcaatttttaatggacctagcgattttttgtcgaccttggccctgaatccgttggccaatttgttttcgattgccaatgggcctttggaaattgacaatttcaagcgaaatcaagcgcaaaattccattaagcatggcaaacttcttttacaaattatgggcaaagatttgactggcctaattttgctagagcattttatggatgtaactggattatcagttgaacacttttttgaaattggagctgatggcctcgaagaaaaaactgcagttcaacaaattcggaacaaactcgaaattgtcttaagaaagccggagatatctgtagacagaaaatcgtcggctcaggcaatcattaagttgattaaagtgatcagtaatgtctcgaacatgttagcccataaagattttgatattttgcaacatataagcgtgaaattataaaaatgttaaattttgttaaagaataaatgcttaacttttcatatttgtcaaagtgataaatgacccaatttgctcaattttacgccattaataaattatttgcaaacttatgggtggcgctcatggcatttacgatttccggaaacgaggatctgcgcaccgctctttctcactgcagtgagatcgaaaatgaaattaatcgctctaatggagagcttaaaacaaaattgatggagcttttcttaaatttccactttcctcttgtagcttcatcgaagtttcgagaaaaatacatcactaaaaattaaatatttttaaaccgctgcaaataatccttcacgcaatagcagataaattttttatttttgttttgtataagccatattattctgaaaggttgagattttttcaaattctgtcgcgagagcgagtcaagaaaaatgtgtcaaaataaaattttaaaaatgaaaacaaaaaactacaataaactttaaaaaacaagactaaaaaaaatattataaaaaataatttcaaacaaaaaagatcaaaaaataaatgtgaagaaatgcttttcggaaa

SEQ ID NO: 21606 - DNA, 2184 bp, Heterodera glycines
  misc_feature (9)..(9): n is a, c, g, or t
  misc_feature (11)..(12): n is a, c, g, or t
  misc_feature (26)..(27): n is a, c, g, or t
  misc_feature (2162)..(2162): n is a, c, g, or t
  misc_feature (2177)..(2178): n is a, c, g, or t
gcatgcctngnncaggtccacatcannttagggcggttgggaaaaaaaatataaaaaatcttttttttttcttgtgagatttttgttacaatttttaaaacttcagcaattcttcatccttcatccgatttttatttgaaaatagttattcattttctcgctttttcttcattggaatctcaaattacacctaaaatttaaataaaatttttttaaagtcaataatttgtgcttttgccgcattttatgccaaattcctttctccatttttggaatgtttcttggttaacccaaactctttcataaatttattttccatttttgtacattttaaactcattaatccgttcaacaaattcctacttcttctttttgtaataatttttattaaaatttaattctttgccttatttgatttttgatcaattttctcttttttatttcattttcccatcattggccaaatatttctgcaaaagttgaagtgataatgtgtttaaaataaaaaatattttttagctaaaaaatttaaaattttagctaaaatttttaaaatcaaaaaatctaactttacgggataaaatttaataaaattttgattttctataaaatttacaaatttttcatcattatcccatcgtttggcctagggatccaactccgcgcctcttacccaagtcaatattaagaaatttaaattttgaataattaatttaattaaaattcaatactcagcccgcttcaccgaacattcaaattgttgaggaacagcagcgttcagtggccgaaattctttcaaaattccagcaacgtgattttgtgcatcccaatggcacggaaagaaaggacaaaaaggaggtacggttttctagggggttagatttcctgaaggtttaaaattttaaaaattttctaaggccccaccagtgctgcgcccgaccaatttaagccgtggctgctccggtgcatccatttgggcaacttcaagtgtgcgaagtgagtttgtgatgcgctttcaaatttacagaatttgcataagatcgaaaaaaatttctttaaaaatttttactgattgattagagccctcgcagggtttttgcgggaatccttgtcctcatgttcctgcattttttgggtgaaaattgcatgtgaattgcaggaggagtccaggctaaaacagtacaggattttcggtctttttctgtccagacccattttcaatctgttcattttccggcatttttttaaaattcagataaattattgtgttaaattggtgaactttcccacgtctgatcactttattggtttgatcatttcttttccaatcattttccaccatttccaaaagctttgggttttgtttttaaatttttggcggtactttaaagtggtaaattttgaaaataattttattaaaaactatgggatccttttcagttcgaaaattttctgacataaaaaaatatgaaaatgagttttatgaaaaaaaaaaatgcaaatcgattatctgactttacctatgattttttttatcaataaatcattgtccgtttaatttggtttttaaaattatcattgtttttgcctaagcctatgtttaggcttaattcagggctcggatcgaaaaattttcaaaatcagaacatcgggtccaaaaaatcagattttggggtcgaaaatcagaacattttgcaaaattgcttcaaatcagttatttttacaatttttcgatcaaaaatgtatcaaatattatatttttcgtctcccattatcgattttaacaattttggggagaaaattagcaaatcatcaattttagcgcattcggaatcaaaaaatcagatttttaagaattttttgcggcgcatttttccaaaaaacttttaggaaatgggcgaggggggagggtccggcggtgccgataggcgccgccggaaaattttttgtaatttcgttctgatttgttaacagattttcaccaaaaaatgccaattttgcaattaaattaaaagtcaagcgacgacttttttttcgcttttaaaaacacttttttgcggggcccttcttccaaaaattttggaggatggacagggggtccggcggcgccgataggtgccgccgggaaaaatttgtgatattagtacgatttgttaacagantttttgtccaaaaannatgacc

SEQ ID NO: 21607 - DNA, 931 bp, Heterodera glycines
attttgaatttgtttggcattttgtttctttggactgctgcctaagctttgaaaagtcttgaaaaagttcatttaaaggcttgcataaaatatgacttggtttttcttattaattaccttctagtctgctgccattcaactattttccagctcacatgcattcctcttcaattgatttgcattctcatggcgctgtcggcatttgtgccgtctgcggtgaccgtgctgatggccaccattacggcgtgctttcatgccgcggctgcaacgcgttcttccgccgtgccgttactttcaatttgcagttccattgcaggcgtgacgggcattgcgacatctccaaaagtaagagaattgaagcggtcatttctcagtctgcccacaaccctttgacatttgtcagatgctcgttgtgcttgtcgcgcgtgtcggctgttaaagtgccaatccgtcggcatggatcggtcggcggtccaagtgcggcgcgagatgaaaaatgtgttggttttaggaaacgcacagaacgcagaaggtgcgaaaccgtttaaaatgttaattgatcggacggacttccatcgaaataaaccaatttgaatacaaatttcagttccaacgaattctgcggattttcttctcctttcgccccctcaggccgatggccctccgttccccacaaatttgcaagtgttgggcagtgggaaaacgctcgatttggtaaagattaagtaaattttcggttgttaattgtaagactcgtcgttagttttcagctgcccgtccgtgctcgtctgctcggctctgccgcttccgtcagcagtcccttggccatccattccttcgatcgtctcatcgaatggtatttccgccagcgctaccgacgccagaaaatgttctgtcagacggcggaacaattctgtcgctgatttccagt

SEQ ID NO: 21608 - DNA, 1235 bp, Heterodera glycines
  misc_feature (21)..(21): n is a, c, g, or t
tccgtccgttttcagtcgccnaagttcgctgccattccatcgatgctttccgtcggccgcacgcgcgccgcaaccatcgacgatttttgccaagtgcgccgggtggagacgttgctgatgttcgagtgggtcgacctgttggaggagttcaaacagctggaaatggagccgatggacaaagtacggatggagagggagcagttcacccaatttggggcgggggagtgccgcggcatttatccaatagtcaaaatgttttcctcttcagacgcgtcttttgcgtgcgtttgccccccgtttccttttgcttgactttgtgctccattcgctcgagtgccattctgtcgattgtcttttgttgcccaacggtgctgcgctcattagtccgtcggggcgtaattcgaacggtcgaccgcgcggcgaaaagaccatcaaatgcaacattttcagatcaatttgggtgccgaggcgaatttggagcggacattgggcaccgaacaatggaacggtaatcgaaatttgcatttttttcatttgttttcttttttagtttgtcagcggaggcggatgaaattgtgcgggaagtgctcgtccccttggccagcaacggcgtaacttttggttggcgttttgctttattaaatccgatattttgtgtaaatttctcaaatggtccctcttttctttgcatgtcaccattaatccaacaaattgcctcattctttgtcaggtgaactgattgcgctccgtttgctgctcctttgggactgttccgtgccgttggaatccgttgccagcgccgaaattgtccgaatggcggccgaacggacgcgcaaagaattggcccagtggttggagttgcattctgcaggcggtggtgtccagggaaaggtgtgtgagcacagccgattaggaaaagtgggggggggggatttggaaaatttaaatgccgagtcaatttttaaataatcaaaccgaaccttttaaaccgaaccgattcaaaaaaccgagaaaagcagtaacaaccaataattttccctcctccacagttggacactcttttcgccatgttcccaattctgtgcgcatttgcggccaaattcgcgcacatttgccggtcaattgccaatttccatgtgatgccccaatggcaatatgtggccgaccttttggacgagtagcagaaaatccttgtgtggctaagccgtaaattaccggtacaataaaattgacaa

SEQ ID NO: 21609 - DNA, 2051 bp, Heterodera glycines
  misc_feature (1654)..(1654): n is a, c, g, or t
  misc_feature (1677)..(1677): n is a, c, g, or t
  misc_feature (1704)..(1704): n is a, c, g, or t
  misc_feature (1712)..(1712): n is a, c, g, or t
  misc_feature (1719)..(1719): n is a, c, g, or t
  misc_feature (1728)..(1729): n is a, c, g, or t
  misc_feature (1778)..(1778): n is a, c, g, or t
  misc_feature (1832)..(1832): n is a, c, g, or t
cggaaaatggaaattcaatccgaattaattacgcctctctagacagaatcgatcgattgttttgcttaattttctgaccaccatttcagtacgtgttcttcaaagatgtgaagcttgtccaccattaccatcgtactgattaacaaacagcagcagaagattagtgctgtggatgagcaaaagcaaaacaaaaaaaagaattattttaattttttaattttagcgcatttattcaaaatattgtttgctaatgaatgaaaagacactaataaattaggattcattagagtttattaatgttcaagtgtgtttcgattaaaattggggctcagttggataaattcacatttttggagttgggttcaaatccaatagaaaaataaataaattttaattaatgcataatataactaattaatacagaaaacattttttggactaaaaaaatgtattatagtctttctttagtgaaaataagcaaaaatcagtcaattttaaaggttagggaattaattgaaagttaacaaagctggaaatgggaactttggccaaaatttcgatttttgaagcactataactttttgatttcttcctatgggaacgtaatattaaaaattcacaatagaagtcgatcctgctctatccaatggtatataacacatatgcattttccgacttacagttcgggtggttggttcccttgtaagaatacaaaaacgaatcattggcgatcgaatgtcgtctacatttttttttttgcactacgatttcttcacccatttcattttttgccagatttgtcgactggttcagctaccatttgtcaaactttgagtatcgttggtcatggagtgattggattgaatgtgtcgaggttcgtttttttttttgaaaaatctgttccattatttcgatttttaattttcttaaacctccctcccaaaaatgtttttttaaattttcacagttggattcattgcatccaaagcgcatttttgtacgtgaagtcattgaaaagtgtttgcgcttttcctaccacaaaaaattggtcgaatttttgccctccgaattggcaccgatcattccggacgagccgaacatcatttacattcttgacgaccgtcagtttttgcatattacccattttagaaaccttggtgtagtaccaatcaaccagtcatgccaatttccaatggaaatttgtttttccaatacaaaaaagggttccagtttttttttcggtctacttttggcacacgattgtcagttttggctcaaaaattagggttcgattaaacgactgctcgcgccctaagtaaaatttttgcccattttcagcccaacatccggcatttaccaaggccgaacaattccggggcctcatcatgaacaaggctgacgatcaggaaattttgagcgcccttcgaatgccaagcgatgaacctggcggtggtggtggtggtgaattttccaccgatttttccatcgatgcggtcgccatttttttctccgttttgttgaagctgtcttcgcggacaatgacacattcatttgcggcactgacaaggtatgtagggaaatggaggaattcaaaaaaaatccttggaacttttttcataagaaaaaattcaagaaaaattttttggcaattttncaattttatgatgaactgctaancataagttttttcaaaaaattttccanaaaatcgnctggttngaaagatannaaaaaaattttttggagaaaataaagtgcatgcacccccgcacgaattncactcatttgtattttatttttttacagatacataaacattgcactgatgacgntgacaatgaggaaatgcatcgacattctcagacattgtgagaaaattgaaaatttttatggtcggttaatccaatttccaggaatgaataatggatttgctaacagtctcattatttgatttttgagtgcagccggggggggggggggggggggggggcgggggggggggggggggggttttttttataaaaaaaaaaaaaaaaaaaaatttttttttt

SEQ ID NO: 21610 - DNA, 1263 bp, Heterodera glycines
gctggtctatttactactaaagaaacaaggagtttcgtttccaaaaacaaaatctccttacggtttgcaggaaggggttcgaaatttcgaccttgggggtaacttttgacggcgcattcaggaaaactatagattttccgatccgagggccaactgagcgccaggcgccgaaaagtcacttttttcgaagcagtttttgcagtttttgggattcaaaaattttttaaaggcctaaatgaaaaatcggcctcgataggattttaagttggacttttttggattttttttgtttcttgaccgaaccccaaggtcttgtcagtttttccgaaaaactggctaaaaattgcatacttttttgggccatttcagcgccggctgaataactcgccggggtttgaccggaggaggtcggtgtaagcggcttttttgtacagcttgacgagctctatccaaccatgttttcggatttctgaaattttcagaaattttcgagctaggccccctcgaaaattttccgtttttgaattttattattttttacagatttttccggggaaaacggagaccactttcaagcaaccgtttttcatgctctatcgattggtgtcattttcagaaaaaattttaaaaatttttttggaaatagaaaattttggttgctaggcctcaatttcagttctgtggctatatcttctcaggggttgattttagcaaaaattcatgcaagagcatttttgtagagagttttaagcccaatataatgtgctttatcgtatgtttttaccatgagtttaaaaaaagttataaaattaattgtgattttgaaactcaaaaccaaaggggggaccccatggttttgcatttcatgaaaattttttttgctcctaaattagccaaaatgcatttttatggcctaatttatggtgctgaatacgtatatacgctttattttgcgtttcagattttttggaaggtggttacaaatttttgaaaaatcgtctaaatttgagccccggaaaatccagtgaaatttcgaaaattcataactgtcttcgtttttggtcaaatttagtggaataaagtttgaaaaatagcaaaaaattaggagaattttatgagatttatttggaatttctatcttccaaaataaaaaagtattccagaatttctgggaaaattcgatttttcaaaaaaaaaatcagaactcctttctgaaaaagtattttataaaaataatatactcaaaaaatccgcaattttttg

SEQ ID NO: 21611 - DNA, 1141 bp, Heterodera glycines
  misc_feature (78)..(78): n is a, c, g, or t
  misc_feature (83)..(83): n is a, c, g, or t
  misc_feature (136)..(136): n is a, c, g, or t
  misc_feature (177)..(177): n is a, c, g, or t
catttttgaaaaaatttcaaaattttccggaaataggaaaaattttttggcctgaccgggacatttcagtccggggcntatanctcgtcaggtgtgattttagcgaaaatcgtccaagagctttttgtagagaatntcgagctctatctaatgtgctttatccggtatttttatctntaatataaaaaaagatataaaataaaaatgaatttttaaatgcaaaaccaaaggggggaccccatggttttgcatttcgtgagaaatttttttgctcctaaaattgccaaaaaatacttttctggggtaatttgaggtgctgaacacgaatatgcactttatattgcgttttggattttttggagggaggtaaaaaaattttgaaaaatcaataatttttggcccttgaaaattcaacctaaattttaaaaatttataactcgcctcaaaatggtccaattcagctcatttaaagcataaaaaatagcaaaaaatcgggagaattttatgagatttatttgaaatttataccacaaaaacaaaaaaagttattccaaaaattctggaaattttctatttttcagaaaaaagtttatatctcggttctgaaaagtcattagagaagagtaaaatactacaaaaatccgcaattttttgcttattatataaattttattttcggtttttcaatttttattcatttaaaatatttttaattttattaataataaataaaaatttttcatttgaattaaattattttttggtgaaaattttattaaaaataatttttaaattttgaataaaaaattaaagaatatcatgtttcaatttaaattgaatttgtaaaaaataaaatttaaactgatgcacctattctaatcacttttgtacctcttcccccgtggttgtacctcttctaatcactttgtacctcccgtggttgtaactctcaagcattcgatttttaaccttattttttaataaatacatttccttattttatttaattttgaataatgttgtcctgtttcaataatgttgtacctcttcccccgtggttgtacctcttctaatcacttttgtaccttttttaatcacagttgtacctcttctgatcactgttgtacctcttctaatcact

SEQ ID NO: 21612 - DNA, 1851 bp, Heterodera glycines
cgggcaggtttgaggtgagaagctgggcattgagttggtctcgtcgtttgccgacgtcgccgtagcggtctcgtagaatgctcacgactgtgctgtaattggcgtctgacggtgggtaaccttcaatcatccgtcgtggtggcgatcccttctcgaggtactgtaggaggaggaggtgcttttggaaggcggggtattggcgtgagtggacggcaaagtcaaaggcggcccaaaatgtgatccattcttctgccgatccgctgaacctcgggatttcgattcggctgacccgaagtgcgtcgtcgtcattggtcgactgtcggaagtggccatggtgaggttccgatcgatgggtggggcgattcgatgctcggggaaatgtgagattaagcgggaatgccggggttcgctggttgaataggttttgatcggctcgagccgaattggaaggctgccgtgcgtttgcttgctgtgcctgagccggtgggtcggtggattgccgttggcggtggatccggttttcgtcgtcggccccgtgatcagaaacacgactgctgctgcgagaagagatggcgtccgtcgtgtcgaatcgagcctcgatgtagacttggaggccgtcgaggatgagctgggctttagagagaagagtgatgatcggccattcttcgacatttgggtcggcttgctcgtcgtcgaaggtcgggagtgcggccaggaggtcctcctccgcctgcttcagaaacgggtcgcctagccgctgaatgtggtcaaaacattcctgtagcatgccattgacacggtcgatgcttctctgtagcaattgtcggtcagttcgtacgcccttggcgagtttggtctcctcggcgagcgggatttcctctggcgccatcctggtgaattcagtgagcctcccgaccctttgtcggaggcgcttgacgaggtccgaaagggttcggacttcggcggtgagacgttgacgaatgagttccgacatttccgaaagtctaggattggcggcttgacgcaagagtcgggcttggttggtcgagagcctagagaaggcggctgtcggttggtgggttgagtggagattagccgagagcccgagagggacggctgacgataagagttgagtggtgaaagccgggagcctaaagggtcggcttaaaaggacggctgacgactcaattgagggcttgtcggaagcctaaaggggggctggcgacaaagagttgagtgatgaaagccgggagcctgaaagggcggctggcggctgggagaagagtgatgaatggtcgaaagcctgaaatgggcggctgacgactcggtgagggtttgtcgggagcctaaagggcggctggcgacttgagttgagtgatgagtgccggaggcctaagatggtcgtcggacagcgaagggttgagttgccgggagcctaaagggtcggctggcggcagagagaagagtgacggatggtcgaaagtgaattgaagggcgaagggttcgtggtcccgggtcgtggcaccagaaagtttgtcgaggaaggggggacaaactgggggagggattgggtaggaggggattcgagactcgctcacaagagcggcgacgcagattggcgatggagaaggcgagagaaagggtgtgccgctcgttcgattttgggggggtttctcgccgtctgtgtccacatttcccgtgtttcccgacccctacccaaaggcacctctttcaacaacaatttatttgaagcaaaaaaaaaggggggaggaggcggttaggattaaaaaattgacgcagagcaaggcaacggttgaagaaaggagaagtgattatatgatgtggaagtga

SEQ ID NO: 21613 - DNA, 2791 bp, Heterodera glycines
ttgcaggcgacgctgagagtgatgctaaagaggaggaatattctaataagctaattaggtgactaactaaatttttaattaccgtgtcgaataggcaattgtgccgtttcggtcgataaataaatttaaattcggtgcaatcacttcgtggaaacgactggtgcgagaattggcaaaataaaggtcaggcagcctttaatgagcacaaattatgggatgtatttttaattttgaatgttaccaaatgtaatggcgaatttttgggtcattcaaaaggacaaaatcactgtccgaatgggccaatgaggggtcttgccagctcagatagaggtacaaatcggcatcaaaactctgtgaattgctcgggattaatttaatactcgcattaataagtgccaaaatttgccatttccgccgccttaaaattgcccagtgattcgatgtaaatgccacaaaaaacttccagccgttcatttcccaacgaaggcggcaatttcggatttcgctgcagtctttcgcgcaatgaacggcccaaagaaaaagtgctaaattaaaaatttaaaacgaattaattaatctattaaaaaggtaccataaagccaaatgttcgaataaaatgaacagaaaagcataaggaggcaattgcatgagagaatgaagaaaaacaaatgtgaacaaataatacaaaatattatttaattaaataaaatattttttgctaaaaaaataataattttttaaagtttttaaaaaaacttttttttattcgtgccgtttcgtccgaatgcttcagtttatttattccatttttgcatttttgcccgaattttttgaatttctccccggagagaaattttgatggcatttgaaagcccaaactttgaaaaacattgcttttatttttgttgtgtgctcgtaattctgtgggatgtccgtcccatgggattttttttgttggatctttcagagaaaaaaaaacagacgaaatgcacttgccatttgaaaagaaaatttatttagtcgagtaaaatttgagaaaaaaacatttacttttaaaataaattaaatcgaacaaaaaaaagtcaaatagagattaaattgagaaggaattgtcacggaaaattgacaaagcaattttgttttgttttattttaaaaataaaattgaaatcgaaatttttttaatgattttgtgttggcataagcaaaaatattttagttttttgttttaaattattgactttcttttattttctttttcctttacgcccattgtttttgaaggcgccggggcgaaaagaacaaaacaaagcgatgaatccttttgtgccaaaactttgttctcgcaaatttaattatggcacataataataaaacatttttcggctgaaaatacaaataaattaataaattcgaatgtttatttgctcataaatttgttcatgattaaaaaatgctcttatttgttagctatcattttcagcacctcagaaaccctataaaagggggtttaagcattttgagtttgccaatagagaacaaacaatggaaaataaagacggacgctttttaagttcgcagtatttcctttgtttttgcccccgagggaaggtgccaaagctctccaatatctttttaatttctgctcaaaagtccattatggcatttttagacaatatctattaaaaaactactagaattgcaaaaatttcatcggtggcgcttaatatttggcggaaattttcagattttcatgttggccattataggaaaagaaatattgataagttaatgatttgaaattggttttcggattgacataattttttgggttatttttttttttaaagacaaacaaaagttgttcaatgatttggaacatttttatatcgaaaatgagtgaagtgtgaataaaaagaggcttttcttctgttaaaatgcttcttcattcagtggtcgtcgtttcattttcacttcgatggttttttcttttggccaaaagtcactgaaaatgaaagggaaaaaccaccggcggaaaagcaccgatcagaagggggggggggaattgaagtgatcggagagccaaaaacaaacgcatcttttgatcgtccgtccgtccctttcctatgaatttgccagctgaaccaaatcgggcgatttattgccatagctgttatttttaatgtttctgatgatttagaaatgaaaggttgtataaaaaagtcgaattaataaaataaaataatttttattttattcattttaatgtttttatttgtcatccgttttattgcgttttaatgcattttaaattattctgtgtaattcaatgccattgccatttgataggccataaaatattgttaatttttgttcgtttttttgccttttcttcattttatcttttttttcattttccttcaaatgttcgtcccgtggaacgaaaataaaaataaaatgaaaaataaattattcgatgtgagaagggcttcagatttaaagtcataattaattgcatcttttaattagaaattattaattcccctgggcatataaatcaaatacaaattaaaacgggactgataagaatcgccactacagaacagacggactcatcagtaacggacaaacgaatcataacgaatcatcttattttaattggctataaaaatgaattaataattgaattgaacaatcagattaaattaataatttattataataataatttgaccttttattttataattcccaaatataaaatttcattgaaaatttatatttataatttt

SEQ ID NO: 21614 - DNA, 977 bp, Heterodera glycines
  misc_feature (20)..(20): n is a, c, g, or t
ttatcgaaattttaaaattntggaaaaatcgagctcattcgagctctacaataagtccgctggcgaccccctgctccgagcaaactcttacgagctattcgcctggtactgaagtgtccaaaaaaagtgattcttacgttgcctaacctacaggtcaggcctttgatctgatcaaaaattttttgctggcaaagttgtaggccatagttggggcatttcgcttttggggtccgctaagctcagaaagcaaaagcaaaaaatttcgtaacactgagactggcggcaaagtcggtttttgagccgctggtactcagttggcccttggaccggaaaacctatatttttcccggatgcgcctcaaaaagttgtaagacctttccactactttcagggcgctcccggccttcggccgggagattttgtttttgcaaacgaaactccttgtcaatataacatatatagtaattaatcgattttattaataggttcagtaattgtaaaaatttgatttcagcaaaattactgatatttaaaatgattttaaaataacgattccgcaaaatttaattttattatagagctcgggactaaattacatctcttctttttatttatgttaatttcaaaaatttaccctttttgtatttattgtattttatgaaaatttatttctacgaatatattctcacatgtaaatgttttctctctatatatatttttcctttataccttattagcatgttctattttatctttgtttcaatgtactcggaaaagtacccatcctcgacttcgaacttataagttaaatttttagctatttcggtgtcatctgctttttaagtaaaaggtgatattattaatttttatttttacaaagattattttaatttcattataggttctttttgtatattaaaattgttccactaagaacatactaagaattataatatttaaatatttatcatttttat

SEQ ID NO: 21615 - DNA, 1306 bp, Heterodera glycines
  misc_feature (1291)..(1291): n is a, c, g, or t
tactaagtattataatatttaaatatttatcatttttattataaaaaaatcttttttaaataaataatattaacccaaattttttcatttattatgttgttgttgttttataatttttccatagttcagctgattaaatagtttataaagtaatgatttatttattttattcaaagctcggatgaacattcttttcttcgttagaaatattaatttttttattaattatcatatatttgattaattattgttattcgttacaattttataaaattcattttgggctctatttttatacattgtttattagttttatcatgagggttcggaaatagcatggatataaaatctcaaaatattgccataaaatatggagtaaaaatcgcaaaatatggacttatttgaaatatttcaacctagaccttttaatgagatttttctactatttattcaacataaaaactttacaaacatcgcgaaatatgcacatacaaaatgtaaaataagcatattttccaaattgaagaacattttgcataattcttcaaattggataaatttaagctaaaaactctataataggtaaatatgatatgaaaaatttgttaataattaaaaaaaaacaaaattaagaacatttaaagaaattcgaataaaaacgaataatttttgagctcaaaatggcgtctttatataggaatttttgaaaaatgcaacattaaaaatatgcatgttcatttaattgatagcattactaaaattagtcacataaaacggtttaaaaattctaatgttttcattttttattatttgacattttttcaataataaatttttttaaatcattttttttatttgtttcaatgtttaataaaatttttattttgcttatttgatatgacaaaaaatgtactgcaaattctatttttttatttatttattcgtgacttgttcccgtttttaagaagtcttatctaacttattcaatataatatttgtatttattttcttgttttacaataaaatttccagcaccagaaaacaaaaatttaatttattttttgttttattttttcaatattaaaatatattttaagttttatttttttaatatttaaaatcttttattcatatttattaaatattttgattcagttctcagttccagtgccgagtgctttgttatacaatcgaacgtttttacatgtaatattttgctgtttaattcaaaaacgtgttttaatgtatggacagttttataaagggggaaaatgcattttttttcaattgnttattattgcgtttt

SEQ ID NO: 21616 - DNA, 2297 bp, Heterodera glycines
  misc_feature (2260)..(2260): n is a, c, g, or t
agtaccaaaatttcttgggtccagcctgggtttttcctttacctggatttttgtccagagctggttcaacatgaaattaggtccaggcatttttggcttaactgcaatttatgcatccaatgacttttacgcgtccaattaatgatcgtctgtattcaagaacaactttccctttcacctgagcccagagactttcaaactttaaatgttaccatgtatgtaggctttgaccaagtaaaaaatggcctaagaagctaaggatgttcattgattggacgcttaaagtccagtagagctcttagctcttttcaaagtaccgagctctactggttatactcttaaaaatgttccaaaaattcccaatttgtacagtttagttgcaaagtaaattgaagcgtgtaaatatgggtagcgaacgaagcccgacaaattgttcagcaatcgacgattcctcacagtctgtatttgatgaatctgaaatattaccggaaaacacacaaatcaacgtttcggaacgatctctttatgtggccaggtctgttttttggggttttgttgcctttttcgtcctcaatttccctctgtttagctttctttctttctgcactgtcgtccaatattcgctgtatttcgcctccatgtggccctatttcaaagctgtccgtttcctctccctctctctttctctctgtctttgtttatttccccctttctttctttagctcgatagtgaggccgacgaaggcttctccacttacatcgttgctgcttattcgctgggtcagcttatcggctcgccactctttggcttagtgtccaatcgaatgcgcaaagtgtcgtctctttcgctttttgtttttcccttcgaatagtgcccccccccctcccattgtcagattcgttacgtcctttacgttggccttcttctgatgttttttggcaatgccctttacctttctgtccacttttgtcgggaagaacggcagcgaaagtattggttatgggctgcgcgatttgtcacgggcattggctcaggtccgaattcaatttatcaatcccgatgattattcatgcgtcacgacttcgtgtgctttagctaacatttctttgctgaaagcatacgcttcgacagcgagcgtcccggagaatcggtcgaaggcaattgctttaattaccggcggagtggcgttggggcagacgattggaccaggtgaacttttagggagatcaatttggaaaatgacttctttagcattgcaatatctgttcactccctttggttctcatcctggctctgatttgccgttcggtcttaaactttcaaagtgcgtttattcgttccctttttgttatccttttctaaggtacactgctcctgctttcatggcgtgtattatgaatgtcgtcaacgcgttgtgcattaaaacgatggttaaaaactatttaaattgtacgataattcccttcttttttaagttcgttgaaaattacgttggcgttcattcttccgaaagcgaacgaaaacaagtaaaattaccagaacattgagtgaactcacaaatattaccccttttcagaagtcgaatacaaataacgacaaaatgaccaataaaaagtccaaattgcctccgtacgacaaaagggcggcgctgttgtgctacggaacacggttcacgcagatgttcgtcaactccaattttgaagcgtaagcgaattaattgctgggatgggcgggggtaattttaggggtcaattggagacaaaccaattaaaattgctataaaagtgtttgtatcccaatttatcatttcaaattcaaatttttctctgtttgattcgttaagcatcggttctccgttatccatgatgatgttcgcttggacaagtgatcaagtgctcatttacatttcccttgccgtgagtgcttttttcatcggaaggacacttttctcaataacaaatgcttttcagcaaggcattatgtctttgctcgccttcctcacttatttggtgttcatcgttaccaaaatcgacaaaatgtgcgttttccctttcatttctcacttttgcctctttcccttaaggatcaatgatcgtgccaatttgctcgcttctttgtacgtgctcctcatgttcttcttgatcacttattcatatccctttttgccggggaatgttgaaacctttcaccaccaaagtgtcacatttccattttctgttccattttttcattttcagatcactccaatcattctgagcncggttggttgtaacgcggacaaattcgattgggtttg

SEQ ID NO: 21617 - DNA, 746 bp, Heterodera glycines
ttttgaatttggccgaaaaagttttgcgcaaagccaccggaccattcattcacaccaaattgaacactgaagaatttgttcttctgcgcgcaattatttatgctcatatgggcaatgactattggataatttaaattattaaataaattaattaaattatatttattttttctttttttagtttcgcctggattaagtgatcaagcacaaaaaatattgttggccgaagcggagaaattttctacaattttaatcaacattttgcaggtgaagttcttttgaacttttctatgttatgtttaaacataaagagctctcatttgcacttatggtgggtcgaatgattgaaaaattaaaagttgaagacaaacaaaaaatttaaaagcatttaaaattgcaaaatatgtacctaaaagtagtgaaaaggttcaaaataagtgctaaatgccgtaaaacagccaaaataggcgctaaatagtatttctaggtgtacataacttgtctaatttattttaaaattgggcacaaaatcccttttttgtgtcagtcatacatattttttaccgaaaaataattatgatagctccggtttttgagagtgttaataaaatgtccaaaatggttacgccccctcatttgtcagattaattggcataattcttatggcacaacatttagcattttcctcgtcagcggcctcattttcctcccttttggcattttcatatggcatcttagcattcctt

SEQ ID NO: 21618 - DNA, 1168 bp, Heterodera glycines
  misc_feature (23)..(23): n is a, c, g, or t
tgactgacacaaaactaatatcncaatgcattcaacaaaaccttaggcctccatgacacttagttcattatctaaattttgaaaaacaattatatatggaaaaactaaatcacagtctcagccacaaatacaaattttagctcaccttttacataattctgagtacaaaaggcaattactttaacttcttcagaaatgctacaccctatgatgaatggccgaccggcagttagtgtggaatgataatattgccgaagcggtagagcagaaactttaaacttgttgaaatttattttaattaatcacttcaattttggctaaatcagaaaaattagacaaaaaaacaaagatctaataacaattaaacattaagcctaagcagcgcataatatttcacgcaaggaacacaaaaaccaaataaacaaacaaacaaactgaaaaataacaaccactaaatcaaatttaaaaaatatactgataaaaagaaaaacatttttttcgttcacaaaacaaattcatatgttaataacaaatatctttataaaccatgacatatataaaaaaacaaataaaataggtacatttttaagaatgtttattgcaaaacaaattgaaaaatcaaaaccaaaacatttccaattttcaaatgcatttttaacgcaaaacaacaaaacgccacgccaattcaaacgatggcagcatacaaacactcaactttattatataagtgtttaaagacaattctatagtgtttatagtgtttgtacgctcttacttttgcttttagttttttgttttcgaaaattaaagaaaaagcgcttttattttacaataatttttttgcttgaaaaaatcatttaattaattttttcttttggaaaaatctcgtttatatatggcccatttgcaataaaaatttcggcccgaccattccgtaaaaataacaatcaaattttgattaatttttcgaaaaaaatctagtgttttagggcgtttcgttctcgtctcgtattttcttttgtttgtctcgtttttctcgtatttttttttatatttgactttaaatggtttgtaaccattttgcgatttacgaaatatttgaattttccaaaccattttctgtttgaaaagtattttattgaaagggaagtaattactaattagtctt

SEQ ID NO: 21619 - DNA, 2260 bp, Heterodera glycines
aaaagcagttcaattttcaattaattttatttcaatttcttctacatatattttttgtaaagtaaatagtatcaaaattttaatttattttgattacgttaaattactcctaaaaattttttgtttgagacatggacaaattttatttaaaaaattacaaaaatttttgattcctttttaaatgctgccaacataagaaggcctcaaaaaagttgagaattcgcatctgctaaagcctagactggatttgctgcccaaccaaaactggtacaatgatggcttggactaagttatttcggggtggacttgccaagttccttccgcctttgcgcatgggcactggttcactttgtcgtcaattttttttgtgcatggcaatgtcggattgttcgggtcgggagtgccgccaatgcgcatttccacttcggccaacagattgcggatgggccgcagaatttcgacgccctccgccttgattttcacacagcccgggatcaccggattttttggcaccagtcgaattttctccggattaaaccgtatcaacggccggtatttgctcagctcaatgccccttctagagaggtaaactgaacgatgggaggtgatgaggtgaagcatctgatcactgttttagctagattagtgcttgaaaaatgtaaaaaaggcacaattttatttgggttttgcatctttgcaaacctttctgagttttagtgagcaaatagagcttgttaagtaagagccgttaaaagatacgaaaattttggatttgatcaagaaaattaaaataattatggcttttttaaataaataattttccgagtttttcaaagacttattttgctatcaaaaatttgaagctaaagatttttcttcactaccttttcagcacctaagctttgcaaactcataaatgaagcttttacattaaaagaagataattgctcacttggactacacgcgccggaaacccgaatgtccacctcggcacggtcctcggttcgaacatggccacaaaacaaagccaatccgagtgtcacaaagctgtacaacatataccaaccgtaacaacttagcctgatgcttcttcggtcgtctgtcgtaatcttcattatcttttagagtgaatttgatttggtttgctttgcttttctcccaccagcgatcgatcggagcgatttggggtgattttctgggaaggggaagagatgaagggaatgattgaatgtgcgctttttgtgttccgttgttcgggcgagatttgtggtggggagagaggcgcgcttttttgggattttattgctggacgagagtcgcaatgcgcattagggggatatttggttgtgaaatggatataagtgaattctgttgatcccagcgagcgagagttggctgatgcgcgatgaatgcacgagaaaccaaataaatgaattagttgaccaaatgatagtggtggttccgttaattgccggaaatgacaattgcggattaaggcgagagagtgtaattagtgttaattattgataacaatcggatctatagagactgactaaaattattattatttgatctctaaattcttgactgaaatagtcatcgagttcattttgcgggtaattaactcaatcagtggttgccggatcggtggttaccagcaggagatcggctaatgatcaattagtgtatgaaaatgttttttggttgcaaccggatatactggatttgagaaaacgatcaatgcactgacacagatcaacaatcaccacaccattttcacattaccttatccccccacgtttgttctatctctaatgaatccaatattaatattccgtgatccgcccgactggtgctgctgctgatcggacgatgtggaagcgatgaaattcaaccaattgccaccccaattggagacaggatgttgcgcgacacacaaaaaccaccccgctgcgcccgtccgtcagtcgtcaaatgatcaatattcgaaattcccaaatcctcctcgcttccacaatccattcaccaatattcataaattttgaaaaaaaaaaacccgctgatccataacaatttttggtgttataagcaaagcaaaattagttgaaagaatgatgggagcaattgagaagatagaccattaaggatttaggacttgaggtggataaatccggtcataaagaaggacagtagtgctatgtcgttgtttaaaaaaccaacaatatgatttgatgaaaaattatttataacttagctcaaa

SEQ ID NO: 21620 - DNA, 2098 bp, Heterodera glycines
gaaacaaagcaacaaaaacatagttttttgaaaaacaacaacctattgacactttattttaatttcaacaccttatggtttttttcggtttatagcgcatattttcggttttttaatcattttaatagtttttttaagtttttagaacagttcatattttgatttttgcacataaatcgaagttttataaacttaaaattaaattacttaataatgacatccaaaaatgatgtcacttttcttcaaaaatctccttcaatgagcgatatgaagccccttcgacttcgtagaccaagcattgtcagcaccagcagaagcggacttgggaatttgggagtggtaaaatacaaaatattacaaaaaaatatatatttaaaattatttttaatttatttcattatgatattttacctcttcattagagtttcgaatgttgagtctgtcaacataactacaagtataatgtaaggattgttttcagcaatgtttgaaatcccgacaccgaactttttggttattttttagggttatttccgacctcgagactttttttaaagacgggcttctacaaattaaacattaaaatgtttttaaattccttaataattgaaaattaataatgtgaagctttcctttttttaattaaagatttatctatggatctgggattaattacccagtaattagattaagccattaattaatggttattaattacattaagccattaactcgtcatctatcgattgaaccaccggccaatttggctgatgccttgggaatgcacaatccaaattgggctttttatcactacagttcgcccaattatcggtcagcgtggccatggcgaatgttccgtgaccgtttcgatgtaagaagcaattggcaaaaatgcaaaaccaaattaaatgcattttttgacaaaaaatcgtcataattttctcgaaagtaatcaaaaaatcactatatttttctattaacctaataaatttatgaaaataaattattttttattaaaattattttaatttgcttaaatttttaattttactttttactttattaatgaattaattaattaaattacaaattttatatagtgtgaacaaatcatgtacaataagcacttctctgtgcagcccatctacagaaatgtgccattgaatgtgccatcgcacagaacgtaaaaaatatttttaaaaaatgaataaatttcttatttagcaatttttccaaccaccaaagagctgggtattggtcatttgactacgattatatgtaaattatatttataatgaatatttgtttagttaattaattaatggaaccacattaaattaataaaaatttattaacatttttgttttttttgggtttgtaagacatctgtttttttggatttgtaggaactacgataatatgtaaatattgtaaataatatatatatttagtgaagccaatttatatcaattacatttataatttaaattcaaaaaataaaaataaaatttataaaattttacaaatctttttttcatcatccgtttcattcttccgattctccaaattgtttcctccatcttgaaacggtacttggaccaattttcaatgttttggcaatttccttttcactcatttttggattttctcttttcaataaattttcatttgtcccattttttcttcatccgttattcatttacatctttttgtacaattgtgagtttttcttcatcagtttttgatttgtatttttgaagaccaaattctttaatccatttttgaatatattgtcgatttgtccaaatttttttgctatttttacttcaattttactccattcttttgttgaatattttcttcctttttgcttaattttctcttttattttgtagaattttccaataatttatctttttttcttctcatttcgttgttttatatctttttcttcccattttctccaaatatttcatcaaatgttttctgttgcaattttttatccactgattcaacataattaatattaattaagacgatcaaaaaaataattaaagtgaataataggcatagtttcatattaattctttgattggtt

SEQ ID NO: 21621 - DNA, 981 bp, Heterodera glycines
  misc_feature (68)..(68): n is a, c, g, or t
aaagcaaataaataaaataaataaataaaatttaaaaaactctcccaagcaaagtaaattttcgcggnattttcagcccgaccctgcccttttcggcattttggtccaattcttcgagacgcctttgaacctcgaaaaattcaaagaattttctgcaaaagaaggcccactttttgagttcacaaaaaaggtcaaacattctctgggcttgggtggacagaagtgggacgcgcttagggaaaggccgtggcaattgaactttgacactgatcacattttcaacttcaccgccgactcttctgcatacaacggtaggtgggcagaaaatacggtaaaacaatggtgaaatgttacggtaaataaaaaaggaatatgtaaagcatggggaaatgttacgatgagtaaacaaaggaatacggtaaagcaatagtgaaatgaattatggtaaagcattggaaaacgtttcgataaataaaccaacgaatttattaaaaccaattgtatgtatttgtaaattaaatttttattgccttaaggtccatataagcttgaagtggatgacggtttgcaaaacatttacaaatgcatcagctccgataattcttcacttctcaccatttctgccgcgtgcactgaccaaattctgccggaggttttaatgtccgcgaaagcgttgctgaacattgtcaacaaacggaataacaaatcatcaacagaggcaagtcacacagagaggaaggagtagtgaactcgagacggaaaatccaacccaaggcaaaaattcccaaaatttaagacttggtcttgaaaatcttcgtcaagatttcgcaaatttcctcaatatgccaaactttcggctttttcatgactcattgcgtgaaatgcaattgctccccccccccactggccaggggcgtagctagaaacattttcggggggggggcgaccctttttttttgctcttcactcaataattttttt

SEQ ID NO: 21622 - DNA, 812 bp, Heterodera glycines
ccccccccccctagatcgccttgcacctggaagggaggggggggggggggggtgtggagtcacgcagaattttacaagacaaaaaaacagttggtcctcacgcgccccgccccttttttagtcgaattttttatttttgttttactccatttacagatgtacaagcaacacgcgcaagcactgttttccgttttgtcctcctttttgtgcagtgttggcacgaaagggacagaaaaaagtgactgcaaaacgacgcatttggacaatgcaaggcaaatgtacaagcaaatgggggtgagtgagcatcgttcgaaaaggccgatgaattaattggtttcaaataaccattatttttcttgctataaattttttaaaccctataacattgtttaaatagcttaactacattttttatggtattgctggctgaatgtttgccttatagcttcatagtttcaaaaaaaaattagaaaccaaaatgaagttaaaaaacggcgccgccgaatttaacaaataaatccacaaaatagctttctttttacgattgcttcaggtgaccgacgagcagaagattaagtcggatatgcttcttgcgcgtcggacagtgttcaatacgatcattgcgtacaacgacgccaaaactggcgaggcagtgcacgcggcgattgtggcagtccgtgctgtgattagtggcggaggggacgcggcaaacgcggccgtcagctcgagcgagttgaccaacgagtactaatcggttggcaggacgtatactgaagatcagctgacagagcgatcggccgagtgtttgcggt

SEQ ID NO: 21623 - DNA, 2080 bp, Heterodera glycines
actcgtcgctgaaatttcgtcgccattcccaatttttccattcatttaaaataacaattttttttatttggttcgttcttattttgtttaagtattcaaacaattaaggcaaattattttcctaataaaagtcataaaagtccaatatattcctgatcactttgttaattgagcagaattaaacaaataattcaaattttgggattttctatttgcgttgttcttcttccgttgcggcaatttctcgccccgccggtgactgtcgcgcgccgatttttgagccaatttggatcagatgtcttttggcatttgtgtagatcaaaaatgccttagatattccgatggacaattttcggtaaccaaatgcgcagtatttgaacagttccacgcaaataaaataaatgttctgggcgatggagtacagaaccatggacagatctctgagcaactcgaaactgaatacctaaacaatttaattgttttacgaaggattaactcagtttatataaaccgcaagtttggcgggcacggagtgtttgaaaatttgcactgccgtcgatgggtacgactgaacacgctcaacccaagtggcgcgttcccaaaggccaagtccgcgacgttcggcaacctaaaaaatgaaacaatttgttaaatcggcacataaaagcaccttctcacaggtcaacagcctggtgatcagtcgggaataattcgtgttgaattggagcgactctctgtgccaatggttgtcgagagttggcgtacgagcgaaacccttgcggatgagttcggtgttgaggttaacgtgacggatagcatgaaaaggaaggaaattgtttaattcgacattataattttgcaggaatattttaaaaaaacttttttttttttttttctacaactttttttgcggtaacgtccgcttccacaatgtccggttccgtttgtgctaattttatcacagaaaatttcacaaatcgtcctttcaattgcatttccttctgcaaatattcaattccaacaggggataattcaattccagccaagcgaagattcaaatttccaccctaaaacggcaaaataaactgaaaaaaacaatcgacgaacgaaatttaaaaaaaggtttaaaaataactaaatcaagtttatgcaagtggactaagttttctgcagggaaagtttgagcacagcaccaaattaaagaattaaaatgaaaatattttaaatgtataaaatgcaatatgccttaggccccggaattttttcggaagaaaaccggattcggtgaatgtatagtttactggtcccacaaaaagaggctgttttgaacaattctaggatttttactattttttgaaaaatgtaaaggcggcaaagcacacacactataattataaccgtttagtcaaccactaaactattctttaaaaaattcttaccactttcgattttttggtaccaaaaagtctaggaatacgaattgctggtcgatgttccactttgattatgccatttgactccaaatcgcgcacaattcctttcataattattcctttctgataataatcttgcggtatttgcttcacgtggttaaaagctgcaaactaaatttttaaaaaaataatgcatagaaaaactgcttacctaacttattgcatttcaaaaaacttgttgaagaatacctaccaattttgaatttcgaatgaaaagtcctaatccaagcgcacccgttccaactatcagcccctaaatgaatagcctatttattagaggtttgtaagcattaacattgaggattaacttacacgaactattaatgctgaataacgatcgaccgggtcaaccattctcaatcgagtcgcatcatcggcggaagtgatgccatcatttgcatttgttgaaggcattgggtttttaaaaagtgcaattttaaagtacctacgtttaaaataaataaaggtaaactcaatataaaatttaattttggatgattgatgaataggattagtagggctggcaaaaatatgcacatgcatctgggagggctggactgtgggaggcctgaaacgcacgaaaacca

SEQ ID NO: 21624 - DNA, 2174 bp, Heterodera glycines
  misc_feature (17)..(18): n is a, c, g, or t
  misc_feature (31)..(31): n is a, c, g, or t
tcacggaaaatgcattnnagagttctgtgcnagtgagtatttcttttaatcattttaatttttgaaatattcaaaaaataataaacattttccaaaatccattaaaaacaaacataatatgaatggattactgtaggtttatgaccatttaaaatcagcttaaatttaaagtcagcatataataaaccatttcgtttttcatgaaaattctgattcgctgacgcattttccattgatccattttccatccgtttttactcaactcttcaccgcacacaaccatcaaatttacttctggtaaagttttctccccttttcttttgcagcaaaaatattctacctgttcagaaattgtttttgggaccattccttcggtgtccaagatgtacaagtatttcgcgtcatcatcaaacgacgcggacacatcgcgatcgtgccgccggcggtgtttcgtcccgcgtctctgcctctttgcatgtccactgctttttcatggtcctcgggggtgtcaaaaaattccggtggtggtattggtgcccctccgctgctgccctccccggatggcatttgtgctgaatcgtcggtgctcattctgtcggaaacttcaaaaaaatgcttaattttcttagaggaatttggaccaattttcgacaattccaaagtcactatatgcttgtggcttgtttaaaacacatttaataaacagcatttattacagtatttaagacaaaaataaccgcaatattttgctaaatgaatatgcatagaaattgacattcatcaatcacatcatcatcaatcatcgtcggttcgtcccttcattgggcatcctttcccttgcgccatccagctttggctgcgtaaatgtgatccgtcattttcttgcaattttccttgaagctctcttcctcatcaatgcgtccatcgctgcagcacaccacccgtccctcactgtgctggccaaacgatgcgtaaaacactgcttggccgtagaatgggtagaagcaattgttctcggcaaagtaggcgttctgctccagccagcttcgcttgttcaactaaaatatgaaaattcaaaaaaaaatattttttttttccaaaaaatgtcatcattattcgtcgtaattcattttatttaccacgccattcgtttggtcgatcatctccggttggcattttgtggtttgttgggtcccattgttgaagccacggttgtgttcacggatgtcacggacgaagcaagcgcgcagatagcgaagcatccgatgcaatttgatgtccttggaaaatgagacacgctgcaacatgaacggaatgtccgaacggcagccttgctgtagcaaaaaaatgggacaaaatcaaaattgtttaacagtatagcaacataattatatatggggttctaactaatgcattcccggggctcgaaattggtcgaaatggatgcccgtgattagggaccccgaaaaccctcggaaataagttttcatgacttttaagtctgaagaagttagacggatttaatgcctttgaatgataccaaaattgtagctaaatagctgtattaacacatgaaacaaagtcacaacggtcaacaaaacccaaagtaatttgactcataacaaaaatgattggactcttttgcgattggattaattgagagtgcattcattcattagtcagtcattagaggagcaacaaaaacaaaaagcacacagcaccagagcagcattgagaccgacgagatgggagctgctgctccggcttctgtccacactcaacattcgattcgggaagaagttgctgtcgctgtctttcggtggatacatgaagaaacagcctggaaagagggggaacataaatatttaattaggtaatagtgatgttgaaatgaaagcaccagggtttgaacagttcttcatcccatgcttgttgtcatcggacaacatgcgcagatcccggtacaaattgatggtgatccgacattccgtgcggtgatgacggtggtcgtccgttgatccgtgctcgtcatgctgagccgtgccgccgatgaagaaaacgggcgtgaacataaggagaagaagaaaacggacattggccatagcttttatgtgaactgtaaaaagaggcacaaaacattattaatttgacgaaatttaatgagatgaaaatga

SEQ ID NO: 21625 - DNA, 1835 bp, Heterodera glycines
ttcgaattactcccgctcccgcccgggactcccgttccccccggatgggattttaacgggagcgggatttttacgggaatcccgttcgggactcccgtcccggaaaattttgaactcccgatcccgctcccggaaatttttttttaccgtactctagtatttagggagttagagttaagtaagtaaaaatggtcattttagaggtaggtatttttgatggctgatttaaagaaaaataaaagagatacagatccagagaaatagtgattaaatagagcaaagttaggactataagaacacaaaaatataaaattttaattacaaaaattgaattattggagagccgagactgaaaggggtctccaaaaacggcatttttcaagaccaccaagtaacataatgttttaaaagtggttttggaaattctgaatttaattaaacaaggtaaatcgggtatgttgagttcgaatatggtcttagatttggtctctgggatcgcaacaaacctgtatctcgaacttcatgcatggagttgagcagtacaagctcaggtttaaaagataggtcccgtttaaggccatattcgaattctactggtctaaattgtatagaaaaactaagattttgttatatcagctttggtttttgaccataaaaaattcgagaaaaattagtgggccaattttcaattttggcatggtcgggaaaaaatgcagaaaaatgtatcaatcaaataaaaagtgaaacgatagtaagatataaaagagggcaccatgaagaacaaaataaaaaaagaatcatttaaataggcgcagaaataacggagttttgaatttttaaaaattggaaaaaatttgggtatcaaaaattatgttccaccctaagtatatactttgaatcacatttaaaatatcaaaatcaaatttattagacattttgttatcaaataaatatatacattttaaaatgataattaaaaaaaaatttatttttaagttaaataaaaataatgaaaaaaatcattaaataaagtaattttcaagtggacccatattcaatttttgtcaactgcgagagaatgcgaaaatttaaacgtttagagattaaaaaaaaacaataaatttataatcaaaataaatacagcaataaacttactattttacaaactaagtataaaataaaaataatagttcttcaacggaattaacaaaaatagagaattggtgcaatgacctgctgctggggaattacatcagtaataaaatagagtccggactttaaggcaaaaaaaaaattttcaaataggcacctaaaatgaaagacaaatataatagtactcacaatttctctagcttttataatgttgcattaataatacaagcatacatatgcaaaaactaaatatagcttctgaattaaatatgaacataacaagattttcttcaaatcactacatgtaatctggacagtataaaaatgaaaatgaaaactttatcaaatttaaatggtaaactaataaaaattaaagaaaaatttattgtgacattaattaaaaacaaatttataaaaaaaacatttgaaaggttattgaaaagggttaattgaaaaaattcttattcatttcagaatatctcgacaaaaaaagaacggtgtaaatttcgcccaatttattccattacttgaaatcactcttaaaagtaaaagcattcataaagttttacatctccccattaaagtaaataaaaaaaactttgtaattgatattgaaatcaagcaacatttacatgatttaattaatgaattaattaataaaaattaaatttaaaaaattaata

SEQ ID NO: 21626 - DNA, 2041 bp, Heterodera glycines
gcttaagcccaaaggtaaacgcttcgttttttaatcatttttataacgaatataagccattttaattgtgtcattatttattttttctaattgatccatcaaattgatttatttatcgataattgcagagatggaaatttacaaaagcctctcattttagaaaattaattcacataacgtccaacagatgactaattttgtgatttttagctgtaatttcttaaaataaaatgaaatttttccaatttgtttaacaaatttactttccaagaattataaattttaagtatgagaaagccttaaaaaacgaaaaattccgatcattgcctcatttttcattactacgtcggtatatgcctcttgaataattcatagccggaaatactaaaaagcaataatttgaaatgccaaaaattgtccaaaatatggatattttttaaactttctcacaatcaatgatccttttatatgaaattttatagaaattttgttttaaataaatttgaaaattttttatttcggcgaaatttttcatttttaaattttttagcatagtttttttgttcaaaagtcactcttttgcgaaaattgggttgataaaatgtgtttaagtgcctaaaacttacctgaaaaaaacaaacaataaatcccagccatggctataagatttcactaattatttattaatttacctataaatttttactgaaataaaattgaaatgatgatttatgcatatgcaatttcttttgttattcatcatttcttattgtcattttcaaatgcagtgccatcagtgagtttctcaacagaagtaattaattggggtaattaactcatgctaattaggttgacgacagcgcactaattgcatttatgaaaagcgatcaaaaaggaagtcaaaccaatgactataaatattcaatccaaaaatatgaggcccatcttggcattctgcattttatggtgaagaattggcactgtgacaaaatgggagaccaatttgagggtatgggacaactcagtctaatgccaactccgtcccaatgcttatggcaaacattgaaatatttaaaattttgtttttaacattactatttaatagtgatgctcgagagtcttggcttcgagaaaccatcgggttttttgggtcacggcttcgagtctcggggtcgactctgttcggtctcgagcatgactattatttaaacatatttttggaggaaaattaaattcaagaaattttaaaaatttatatttaaaaataaaggcattcttaaaataatttttacaactttgcatttttgcccgccaaaaattctcaaaaatagcattttttttttgcataattttacaaaaaattttcccaggacccacagtacaaaatttttcaagagcgagactttcaaggacgcggaaaacgcgtccttatatattttgggatggtcttgaccagactgaggtgacccaacttgggaatttggagactttgaacggacagaatgccacaaatatcgccaacttttggaccttttgtacgaatatttgtaccgagaatattttgacggattgccaacagtgagaccaaaatttgtacttaaaaagcgacgagaacaatttgaaattgaagccccattaatttatgtggtgaattgcatggccagaatctcgagattttatttcaattcaaattgggccgagaattctgaatggaaattaaatgtatttttcaaatggggcaattttgacccaattttattgaatggggataaaatgaattatttttattttaatcgatcggcaaaattggacgacgacaaaatgaaagtgccaaaattggaggaggacaaaaagaaagtgccaagatgggaggaggacaaaatgaaaatgccaaaggacgacgacaaaatgaaagtgccaaagttggatggggacaaaatgaaaatgccaattaatgaacggattttgcagttggcaattgatgtggccaatcatgatcagacaaatgaaagtgtggacgaaataatgcggaaaaaattag

SEQ ID NO: 21627 - DNA, 2291 bp, Heterodera glycines
  misc_feature (1013)..(1013): n is a, c, g, or t
  misc_feature (1022)..(1022): n is a, c, g, or t
tgaacttggcctgtgtgtcctgcaccaccaaaaccgacccttcaccatcggtgttcgcctcgcccacgtcgccgcacacaattttcacggggttgaacagcgcatggaacaccaacttttcgatcttgctcttcattgttgcactgaagtggtcaagaaaataacatttattatttaatttgtatcagttttctaacaaattgcaatgcaaatttggcttttcctgtggtgcctattagcaccccgcccgagctcacaattcgcgctctaattcccaaataaagattacataatgaatattctcactgtaaagcttctagaaaacaaggggataaagtaagtcacaaccaaatctttaaaaaaatagccgccaataacagcagaaacccaattaatacaagaaccaatccacccacctaaacacaaggcattgccgatcaggccgaatatgttccgaaattgacttcacttgcggctcttaaatgaaataaaatagaaaagcatgaaaatatgagaccgaccaaagcccaaatcgaacattcggtcgacttcgtcaaagacgagaaaagttgtacggagcaaattagtcgcctcaatttttaccaggtcaatgatacggccgggcgtacaaatgcaactgaacaaaaaaagcaaggcaattaggaaaagcaattagtaattgaaaatgaaaggaaataaaatgaaaaaacattaaattcaaaaataatgtaattaattttacagctctgctccctgctccagcgccttctgttgctcatatttcgagccaccgccgtaggcgcaaacaacagaaatgttgtacggcacgcagaatttacgcgcctcgttgtaaaccttaaattaatttttaaagaatgaaatggtgggcaatttttgaaaaattttaatcaagttttttcttaataaaatacattaaaatttcaaaaattattaccggcggacggcaccgccgggcctccattttaccatttttaacaccaaaatggcaaaanttagttttntttttttttttggcgaaaaacggctacaaattcttgttggttttttttgctctcaggcactgaaattttaatataatactggagaaaattgtccctttccgagatttttttaagttatgggcttgttcagactacgattcccgaaaatgaatgaattagcgacctgaatggccaattcccgagttggcacaaccaccaaagcgatgggaccgtcgttgggacaaagttcaggttgttccaaaatgtggcaaattactggcctaaaccgtatgaattgattactgtatgctttccaccggttaccaaatgtatgcgagcgttttgccgctgcccgttttggccaggcccaacacgtcacgtccggcgagtgcggctggcacagcctaaacatttcaaattgcctacaataccattgaaactgtgatgtttacggtatgacctgtgcttgaatttgtgtcggcttctcaaacgaagccttgcatattgacgacatcagcactttgtcgaattggaaatgcgcaaaactgacgacaggtttgggcggatcattgccgtagactcggatctgacaatggatgtaaaaatgtgccaagaaattggcaccaggatttgtagtcagaacaaatgattacgtaattcccccgcaaaaatatttaattttaaaaataattcgaggggggggggagtacaactgacatcaagcgcaattctcagttcgaacacgtcctttggactgagtgcctttatttcgccgtgttccacataaaaattcttgttgaatggcttgtacctaaaattacacaactcataaaaatgggacaaacacacaaatgttggcattatttgcactcattggctgacttactcaatgttagcatggtcaattggcggcaatgggtcgatgatcttaattcatttgaagactttagagaaaaaggaaaattctaggaagatttatgatccctggtctcgacttttcgggaatagctagtccacccctggccattcaaaatgttcttcgatcttctctggtcctagtcaattgtaagaccttcttccatgtccaaatgatgttcccgtcctcgtcatattcgtacacttcgccgtcctcttcctcgtgccgtttggcatattcgtccataaacctggacatttggtggaaccatcaagcagcagaaccaacaaacaaaatgggcacaaggttgcgaaaatgatatgaccaaccaaatcgattgactctgaaaaatttagaaatcagtcaaaaataaa

SEQ ID NO: 21628 - DNA, 1012 bp, Heterodera glycines
  misc_feature (15)..(15): n is a, c, g, or t
aaattcatccaatcnaatggacaatgctaggctcgctcaggtattccaaaataaagcagaaaagagttattcagtttggcaatttatgggtccccagagaataattttcagaaagtatggaaaagcgcttaaggaaaattcatccaaatcagtggaaaaagattcctaggctcgctcaggtaattccaaaataaagcagaaaaaagttatttttggcaatttatgggtccccagagaataattttcagaaagtatggaaaagcgcttaaggaaaattcatccaaatcagtggaaaaagattcctaggctcgctcaggtaattccaaaataaagcagaaaaaagttatttttggcaatttatgggtccccagagaataattttcagaaagtatggaaaagcgcttaaggaaaattcatccaaatcagtggaaaaagattcctaggctcgctcaggtaattccaaaataaagcagaaaaaagttatttttggcaatttatgggtccccagagaataattttcagaaagtatggaaaagcgcttaaggaaaattcatccaaatcagtggaaaaagattcctaggctcgctcaggtaattccaaaataaagcagaaaaaagttatttttggcaatttatgggtccccagagaataattttcagaaagtatggaaaagcgcttaaggaaaattcatccaaatcagtggaaaaagattcctaggctcgctcaggtaattccaaaataaagcagaaaaaagttatttttggcaatttatgggtccccagagaataattttcagaaagtatggaaaagcgcttaaggaaaattcatccaaatcagtggaaaaagattcctaggctcgctcaggtaattccaaaataaagcagaaaaaagttatttttggcaatttatgggtccccagagaataattttcagaaagtatggaaaagcgcttatggaaaattcatccaaatcagtggaaaaagattcctaggctcgctcaggtaatttcaaa

SEQ ID NO: 21629 - DNA, 2170 bp, Heterodera glycines
aaagggatggaaaaaccaatgaattacatacgacaatcgttttcgtttcttcgagactcttaaacgagcaacgaataacaaagtaatgaagcacaatccgaccgaacgcttcgcaccgacaatgatcaacaaacaacccattctcacatcagtactcgctgaggtcgatctcgtctactccgttctcgagctcatccaactgcggaatgtccaccgaataacgaaggacaccttggacaaagaaaagagtaatttaaataatttcaattcattaagtgataatcgtcgttgtttttgctggccataatttgcagtttcaagtttcaactaacctccaagtcctccaaaaccgcgtacaaactgcgctccttcctgcgatttgtcggtgacaatttcaagtgccgcaccgaatcgtttgtaattgttagcgagccattccaataatggcgtgctggactcaatctcgtagtcagttccagtctgaaacaggtgacattcaacagtaacaatagattgttttttatttttctgctaaatgagaatataaatttggatgggtgaattacctccgggtccacaaagttcgaccggtccttctcgtcgggcttcagattaacgactttttcaccattggttgttcggaatgcgtatctgtttatgggtttgttacgctattctacttgcacttctcattgacagaacctaccttatcagatccaaattctcccaacaaatcagagtttcgatggcgcccatttccaatggctgtcagtgtttcttttaccccgtaaattgccttgttagtgtcttgggaaatctcgtcgaaaaaggcgctgatcagtttcttctccttgatgaatttaacatccgccaaagcatcggctgccaaatctatcgcttggttgaacccgttttcaccaccgtatgatatgtcgacagttttgattatttttgcctgtaattaaacaaattggaaacaaattatcccaaattttacctgtaatcgttggtcaaacattgtcggactggggcgagttcattcttaaaatcagcacttccggccaggacgaggcccaccaccgcgacttttgtcgtttttgatgaacatttcaacggccgtctccgccacttttctgacgtaattgtgtcgcttttccatgcgcaaccttgcaaatcgcagtgcagattgccctccccttccatgcttcttaggtaattcgacagagaatttgtgtagcacctccctggcatttccttgcaaagtcacaaaaagtgatccgtttccgtccatcacaataaacccgaatttgttgtcgtcagcgagtagtgctaaactttatattaatattggtttaggaggaatttgaattgccattcaatgcttcagtgtggaatttgttgtcgcatagataaagtgatgtgttcactgctttgaagggttcaaaatcgatgttcactttcttttcctttccgtcctctgtgacaatcgttccacaataaacaaccaatccattctcgggcacttaacgaatttgttaaacaaaacaaaaaaaaaatccagagaattcttcctaatccaaagttacctcttgtataaagctttaacctcgcctggactgaagtgattgcccccaaaacagagagtctgttgactcgcgactttatgttggacgctgttccaaattcgtctccaagcattttctggatacgagcaatttggtctcttggcggaatgatcagggaaatcatcgaagtaccatttctgtaagataaaataaaattagtaaggcctaaatggtattaggtaataccctttggccatttcaagtgactttataagacgcttgattttccagagctcaacattgtgatcggcttcaccttcggaagaagccattcaaataaaaagttggaagaactaatatcaaatttgtgaggttttaacagaaatacttgttccttaaaattaaattaaaactttcaaaagaaaacagagaaatcaataaaaaaaattctttatcaggggttggggtcaattccctcgtgtccggtaatcccgacactgggtaatttcgacactgagtaatttcgacactgaactattttcaaaactttcactgttttacttcattttcgacactgagttggacactgagtaatttcgacacta

SEQ ID NO: 21630 - DNA, 2074 bp, Heterodera glycines
tacagttatggggaaaaaagctccgaattgtctttgatgcctcttcgcacgaaaagggagcccggtcactaaatgacaccttattttctggtccaaatttatacccggacttggccgggaaactcatacaattcagggccactaaatttccaatttgggctgatattgaaaaggcctttttaatgatcagcctgagagaatctgatcgggagttttcgaaatttctgtgggtcaaggacataaaagctccactctcgggtaaaaatatcatagtttttcgttttaaacgaattacgttcgggatagtttcatgtccgcttttgctggccgcaacactcaaatatcatttggacacgcaccctagcagtctcgccagggaaatagtcgcgaagtcattattatacgtagataacctgctcttgttggcagacacgcatgaggaagctcgcagcaaggccatcgaagcgcaaacaattttcgccgcggctaaaatgcgtttatgcgaattcatcgcagcggttccgattagtcttgtcggtatacccgaaaaggaccggcttgaaaccgagactccgaatgttctcggaatgaaatgggttattaatgaggacaatttatcgctgtctttccctccggttcccggtcctgaagggctaacacggagggtggttctaaagacaattgcttctttttttgaccctttgggtttatgctccccgtgtctcgtggggcccaaaatgttcttccaaaaattatggaatgaatcccagggatgtgatgatctaattccgattgctgaatgtacggaattgatgaaaatccaaaaacattgggatagtgaaatcttatcaatcccacgtcacactcgccgagtaggcagcaattcgttgcagttacacgctttttccgacgcatcgcccgaagcttttgcatgtgccgtctaaattagggcagaaatgcaaaataagaatgttgtgtcgatggtgtactcccgttcgcgaattcgtccaaagaaaatggcgactagtcaatcggatggtctaaccatcccacgtttagagctccttggaatcctaatcggaacccgagcaattaaattttgtgaaaaaacacttaaattacgacatcaaaaaatgctttctttggtcagactctcgcatagcactttcttggttggcttcaaccgataaaatgccaatttttgttgcaaaccgggttagagaaattcgttccaatcggctggtcactttcagctatgttcggtcggcggataaccccgcggatttggcgactcgccaaacaacgcccgcagagctgaaaaacgccattctatggtggaatgggccagaatggctgtccaaatccaatgaattttggcctaaagagtatacagtgcaacttccgcccgagcgaaaattgctgggagcggcgatgtatgtcctgcggtttctgtcaatcatgggagaaaaaagaagactatttacggaatttcgggaaaaatcttttttgagccccgaaaacaaagaaaaggcccggatttggattcttaagatcgctcagagggctattagccccccgaagagacttatctggataaaactggtctcctccgtctcaaatcgaggctgtgcggtgcaggaaacgtcgatttcgagcacccagtcatcatcccgtccgattcatggatttgcacgttgctcattcgacactcacatttgagcttgtgtcatgctggaatagattcaacgctgaccgcctttttagcaaattactggtgtaagcgggccagacgaacggtccgttccgttatcctcgcatgcaatacctgtaaaagggacagggcggtcaaatttgggcttccgtccatgcccccactcccacaatcccggactcgcccgtccgcggtttttgaaaatatcggtatcgattttttgggcccaactctttacaaaataccaaacgagcaaccggccaagtcatgggttctcttaattacctgtttggcctgccgagcagttcatcttgagctcgtctcatcaaaggcagcggagcactttttgctcgcatttcgacg

SEQ ID NO: 21631 - DNA, 1843 bp, Heterodera glycines
agagtccacttcgccagaaaaagggatatttgtccactatatgatgctaagatgatgacgtcatcactgcgaggggtactgtagtcctgctgaaattcgcaataaattagctgcaggcaagcggcctcgaacttttgctctgccaccaaacccaacacactaccactctgccacgagaccagttgccagaaaaaggataattgtccactatatgctgcaaagatgatgacgtcatcactgcgaggggtactgtagtcctgctgaaattcgcaataaattagctgcaggcaagcggcctcgaacttttggtatgccaccaaacccaacacactaccactctgccacgagaccagttgccagaaaaaggataattgtccactatatgctgcaaagatgatgacgtcaccactgagaggggtactgtagtccggtgaaaaatcgcaataaatgtgccgcaggcaagtggacttgaacattgacatgccaacaacaaccactctgccatgtgtacatttgccagaaaaaggataattgtcaactatatgctgcaaagatgatgacgtcaccactgcgaggggtacggtagtccggtgaaaaatcgcaataaattagccgcaggcaagtggattgaaaaatcgcaataaattagccgcaggcaagtggattcaaacttttggtctgccaccaaacccaacacacaaccactctgccacgcgaccagttgccagaaaaaggataattgtccactatatgctgcaaagagtgtgacgtaaccactgcgaggggtacggtagtccagggaaaatcgcaataaataagccgcaggcaaaaggactcaaacttttggtctgccaccaaacccaacacactaccactctgccacgagaccagttgccagaaaaaggataattgtccactatatgctgcaaatatgatgacgtcaccactgcgagggatactgtagtccggtgaaaattcgcaataaataatccgctgtcaagcggattcgaacttttgctctgccaccaaatccaacacactaccactctgccacgcaaccacttgccagaaaaagaataattgtccactatatgcttcaaagataatgacgtcaccactgcgaggggtacggtagtccggtgaaaatcgcaataaatgtgccgcaggcaagtggacttgaacattgacatgccaacaaattccactctgccgtgtgtacatttgtcagaaaaagaatattgtctatgacgacaccactgcgagggggtttgtagtccggtgaaatccttctcactgctaaaatgtctggacaaaatgctaaaaactttgtaaatacgaaaaaaagtattcaaaagttgatcaacaaatattatgaaaaattgatgaactaaatggattcgttgattttctttgaaattgggtctatgctttttttggatgcatgcctttgatgtggcgacgcatcagatgaaaacaatttgttaaaatagtagttagtgtctacaaatccgccggattacggtagcctcccatacctatgggaggggtgcacggccaactgagcgccagccaggtgagcgccgccgggtgagcgcgggccatctgagcgccaaaatttttcagtactgaagcctaaacctattgcgcgacttttttttgaaacccaaacctattgaaggggggggggcgcgactttttttctgcaagcctaaacctattgcaggggtgcgcgactttttttgtttgtaaaattttttctgaaaattatttattattatttttatttttaaataatattttttatttttttcaaattttttaatggaaaaattctgccgcaggc

SEQ ID NO: 21632 - DNA, 1909 bp, Heterodera glycines
  misc_feature (1891)..(1891): n is a, c, g, or t
agtattcctaaatccttttcaattaatgatttttggaattttaaggaaaaataaccagtagcaattgctgtgcatttattttgtttcgaaacggatgtcaaattcttagtcaacgaccccgaaaacctaaggaacctgttctacccgactctttataaattataattttttcaaaaaaattatgggggacaaaccatataagagccgaaaagatttgctataaataatgaaaaaggtgagatcgccgtcatcactttcttttcgcttctttctcatcgccgtcgttttatcttctcaaaatggaattgtccactcataaacttttgttgcttcctccgtccctttccctcctcgtcgttttctttttccccaattgaccgtttccacgccaattcaaattccgcttttccaaaatcgtaaaattcgcgttccatccgataaactttatgctgcttgaatttgcgcaatgtttcaatggttggcggaaacttccgaagagtgtgccgcaaagattttctgtcctcttaaaaatttaatgtttaattgcgctaaggcagagacatccgggaataataaataattgtcgtcctgagacaccttacttttctatgtctcaaaatcataaaacatttttggcattttttgtcgaaatttaagtagatttttattggccataattttcaatagagagcatgtacgggccgggcccgtatacggatttttacgggcccgtaacccgtatttttttcggctgatacgggttaagggttttacgggtttttagcccgtaacccgtatcggtgtcaaacccgtaacccttacccttatccgtacaattacgatacgggttattttattgggttgtttaataaatgaatagaaagaggaagagaaagggaagagtttttaagtggtcatattaaaagttagagtttaatgaaaaaattaattgaattccatgccaaaaaatccattgccatcttataaaggtttttggcgcgtagcgccctctagagacagtgtttaatagcgaagctatttcaattttaaaaaataaatttaaatcagttactttcagtgcccgtagggcactggttacaaatattaatttattatctcgttctggtcaaaactattgttaaatgttcgtaataaaatttagaacaaatctatattggtattttagtaaaaaaaaacttgttttttctttataaaaaatattttcaaaaaacccttacccgtatacgggcccgtatttttcctggatacgggtttttacggactacgggttttacgggtttttagcccgtaacccgtattggtgtcaagcccgtaacccttacccttatccgtattttctcaaaatcacgctctctaattttcaaccaaaaaatcatttttggcaaaaaatcgggactaaaaaataattcacatttaaccataaattttcgtatcttacaaattaacggaataattaacaatggaattggtccaacaaatattatgagggaatatgtaaaaaaagacaccgtttagcaagcggaaatgttcgccggcgccaaggaaaaaggcgggcaaaagttgctccagcaaaaggacggtctcttcgatgcgttccgtcagcccaaccaacagaaaatggtcccgcaaattgcgctttgccaactgaagggcctgcgcattgccgggaatacttaaaaagggaagaaaagtgaggaaatcagaaaaaaagaagtcgtaaagcctattaaacaattagttagtgagtgacaaataatggaaaaagggggggggggtaaattccgtattttgggtgaaaaagcccaaaattcagcatttttcagaaatgtaaaaaataaaaatcaaattttgtgccttgtaaaaacctaanttgctccattttttgaga

SEQ ID NO: 21633 - DNA, 1471 bp, Heterodera glycines
aaaatttacttttcttgacaaaaatttttaattttaaaaatttttttaggcatctattttgggttttttggtcttaaaaatcccagtcctactcatttgcaactgcaaatagtgaataaaaattatttttgctcattttggatgaaaattatgtcactattcgtcactattttggacttttttcactattttgtcactattttggcactttttcgtcactattttagttaactatttcgggatttttcgtcactaaaagttgctgccctaataataattatcttttaatatagaatttcatattttttttaaattgaatttataaaaattaatttcatattaatttaaatatcaaattcttgtacatttcaaaattctctttttaattaataaaaggaataattaattttattttttaaaatttataataaattgcattcaatttttgtacctcttctaatcaccgtcgtaccttttataatcatttttgtacctcttctaatcatttttgtaactcttctaatcacttttgacctcttctaatcactgttgtacctcttcaaatcactgttgtacctcttctaatcactgttcttcctcttttaatcactgttgtacctcttctcatcactgttgtacctcttctattcacagttgtacctcttctaatcactgttcttcctcttttaatcactattgtacctcttttaatcacttttgtacctcttctaatcacttttgtatctgttctaaaatttaaaaaacggccgcgaagcggccgaaaagaacaacaaaaattagaaacgggcgtgaagcgcccgtctgagtcgatcaaaatttaataacggccgcgaagcggccgtcaaagcccaacaaagtttaaaaacgggcgcgaagcgcccgtccaaggccaacaaaatttgaaaaacgggcgcgaagcgcccgtccaaggccaacaaaaattgaaaaacgggcgcgaagcgcctaacaagctaaaaaacgggagctaagcgcccgtataagttcaacagatttaaaaaacaggcgcgaagcgcccgtccaaggccaacaaaaattgaaaaacgggcgcgaagcgcctaacaagctaaaaaacgggagctaagcgcccgtgtaagttcaacagatttaaaaaacgggcgcgaagcgcccgtcttgagcctcgatgtggactaaaagcctctaataattttttaaaaattcaaaaaaaaaatctccaaccaattcgatcaatttgaatcgcttcacagtctaggtagcgaagctcaagaagcgcgaagcgctttatcccaagcccatagccgacggttcacgcacccgctagtttatatatatgttatatagactaggagtttcgttagcgagaactacatctcccggccgaaggacgggagcgacctgaaagtagagtaaggatctgaagactatttgaggcgcatctgggaaaactata

SEQ ID NO: 21634 - DNA, 1658 bp, Heterodera glycines
  misc_feature (27)..(27): n is a, c, g, or t
  misc_feature (110)..(110): n is a, c, g, or t
  misc_feature (135)..(135): n is a, c, g, or t
gcgccgcattcgtgacgtcatcctcgnccttgaccaattgttcaccgatctcatagacttgacgacccgctcaatgcccaagcggcgcagcagtggcaaaccaacaaagntgaatgaaaaatgccaaaaaaagcnagtgataaatgaatcgttcaggatggatttgcccaaaaagtcaaggaatacatgaccaaatactgcccaagaaactgacaaaaagacggagaaagggaaaagacgggcgataaattggcaaggattctttaatgatggacggatttgactaaagtttgttttgatcggacattatttcaactcgtttacatttgatcgttgttataaattttctattcttttttcccatcatttgtcctcaatttgctactgacccttcctttacccctcgatcctaaaagagaagtctaaattttggatgccattttatagtaaaatgcgagtgaacatgaaatttaaatttatgtaggcaaaagaaaaaaaataagagatctgtaaaaagtgaaaaaacaacaaaattcactgcgaattctggtttcattgttcgtgcaatgcgcggatttgctcggaaagctcagcgagttcgtccaaattttgtgtgtcttcgcataaggcagccattttggccattgaaaaggcaatcttaaaacagtctatgcccagaaacaaatgggtaaaagaccaatttcttgcgtttgtcctcctcctcctcggacatctttctcaaagttcgtttggcctctccgaattgcccctcggcaatttgtcggatccaattgatctcttggcgatgcgaaagaaagtcactgatccttttgccacgttcagctaacaaatggttgaacattccttaagaagaacaaatgtggggatgcgtaacaacaacaggtctggagaaatacctttttgttggtaccaggtgtaaaggaaattgtgaaacctaaaaagggatttgaatttattatggaacatccgataaattgtgggtcacacccgtccttttcgtactgttccttataccgctccaatgtcttggcacattgttgtttgtccaattggttgtggcagtatacgatcaacattgtgaaatcctacaaagagcactcattggacaaccatagtcaagggaatgtcactttgtatctttcgcccaagctaagtgccacgtccattttgccaagggacgaaaatcgggcgatgattttcgagtcattccgttgtgctggcgactgttgcgacaacacaaagtcagcaagctggaaagaggaaaattttcattaatccattggttggaattgcctgaacgcattgcttgaaaatcacagagttttgcggttgcgaaagattcacaacggcactttccgcatggtcatcagttgtggctcggtttgttgtcgactggagaaagtgcaaagcggaattcaacttaaaatttaaaattatttcaatgtttcacttcaaataaaattgaatgggaaaatatattctctataaacggttttttgaaaaaggcctgaacctgggcctagactccatgttagacctgtattcatacatggacaaaaatcaatgaaaacccaggttgccggaaattgcctgaatctggatcatacctgtgcaagggggtagtcgggggggggggg

SEQ ID NO: 21635 - DNA, 788 bp, Heterodera glycines
ttcgactcaaaatccaaatcgactattttttgaaaagatctttaaatattataataattcattattttcgaagacattctataaatatttaaaatgattttttggaaacaaataatttaaaaattaaaatttccccagtaaattgtaatataataataaaaattttctaatctttaacttctttatttttttgttaaagttttttcctaaaatattttttggtttgtatcaaatccaccaaaaaacttagactcgttcttggcttttctggacccggaaatacccggatccggtttcccggacccatgatgtaactaaccctaattagcataaaatttttcggaaatttaaattttttcaatatttttggtcacaatttgttgaaattaaaatttcatgcttgtaaatcaatcaaagagttgccgtaagataaactaatattatttaatttggttccatttaagaattgaaattctgaaaaaattggaacttttaaagggaactcccagagccaaattaatttaatttcttatttaaaattacagatcagacaggtcgttttttcgggtttttttcgattttcggtttttaaccgaaaccgaccgaccgaattcatcaaaaactgaaacaaccgaccgacttttatgaaaaattttaaaaaaaaccgaatggctaattggagcgacattatatgttaataacaatattttagtgctttttttgtgctcttttcattttgaagaaatttctaaaatattttcagctattttgaaaaaaattataaacaa

SEQ ID NO: 21636 - DNA, 1480 bp, Heterodera glycines
taatcagttattgtaaaacaataatgtttattatgatatttttctctgaaatttgagaggaaatttaccattgccacttgcaggcatttcgtcgaagctgtattattttggcacagtgatggtggaataagtagtgcaaaagtcaatcagaatgcattgcccgttgcatttttgaacatttataaggtcaaaattggtcgggtgataaaaaaaaagtttaaattcaatttttatcattagtcattttgcaattcttttacgctgtcgatggtgcaaaaatttcaaatctgagtgcaaatgtgccgaactcgagctgacacatatgaaaataggtaagtgatgaaaatccaatgtttcgatattctgtagttggaagtttttgccggccgaatcactttataattatttaaagttttatcttatcgtctctgaatttaggtagtttctagagctaatttaattggttcaatttaataaccgagaattgcaagccctgctacgttaaaatttttggataattgataaaatgggaattttgccaagattttaacaatttaacccatgtaaccggtttttcaaaaatatctctattaattagtttagaattaaattagttaatctttttcttgatattttctctggaattaaaacctacgagtccgtttaaaagaattattgaaataatttaatttccagaatccaatttacaatattttttattttcttcagccatttctgaagggcagctgagaaagagcagtgaatgcgctaaaaaaagttggttttattttttattattaaaaaattgaaaatttaaatgcctgtatttgagcataaatgacatgataattttggctctttttgcttaagtttaagaaataattcatctcatttgttacaattatttaacattttcaattttttgtccaatttgtgtgttagtcacaatcttttttagcattttgaatatgcaatgactaaatttctttcttcatttccaacggtttttttctcattttaataaaattaaacattaataattattccgaaagagtttttggatacaaatacaacgcttaagagtgttcaaatttttataggttaatcataaacttactgctgaagagttttattcaaagtttctgttgctgaagcgtccctgacccctatcaaccaaaatccatgttatctgattagtaatctaaagtaatggcatttctcatcgctttcactcatttgcaaatgtctttcagcaatgagacaaaaatgcaaaacattttataaaactgttgactgtttctgatgaaattatttttataaattgaaagttccagcaggatcttagaaatccaataacaaattaagaattcgatttgtctactttcgaaataaataaagaaattttggcgctagtttaaaagagcactattttgaaaattttttcaacttctttttggtcaaaatttttttttggtttttt

SEQ ID NO: 21637 - DNA, 1909 bp, Heterodera glycines
  misc_feature (1881)..(1881): n is a, c, g, or t
ttaaagggatttatgggcaatttcggtctctctagccttgtaatgaattttaggaggattccacaacgttggaacaaattcttggtccccatgtcatttgagttttaggacggtccaatcttggcactagtccgtgatcaccatggcaatctcggtcaaaatatggaataaattacctgtctctggccttgaacaaattgttggcccagactaattatgttaagcctcgaaaagttggcaccatcaaaaaaaaagcgtgaaaaacaaacgcagacccgctaaaaagtgtgtagcaaatttcagagtttcggcattttaaacaccatggcttgatgcttccaatcgtttaagtttttgcctttaacgtccccctccccttgtgccataaatgttattgcggaatggcattggcacattcattcattgcttgccaatggtcggtcccctactgcttgctggctgtgccgtgttttcacccccaaaaataataggcgttgctaaatggttgcggctttcggcgccccgtcggcggagtctctcctccccccggagcgctcgccgttttcaattgactgaacacagcgagtacggggctacctccagcagcagaggagcgagccaaaaaaccattcaccgacaattttgggcacccgagggggcggggggaatttcgaaattggtggacggagaaaaaaggatgggacggggacacatgaggggcttggatgaacaaaaattttatggaattgccatggcattttcaatgctaggccaaagaggaggcaaagggcgtggccaattgtgggccaaattttgggacacttttttttggtttatcaaaaactaaattattagagaagagtcctcctgtcaaattttgaaaaaaagttggccaaatctcaaaaagaaataattaaaaatgcatttcctggcggactttttgtttttttgtcataaattttgcgaattaattaccgaaattttttgaaattttatgggctgatctttcaaaaggatggatggataaaaatatttttggcactattgaagctaaaccgttataaatagtcagccaaaaagtgatgtgcttggttagttttcatcaaaaccattgcccgcgggcattggcaaattaattaaaaaacgggggtaggggggacaatttagggccatggaaattgaattgaacaggaaaatttgccaaaggcaggaaaatgaagagagaggagaaatgaatataatgaatggaattgaatggggaaaaagtcaattaccgtatgccgaaggaatgaatggttactgtagcaattcttcggaattctaattgccgagattttttatctcaacgtttcttcgacatttcaaatttggtcggtctcaattcttcggcattttcaccaccggtggtactcaaatctcaccaattctaaggcaccgggtcaacaattctcggcatttttctttttttttttgaggatttgaaatcgggagacagagggggtataggaaaaggttggctcggcagcttctcagcctagcttgaatcaatgaaaagcgcacttggtcctcgtttcatctattacatcaacgggactcatctctcaaaaaaatcttgagcgccaaaatgtatttggaaataatttttttgaaactcaattatttttttcgaaattttaaataattaatggaatctttgggttttcggaaaaaacgccaaaaaaaggcatgaaaacacaaaaagggataaacacgatttttcgaacaaaaaaataatgaacaaatcaaagaggatgaaaaaaggtatcaaagcaacaattttccattcaaaaatttgaaatgattggcaatttgtcaaaagtaattaattgactcccacataanttaattagacgctcttttctccgcttca

SEQ ID NO: 21638 - DNA, 1384 bp, Heterodera glycines
gtcaagcccagtgttagacaaaattgctcataacgccaaatagcgcatttggcgtaaatttttgcgcgctatttcaaaatttacactggaaatgccttttttgtattttttattttgatctgccataactcgcttcattcccaactaaactgaacaaatttggtatctaaaaaaagattttgaaaaggagaatctgcttctaaacgaatgctaagcaatttgacatctcagaaaaaagttgtgatactttcaaatttttatcacgttataacgcaagtcctaggcagctctttctaaccaaaatgctaaatttattcatttttttattgattctaaatgttcaaagtgattttgtacccttataaccaaaattattataattttcgaatttatgttttttcatgtgttagagacatgaaaatagtacgccaaaaagagagaaaaagtaatgcattttcatgttttatatatatctcatgaaaaagtgtataaaacataaaatggctgtattacattatgcagaatttctttctctatcgctatgcaaaatttggtatagatttaacgtatagaaaaaaagttaaacgtagcgaagtgaatgttgttttttacataataaaaaagaagagatagtacgccaaagtgagagaatttataaagaaaaagagtaacgacgagatagtactaggcttttctctgcacagtggggcgtacccattgtgaggcagagcgtaaggagagaaagaggtagaaaggaaagcggtgaagtggggaagcgagcgactgagaggagaaaacgcagcggatagagtgaaagagaaagcgagcgggtgagagagagagagagagaggagaaaatgaatagtaagagaggaagtaagagagaatggaagaaaaagcgcgagtgaggaaaaaaataagtgagacaaagagagtgaaagaataaattgagaaaaagagagggtagacggaagagtaaggtgagagtgaggaaagagagagaaataaagaagagggaaaaaggaggtaaatgaagagaaatgagattgttagggcaataaattttataattgaattctaatactactttcataattgaaaatgcaagtccatggcaattacagatcattctatttttgaaaaagaggaatggcagcagatctgatagccggaaattcgaacggatttatttcaaaaaatatttgaatattgaaaatgtaaaaatatttcatttatttataaaaattattataaatagtgaatataaaaaggtttcattaaaatattcttcaaattcctcagacagcgcctatcagcagcgccagaccaactttcccataaaatacaccaaaattttttatttcacatttcttaaaataaaaat

SEQ ID NO: 21639 - DNA, 1601 bp, Heterodera glycines
tcacaaaaatttcacggagggggagaaaaacgtagtgctcccctttttaaaaaaactaaaaatttttatttcaaaaatttcttatattttttagctaaaaaacgttaaaaataaaacttctgttttcaaaaaataattttagaattgtcgattaagttttttgtttttaaaaaattgtgtggatgagaacgagcttcatccgtaataaacacctgatttgcgtggtgaggaggcaaatacgcgctcaaattggaattcttaaaaagaaaattaaattaataaagtaataatatgttaatacataaaaattgcggaaaaatatttttgtgttctgtcggtcgagctgttcgacgagtgtttgttcggcttcgttccaatggctgcggttgacaatgtccaaaaggggccgattcagcacactttggaactgaaggggggctgaaaatgggaaatttgaaaagggaaacatttgaaattttctttggaatttgtcgaggcataaatgaatccgtttgatttttgcttttaaggggttttcaggtagaatttgaagggcccattcctccaatgaatttacttgtaaattttttaatttatagtttttcgttgaaaaaaaaattttaaaaactttttaaaatttaaattatggcccaccgtaaagctcttcgttggaaattggcagcaaaaccgaaggcgtaaccggcaaatggtgaagtcgaggaaaggaatgctcaaagagacgaggctgaacacggttgtggagctgaaaacaaagggttaacaccacatttaaggcccaaaattaaaggaattttgcggccagcaaaaattggatgtttgaggcttcgagaaaataatacatatccattttgttccaatcaaaataaacctgcatattgtaatatcttgagcagtattaaagatattagcatttagaggctatttaaaatgcatcaaaaaattcaccaaaaattctaaaatttaggccaaaaattttaactaaaaataaatgaaagtgttcaaaatttgctttgcctaccgcattcggcacacaaccagcaaacggttgcctccgacagcgatggaacagtcgcgaaccgccaaggcaaaagccggcggttggacgacgatagggaatttcgatgttggaacgctccaattggcaggcggaaaacctgtaaaaaaaattccaaataaacaaattgtcggaattatttatccgaaaaaaccgaaaaatcgaaaatattatatataaaaattaaaatctcatgaatggagcgattttcgggctcgcaagggcaaggaggggctggaaattttcttaatagattcattaaaaattctagaatttttccaggcggtctgccgtttgatttgtgtacctttcccctgccaccaccatacatgcacaaaaggtgtctcagcccaagggccatacgacgtacgattgggacaggggggtgtctcgggcccgatttttcatacgaaggtcaaatttttctccgtttttttttttttttgctattgacaactctttatgacgaccttttttttgctattcaaaccacctttccacggcggcccgcccgctccacgactcc

SEQ ID NO: 21640 - DNA, 1768 bp, Heterodera glycines
gacctggaccttgatttcctggacaaaaatccaggaaaatccaggtccaggaaaaatccaggctgccgaaaaatggcctggacctagacctggatccaggaaaaatccaggcctggattcaggtccaggtcgatctctaaaaattaccaaacaaatgtttaaaaattttggccaagaaaattgggaatttttataactacctattttgaaatctagagcctaatctttctgtccccactttgtcaaaatttccaagccccattattttggcacgaaaatagccggcactgaacagcaattccagcgtttgtgacaagcgttccaactgttcatcgtccatcactttttcttcttgctttgaatgctgctccatctctgttttctcgaataaaatttgttgttgttacatttatataaggttaggatttatgtatatttttatggccgaacagatctgaaactattttcaatttttaatccatcaacacgctttaacatccccttttacagatttaacacaaaatataaactaggcaaaaaattcattccctttgctgggagggtaacaaaattgtggaataaactcgataaagaactaataaaaacaaattctttgaattaatttaaaacaaaacttaaaaattcattagggtaataaccggaaaagcaaaaaacagaattaattttttaagtgatttggcatttatactgtcgatctcaattgactttgacctcattttattaatatattttgattttttggtcatccatatatttatcacttactctacgacatattatctgaacagtcgtcagagtaagtggttttgcccttctgataacttttttattcatgaataaactctgaaaaataggccttttactacggtttaattaagaaaacataaattcaaaaaaataaataaaagtataaaaaatggttttcccacgtctttgcatttcctatgtttaagagtggttgggtcggaaaatccggcccaaactggtcacatgaattttctgttttatgtgaatattttggcttgataatgccaatgacaaaatcagctgatttttgcctgcttttggtttctgatgaaaaataattgtaaattatcacagtcattttgttttatgcttaaagtatggctctttgcagtttatccgactttaaaaaataataaaaaattaaagaagatatggaaaaaaatcttccaaaattgtagaccaacaaaaatttaaagtttttcctttgaaaatttaattttgggaatgcttatggcctggacttaatccggacatgcttttcctgggcaaagaaaaaaccagtttatcaagcgctaaaagtttctttgttagcttatttcgtttccaaaatttttgggtttcagttaaattttttacaaaatattaaattaactcctaaaattaaatttgtttattttttgttctaattatcataatgtatttttatggtcgtgtaaattttattataattaaaaaacaactcgaatctgaaggaatccaaataaataatccacattttatgaaggctatctatgcaaacatccttaattaaaaacgagacttttattgaaatcatttcataatgtattggttcattattttgggtaggattcgaatagacgtccgccagttttggcgccagggtcgtttcggcgccagggtcgtttcggcgccaaaaatcagaaacgcagaaatagtaaaaaaaattttgttttgtttcaaaacaatgaagtcaataaaa

SEQ ID NO: 21641 - DNA, 1693 bp, Heterodera glycines
  misc_feature (1674)..(1674): n is a, c, g, or t
ctttcttcggaaaagatttctgattgttgtggactcatattcgaagtacccggaggtattcgaaatggccactaaatcagcggccgcaacaatcgaacgactgcgttatctcttcacgcgtcacggtataccggaaacattggtaaccgacaacggaacgcagttcgccgccagtgaattcacaaaattcacagaagcaaatggaattgcacatctcttttccgcaccgtacaacccaatgtccaatggacaagcggaacggttcgtggacacttttaagagagcatttcgaaaaataaaaggggagggagtgccgaataaagaaatcatcaacacattcctggtaacttaccgcacgactccgaacgattcgctgccggacgaaaaaacccctgccgaaatgctccttggccgaaaaccgcgcacaacgattgatctcctaatgccgcctcttccacagccaacggagagagacacaaaaatggagcaccatttcaatcgccggtttggcgcccgaccacagaaatttgtgtcaaataagccagtttgggctcgacaccgactctcgcagaattggagagctgggacaatttgtgattgctccggagtcatctacacggtcaaattccccgacggttcgacaaatcgctttcatgcgaatcaattgagaaaccgggaaaacaccgaaaatggccacgaaccattggcaattttaaatgaggcattccatctgccgatcaccgcaccgaacgttggaattgtagggcaggaccttgagccaaggcctgacccgatcaacgatgagcaccaggacgagatcgaaccggagcaggcccgtcgaagcccgacaccgcagcaacaacaagtgccgcgccggagtggacgaaaccgccgagcccctgatcggtactcgcccggatgagcccaatcaaaaggggaggtgttcgggtgatgaccccgagagagacatttaatttattttatttatgtaattccctctctctgtctcccgcactatttctctcatttaattgtgtctgcactccctttgtaaaggtcagacacatcattcctcccccacattgtgacccccgctcatttccataattcattctgtcttcttgttgtattcccacatttcctccaattgtcctccgccccaaatatttatttatttgttttccaataaataattgattatttattggactgtttaagctcggttaggtaagaccgaacaattggcgacgcctctcttcgactcaagccgggttggctgagcatcatcatcaaaagccgagtcggcaatcaacaattttgaaattctaaagccgggtcggctatcatcgaatttcttaagccgggtcggccatcatccaatttgaaattctaaagccgggtcggctatcatcgaatttcacaaagccgggctggcattcgtcgaaaagcagaaaaccaaaactgcgaaattcttcaaagccgagttggcattcgtcataaattgctgaaagcgaacacaactcaaaatggctgtgaacctcgaccaattggtgagattgatgacgcagcaacagcaacaatttgaggaccaacaaaattggtgcagcagcagtcgcacaaaattgcgcagttgctagcaaaccaaatgctgcaaacatcgcagctggtcaacanatcccgccaatgcagttgc

SEQ ID NO: 21642 - DNA, 1500 bp, Heterodera glycines
aaaagtcgcgtccaaattggcattttataacaaggcatccaaggccccaaaattttcagaatagtattccgaggcttaaaaattttaatctcaaaaatttgacaattttagtggtgcgcttttcaaaaactttttgaagcttggggggggggggggtattgtccggcggtgccgataggagccaacgggaaattttttgaaaatgagtataatttgttaagagaattttgtaaaaaaaattgtctaaattttgtgattttcgagccaatttctgggaaaaaatttggggttttggggccggcggtgcctataggcgccgccgaaaagtttttcggaatttttaattaattttattaagaaaattgttcaaaatttaaaatgctcaagagtccccaatcccccaaattagtgtcggggggtcgggggggcaaaaagttgggggccgtggacctcggtgggcgacatgtcgggggtcgggtcggggaataggtcccaaaaacatctcgggtcggggggctcggggtcggggggcaaccctagtttaaatagatgtcacatccgtaataaattatttttaacaaatttgtggcatatggaatgaacagtactgaaaaagatatcaaaaaataataatccaacccgacctcattaattatatcaaattttctcgtcgctaagtgaaaaaaaattaaattatctattaattgaaaggcgttgttggttgatcaatgaagatggtgaattcgtcattttactttccgtaaaagctactcacaaaaaatgaatttgtctggtggtgcccgctggggaaaataggaaaatttagttgcaatttattaaagattttatcagaaaatgactttttgatttttggaaataattttgaaaagtgcttaatcagtagagaccggaaatttcaaatttgcggatcccgctgcgggattggaactcaaaattttttgtgggacgggatcccgcgggattaatcccgcaaatcccgcatttaaaatttgcgggatcccgcgcgggattgcgggactttggaaaattcgaaaaaatttcaattatatttcaaaaaatttccaaaaaacaaaaaatacctgacattttgaaaaagaaattttttaggggctggggctgcatttaaaggggctgatgggtcgactaagattttcaaatggatcagcagacggtaaaaagagatcgggaaccaaaatctcctaatgatccataaatttgaatatttttgcttttcaaaaccgcttttttttggtgcgctattttttcaaaaaactaggaacatggtgggggggaggaccgccgtagaaattttttgaaatttaatacgatttgttaatagattttgtaaaaaatgaccaaattttgtaattttgagtgaattctttaaaagagaataatgtggaggccatccggcggggttacctatcatttcttcactgagaaataatttttaaaaatgttggcaaaatgtccattatg

SEQ ID NO: 21643 - DNA, 1647 bp, Heterodera glycines
ttaataattttcctgcaccgaaggtacttacatgcgggccctcccactaaggccctcgtgggtgggcgcttccgacgccaagaacccggtcccttgcaacagtccctggtcacggcggaagacgcaaaagttgcaaactgtcagatttgaagagcaaaatctgaggtaaaaatacgataaatacccggacagtgaaatgaacgcggaggcgaattcgattggcaaaggtggcagaagtgaaagtcgcgcttcaccaccgacggcaaaacattgcgctgggaattcggtcccactttgaacatcatcagcgcgtttaagtaaacattgaggccgagaagtgagcaggggacgaccctcacaagccaaccataaaaaaggacggaattactaaatgtaaccattttaagcataccttgctgaacgggtcaaacgaaagggaaagtggaaaagttacggcatataaaaatccaatcggaagggcaaaaaagataaaaatcccaatctgaactcaatttgtatgacaattcacatgcgaaatgaacaacttacaatgtcttgtgtgtgcatcttgaccataaatttacgggccgattggatgcaattattgttttgttttgtaagaccttcaatagacgtagaagcgtaagagtcattgtgattattcgtggacatctgaaatatcactactcataattttgtttatgcatataatggtcgagaaaatataaaaaatccaccctttgtccctttactatcttacaaaaaacaatatacataagtagggttgtaaattatatggattaacatattttttctgcgcatatgctataaagaaaggggctcaaaaatggcatttctgcgttaaaattttttggtttgctgaaggtttttagtccatataaatccatattttgggggttttcgggaataaatccatatttagccatttttgtgtttttagtccatatttcggccatttttggcaaaatttcacaagaaaatgcaagaaaagggaaaaatacaccccctaaagattgattttttggaaattttaaaaattacagtccaaaaaatatgaaaaatttgaattttcgtcgtcattttggcatttttaataaatcttttcatcattttttgcgaacttttctttttttaaataagaatttttttaaaattttggcaaacttgaaaatatttttatacaatggacgacaataaatttttttttgcatttttatgttttaaatccattttttggttgtttattgttttttttaaatttatttaagcaaatattgaattcatacacctttttttggaatttttgagggtttaaaacacatattttggcagtttttagtccatattttggtccatatttggctatttttagcttttagtccatatttcgtgcttttttagtccatattttatgtccatattttgggttttttagtccatataatttacaaccctatacataagccaagcatgcatttttctactgggagaccaaaataacccatattcgaacaaaaattcaaattttcaaaaatatcttttatggtgcgaaaataactcgaatacgagttcggagttcgaatttggtagaaatggatgtcagattcgtgatcagcgaccccgaaa

SEQ ID NO: 21644 - DNA, 1410 bp, Heterodera glycines
tcagccggactattcactcactggcggagcatcaactgggcacaacatacacagagctgcacaaattcagcagcctaccgcttctctggcctcgtctcttcctgctcatcatcaacaacaattgctgcaaacccaatcattgctcctcccgcagcaacagcactttcaacatgttcgtctcggaactatgacttcaagtgcggtgttgactgaacaacagcaatcgacgcagcaacaacaacaattgcaaaatttcgctggagtggtcgcgaatattcttccttcagcggttcctcagaatacccaacaacagcaaatggcggctgtttcaccggcgcaagtgatgtggactcagcaagcgcaacaaagccaggcacatcagcagcaacaacagcagcaaatgttgcggcatcagaagaaagtccatgtcccgcagcaaatggcatcatcgtccatgggaccatcattcttctgatgatttaaaataatggattcttaactaattatcttaaaatgtattttatttctcaaacttttcatcttcaagtttcacatgtgcctgtaaattaaaagtttcaatgatataagtatatacataaaaaaatggaaaagtgaagatacgaacatcacttgcgtttgataaatgaatacattcaacggttttggtcggttttatgcgtcccattacatggcattttatgcttggcgggttacgcgtcccaagatttttgatgtccgtcctacagcatttaatgcgaccttttttgatcgagttgcactttttgtctgggcctttaccttcgttaaattatcagtacgcacattatcattcatacatctcatgcagttttcatattgaactcgcacgaaaaattgaagctaaaactcaatgcttaggtcggataattaggtatctttcagtctcgccgaaacttcacgttgttgcggtgaaacatccttgaaagcaattgcagactgaagatttattattagagctgggaatttaggtacttgtttggtttaactgatagatttcgtatacatttttagatgcctataaatgtattcattttacattgttttttttacctattttcaaatcattaaaatatgtttccaagggttttcgagatcgctgaacatgaatccggcatacatttcgtataattccggaccccgagcccgaattcgaacaaaaagtcgaaaattcaaattttttgagttttacattttggttcaaacttgtttacatacacggaaacgaactgaaagtcatcagtgcttcaataaaagatcatttaaaccatttttagttttcgacttttgttcgatttcaggcaaaggtgcagaattgtggtcacgatgggaaagaatagttttttccggggttaaaaaaccgctgaccacgaa

SEQ ID NO: 21645 - DNA, 1076 bp, Heterodera glycines
catgaaatgtgggcgcggtggagtttgcacgctattatattaaattgaaattttaaaatctaaaaaaaaattcaacagtctgaccctcgcaaagatacaaataatacatttgtagtcttttatccataaaaaattgtaaaaagacgcccaaaataagcatggttaattgagtggatattcgtttaaaactttagattctcaacttgattaaaaattacttttttttagattagacagttgaattttttaaatatttaatttttaaaatccttaatctggtgcccaaacttccccctgtgatacggatttggtcgaaatggacgtcagaaaatgatgaaaatgatcccgtaccctatttttcgttttatataaaaaaaattttcccattaataattctcaaatggtgccatttttcaagcaccgtaaaaatactgttttaattttattaaagaattggtataagtatcggcggtggcattgaccaaaaccatcgacagtccgtctacagtgattccgtctgtaccgtataaataatttaagcatataattgaaatgaattcaatctatttcaagcctaattgtaaaattatattcaaaaaaggagaatacatccctaaaatggtgctgagacgtcaaataaaagccaacaaaaaggacattatataaaaactatcaaaataaagttttactaattttaaaatttgtttcttgtattgctttttgaaaacaacgatgaaatttttcttaaatgccctttttgatgattggcttttatataacgacatagcactctaaaaactgaacttttatgatatttttttcaaaattaatgcaaaatttcatttgtaacgcctttatattttaattaataaatttaattgaaatataattacataaaaatgattacatttttcctactacttaagggtatttatgtgacaagcgtggaagcaaagtgatatgccaattccttctttacaacttaatcatttaccattttaagttcacccgcagaagaagctgggctgaaagtgcatgacaaaattctgcaagtgaacggcgtcgattacgtaaaa

SEQ ID NO: 21646 - DNA, 1388 bp, Heterodera glycines
tgaacagcgcatttttttcccctagcaaaagtgattttgtaagaaaatttttattttattttctctcgggacaccaattctgaaggaatacacctttttcggtaacatgtggtgaattagatatttttttgtactggttgagtttatggtgtccttacaattgtcatgtcctgcagaagtgccgaattttgggccaattcttcaatttgctggcgttgattaacccttgcagaacgcatttggaaaaattaatgatacctgcaaaattaaatatgtaaaaatttaatcattcggatactatattttggtgtatcggtctgtgatttaaattcattatgaaaagttaaaaaggcaattgctttttgaaaaaaggtttagaatcaagcaagctttttcagtttagtatttttccatttgtgtctcggatttgaattatggaaaaagggaaggaaacggacacctcggatttttatactaaacgatatgtcaatcgattcctcttaatgagagaagacgaatggtaccatttttagggcgcggcgacaattctgaacagagttacagacccggtactgaaatgtccaactacccccgggactcaaacttccaacacacaaaaataattgagactaaattaaagtgcagcgggactggggtccactgcgtttcggcgctcccgtttcggcgccagcatgtttttggctataacttttttctttgtaaaccaaatccaacattgttggtgtcgttcgaaagcttaatctatttagaagctttttctaagctattgctttgcgattagacaattatcaaaatagttatgcatgaaaattgtgaaaagtcgaaatttttgaagttttttcttaaaatttttacaggcttgaaaaacttttcgtttttgataaggctaataaagcatgttaagagctttcgaatgataccaaaagtgatgaatttgctttcctaacatgaaaacctaaataattattgctaatcttcattatgatttggataaatgaatgaaaattttatccgaaaaagccaaggaaggaaaggcgaaattagacaacgcaaaatcacaaggagacgatcataacgaaaatgtaaatctggatgacgactatgatgacaaatttgctacttttgtttcctctccattttcataatttttgatattattaactacattccgattcttctgctgattattagcataattcttattcaattataattgatgcagagtctatatttccccatttataattattattttgactttaaaaattcatcatttgttgaaatattatattttaaaacttggattactaaaatttcttggacaaaaaaaatttaaattttttcatgggaatgatgacaaatcttgg

SEQ ID NO: 21647 - DNA, 1583 bp, Heterodera glycines
agtttaaaaagaaaaagttcaaagagccaattgtcccaagagtagttcaattattaattttaagttaaaattattgggtgggggacaccatagtctggccggcatagtctgagctaagtttaaagcatcatatacttctttattttctcagctggccaaattttatgaatttacaaacattcgaaagctctacatcgatgagaagctctttgagaaaccattaccatacgagtcaaccgcttatcaaaaagccgaaactcgatcactaccaaacggatggaatgtatgcttaccaacaacggctaaagatctcgagaccagggatggtgaagcgctggctcgcaattcgtgaccgaaggcgatttttggcgaaaatcaagttcgcttgggagctatcggaagtctcgcttcggatgtagacggcggcggcaaacgtgtgttccgacgcgtcgcaaaagacgtggagttgtaggcgactgtgcttgccgagaatggagtgccggggaacgacaagtgtttggtgttgccaaagggaaagggtttgattccaagtttccgcctcggtctcggggaggggtgtgtcccaggcggttccttctccccacaggcgttggaagagccgtttggcgggcagaagacatggcccgactagtccaagagggtcgaacgtgctggcgatgatgctcaagactgaacgccgtgtagcagtgatgtctgtgtcttttgggagactgaaggtgatgcagtcgctgggggtgtcccaggtcagtcccagaactttggccggcgttttgtcgagtcggtcgtcctcggggattcgtcccatgacgtttggggagtggctgaggaactcccggaggttcatgtcggcgtctttgaggatttgtttggcgatggacgacttgtcgatggcctcctcttccgtttcacactcgatgaggagattgtcgacgtacatattcgcggccaacgcttgggcgaatgggtgctcgtgcttgtcgaagtgttggaggagaacagcggcaaggataaagggggagcacgtcgcgccgaacactagccgtttgtagcggtagatcaagagattgtcgcctgagacaggacgggcagggtttttcagccaaagcattttgcaaaagcgcctgtcctcgggttcgacttcgatggcatgaaaggcgccctgaacgtcggccaacacaggaattgtcgctgaacggaagcggaggagaatcccgcaaaggtcggggagcaacactggcccgcggtgaagacagtcgttgaggcttggggtgcccttggcatgagcactggcgtcaatgacgatcctcagtttctttgggttgatgacggcgtggtgaggcaaaaaatgctcgtcgttgtctcgcccagtcagctcaataatgtcggcgtccatttgccgtgtcagttcggcggagtaacggtcgagaagctcaagagagcattgcagacgcttggtcgttgagaggagacggcgatatgcgatggacccattcgaggggaagggggaggccgaggttcccgccaagtgaggcgaacggagtaccggccagacggaaattggc

SEQ ID NO: 21648 - DNA, 1700 bp, Heterodera glycines
aaacaaaaaaatcgattttttcaagtgtccgttgggggtactcaaacatttatggggagcaaaaatccaacgcagaattaaagtacaggctatagggaagctattcccgaaggattcggtctccgcttaaatctgggcgcatcggacggggggactgccccgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggtttttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaaattttttagagcaagctagctcggcgctcatttcagtgtaagttagtcctttaccggggagtatccctgcaaagtttggtatgcttctgctcaattagcaaaaaatatgagtgatcaaactttcactaaaaagttaagcctaaattttttggcatatttaaaaagcaattaaaaaatttttaaaattttattcacctccattattgatagaaaaagcatcagagagccttattaacttgtaaataaaatttggtgcgtttcagaaccctttctgaaaaaatatttatgaattaattttgcaaaaaataaataaaaacgaaagactcagattttcgaaaattttttttgagccagctagctcggcgctcatttcagtgtaagttagtcctttaccggggagtatccctgcatagtttggtacgcttctgctcaattagcaaaaatatgagtgatcgaattttcactaaaaaagttaagcctacatttttggcatattaaaaagcaattaaaaatttaaaaatt

SEQ ID NO: 21649 - DNA, 1045 bp, Heterodera glycines
agcaactgcaacattcacctccctccttgacaaagcgtccctggcgtagaacagcgggggtccctgcccgggctggtgttcattcgacgccgccagtatccccacagccccctgcagcagccgcagcacctcaacatccagagcggcggcaagacaaagacaaatccggcattactggacaaaaagggaaaaggaaacgaaccaccaccgcctcatcgtatacgtcagccgcttctggagcagaaaaagaagaagaacaacaacaacagccagcagctgcatctacatcatcatcaacaggcgccgtcgttgttgccggagctcagcgcctgggtgaggcggagcagcgacgaaaacagcaggcccttgactacacgtcacgtcacgcgggcacgctgggcatcggtgatggtcagcaggtgtacaagttcatgcatggtgcataccgcccgatcaaaaacagcagtttgcaagccgtatcaccagtgtacagcgaaggccggggaaagtgcacaagtcgaggcacacccgtttcacatctgaactgctaaagtgttgcgtttcgcaccctcccctccctcgacccgtctctcaccgttttggccaagagatgacaagtgttgtgccatctgttcaatgttcagtcggtagggcaagtgcagggtagtgaccagattgcgcaactccaccgcgttgacgctcagtgagagcgccagtgcgggaaatccgccccatttgagtgccgcaccaactcgtcggcaaacccttttggcttgcttggcacattgggcgtggatttggttgggcgggacacccccaatgccggtcagcaccacacgaccactgcgaaagatgagtgcagtggtggtggtggtggtggtcgcggtggcggcgctactttgctgcctaggcccgctacgcatgcgcatcacaatggcgtggaagcggggggggtgcgtactcggtgcacaccccgttgcgtgccaaagccaaaaactgtgcaagggaaaagcactgctgttgctgctgcgacggtgagcgattg

SEQ ID NO: 21650 - DNA, 2109 bp, Heterodera glycines
tttaatctatttataaatttcaattatgtagacattaactttaatggtattttagccattttttcaagttacacttccacacccattgctcattaccagcgaaatcatggagtaaacagcgcattcgaattgacacatttcagtttattttctagtaaattttatttctgacccataaatgcgaaccaaataagtgtaaatggtacaataaatattttaaatgatgataaatcattttataatctgcagagatccaccagattttgaatggcatttgaatggattttgaatggcatttgaatggcatttgaatggcaattccctctcacaaatcgctgtgtctaaaaagtcatctaatcaaaagtgttttcttaatgaattactataatataagcataatcaatttcttatttgccttgcaattttcttttgttcggcttgcaaaaagtgaacaatttctgagtgtccgtatttaaaagcaaaatccagcgcagttttgccttaattatgggagcacaaaaacattaacaattaaacgtattataagttgaggccaagacgaaaacagaactgagaatggaccaaaagcctattcaaaaaagaccccgaaacattttcaattagcacaaaaaagtcagaattgcacaatttatgggtgggtctgattgagtgcctttttaattgtccctttcgctcgctttaccgtatttattcctttcgtcgatacgcgcaccgttagagagcaaaaaacgcacaacgtccagctaacggatggggaaatgaaattcttttttaatagacgaatttttcttgcccttatccttttccctttaaatccccttttttcggctacaatcaaaggcattcattatcattaattactcttcccttcccctctcccttcgctcactcgtcccgaaattgatgccccccattagcgcgttgttccccgcgttgtccgttcgtccgatgttcgctccgttctttacgagaaaagcagctaaacactgtatgaatatgaattgagagttgccgagatatttgtttgactcggcgaattaatcaacaaatgccgaccaatttccttatggcccgcgtcacaggcggccatcaaaggggtgatgccaatttccaggcccaattcgacatgggcaccgtgcgcaagcagcacacggcacacctccaaatggccaaacgaagcggcgacccaaagtggagagccgtctaagaggtggggaaaagcacattaaacgaagggccaaaaaggtttaggaatattttacgagagtaaaaaatcaaatcaaaaaataagtgatcagaaagagttaattgggccctgagttttggacttaaagcacatttaagaacgaactcataattttttgaacttattcaaatcacattaatattattcaaaatgtctgtgtatttcgtgtattttctaaattatttttcaaatgtcacttttttcatttttggcttttcctctctcaactcactgatcaaattgtcatcggtgttgattttccttacaaaggagaggtacccaagtgaccatgggacttccgaatgaaactttcagggtaggtagattaccccccccccctttgtattataaatttttttttatttttgctaaatgaagcttctggccgagatatgaagcttttcctttttgccttttcaatatcattttaaaagaatgtaaagccaatgtgagcgtcggtggcctggtggttgtgccttccatacttttttcttcttctaaagttcaattccccaaccctgtaaataattattttgtttttttttcatatccaaattagtttttaagctttttaatattaataaatttgaacataatatttttttcatttttattcgacattaattttggcacatgtgataattttggtagaaatgagtgaagcaaaggaatttgtcacaccatgcacatctaatcattataaattccgaacaaaaagtgatttgacagtgatcaggaaaaattgttgggaataaatatttaacgggatgagaaaagttggaaaattcatcattttgtgataaaaggtagccccccttatgccaagaataacgacgaaatga

SEQ ID NO: 21651 - DNA, 2143 bp, Heterodera glycines
ccccctgcccaccccatgtccacctaaaatgttgcgttattttttatgaaaaaaataaaaatgtgaaatgaaaaacaaaatcaatttcgaaaaatgtgctcattgagccttctctgctgattccatgttgaacagccggccactggctcttcctccaggtcggggtccaccggcgccggcgctgcctcctccacctccacaagcatttcttgcaccggctcggccctggcccgcttgcgcaccggctgctccagcccatcactctcgccgccagcgtcatcactgttcgcgtccgcctcctcttccccctcctcctcctcatcatctgtctccatttgctgcgcctctgccgaacaccagccaaacggtcgcgtgcggatggacagaggcgtcggcgtgaccgcttcagcttcttcctccgccgcggctgcctcgcctcccgctgttggtggtggtcgcaggacacgccccttggtgtagacggggcggtacacgcgggtggagcgacgcgtgaagatgtccgcctgtcgagtgcgcacaaagcgttgacagggcacggcaatggtccgctgctcggtggccgcctccgcaatgtcgcctccgcccccaccaccatggttggcgcgctgctcgggcctaaagaaaacagcgaatgagtgtggtggtggtggtgcttgtgcaagtgtcgtaccgatttcggcgcctttacctgacaaaatggttgatgaccagctggcgcatccgtccgtactgcagctgttggtctgctgcgtaggtgagctcaaaggatcgcaccttgcgctccgccctcaggtcctgacccgtgcgcgcgtccacgtgctggaacccgtagttcttaggcccagcagcgaagaagtcgatgatgcggcggccgggcagctcccgcttcatgtcccccaatgcattgccctcccgcacaccggcagcaccctgtcgcctcacatacaacacgctgtccgtgtcgcagtacagcgctcggccgcccacccgccggacctcctccaaccattcgtacaggtagagccgtgcgtgtgatgtcacaaagcaggcgacagccaggttgttgtgctccggcgcccgtgcaaacggctcccgcttgcgcaccacacagcggtccagctgctcgttgatgtgcgtgaagctgaccacctcctgccgcgcatccatcaacagctcgtggaaggcgcgcgcactgtccgtgtagaccacctcgtcgcgctccggccgctccgccatcttgccccacagggagttgagcaaatccttggccagctgtcgcaggcccgggttgtgcccaatgttgtcgcggcgtaggtggacgccctcctgctccgcaaactgacgcacgtgctccgcccgggccggctcgtcgtcgcagccggccggccaaccgctcgcctccgccttcagccgcagaaaggtgttcacgtagtcgttgaacagcccgttgccgctctccggcgacgcccactgctcgtagtgccacacctcgtgcacctgcagcacacggtagccgaggagcagcgccctgttcagttccacatgcgtgtaggcggcggtccacgcgcgctcgcgttccgtgtgacgacaggtacgctgctgtcggagctccgcgcatcgtgcgcacaggccgaacgtgagtcgtccgtctgcctgtgtgcgatagggcagcagcggctcgcggttgcccagctcgtccgcgctgggtggcagcactcggcagaagaggaagccgcggaaggggttgtcctccggtcggcaccatggcagtgcgggtggtcgaagagccggtggtgatggtttagctgtagaaaaagggggcagaaattagtcatgatcataaaactataattatacataccacaatcagtgtgggggtggcctcctgccgtttgtggctgctgctgccacagctgctcaccggtccacacacgtggcgtgccgatgggaaacggccgcgtcttcatgcagaacgggtacagagacaccttggcaaagcagatttttgaacaaaaaaaattaaaaagaaaactcacaatgtcaatgtacacaatttcctcgtctggcgcgcaactgtacagcagacagaagggctccacacgaccaccgaacagggcgtgct

SEQ ID NO: 21652 - DNA, 2032 bp, Heterodera glycines
  misc_feature (1434)..(1434): n is a, c, g, or t
  misc_feature (1497)..(1498): n is a, c, g, or t
  misc_feature (1503)..(1503): n is a, c, g, or t
  misc_feature (1508)..(1508): n is a, c, g, or t
  misc_feature (1512)..(1513): n is a, c, g, or t
  misc_feature (1517)..(1520): n is a, c, g, or t
  misc_feature (1527)..(1530): n is a, c, g, or t
  misc_feature (1537)..(1539): n is a, c, g, or t
  misc_feature (1548)..(1552): n is a, c, g, or t
  misc_feature (1555)..(1557): n is a, c, g, or t
  misc_feature (1563)..(1563): n is a, c, g, or t
  misc_feature (1565)..(1565): n is a, c, g, or t
  misc_feature (1570)..(1572): n is a, c, g, or t
  misc_feature (1575)..(1575): n is a, c, g, or t
  misc_feature (1577)..(1579): n is a, c, g, or t
  misc_feature (1581)..(1581): n is a, c, g, or t
  misc_feature (1584)..(1584): n is a, c, g, or t
  misc_feature (1587)..(1587): n is a, c, g, or t
  misc_feature (1592)..(1592): n is a, c, g, or t
  misc_feature (1594)..(1596): n is a, c, g, or t
  misc_feature (1604)..(1604): n is a, c, g, or t
  misc_feature (1614)..(1615): n is a, c, g, or t
  misc_feature (1619)..(1619): n is a, c, g, or t
  misc_feature (1622)..(1625): n is a, c, g, or t
  misc_feature (1632)..(1632): n is a, c, g, or t
  misc_feature (1634)..(1634): n is a, c, g, or t
  misc_feature (1637)..(1638): n is a, c, g, or t
  misc_feature (1640)..(1640): n is a, c, g, or t
  misc_feature (1644)..(1644): n is a, c, g, or t
  misc_feature (1650)..(1650): n is a, c, g, or t
  misc_feature (1652)..(1652): n is a, c, g, or t
  misc_feature (1656)..(1656): n is a, c, g, or t
  misc_feature (1658)..(1660): n is a, c, g, or t
  misc_feature (1663)..(1669): n is a, c, g, or t
  misc_feature (1674)..(1674): n is a, c, g, or t
  misc_feature (1676)..(1677): n is a, c, g, or t
  misc_feature (1686)..(1686): n is a, c, g, or t
  misc_feature (1690)..(1690): n is a, c, g, or t
  misc_feature (1695)..(1697): n is a, c, g, or t
  misc_feature (1709)..(1709): n is a, c, g, or t
  misc_feature (1711)..(1714): n is a, c, g, or t
  misc_feature (1728)..(1728): n is a, c, g, or t
  misc_feature (1740)..(1740): n is a, c, g, or t
  misc_feature (1742)..(1743): n is a, c, g, or t
  misc_feature (1749)..(1749): n is a, c, g, or t
  misc_feature (1753)..(1753): n is a, c, g, or t
  misc_feature (1761)..(1761): n is a, c, g, or t
  misc_feature (1771)..(1771): n is a, c, g, or t
  misc_feature (1773)..(1774): n is a, c, g, or t
  misc_feature (1776)..(1776): n is a, c, g, or t
  misc_feature (1780)..(1780): n is a, c, g, or t
  misc_feature (1784)..(1785): n is a, c, g, or t
  misc_feature (1788)..(1791): n is a, c, g, or t
  misc_feature (1798)..(1798): n is a, c, g, or t
  misc_feature (1801)..(1801): n is a, c, g, or t
  misc_feature (1803)..(1803): n is a, c, g, or t
  misc_feature (1809)..(1810): n is a, c, g, or t
  misc_feature (1813)..(1816): n is a, c, g, or t
  misc_feature (1820)..(1820): n is a, c, g, or t
  misc_feature (1823)..(1823): n is a, c, g, or t
  misc_feature (1833)..(1833): n is a, c, g, or t
  misc_feature (1845)..(1849): n is a, c, g, or t
  misc_feature (1852)..(1853): n is a, c, g, or t
  misc_feature (1859)..(1860): n is a, c, g, or t
  misc_feature (1864)..(1864): n is a, c, g, or t
  misc_feature (1867)..(1867): n is a, c, g, or t
  misc_feature (1869)..(1869): n is a, c, g, or t
  misc_feature (1875)..(1875): n is a, c, g, or t
  misc_feature (1903)..(1905): n is a, c, g, or t
  misc_feature (1958)..(1958): n is a, c, g, or t
  misc_feature (1968)..(1968): n is a, c, g, or t
  misc_feature (1972)..(1973): n is a, c, g, or t
  misc_feature (1984)..(1984): n is a, c, g, or t
ccggggacctctagagtcttgaatcaggattaattattgtttttaaattagtttttatataatattccatttaaatgcaaatttttttttcattttaaattgtttcactttttcattggcccatcctcctgctgaaaatttggtgatttggccatgccgtagttctgcgcccgctgctgcgcctccagcgagcgcagtgatcgcatgcttttcgtgtcgccggtggcccaacggccgcgcactgacaaactcaaaatggcactaactttgcttacaaattactaatagctttcctccccattttacctcgcatgccgacgcaacaaactgttgtagcgttgcgcagaacgccctgagtgaactgaatgaacaattttaagggaaattccgaataaataggctaattgcagccgattttggcatcgatggcactttcgacccccccccatccttccccccccccccgccgggaaattgtccccgcttttcattccaaatatttttcattttatcctgcatatttttgtcccattttggcctaccacgtcgcacattcaccggcgcatttgggtggtagcgcaatttgagggcactgcgcttttcctgccgctttttggcctgccaacggcaataggcacagcatactttaaagtagacgaaggtgaacaccttgaaaatgaggacaaaattaaattccaattaaaatttaaaaacattcgcttttctctttcacttctctctctctctctctgacctgtgccaaactttcggcaatgtttgctaaacacaaaagcatcagcggaatgccgaaggtggcgtacacaatggtcaggccccgggcaagcgcagttttgggacaaatatggccatagccaatggtgccaaaatgggagaaaagtgccaattgaacattttgaaaaaataaaatagagaataaattacgtgaatactgtgatggaataaagaagagcaccggaaaactgaacaaaaaaacaatgaatattttttaaattattttttcaaattaataataattatttaaataaacatttttaataattattagttaaaattgtttattttaccgtccattgaaatgtcgggtgactgtcgtcgtatttttcgtcatagccttggcatactttttgaacagtttcaaattccctccccccaccttcgtagttcacggcgaacaccagcgactgttcgtactgcttgtaaagtttgtgtgcctctgaatttcaatcaattaattatttttcaattttggatttccccttttttttgcttctcgcctcgtttaatttcgtcctctctgatcacttcacttttctcgataaattcgtacaatttttgcaccacctttttggagagataaaaattgtcatatttttaaatcatttttaaattttcattttaaattcatttttttanatttttctccaccgtccatgtatcgttggcgatatgcccctggaaatttttgttcggccgggnnttcgntggcncggnncatnnnngcgcccnnnncggcgtnnncggcccccnnnnngcnnnggccgncntgggnnnggncnnncncgnctngctgngnnngtccggcngggttttttnngcgnttnnnntttgtgntngcnngngggngttcgngnctgntnnntgnnnnnnngcggngnngtttctcgnctcntgccnnntggttttccctntnnnntggcctttgccgtngggtccctgccngnncctggnccgngtttttgngttttggccntnntntccntggnntcnnnnctctcgngcntntccctnnttnnnntggncgncccttttttncctttctcgtcnnnnncgnngtgcgnntgcngcncnttctgntgctcgcccttgccctttttggggtttnnnttttggccgctttttgttgttctgtgccgttgtccgcctccccccagggcccntttccgtgtntccnntcccccggggnctccttaaaggccaaatctttccggcggaaggcatagggcggaattcg

SEQ ID NO: 21653 - DNA, 1542 bp, Heterodera glycines
ataataatcattttttatgaaaaaacatttaatttttcctttattagaattcattcgatatttaaattcaaagtaaaattatttgctcgattgtcaaccgatatatgggtggtcatttacatatcataaaatattttgtatttgtgcctcgtttttgctaattttataatcctgtatgtttatttataggtggtcgccagccattcattctgcataatctcggaatttctcttttaaatttcttaccaggggtggagcgcgacgcagcaatttgaatccgcgctcgcgaccgcgtgagctttctgtcctcgctccatccctgtttcttactaataattttgtatttctgcattttgagtatgttgatgctcttacctaatcattttttgtctccaagtcgaatcataggcgtctggcgatcatgtatggaagcgacctttaccttttcgagtgtgttacgagtagctgattttcgcatagcccagatgacggaaagtgggcacgtgaaaagcacaaataaaaatggattcggcattgcaacaatttgagaaatcttatagaggactttgcaaatcgtgactcgtttaaatatttacggatctgttcttatggctcgaatttttgaatttttttagctaggtgtacgcttttttaataattaattttcactgacgaaatcactcactgacgaaatcacttactgacgaaatcaccgggaaccttaagggacaattaacattaattaagaaattccgggaggggtcggtttagtctggccggtttagtctgaggtgacgttttagtcagggggtcgttttagtctggcaagctgattttgtgccatatggattctaatctgattttttttcaaaaaatgtttaatttaatactaaaacatatttatcaatgtatttccaataaaaaaaacaaaacattgaaaaatcattgcgggcacatttcataaattcgagataatgtaccaacgagaaaatcgctgatgatatcgggattaacattgacattggcatgcccgtaagagtcgaagaattctcgcatcggcgatatcaccagctcgaattccaacgaaaagtttcaggcgaaaaattcggccatctttgacaatcagttgaggcatacgtgttcaacgcttttactttgcgaggatcatcaaaaaatcatcattcgaccaacgctgcttcaaccgcatcgttgccacagcacagcagtgacgccggctcggccaccggtgaattgttttacgaggagtgcgacccgccgccgtcgtcgatggcagcagcacaactgacggcggtggtgccaccgcaacaacaacagcaagcgcaacaaccgccgcaacagtcgcaggactttgtgctgggcacggcaatcgcaatgtactgcttgaacttgatgatagaattttctcaattttttgaaattttttttaaaaattttttctgagtctgtcttcaaaaaaaaaaatttcagtcggcaacaaatctgggagggtttccagcaaatgtgtcactatttaaattttat

SEQ ID NO: 21654 - DNA, 1055 bp, Heterodera glycines
gaagtccgttaattaagcacaattgtttcgtttcgagcaattccattttcattttggcaaagtttagacgaatttcctataaattaataataaaatttatttccatttttattgtttctgttgcgttcgtccacctcaatctgttgttgatcactgaatgatcttgggttgtccaatttttgaccaataagcgaaccatcataacaactcgcctctgaaattttggaaaatttttattaaaacactaaaaagaaattcacgtctataagcttaaaaattttaaaattttcgttcacttacaataataattgttaaaaatcccggaggttggtataactactaattaatccgcacactaattacaatatttatttttgttcacccatttctttgccaattaatcttttcttacccctttctgctggtgtgaaaatgctgctgcttgacaaattggtagaagttgacatttatttatttttttcaaaaattgctgaaacttataaaaattttatttgtaataatttttttatttttatgtaagcgtattaatatgatgggtgtgcattttgaatggcttactgctgattgattgccaatatttatagggtcgacacaaataaataaatgtacggcaaaatgatgacccaaaaagtgggagagaggagaacagcagaatatgggcaaagtaaatgacatgagaatttgaattggttcaccaattttctcttttttaatgaacgatagtgcaaaaagtgaccattaaaagagggaaaatcggagaatcagttattaatgttagtacaaacgtccttgaaattcagaagatatgatccaaaattcaggttttttgctagacttttaaaccctaaaaaattcagaaaaatgtatttatattcatatttgctaaaacagacttaaaaatacgctaaaagctgccaaaaaatgatttaaccttaaaaaatgccaatttttattaaattctagtttcacaattgcaaatcaaatacatctccaaatttttgtaaaaatctctttctgtagtcagctaatatttt

SEQ ID NO: 21655 - DNA, 896 bp, Heterodera glycines
  misc_feature (17)..(17): n is a, c, g, or t
cagagcaatgagctacngaatgatacaaatatctttgattttgatatttttttactagggttctccgggcccgcgtattttaacaaaaatcttttgctggtatttccgggtctcgcaatgatgagtccacgtccgggtccaagtttttcaaccgattttgggtacggagtccaaccctgtcttgcaaaaaattcattgttttaaaaatgagtattttcatgtttaaaagcttgcaatttataaaattatacgtaaatatttgaaggagaaaaaattcaaaagaaaagttttcaagcgggtcctgaaaatcaaaaaaaaattatttaatttcatgaagatgaaagcatatactttcaaaataatataaaatattttcatgaaaaatatataatttacaaataaacgctttattatttatcctacttttttttgctattcaaacaatttctttttgcaggcctttttttaaagtttttgggacagaggagtccgggaaaattttgaaaatttacttttgatttgttaaaagattttaccaaaattgaccaaattttgtgatttgagccaatgtgttaacttgaatcttagcaaagagtgaaatgaatccaacagaaatcgacaaggccacaggagcaataaattatttcactttcaataaatatcaaactaatttttttaaattttttcgttcgtgctttgaaattgtattattttttatctataatataatataataattgggctatttttacatttattttaggaaaattgattttattgattccgcctcttttattcaattagcaattataaaattatatgtgttaaaatgctttcattttactcatgaaatgatatatatatatatatatatatatatatatatatatatatat

SEQ ID NO: 21656 - DNA, 2766 bp, Heterodera glycines
  misc_feature (5)..(6): n is a, c, g, or t
tatanngagagttgggcctaaaaagtcgatcccgatttgctcccccacggaagacggttgtgtccgtgatttaggaagaggcgccttcggtggcagaccaaatttaaccgctcggtcctttttgcacaccgggcattcatttatgattttacggaccgtacgtctcgcccttttacaccaaaatttggacagaaaatcggtgagggtggagtccacacccgcatgaagcaagcgaatgtgcgagtgccttatgagcaggacaagaacccacgaatccgtcggcacaaaaactggatgctcaaaatctttatctccaattccacagagccgtgatttgagcctaatcaaaccgtctgtgtcaagataagtcgggacgggggggagcattcccctctgaatttgtttgaataaccaatttaaaacgaatttttggttttcggggtccaaaaaatcggaatttctcatattggggaacagttgtttgcttttccctattttggacaggaatcgtaaaacgacgaaagcagtgccgagaagctttcgccaagaaccgaatcggtcgaattcgaaaatgtctggcccaattttcacaacggcgaccacaacgggatcgggcgctgaactttcctccggtggcagaattgccgtcaattcgtctggccaaaggtttgctggtttttccaaccattcgggtcctttccaccatatgttggcggatcggagctcatttggactggtcgggtgggttgccaggtcggcagggttttcagcggaacgaacatagtgaaaattaactgaacgatttgttcggatttcacgtatgcgatttgacacaaaaactggttgcttttctgtgctagaaatccatgctaaaacaattttggaatccgtccagagatggacactttctatgtcataaaataaatgtgattggacgaatttggctgccctggtcccgatcagaacccctaagagttccaaacggggaattgtgagcccgtcgggctgattttcacccatccttttgggtttaaggcgagaacgggcgtaaatgagagagttaattacatggccctctatttccgctctcagatataccgccgtcgcaaaaacattgggtgaagcatctgaaaaaacatgtaattgaatagctccattttttgtgcggggtgtatttcttgggatcaaaattgtttgatcactccactgacttctgatcaaatcccatgcacttttttcggaattttctatgggctggtcccaaccgcgggactggtcccataagctctgaaaataaatttttgcccccactaaacagggggagcataaccctagggggtcgaaaaacgatgcgatagttttcaaaactatcctccgagtaagtaccgctgggtttggtacttcgggaaatggcagggacaaatcgtccgactgtaaaatccatttcagaccaagcactgatggctcgtcttcagagaggcaatcctcttttggaattgtcgtcagaagttcaggtttggccgcgacaaattctcggaggcgcatttttgcctctgaaaaaatttcttgcgcttcgatggccttttgttcggcttcggctgggcaatcggccaacaacaacaaattatccacgtatagaagtgacttatgccggatttctctggccaaatcactcggcgatgtgtccaaatgatgttgtaaagtggccgctagtaaaaaggggcacgacacaatcccgaaagtgatccgccggaaacgatacaccagcaaattatttccggacagtggtgcattaacgtctttgacccacaaaaatttggaaaattctctatccgcttcccttaggctgaccattagaaatgccttttctatatctgcccaaattgggtgggcggtcgcccgaaattggatgagtttgcccgctaaatcggggtacaaatttggacctgcatataatgtgtcattaagtgacggtacatttttctcatgcgatgaagcgtcaaaaacaattcgtaattttttccccataacggtatggtggggcaaaaaatgctgggggtcacaagtccgggacgaattttcaataattcctcttgctaaataatcctcaatgatttcattgcatccctgtaaaagacgcggggaattgcgaagtttatgcaccagagcggaaaatcgcgaaaaggcaattcgaaaattttcaggcggatattccgtctctgacttccagggaaggcccacttcataccgtccttccttgtcctttttaatggttttgttgaatttttcaagcgccatctcgtcatcttttaaaattggagaatcggaaacgccgatcgtttctaaagcccaaagtttggcaacatcggattcgatgggatgaggtgtgttgaggactggacaacataacgacggatttgaggttttctcggggacaccgcaatcttcccctccaaaaatgacaccaaaaacggttctgattctgtaaattccgggtcgaatttcatcccaatccaagataaaacgccaaaaatctctaacaccgatcatgattcttggcttgacggagcatggcaatggattttctgagtcctcggaatttgctggtgtcatcaggcagtcaatggacgacgttattctctctgtctgattcaaaaaaacttcttcccatccgccatcctccctagctaacagcactgaatagcagggggagatgaattccgaaaaagtttctttttgatttccaacaaaacccaccaacgacca

SEQ ID NO: 21657 - DNA, 2255 bp, Heterodera glycines
cggggactctaagcaggatctgttattttttctttttcaaaaatggcacataatctgtaaattttacatgatttgccaaaataaaacaattaaattatttataattaccaacacagacttgttctcatttgtactgattcacattttttgctcattttcaggtgattggtcgcatgggcaagctcggtcacggcgagttcaagcagtggaccgaaattctgtcgaaaaagaacctgaagagtcgcaacaacgcgctgaagggcaaagcgccgccggaggaaagcggtgccgtgtccgctccgtgccagtcgtgtgcccagtcgcacggctgggccgagacgcccgcgctgttgtccgcctgcctggtgtccaccgagccggagccacacttacgcgtgatggcctccacctcgccgggtgcgctcggcgacagcgccggaggcactggcaccacaaatgccgcaggcggtggtaccggtgccggcggaggaatgaagccgagcggcggtggaacatcgggcggtggcggcggtgccaacaccatttcgtccgcctccagcgcgacaagcagcaaaccggcgatgggcagtgccggcgcggggcgccaatcggcgctgggtgccaatgttggtgcgcagcaacagtggtggagccaaacggcagtcgcctgtccggacgaccgttccgtcacacacattatggtcttccaggtacattttgggttcgggttttttggtgccggattggacggcacatattttctccctccaccgagggattccctgttttttttgtgccaatgccttattgtgttaattttagaccattctgaatgtgtcgctgggccaccaccagggcgaggatatgcttcagagtgcgtttgacgatgatggcgacctcacaaatgtgttgggcggcttcaattttgttgaacagaaccaagaggaattggaccttgacaatttggagattgacaaaggtcggttttcacatccgttcatccctcaaaagattggaaatttctaaagggatttcgattacaaaaaaggcgtatatttcgggaattcgacaaaatttcgccgccaaaatttaaaaaaaaattttgaaaatttttctaataatttttttcattgcgcgaaggttgggcaaatgaaatgctttgccctgttaacatgctatcatcattatttatggactaaattttaaaaacaattttgcagacgaagaaacgcagatcaacaaccagccgatggccatcgggtacaccgtgtccacggccccactgcctccgggcatgccgtccagcttttggcaccggtgccctgccgcacgccgtcgtgccggcgcctcgggcattgcacatctcaaatcgtcactgcacatcaacacgtccaacctgaacgaggagtacgggggcggcgcggcacagcagcgggagcgcgactcgggcggcggaggaacaacggcttcatcagctgggggaggagcagcgaatgcaaaggcaaccggcgccgagcagcaacaactgccccatgcccaacaccctttggacgcagtggccaccgacgacgtgttaaggtggtatttaagattgaacgagaagatcaagccgtaccaggagtaataatgaagggtggtgaatctccaaaacaaaaatatttcatgaattgggacattgtgaaaatttccattcttttaaacaatttactcttaaaagccaataatattcatcattttatatggtctaaaaacttaataaaatgctatttttgtcgaaaatattttcggctgaaaacaaaaaataattcgggattcactctcctaaaactgttctgcttgtaaacctgagttctgaaccgatgcgtttaatttctgctccttccaattttataaagtatttcagcattccttaactccatttgtgttcaggtacgtgttggagtcgtacaatgcgttgagttggctttcgcttgacccggtgaccggcgcgcgtcgttcctgtctgcccgttcacatgcaggccatccaacggctgaacttggcggtgaacacattctgggggagcgctgaacaaaatcaacaacaccaacagcagcagcaacagccgaaatgatcgaataattaattatcaaatcatcgaagaaaagacgcagcattcgcatcgaaaattggcattatcacatcttttacacatttctccattttttgttgtaaacgggtccctcggttcataaacataaaaccttctagatttt

SEQ ID NO: 21658 - DNA, 1708 bp, Heterodera glycines
ccttgcctgattcaacggtaaaattaattttaaattataataatgaacatgtgcaatgccatggaatgagtaatattcaaaggaaacaagagaaataggcaattttgaatctaaggattgaaccgagaatagaaagtaggtttgacaaacagctgactgactgtatgtgacgagaaagggtagataagggctaaatgtatgcgtgaagcaggtcttgtaataggaataaatgaagaaatcatatgaggatattgtagtgaaccatagaatcaaggacaattaataatgggtgtaagagatagagatagagaactcagaaatgtggttgaagagagtcaatattaaatagtgagaatttaatgtgagtttgtaaggcaaacattaggtaatgtatagggaagagaatagtttgataaagaacaagaatacgaacacttggaagataacggttcgagaataaaacatagtgttggaagaaaagatattgaaaaatagctaacggaaacgattatttagacaatatgtaggtctgaaattaataaggaataacagtgaaagtaaacagatatagaagagtagagaaagtgtattacggagaaaaggaaaataattcaaataaacccgaaaccaaaatctctaaatataggattttgttaagaaagcagttggcgttagcctctttccatttgttccttttagaggaatcgatttacaggataagatgacgcagtgacctcacccccctctccttcacttatttggtttcctcagctctgcccttcctctccaacacatattcggtcattattgctccttaccatcgcaaactcagtttacccactcccttttccatcctatgcgttttgccaaatcaataggaaagatatattttattctcatataaattttagaccacgaggataacaatttgcataaaaataaaaattcatagtcaaaagaatgaagttttcagtgttcggtgtcagagccttgcgaggtattggtgaccggagggccaagcttaattaggtattggctaccggagagccgagccatgtgaggtattggttactggcgggccaagcttaattaggtattggctatcggagagcagagccttgtgaggtattggttactggcgggccaagtttaattaggtactgactaccggagagctgagtattggctaccgaaaattcatcttttattattttccttgtttttatacatttctaaaatccttgcggctgtaataattagttacttacttaaaaaaggtttatcgctacccaaaaagttgcattctttttcagatattttagaattaattgccatatttcctagccatcaataccataactaagttaatctgtcaacaattatcatactcatgtagtgttcatcatttcctttgtctcagccttcaagtattctgcttcattgaattacaacaaaaatgtggcacataatttaagtaccatcataacccttctttccaccagaaatattcagattgtaaaaattaaagaataattggttataattataattaatgcagatgtcataccctaatagcaattggagtattttagcatgggattcgaccataccaaaacacaaatgtaaaagatctccatcaaaacttttgttaataatttttctcgcatttaaatgattaagttggttcttaagttaaattacccaaaaa

SEQ ID NO: 21659 - DNA, 2069 bp, Heterodera glycines
cattggccaatcccatcaaatcccatcaattgacaatgccattggctaatccaatcaaatcccatcaattgccaatgccattggccaatcccatcaaatcccattgctattggccaatcccatcaaatcccattgctattggccaatcccatcaaatgccaatgccattggccaatcccatcaaatctcatcaattgccaatgccattggccaatcccatcaaatcccattgctattggccaatcccatcaaatcccattgctattggccaatcccatcaaatcccatcaattgacaatgccattggctaatccaatcaaatcccatcaattgccaatgccattggccaatcccatcaaatcccattgctattggccaatcccatcaaatcccattgctattggccaatcccatcaaatgccattgccattggccaatcccatcaaatgccattgctattggccaatcccatcaaatgccattgctattggccaatcccatcaaatgccattgctattggccaatcccatcaaatcccatcaattgacaatgccattggctaatccaatcaaatcccatcaattgccaatgccattggccaatcccatcaaatcccattgctattggccaatcccatcaaatcccattgctattggccaatcccatcaaatgccaatgccattggccaatcccatcaaatctcatcaattgccaatggcttgaattaaattattctttttatttaatttaaaatttcaaaaaaaaaagtttttttatctaaaaaacaaaaattgaacagtaaaaaatgcccaagtgatcaatgccataaaaaagtgcaagggtaataataacacagctgttttttaatttatgtttcaattgtccttttccatgccaaggcacgctttgactgttggcttaagtgtcacgtaaacctgaaaaattaattattgtaatttaataatttaaaacgattgaatctacccaaattccgaaaagtgccgtcagtgaaacgggaattgcaacaattccggcgctaaattgtgaattaagcagtttattcataattgtggattacgaaatttacagtgtccacctgactacgcccatttgcagtgtgactacggtagcggcgacggcgccggacgcggcgccgccgaggccgacgccgaacagcggcgagtcgccacacgccaacatcgcggaagcgcacgtcgttacgcgcttctcctcattcaagcgcttgtaacgctctaattcatgctgaaaagccgaaaaagttttgggcagaaatggggcaccattgctgaaatatcgctgcaaaacagtgagtgcccatgccatttacagtaccctttcaatattcaattgggtacggtattcaaaaattgcaattatagtaattcatttaatccaaacgccggacattgatggattcttgtagtcgggccaagttgttattgcgcacatcaccagaatatattttaggacacctaaatttgcattaatttcgctattttactgtacctttgtctcattattgatacggcggcatactgagtagggaccaaatacggtacgttaccggtcgtaaatgttcagcgccttgatgccgtgctttatgtgtgcctcctgcagcttcttctccgccatcattcgacttgaccgtgtcgcgcgatccatcgccctacagtacgccacttttgcctccatcgcaaaatccacgcaagccaattgtaaattactgtaaaacaaacaaattgagcacgtggtaatgggccaaaaaacaccgcacgcgtttagaatggcacgcgggtccggcatttcgacggcactgtcgaaaatgcgggcgtattccttaaaaattaataaaaagcaaaattaattagaaatttaatattaaaatagcgcgaccactcacccggacgcattcgacgaattttcggacggtcattggccgcccattgagcatttttggcttcagcaaattcggtgccaccatcgactcgaccagtcgcttcacttcgtctcggaacacgggctcatgtctgagcattttttttctgatt

SEQ ID NO: 21660 - DNA, 1371 bp, Heterodera glycines
gcagcatctccagcgccggcatctggtacgatggcatctgcgatgacgtttactgagttagcaatcaaataatttggcaaaattatcttttggtttttcaggaccaaaaccgcagcatctccagcatctgcatccaaggggtcaaacaacaagcccaagcagcaaaagaactcggcatctgcttcaatgacatctgtgatgaagcggactcagttagcaagcaaatactttggcaattatcttgtggtttttcaggaccacaaccgcagcatctccagcgccggtatctggtacgatggcatctgcgatgacgtttactgagttagcaatcaaataatttggcaaaattatcttttggtttttcaggaccaaaaccgcagcatctccagcatctgcatccaaggggtcaaacaacaagcccaagcagcaaaagaattcggcctcggcatctgcttcaatgacatctgtgatgacgctgactcagttagcaatcaaataatttggcaaaattatcttttgggttttcaggaccaaaaccgcagcatctccagcatctgcatccaaggggtcaaacaacaagcccaagcagcaaaagaattcggcctcggcatctgcttcaatgacatctgtgatgacgctgactcagttagcaatcaaataatttggcaaaattatcttttggtttttcaggaccaaaaccgcagcatctccagcatctgcatccaaggggtcaaacaacaagcccaagcagcaaaagaactcggcatctgcttcaatgacatctgtgatgaagcggactcagttagcaagcaaatactttggcaattatcttgtggtttttcaggaccacaaccgcagcatctccagcgccggtatctggtacgatggcatctgcgatgacgtttactgagttagcaatcaaataatttggcaaaattatcttttggtttttcaggaccaaaaccgcagcatctccagcatctgcatccaaggggtcaaacaacaagcccaagcagcaaaagaactcggcatctgcttcaatgacatctgtgatgaagcggactcagttagcaagcaaatactttggcaattatcttgtggtttttcaggaccacaaccgcagcatctccagcgccggtatctggtacgatggcatctgcgatgacgtttactgagttagcaatcaaataatttggcaaaattatcttttggtttttcaggaccaaaaccgcagcatctccagcatctgcatccaaggggtcaaacaacaagtccaagcagcaaaagaactcggcctcggcatctgctacaatgacatctacgatgactcttactgagttaacaatcacataatttggcacaaattatctt

SEQ ID NO: 21661 - DNA, 1443 bp, Heterodera glycines
tttctgttcctctttctgttcctcttccactttctgttcctcttacattttctgtttcaatttctgttcctctttctgttcctcttccactttctgtttcaatttctgttcctctttctgttcctcttccactttctgttcctcttacattttctgtttcaatttctgttcctctttctgttcctcttccactttctgtttcaatttctgttcctctttctgttcctcttccactttctgtttcaatttctgttccactttctgttcctcttccactttctcttccactttctgttcctcttccactttctgttcctcttccactttctcttccactttctgttcctcttccactttctggtcctcccgtacccggtttaaaaacttggacccggacccggcttttctagacccggaaatatccggaccctgttttgcccaaatacccggattcgtctaaccctaaaattaactcattttgagatttataaattatttaaatatttattagtatttgtttatttttaatttttattcgattaattttaatatttattattttattaattcaaaaaatcattagcattaatttaaaataccataaagttaattaattaaaaaaataaatttaaaaaaacaaaaattagaataatttcaatataatatttgctttaaaataatcagaagaaatgggactctaacccatggcaagccagcaccaaaggaaggcacactaaccacgaccaccggatcgcttgcctccttttaatttccttttcactttccttctttttttggaataaaatatttataattttatgtttaggtaacttattaatttgtctccatttttaaatgattttgcacaaaaaaggtcaaacaatagatttttgggctaaattagaaagaaagaattattatttttaatatttaaaataaattatttttaacaaacttaattaattttaaaaaaataaaatcattcaaaaaatgtaataaaataatggatgaaaacacccagaataggtgggacccgaaccgtcgcccaccaccaccaaaggcaaaaactaaaaatgtatgctattaaaacagcaataatttagctggaaatatttattgaataaaagtaggagcagtaaaagggctgatgatgtaaatggaaacaattgataattaactggggaaagaaaaggaggagacattttttgcttattgaaaaggcgaggttaaagaccactggcgagtgtgcattacatataaaaaaaggaaagaaaggaaagaaaggaaagtaatcaatttttatccaaaagtactttgctccatattttttattatgcctttctttctcttttaactcacttctaaaattcttataagaaaaacattaaaaacaaattttaaaacgaataatttaaatataatatttgacgggaaaatcccata

SEQ ID NO: 21662 - DNA, 2467 bp, Heterodera glycines
  misc_feature (16)..(16): n is a, c, g, or t
  misc_feature (2236)..(2236): n is a, c, g, or t
  misc_feature (2258)..(2258): n is a, c, g, or t
  misc_feature (2404)..(2404): n is a, c, g, or t
ataaatgaatttattntggacccgaaactcagggcccaaaaatttacgaaaaatttctgaaatacgtagaaactgacaaaaacttttgttactaaaggtacaaaattcgtaaaattcgggaaaagcaggggaaaaggcgcgcctatgttgtaatgaccattaatgatgttcgagagtctcggtttctagtaaaaattttgcttacaaatcaacaaacaattatcgcgattagactctctctcagtgtacagtaagtaagccaaaaaatacagtatatatgtttatgcacaacacttactgtattcgtcgactgttgccggcggtggtgccattgcatcggcggttgaattggaggacgaataaacgacggactcatccgacggcggcgaaccgttgtgatcagtcgggggaggaggagaagcggacgagccaaaacactgacgaaggggggggggagagctgggatggacatctttgaagaccaaataaaactgcaaaaaaattttaaaaaagtaatttttaaatatttcaattaatgactaccgtattgtacgttgtgttgtcattcattttgtttaattttatttaattaattttttgagataaaacaacgaatggcaaaatgctgaattatttgcttaaataaaaccgaaagctcacctgacaatttatttaattaaatgtttctgaatttacataatatttgtgattttttgtgtctgcctttctgttcatggcacctgccaattaattaatgaaattacacgttttacatcttttccaattattaaataataaatgaataacgctttttgtccgtaccgaactgagcaaaaagaattcatataaatgatttttttattataatgagaatgagaatttattttttattttttgaaaaaggagctaaggatgagaagagtgacaatgtattgtataagggaaaggaatattttccaaaagctttcaagccattttttggtgtccgatcaccgtgatggaatgatctaagcaatttggtgtaaagtaagcgttttttctgcttgcattaaaatttagcttaaaattagtatgcattttttcaaattaactattaaattatggaatatcaaggtaatatactgagactgttttctatatattaaatctttttaaattttcaatttataaaaactcttttaactttataagactgaatagaagagacccgatatggagcggaatcccgcgcgggattttgtggacgggatcgttctgaattccgcattattttttgaaaatggcaaaatttgctgaattaagcaatcccacgggatttcattctgtcgcagcgtgacccgaaaaatttaattttgtaagcgatcgtcctgaatacataacggattttaaagaatttttttcctggattctacatgctctaaatagtaggaaaaacactttcttttttgtgcttgcgaacaaaagttgggacttttatttacatatttttacatattagtagatttttatacatatttacatattccggaattttatacatatttggtaaatatttttggattttttttttcttaattttcatttttttttacatattttgaggattttttagggaaatttttgaaaatcctcaaaaaaattgaaaattacgtcaatttgtcgtatatattttcattttctttttcacatactttgagaatttttgaaaatttatagaaatttcttgttaaaaatataaaattttttttgaaaatgtaccaatagaccaaaaataatttttaaaacactaaaatgtgattctaggccctatttaggtcattttaatggcattatgtgcctatttcaccctttgcgaagaattcttttacaaaaaataatcttttaaaaattttatttgcatattcggtacctatttgttttttgtacatatttcgggatttttcttacatatttatgtacatattttgactatactttttgtacatttttttgacagcactagtcattatacaaaacaatggtaggggtaattcgtcgcttttaaaagggaagaattcttatataattataattatggaagttctatgctttcacgcccaatcaataaatattaaaaaatattttgaatacagtcttttttaccaaaacaaattttcttcagaataggcgaacaaaatggttttcttaactatgaattttcctcctaatatgtatatttctttttctgtgccctcanaaatcgaagtccgatgccatcnggttcgtctgtctttccatggccaaccgaactctgttggccagggttggcaatcacatggcttggaattggcacattttggtgcgcggaaatccttaaaattatttaaataatattatttaattaattttatttgcctttgcttgngtgtccatgtgcacatccgtaacttcaatgttcatttcttggccaattgctttgattgcttgg

SEQ ID NO: 21663 - DNA, 2371 bp, Heterodera glycines
ctactgcagaaacatgcactgcttgagtccgacttgaacattgtggcagaccaaattcaattggtcagccgcgaggcggaacacttcacgcgcgaggaagggccggacggaaaaggttggcacggcaaagccatgggtccggcaaaaatgccaagtcaacaacggcaattcccatcagcagggtacaagcctgtggagccagccgtggtgcaggaacgggtccaattcctggatcaacgctaccaggaactgctcgaactcgccgcccgtcgcaaggcgaacctcgaggcgaacaagcgattgtgccagttcaactgggacctgaccgacttggacacgcacttccgggagcaggaacaagtgttggcacagaaggacaaaggacgagacattgtgtcggtgagagaagcaaaggaaatggaaggccgaaacgaatccgccaaaaggtcaaccgactgttggccaagcacaaaaatgcggagaacaacttggccgacctgggcagaggcttggaccaattgcagcagcagggccaacagctggtggacgagcaaatccccgggtcgggaccggtgccgttgcggttggccgagacgaggacgtattacgaccatttgagacgattggcggacgaacggcgcaaggaattggagggggcggtggagtactaccaggtcaaagggatgccgccgaatgacctcggttcaacgacggaccgtttagttcttccacgacgcggacgacgtggaggcgtaccttttggacactctccgcgtggtcagcaccgacgacgtgggccatgacgagtcgtcggtgaatttgctgatcaaaaagcacgacggagtgtcggacgaattggtcagtcaatgagcgaattggtacataactcggactgatcggagtgatttggcaaaatttgaaggaacgatttgaccggcagattcaacagttggagacacaggcagacgcactgccggaagaggcacgagcgcacccggtaaaggaaatgggaggacggcattttttaaatccatccggcaatctttctcaccgctaagaacattgcgtcacggatcaacggcacgcagcagcggaagtccgatttggtggaggtggcgcggctgcgcaagcaaagactgctcgacgcactcagtttttacaaagtgaggacagagggacaaaggtttttcagtcaaatgatcaattaattaattgtgttgttaagctggtggccgacatcgaatcggtggagtcgtggattgatgagaagggcaaactgctgaagacgttgatcccggggccggacttggaggaggtggagataatgaagcatcggttcgagacgttgcagaacgacatgcacaaccaaaaggccaaagtggacacaatcaacacaatggcacgggacatgcagaaggcaatttacactcagcagatgattagtaaaaccatgaacacaattatttagcaggaacatccgaactctgatgacattttggccagacaaaacggtaattcagaaatggaagtgtcgtcgcaatttgtcagtttgacaccccccccccccactaattacccctaacaacctccacccatcactttaaagctttgaacgcccgctgggcacaactgagcgacatggtctcccagaagaaggaggagctgaacaaagctcatcgcatggaaacgttcagaatcgactgccaagaaacgatcacatggattgaggaaaagacgagggttggcattggcacaaaggcaaaaactatcactaattaccataattaggtgttggaagacaccgacgaaatgaccggcgaccttaccggagcgatgaaatagccccgaccactttccatgatggagagggacctcgccgccattcaagccaagcatgccacgtgtttgggactccaaatattttccatatctttgcattctcagactccactcattgcccacccaatcgaatgccattgagcggcaaaagccgcaagaaacggcaccaaatcctcagaacatgacgcgcattccactccctcgctgactgattatgacggaatccgactttgtttctcgcggtcggttagggtgaagatatattgctgaatccactggtgcgcgagcaggagtgtaaactgatctacgcaggcgacttgtcgcgatctctgctccactcgtagcatatcaaagcgaagattcttatgttccgcccttagtctgcttggctaaaattaacaacaaaattttgaaaaaaattttttgcttttttgaccagtcattgttgctccttcaattccttctgcaatttcggcgtccgaccaatttttttgcttgcattttactatcaaaattttttgatcgtccgtca

SEQ ID NO: 21664 - DNA, 1788 bp, Heterodera glycines
  misc_feature (1753)..(1753): n is a, c, g, or t
  misc_feature (1783)..(1783): n is a, c, g, or t
tgaataaaataaacataaaaaacggtttttggcaataaaaatttaaactaacaataagaaaaacttaattattggtctcatgaataatttttatatttttattaaaaagagtggcatgttattaaaaatgtttattaaaatttgttttgcaaaaaaatccccattcgaatttgtaaatcaattttggtcagggttggcagtgatggaaaaagctactctcattttgctatttgttgtacaacaacagcaccgtccagcagcagtcggtgcagttcgatcgtgcggaacatggaatagttgtggccgtagtcgtggaacagtttctcccagcggcgagcagtgcgcgactgcaccggcccaactgcgtcggcgtccgcagtgccggcgagggttgtgccgaccgtcgtattggccgtcggcgtcggcacggatcggtgcgggtagtgcgcgtacagcggctcgcgcacaatcttgcggttcagacgacggacggtggcactggcggactgtcgggcgagtgccaactgatcaagtgggagagagggggatggcaatagttaattaggcgcttaattgggaattgcgtgtgaggtgagtgaatagccgcagggcaaaaaaaggaaatccaattaatgatcaaactaattaagtgggaggggagtggcaattaggggcttaattgacaagatgagggaaaaacggaaaacaaatcaagaaacatatggtattaaaggacattcaagcagagagagtgattggcatgaattcaaatcggtggcattttaaaatagaaacttaaaaaaggaatttttaaagaaatgtccacctttttttgcttttcagcttcaagacagttttgccagaacagtttgaccctttgcaacactttgaaatggcccgcaactgttgagaagatgaactcgcgctgaaataattaattataattaaattttaaaataattaaattaattaaatattttggcaccggcatgccattctctctctttttctcacatttccctgctccttgttcagctgaatgcgaatgccattggaaatgccctcctccacatttttgtactcatccattgtcacaatgtcgcgcaaaagaatctttattaaaaaatatattttaggatttcgaaaatttggcagaaatttcgaacggacggaccaccacggagacgagccgttccatgcgcgaggcgaagcacaaaaaattggcggacaaatgcaatcggccgagcacacaacgcttgtcgtacggagtgtaactgaaacaaaaaaggacaattataactcgtccaataattttttttaattttaatttataaaactttgtttaaaatttctaaatttttttaaaaaattgacaaagctaaaaaatcttgaaaatatttttcttaattgtttttctttgtggctttggcacttctgcaagacatttctctactgaataaatatgtaaacattacagtggccaagcattttagcagtttcacaattggattatttattaataattaattacaaaaatcgaatcgataatgaaagaattaaattaaaaggtttacaggcgacaagtcacgtcgccgtccaatcgttcgtcgtgcggcagcgagaaacggcacctgaagacaatcattggcaaaaccatttgaatagagaatgaaaacaaatgtttaaagatgaaatttgacaatattgtgggtaatgtaagcttccctactttaattatgctttgtatatccanattattaattattgctcaatttgttctcgngttta

SEQ ID NO: 21665 - DNA, 1428 bp, Heterodera glycines
gagaaagaggaggaggcaaaaagaaaggaagattgcgggtgggggatgggcgagagtggtggcgttgggcgtcggaggctcccgcaacgcatcccacgagggaaatccaattgaagtccttacaaaaagcactctctgggccaccgcccatccgtccgttcctttttgcttatgctttcccttcgctcggatgcttaattaactctcgacagagatgcaaaagatgcgctcccgacttatccgttctcctcctttcggaaatggcattccttcgcctaccaatggcaccccttctccaaattcattcaattcactccttgccgctccctttttcttattatcaaacgttcaacaaattttctcacaaaagcagaaaaatttcgtctcaaatgcattaattattgactgaaaaccgaaaaaagaggaagagaaggcgggggggggggggggggggggaatacttctgaaagggggaagaaatggggacaaagcgaaattcagaaaaaagggggaaacaacgcaattgtgtacaaaacactaggaattcttctgcgaccatattggtcaacaaggttttcaggtttcgcaagtgttctaattttcagatttacctgaattaagggtagaccaatatttgaaaatatcaatttttaggaaataaaatgttgattttttccgtgttaattttggggtaaaaatttgcttctctaacaataagcagtatgatattgaaaataaattaagaacctgtaaattatcaatgtaaggaaattgcccactgtaaaacatctcctataaaaacctatttaatttgttcactcacccgaaggagacggtcgaatttttcagcggacaaaagaaagcgtccgtcgtccaattgcatttcgcgattctccagcaaattgttcaaaattggcagtacgttccgttcggccttttccacgccatcgataaataaaatgcgtccacagagagcggcacggacagcgcactgaaatgtgaggaaaggcggtgaaaacttgagccggatatgtctggtaaacttttttttaaatcgcttacaagcgctacaggcctaacctagttttcccttgtcagtctgggtgggaaaaatctggttcgggcgcctggtgggtttgcgaaagtcctagataatcaaacagtagaataaatcttccaaaatgaggaaatacgaaaaaaaaaaatgtttggctttgatttttcgttggatcgccccccccccctccatttaccaaatcagtgtaataggctgaaccggcgcggatttcgcgcctttgtttgatgtcgacctctgtcgtgtcccgcgtgatgctcagatactcaaactctcgattgcagagttcctttatttttttaagaaattggactattccatttggcattccccacccataaattggtggactc

SEQ ID NO: 21666 - DNA, 2082 bp, Heterodera glycines
ctcttctcaatttggaaggcaaatgcccctctgctcactctgcctttaagggtggcacgccaaatttggccagggcatctcctcaaaaatttggttgccaaatgcctgccctctgtttaagagtgtcatgccaaattggacaatgccaaacaaaacacgtggatgatagccccaggctaagcacatgcttactcaatgatgtagcaaatattggtttttacatttgcactttatatgaattacaaataatttttgtaatattaaaatttttattatatgaaagaatgatgcgaatgtgcggtgactgacatttgtagcgtcaacaaaaaaacgacacaatttctgcgcagactttgcgtcacttacatttgcggcacttacatttgcggcacttacatttgcggcacttatatttgcggaccttacatttgcggcacttacatttgcggcacttacatttgcggcacttacatttgcgtcacttacatttgcggcacttacatttgcggcacttacatttgcggcacttacatttgcggaccttacatttgcggcacttacatttgcggcacttacatttgcggcacttacatttgcgtcacttacatttgcggcacttacatttgcggcacttacatttgcgtcacttacatttgcgtcacttacatttgcggcacttacatttgcggcgctgagatacaaccacataatggacgcaactcatacacaaattttatctagaaaaatctttttaattgacaagtatttttaattgggagaacccaggaaaaatatcagcgccgcaaacatttcgcttggaatgggcgatcgtattgaccaggggtggagcgcgaccgcgattcgcggcatttttttttgcgcgatccgcggtcgcggccgcgtcaaattgaatgcgcgatccgcggtgcgcggccgcggcattttttttttgcgcgatgcgcggaatttggggctccgcggcaattttggaccatttttaaaaaaattattttttgaagcgattgttttttacgttaaatatttttaaaaataattattagtttatgtaaaagcaagagatttgaaaattggattctttttctcactaattccttcaaaactaagaaaatattcattaatttttctagacaattttctttttgtaatttaaagccaaatgactcatgaaaaagactctatttggttttattttgacaaaattgacaattcttcttatgtcaaatgcaaagcatgcaatttaattttaatgttttccgtaaaaatcttaattgttttagtcatcaagtggatcatcaaatctctcaattactatggtcattgatcacccggaaagctaaaattggtgccgcaaatggacaaagatcgggccgaattcggcacgagacctcggcgaaagtgcgaattgaatgtggaatcgaacaaaattacagcaaaaaaaaaacggaggttgtgagaaggcaaaaattcgtgacaaagcatgtggaaatgcaaacgcgacaaaaaagggaattaaaaaaaattaaaattaaaaaatgcaataaccaccgcttcattctgtgtctgtacttttatggcactaatttggacaatttgcgacgccacacttcgtccacaatattctcaacgacctcaaccaattgaattcaatcagctgctgccattccttaccccgatttgatcgctgatgatgggccaaatgcaattggtggccacaagcattgtccaaatggctgcacaccagggctggacgtaactgattttcaattacggaaatccgtaatccgtcattacggcgattttttcagttacggccatccgtaatccgtcattacggaggtccaaaaaggccgtaatttggcgtaatccgtaatacgtaatccgtaattttcaaaaaattttaaatttaaaaaatttttaaatttaaaaaatccaatctaaaaattgttaagattaatttatgatcagaatatctgcttgtttttttgaggtgaaaatcccaaaatagtttttttcgcggtgtgctttttccaaaaaactggggaaatgtgggggggggggggg

SEQ ID NO: 21667 - DNA, 2301 bp, Heterodera glycines
cctcactcatcctggcatcgttcgaatgaagaccctagctggagaattggtctagtgaccgtcgatgcacaccaacattgaatcactcgtcaaaagttgtgttccgtaccaagaagcggccaaacggcccgcaaaacagcctctccaaccatggccaccaacaacatccgttttcgaacgtgttcacattgatctggcagggccatgcagtaatggtaaaacatacctagtggtaatcgacacttattcaaaatggcctgaaattttccagttaaacaatacttcgtcccattcagttagttcacagttacaatggttgtttgaccgttatggtgttctgaaaacgcttgtgtccgacaatggaccccaattttcgtcatccgtttttgaggaattttgcaaaaataatggcattaaacacattttcagccctccatatcatcctcagtcgaatggagtagcggaacgttacgttgactacttcaaacgccaactcaaaaaatgcagtggtgatcgaaattggcttagcaaatcacttctctcatatcgatcaacaccaattgctattttaggccaacgctcaccagctgaattgtttttaggccgaaaattgcgcacaaaattgtcactcatgaggcccgaaaccattccaaagcaacaacatcacgaacacacgtccaaaatgaaattgcaatttgacaaaaagcacagtgtaaagccggtacagtttaaaattggagagcaagtccaatttctcaattaacgaaatggtcaaacactttggcttttcgggcgcattgtttcaattaaagggctaattttcgaaatccgttcccctcagcttggcaaccgaatcatcacgcgtcatgccaatcaaatgcgaacaacaatggcacagagcggtgacgaaacatgttcggttcccgatgacatcattttcgcgagggaggagcatggaaccggaaatgaaacgacgaccggaaatgaaacaacggacgatcagcagacaaacacgcagccacaacaacaggcagcgcaacaagaggaacaaaggcaaaaccaacaaccaactttgcgtcgttccgaacgaacgaggaaaagtgttcgttttcttagtccgacgcacactggacagagttacgatcactgataaatcaccacacacattaccccaaaacaaaatcaaatttttaaccttttcacttaaggggggaggtgttgtgtagtgaatttattatatatttaaattcacgccaaatgatgatcatttatttttattctgtatcacccaattattgtccatttaatgagtggacttcgttcactcatggtctttttccatattcattcactttatcaacaacacaccgcagcaatggcatttgctccttcattggttattgattaatttcctctgactcatcatttcgttctacacttttaccttttgaataaatatttgtctttactattttgttgtgccaaacgcacgacacaacaactattttgttgggttttatcaataaagaaaaagtgatttttaactttgctgagacggaattggctagacggagttcatccctacggcgataggcgccgccgcgttaggaaaaaagggaatttttatatttttcttcgtacgtcattgaaaaaatggctaatttcagattcgaatttttaaatcttaagggaatttgtgtgcggcggcgccgataggcgtcgccggaaattttttggggtttttaatgagttttgttaagaaaatttattaaaaatttcaataatttttcccttttctcccttggccggcaacccactccccgaaaaggtcattcttaacagtgtaaaaatttctcggtttccgagactaaaaacccgagaccgggaaccgagaaccgagattctcgcacatccctaaaaattatgggcatactttatttatttatttgcatataattaccaaacatagcaccgcctaaatgttcaaactaagcttcgtcggtaataagtttttaaatcgaatatttaattaataattatttccagtatccttattttcattttctaaaattttagtcattcaatattttctgcgtacaatagttactaaatactgaataaattgttttatgtttttaaaaaatgtattttttacgttagacgctttttttcgcccgatttctcgcgttctcgtaactaattcatgttttctcggcattccgaaatttataatgcttattatgcaatttggtttgaatatatataaaaattttaagaaagaattttcgtctttttgtttaa

SEQ ID NO: 21668 - DNA, 1864 bp, Heterodera glycines
cagagggcataaaaatgtggaaagacccacaaaaaaatggtgttgtggaaatcaaaacggcacaaatgaggtaaggatcatttgctggagcggtagggaggggtgggggtaattagttttaatgggcatcatctgattaaattatcattttatggggaaattaatccggcgtctggctaatttctgacctaaatacgcatcagctctatttttatagttaagaagcgaaatacacttttaaatgggttgaatgtttctcaaaaatgtcataattaggaaattttctgtgccctgaggcaatttgcgtgcgcattttgccccaggcgcacgccacatttggaaatgtctgtttctgttgtcctcggcggacggaaagtgatggatgaacgaatgaattggatgacgaacacattggtgaacaacaacaataaaacaataaactaataaattatggaaaatgcaaatggtacacaaaaattacgggccgttgttagcatttgggggacaaagaacgaagaaaaagagggggacaaaagagcgaagaaacggagaggaaaagaaatggaagcaagagaaagagtggaggaggggtgagggcaaagcaccgccagttgtagataaggtaattgggatttaaaaattcaaatgtaaagagaaaatgaccaatttaaaatattagattaattacgaattacattttttattttaaaaaaacaataaaaaaatttaaggcaaaaccaacataatattttttttattaatttcgattttatttccataaacagtggggaaaattcattgttttgtttatagcagccgaaaatggggcaggagcatcacaaaaataatttatgtatgtttccaaaaatatcctttttaaaaaggcattccatctcatgtgcaattaattgattattggggggggggggggaatattcctattattttaaaagtgtaaaatgtatattaaaaataaaaataatgtataatataatacatattacgtaaaagaaagagtgcattcgaaatttgaaaaagatttgttgggattacaaattaaaacacagctaaaaaccaaaaaaaaaaatgctaaatcgtaacggaaaaagtttgaaaagtgttcgaatttggactgtcggaacaaactttggcaaaaactattagcatttgtataattaggtagatatgaaaattgtcgcgggaaagtgcacttcgcaaagcgacagagacaaagggaggaaaagcatttggagaaaaagcatttctgggaaagtcacggggacttcattcacttgcggttcgtttggttggttgatggtctcggcacggaggtggacaaagaaagcgaaggagcagaagcaaatttttaatttttgtctaggcaaccgaaaagtaaatttaattggcactcatttgtttggcattttgtaacatacaataaagaaaaagtacccgtgggcgtcgttagtttaaaatttgttgcgctcttccttctaacataataaatgggcagcaaagaatgaatgactgatgaatgacacctttttgcgcatttgttggactgacccaattggcggttactgtaattggaaaaggagtggaagtgcgcgtgagtgcagcagagaaaaataacaatggcagacaatcgtttcgaaatttttttttttaaagaaaccgtcaaaaaccacaaagagcgaggcttcttgaaaaacaaaaaaagaaaataaatataaaaccttagcaaaataagcgtccgctaattgagaaattagaaaagggataaaataagctgcaataaaatttagctgaattatatttaaaaattatgaagaagaaatagtatcaaatattttaaaatgaaatg

SEQ ID NO: 21669 - DNA, 1075 bp, Heterodera glycines
  misc_feature (106)..(106): n is a, c, g, or t
agaattacaacttttttgattgaccaaattttaaaattttgacattagtcaaaactatacatgtctagaaactaatgataagcttttattaagcgattaaaatatntataaaaagatgcaacacgaaaaccgcaaaaagggcagaattttgcatatttttaactttttacgtgtcggtggtatatatctgtgtattcttggaaagccgatagagcttgttaagagctttcgaatgttcctgtgatttggtcaacaaaattatcacgttcttctaaacttggctcattgtcagtttgacccgctttggttttttgataattttttttcttacacaaaatttgacgctttcacttttaattcgtttgttcagtgaacgcgaggccgccctgaaggaggagcagtcgccgaacaatcagcaggacacagcggtggtgtgggagcgggtggcacgaatgatcgaaggcgccgcagctggcacaattggagcgccgatcggtggcgcgaaaggggccaaaggaggcgcgcaaagcgtcgcttccgccggagggggaagcagcggcggaaaagacaccacgcggatgaagcaactgatcatcgcattcgcccggggagaccatcaacaaaatgagaaaagcccggacaaagagacgacggaggcgtgagaagggacacgacggaccaatggacggaccaaagggttgtggacaaacagagacaaatggaaatggtgtattgacccccccccctcattcgtgttctgacattgcgcttcggacaggatcaaatgtcagaacatttgtaccgaaaatgcccatccctgcttatcggttggctttctgtttttttaaaacgacaaaattctaaattaaacgtgaattaaaagttaaacaaaagacagattgctttccattctcacatcaatttatttccgcgcattttatcgtaccaaagcggtgagtcattcgtggcattcatttcgctgtgattttgtttttaacattttacatttgtcttacaattaggcacagaatttaatcactcggaacaaatcacagttcggcggataccatgactt

SEQ ID NO: 21670 - DNA, 997 bp, Heterodera glycines
ttttgttagcactgactcatttagcagcttctgaccccctctcccccccccaatttcctccgttttttattcgatgcctatcaaaacgtttaattcggttattccattttatattgactgctcacttttctctataatttcttttaatttggtcttttctttcctttttctaaatgtgcataatttctgtatgtatttgtgttctacttattggacggtggtaaaaacagataaatatattaagggtcattaatttaaaaaggaaacgaaaatgatttaacttaatttattatttattagtaaaaagatattatcaaacgaatgaattaattaaatcaactaattataagcgaaatggacaacacaaataataaattcattttgttgaagaatggggcaaaattattctatgcttctgaagaatgcgtacgtcaggaagcgaaaaactttgtgggtggaattgtcggtttgaatgggccttcggatttggaggagggcatttatgagggtgagcttttccgactgattgttggccatcaattagtgctaatgagtgcgcaggtggcctcaaaatttgggagtgtacggtcgacttgtgcaattttctactcagcaattatcagacaatgagcggaattgacattttggaggtgcccgaaatgaaagagtgccaactcttgcaactgattaattaacctaattaattaattagttggggttgcgacaaagggtctctcttcccactgaatgtttcctttgcttttcctttttcagttgggctgtggcgccgctttgccttcgattttggcgctgtcaatgggcgccgattcgatttgtgtcaggatttcgtgcgtactttgcccattgttttttgatggccaatcctttcgcttcttcttttgccttttcagaatgcttttgtcgtcgaatgtttcaccaaaaggaatttcgaattaatggccataaaattgacggtggaaatgcgctttataaacga

SEQ ID NO: 21671 - DNA, 864 bp, Heterodera glycines
attttctgatcggaagcgatcgggcggcgctttcgtctgaatgcttttcctgtgcttttcccttcttttttttgctattcagtcttttggctgccaaatcgcattatttcggcgtcggcggaagtgttttggcattcgttgaattcgtccgctcgcgaggaaaattcgcttacgttgaggaaatttggagcaccaaaaaatgtgccattccacgcaaaattctgcaaatatcgcggaaaaccgaataagaaatgccaaattgttttatggtcattgtataaactgctgttaaattttggtggaaaacgaattgaaaagggacaaaagaaaggggagagaatgcaaaaaaagcgaaagtgccggggacgtcgcgccgttccgactcggctgcgacccgtaatggatttggtggtgcatttcgtcgtcttccgtttgcttccgccggtcggcttttcccccatttccctcctcctcccattgctcccagccatcgaatgggtctgccgtcgttgtctttggcgttgttttggcgttgtgccgtgccatggcatttccccgccctccgttcgtctcggcttctcttctcccttccgcttgttctgctgctgtctctgcccatccgtttgttcgtcttccgccgttgtttgtccacattctctcttcttcctctttttgcccactctctcccgtttctttcactctcctgtcttttgtccctgctctctcctcttcctccgcgtctctgtcctcctcctccttttgtccactctctcccttttcttccatttcacttctctcttcgaattcgcattttggcatcaaagttcgcgttgtgtcttttaacactcggaaaatcacttgcca

SEQ ID NO: 21672 - DNA, 1197 bp, Heterodera glycines
ataaaactgcactcaccaggatcgatctcttgaacctttttttcaaaaggcttggaaaaaataacaaaaacttttgaaggttttggaccaaaaacaagtaaaaatttctttttaaatatttacctaactatgaaaaaaataattcgaaaaatcgaatttgctgtatgaaaaacgttttatccttacttagacctctatatttgaatttttaaccccaagaaaccctcgccctattcattatgcaaaaataatagactttccaaatgtctctcattattaaattaaattacctgcaaaggaatggacagttccgttcgagtccagtgtgtgccgccgattggtgttcaaattgttcgatctccacgcaatttgccaagtgcgtctcacaacgcgaattcatccagtccacctgaaaaagtcggccaacttgagcagcgccagcacattttcctctgaaatgcgacaaaatgggaaactttacaaaaaaagcaatttaaaatatattttttaaaattagggccttaaccatagcggtacggtggagggcggatttcccccgggtgcactccgttcaccccccccccccccccgtttcccgcgcatcgtttcccttacgaaaaaatgttaaaaactgaaaatttttagttttctatttttttataagttaaatagaatttttttttcagttttatcattaaggtttttccttgaaaaaattaaaaagttagaaaaaaaattttttaaattttttttcgggggaaaatgtgctttgggggtgggggacggacgctccattataaaaatgaaaataaggaatttttagcaagaaacaaatgggtgcattctgaaaaataccgccaattttcttaataattcggaaaatttccaaaaattttccacgcggcggctaccgccatcgctggatttaaaaaattcccataatttttgaaatttataaaaataaaaaagatattttgttaaaaaaaaccaataaagcggctctacaattttgaaaaattacactacaaaattttttagggaccaaaaagaaagaaataaaaagttttcttttaggctggctctcacactgctccatgtccacgcccaactcgttcaaagtgatcagtcgctgctgcttctcccgcatttccacactgagcatccgctggaccaacggcaaaacggacataagccaat

SEQ ID NO: 21673 - DNA, 1690 bp, Heterodera glycines
taggtaaaaatattaattttgatacaatgtttttctcctgatttaataatgtcaccattaattattattttttttataatacatattccgggcactatgccaatcttctatagcgttgttagttcgaccattttcgataattaaaaaattattaattttcaatgtatttttaattcatcaatttacaatttatttaataatgttcaaatgtttttcattttcacaaatttttgttttttattctttcttttttttgttaatatttttttttatgttgctcttttaatatttattaaaaaatatttttataaatgaaatttgtttttaaatattttgtatttgaatggtttgatgttctttcacagcattcctgctggtcagtagcgttgctcgggccaggtttggcccagatccatacagtatatttttcaagactcagacccaacttttaaaaatccaatattttcaatttttttgttagatatttttatttaacttttttgtgctataatttttaatctttttaaaaaatgaataaaattgaaaattaattttatagtttaaagcttttttataatccgaaaaaaatgaaacaaatactttttaatttttgttgcacgggtccggttatctgatctgggtcattgacccggataccggcttttccataaggcgaatgcagctcaaatattaaattaaaaaagggcttttttattactcctgtgaccttatcagttattctcgtaaattcattttcaattcgttcacagagcgacgaatgttatacatcaaaattttcaggactcggaagaacccggcccggtttttagcaaatacccaaaatcctttgtcattcgttttcagtgcctacaactttaaatgaaaattttggtacattaaaattattaattccgaatttgatttcttggcattttgctttaattgtttatcaattttaatccaaaatttattttttaatatgtattttaaaaaggtattgagttttttgctctttaatattggtatttgacatatattaatttttattgcaaattgattttaattataatttaatttcccatttaattacgcatttatttaaataaaattactagttccatgtacatatggtgtaacccctttattgcattatttgttcgaccattttcggtatttttaaaactatgattaatttgtttcgatgtattttttatttcagttaatttacactttcatttaataattatgaaaatattttttcattttcattcgtgttttttaattaaattattatttttgttcaaatgatgaaaattaaataagattaatgcgtttatttagctttattaattttaatgaaaattaaaatacttttttcagatttaacttgcttttgttccttctttttttttgttaatctttttattttatggttgctcttttgtattttattaaaatatttattattttaatgaaccaatgaatatttgttttttcaatatttttgcatttaaaggtatattttaggttataaaaaaaaacataattaaaaaacgactaaaacgataaaccccaaattttaataaaatttctttcgcagaatccctgttgagtcgaaattagttttttaaactatcttatcttctaaaaattttatacattatgtaaggacatgtatttctgaaaaatt

SEQ ID NO: 21674 - DNA, 1586 bp, Heterodera glycines
atttatttatttattcaaaaataaaaataaccaaaagaagggcattgctgccacttacacttgaggtggaaatacgacaggtcaaaagagtagtagtgatagaacacttaacattggtgatgaaaaataggtcaatgggcagttgtgatatgagttgaaatttaatttaaagaagcggaaaagtcgacctccagcaaagggaaaattggtttttataacaatttgagtaaaaaattttttgggggaaatttttaagaaatttgtagtagaaatattttattgaatttgctggaggtctgaaaaactatttatcgaagcactgggggaattgtttttgaaatgattgcagttggaggagaaaattgtcaatttttgggagtgaatttggaatttgattttgtgtgattgttttttcaacctgtgaagattttgaagtgtcttcactggcctccttcggttttggaccattttctttggcgggagccggaacatttgtctgtggtggctgcattgctggtgccacgggagcagtgttttgttgacgttttctgacacgcgcttcgtattcctccttgagttgttccttgctgagcgctgggcggacgaacagacgggccaaattttgttgcgaacggagtcgagcacgctcgcgcttccatcctccaagtgccatgtgttgatgtgcgggtgttggcatgaccaccttgagcgggcgaggtgttgttcgctgcgggtcgaaccggccgagtcgaaagacggcggttggttcggcctcaacttcaagatggtccaagattttggtggtggcttccctgtcttccttaacacgctccgatgggcgaacagcattgctttccgggatgccaatgaagaccaatgtgcgttgacgttcttgctctgcgagtgcgacagtgtttgggtccaggtccagtgggggtgccattgaacgttttggttgaggaggagtgtcttttgttgtgttgcttcgcttcattgtcgataatcgattttatagagaatgtgtttttatctcaaacttgggtaattaaaccagagtctcaaaaaggatttatgacgcgctgcgcggtgcattttttaccgatttaccccatgtgaaagtcgtcaatttcaaattattggacccttccgcgcccgacagcaaagaaatttgggccacaagctcctgggacaaaatcccgtaaattttaaattatatatttttttaaattataaataacattagggttgtgatcgagattcacccggagcagggtgacagcgaacaactggttgcgatgttggcacatgaaattgccacggagtgacaagcaaggaattgcgcgaaaatggcgcgcattcggcgaaagagaaagccgagcggttcgaacaatgggtgggaataaatgttacacaaacaaaacaaaaaattcttggttaacggtttttttgaaagtataagacaaaaatatttaaaattattctctaaagcgtgagggaagatttaggcgttttcggtctctcaatgcatattctggtctatttttttggcttaattgattcgtctaatgaattatttccttcttctt

SEQ ID NO: 21675 - DNA, 2453 bp, Heterodera glycines
tacttatatggttcgtacgccacaaatttaaaactttttttaaatcatcttagcttgcttagaaagtcagtaggtacatggttttcaggggcgctgattaaggggtagatttcacatacattttcaaatgcctataaatgtattcattttttaatgaaaataggttttaaggggtttttggggtcggtgatcacgaatccgggctcagatcagcgctaccgttcactacatgagctgtacagggacaaagaattgataggcttcctgtaccaataataccctcattggcaagatgcccatgagtataccatcaatacaattttcgaactttatgtttcctgtaccaagggtaccctcatgggtaagatgccaatgaggatatcatccatacaaattttttaatttatttttgttcgaattcgggtccgggatccgaaattggccgaaatggatgccggattcgtgatcaccgaccccaaaaaccccttaaaacctattttcattaaaaaatgaataatttataggcatttgaaaaatgtatgtgaaatatgtcaggtaaaccacacaaatgtttcccgagaacgtgtgagataaagagagagagagagagattgaggaggagagaagaggggaaatgagagagaagagaggaaaggatatagagagaggggagaaagtgatagaacgagagagagagaaaagagaggaagcgatagtgaggggggatagagagagagagggagaacaagtgagagagaaattggatagagagataaggagagagtgagaacgagtgatagagagaggaaagagagagagagattgaggagaagagaggaaacgagagagaaagaagagaggaagcgacagagagataggagaggagagagattgaggagaggagagaaggggggaaaggaaagaaagaaaaagattaagaggagattaaaatcgcaaaaactacttttcttatttttatttgcctgcattataaccgtttgtttaaaaaaaattttgaagtagaacggagcggttgggaaccaagcgctcgtaaataactattgaacaattctgcgcatttagctcaaatatattatttcatacttaaaaaattttatatttgttggcgattcatctcgaattcgagtttcattggttaaacattttgctgcaatacttttgcgccgccttaattgcctgaatttgtttctccaatttctttctaaaaagttaaataaatctgttcatttttgtatatttgttaggccactaaatggggattattttgacacaaaaaagtgaatttttttaaacatgcattttttaaggattaaatgttcgtaaaaatttttaaattgcgcaaaaaatcccatcggagaagctaaatagtagcaaaaggcagaataatgttgagattttgatagttctactgatgaatccaatcaacattataaaatatttgcatcatatttaataaaataataacaaattaaattaaataaaaaataaatttggtaattctactgatggaataatttcatcattatttaataaaataataacaaatgaaattaaataaaaaataaatttggtaattctaatgatgatcaatcaacattgtaaaataattgcatcatttagaataaaataataacaaattaaattaaataaaaaagaaatttgataattctactgatggaataatttcatcatttaataaaataaccaatattaaacataagaactgatgttgaattccttttttatttttttttatttttttcaatcagtttttaattccatttcaaaatgcaattctatttgggagttaattaattaattaagacataatgatgtttaattcctttattccttttttatcattattttccatcagtttataattccattttcaaatgcaattccatttgtgagttaataatcgagaaattaattttactaatccgttttaattaattagaatgaggacctaatgctaattgcggttatgaaaggccgtccgaaaattcaaatcagccaatattctgtgcaaaaatatgaggcacaccttggcattgtgtattttatgaaaaacaattggcaatgtgacaaaattgtggatgtatttgacgaatttgaacgggcagaatgccaaaaatatcgaaaatatttggacattttgtacgaatatttgttcagagagtacgtcggaattcctacagtgaaaccaaaatttgtatttaaaaacaaaattgaaattaatgggccaataatttatgtggtgaattgtctagcgaaaatttcgcgattttattttaaaccaaattatagtaaacatattgaatacaaattaaagaaacttttcatttattatttcgaacaaaaattgttgaatgagaagagatttgaataatgaaattaaattgaaaaatgagcaaaaattccaattaatg

SEQ ID NO: 21676 - DNA, 1527 bp, Heterodera glycines
agattcgaagacaaaaggacatttgcggcaaatggacggagggcgaaagtttgacaattccaacgaattattacaacgaatgatgacagtgccgccaaagtactcactttgtactcaatcactctcccaatttcgcgaaacttcccatcaaaacacttttattgccccattaatcagtccgcgtgctcttccgatgccaaccaattggtaaatatctttttttctcttaaaatggcttccatccgtctaattctgttaacaatttattagaagttaaaagaaatttataccaaaaataacagtacaaaaatttaattatgcgtaatgaatttgcaaattgatcaattctaaattaagtgaaaatatttaattcttaatttgagcttgctttatatctcccgagcaattaactttgaatattttttataatttttattatattatttatatatttacaaaataaattcatgataaaaattccaatggttcggtgagcaaatgtttgttttttgttacttcaattattcactgattgtcccattaacgccacaactaaaattgaatgccaagcggggcgatcactgcaaagtgccgacaaattgtgcatcctttcgcggcccattcttccgccggtcaaagtgccatttggccgtccgtcgtgccgttgccctctccgtttttcttcccaattgtgcccgtcttcagaaaagtgtcgtgccattttttgacttgttctcgcggcggcgggtccattccaaattcggtccgaaatctggatattttttgcattttatggtcattcattagcccttcaccttcgtgctgtttgggtgtacgaattggtctcttcaaaccaacagaccaatttggccctttccaaaatgctaaaaacgcgcgacgctttcgacgcagtggccatattggcaataaaagcgagtaattaattaaaataaataaatgggtaattagtgaaagcaaagaacttttttgtttcttggcactatcttattgattttttaagagaagctttacgaaaaatcagtaaataaaggggagggacaacgacccccggggggagggatgcttttgtttattatttgagggaattgaaaagaaaaaggaacggagggaaaagcaaacaaaataaggcgagaaaagacctcacatattgaaaaatttaaaggaaatgaaaaataaaataaaataaaatgtaaaatataaaattaaaatgaatgaatgaaaagaaaaatctttgagaaagaaaggccaatggcaaaagcaattaaattaataaatcacctacaattcgcactaacaacaaaaaagtccaaagttcgtccgtctgatcagccaatggcttattccccccccccctcccccgtgctttctctccgttcgcaaatgtcgtcgcccgccttggccaattgccaacacttttctgggggggggggggggggggttaatttcaaaattaaataattatgattaaaaaaccaatattttctgaatatattttattaaattctg

SEQ ID NO: 21677 - DNA, 2138 bp, Heterodera glycines
ttttaatttgaatccctcttatttatgcgtttatggaccctttcccaaattatcaattaattataatcattaatggagaaacataaaaaaataggcttaaagacaattgtcagtggtaaggttttgaagtaggttaaaataacatgtaaactccacgttttattcattatttacttataataaattaaaaatttatttataaattaattaattggctttttcactgggctcataatcacctgtcgcgcgtccaaacgcattccgcgcctcatgtcctgcaacgcaagctcaacagctttggatgtcaacgtgctaccgcctctgtacttgatgtcttcaattgccttacggacagtctaaatttttgaattttgtcaaattatcaattacaggttaattaatcacagtgaatcgatctggacatgatgagtccaggcctggattttttctagatccaggatacatttccaggctctttttggacaacctggactttgtcactgaacttggatttttgtgcagcaaatcctaggtccgggtcaaacacgaaacccagacccatgcttttttcatatttttaaaattatttttttccagaaccttacggtcccggcccaggccaaggttttgtcgtagcactggactgtttgtgaagctaatgatccccgtggaaatgtgcgcatcctctcggttgatcggaagccgttcaattaatgacagtgcaagctcacgctggtgctcgaaaacgttttcgcgcgaggttgacgcgtccaatataataatcttgatttattttattctaatttttaatatggaaaacaaattcactcaatatgaatgacaagtctttttcggaatatggttaaactaaataaaaattagcgcaatttttcttttgaaaaatcgattaatttttaaggataacaaaaattgaattcctaatatgtgaggatttgtccctttttcggtggctaggatttacattttcagcgcagttatttatttattattttaaaatatattaatattattcattttgaataaacttaccaaatccatgtttgaagctttgcactttgataacatttcagcaccgcgtgtttcatcaaataattcgtcttcacggcttgttctgattggatgctcaaaaaaaaaaaaattatttatgaaatttttaattaaatttgcacctgttttcttctcttaaccccagggttgccgacagagagagtggcgaatgtgggagagaaaagcataaaagcaaatggcaaaaaaaacataagtcacatcaatgctaacatataaataagtaataataataataatataattgtatatagccagggaaggatttaaagaaagtttcagaaaattttttttaattgattcattttgttgtaccaatttcataatcattaaaattttcaatgctttcgagtgtcgatttgaagcgaaactatgtatgtatttaaaattttttgaaaagagagaaaattatgaaaaataaaattgtattttttttacaaaaaagtttcagagtgccattaagggcatttcagtttcgtttaaatcattaacctcccatcgtttatgaattatttaaatatttaacaattataataataaataataataattattaatattatataaagcgcagagcacacaaaatgatagcaaaagcagaaataatatggcataaaagctttgaacggcaaccctggtcacagcgaacattggaatatttaatttagatccattaaaaatatttacacatttttaagcttagaatgtttttttagtatatttttttggcgttttgataatgataaaaattttaatactacaaatattcagcctcgaatctcaagtacagtccttgaaatcagtttaccttataaattaatagggttagtgcggttaattctttcaagttttaaatatacttttctaagattttcaagcacgaaataatttaaggacaccgctagtcattcaaggaataggaaaaatcatttttgtatcggttttagaaacttgaaaattctacaaaataatcagagtatttttgaaaatctacgaccattttaaaattaagagattttatatcgtcaacattatttttgaaacatttttta

SEQ ID NO: 21678 - DNA, 1736 bp, Heterodera glycines
attgaccatcaaccagagactgggccaaggtcagcaagcgtacttgcaaatgtgccgccaaatcgggctcggagaaaccggagagcacttctggattcctccgcagttcctcgttaagagcaaggaagagctgatagattatgtctatcctaacttccaacaactccttggcaatgacaaagagctgctcaatcgtttgattctcgctccgcacattgacacgtgtgatgaagtcaacgagatcatgatggcgaatgtgccaggtcaagtgcgggaatacttgtccacggataagccccttgacgaccgcccactggacatcgatgagatcgagtccgaagtggctgcgttgaaccggcgcacagactcgggcatgcccccgcacagtctccggcttaaagtcggatggtcgtcgtccttcttatcaataaaagtgataaggaaggactgatcaatggcacacgcatagttctggaagaacttggcgatgatcgcctcattggtcgtgttatcaatagcaatgctattggcggccaagtgagattctttcttgaaagaacacgaaatgtctatgaagacaaatcgcctggcggcataaaatatgagcgtttgcagttcccaataaagcctgcattcgctatgaccattcaaaaaggtcagggccaaacaatccgcactgtcggcattgatctggaaagggaagtattttcccacggtcaattgtatacggccttctctcgggcaaccgacggaaacaatgtccgtgttcatgctcccaaccgggaaattgatgcccaaggccgagccaaagtgctgaatattgtagctactaatatgctcaagttacaataaatagcttagtccagagcagttggtacatggtttttggagagatgccaaagcattccattcccatctgcactatgttgggtgcgaaaatggtgagaagcttggatccgggacatggaccggtcagccctctttagggcctacaggtgaattgccatttagcgctcaacccaataacgtgccaacgcctggactaagggagggaggagggccatgacgtgcaacgttagggcacttccggtttccattgcattatgcgatgtgtcaactccaattattggaggaaaccaagtgcatgtcggctgacgcaaagaccctaacagactaaaacgcgcctaggtagcgaagctcaagaagcgcgcagcgctttcccaagcgccaccctcgcatgcacacacccgctagttttggcattatatcgtattaccccgaaaaaagagatagtcgttttttgaaaaaaaattataacgagcaaaaccaatccaggtattcgttagggagtcagcaattattttttccaaggacgtccatttattttggcattatttcgtattaccccgaaaaaagagatagtcgttttttgaaaaaaattataacgagcaaaaccaatccaggtattcgttagggagtcagcaattattttttccaaggacgtccatttattttggcattatttcgtattaccccgaaaaaagagatagtcgttttttgaaaaaaaattataacgagcaaaaccaatccaggtattcgttagggagtcagcaattattttttccaaggacgtccatttattttggcattatttcgtattaccccgaaaaaagagatagtcgttttttgaaaaaaataataacgagcaaaaccaatccaggtattcgttagggagt

SEQ ID NO: 21679 - DNA, 1976 bp, Heterodera glycines
  misc_feature (1894)..(1895): n is a, c, g, or t
  misc_feature (1913)..(1913): n is a, c, g, or t
  misc_feature (1937)..(1937): n is a, c, g, or t
aatcaaaagaaaacgtcaaccggtgtcgaactcataacaaaaagtattgttaatgttgttgcactaaccactaaaccacaaatattttaaaaatataaccaaatttactttatttcataaaattttgtataagatggttaaaaaaaatcaaaattgtataaatttttgcctttaattccacgaatatgccattcttaggggtgtgtttttcacccccgcgcccccgcgggggtgaaggtcgcgggggatgcgggggtcagagtcacgggggcggggacgggggtgagccccaaaaacctgtcccgcccccggggacgggggcggggctcgaaccttatttttattgctgacagccgtttttttgtaaaatcatggaataaaattcactggtaaaaaagggtcttctgagtaaaaaaaaaaactagaaaaaaaaaattcatttaagcaaaaaatatgaatgatgtcataaaattttttttattggcccatttgtgatattatttaaattagtgcgtaattatttggcgttttgacatttattgatatttcctttattttcttttcattcacttcttctcctctcttaaaaagttttgttatgtttcgccgttctccgtaatttggatttgttgattattttgttcccacctcgtcgtttgttttatttgtttgtgttcgattttaataaagtgaaagcctatttggttgtgtgttcttcgagtgcggtggatcaaaatattattgcgcatttaaccccattaaaaaatgcattttccccattgtttgtagtaacatagccttttatttgcatatgtgatcagtcgagcaaatttaaaagatatttctgtgaaattaatcgaacaaaatataatgttgaaaatcttcaagtcacaaaaaagttccagattaaattcaaagttgaagaaatgtttaataaaattcaagaaaaagaatttttgaataataattttaagcataataaaaaaaattcttcaaatttaaattcccaacaaatcaacactcttcttcttctgctcttttcttaaacatttcttctccaaacagtttcttccatcttataatgctattttggtggattttcaatatttttgcaatttcattatcactcattttcggattttcactttttatttcccaataaattttcattttttccattttttcttcctccgttattcttttcttgctaattccaaattgtttcttccattttctaagtgtttctctgttaactccaattttcttacaaatttcatcataattttgtttccattcttttcgtgaatatttacttttttgcttatattcatttgtcatttcaataaattcctgcacaatttctattttttctgcatcactttttgatttgtatttttgaagaccaaattccttgatccatttataaattttcattcgatttgtccccaatttcttcgctatttttatttctatttttccccattcttttgttgaatattttcttcctttttgctttattttctcttttattttataaaattttgcaattatttctctttttttgagttcatttcgtttttcttcttctttttcttcccatttttctccaaatatttcgccaaatgatttctgctgaagttttttcttttctgattcaattggaataattagggcaatcaaaaataaaaataataaaatacagaatttcattttcaagattttattttatttttcttaaattaaatggcaattcattttttgaggcatttaaatgatttttttctgattaaaaaactgaataaatcattattttacttaataaaataaggaaatcctgtttaatttcaaagaaataataataataattttatcttaaatgacaaataattgccanntggtaaattaatgattanataaaatttattactttctactgnagctcattcgaaataataaacatattttcataaaaataa

SEQ ID NO: 21680 - DNA, 3478 bp, Heterodera glycines
  misc_feature (1745)..(1745): n is a, c, g, or t
  misc_feature (1768)..(1768): n is a, c, g, or t
  misc_feature (1804)..(1804): n is a, c, g, or t
  misc_feature (1876)..(1877): n is a, c, g, or t
  misc_feature (3430)..(3430): n is a, c, g, or t
atagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtacagcgtaattaaaagctaaaataattttcgtatatttttcacaatttatttcaaaaagccaaaaagtccggaaccaattttaaaaactaaaatagtgcacaaaaggggagccgccgcacggcggggcttaaagcattgtacagcataattaaaaccgaaaataattttcgtatatttttcacatttatttcaaaaagccaaaaaaaatgattcaatttttgaaacgaaatagtgcacaaaagggagggaatgggtaaacgaaaaaaaggaatttttataaaaaaaacgcacccccatcctgatatttcccttttttccgtttccccaaatggcccaaagggggaatggggttctttgaccccaaatttgcccaaaaagggaacttggacttttcccccataaaaaaggggggaaaaaatttttgaaatgtgccccccccccccgcgggggtttaaaaaaaattttacacggcgaaaacaaaaaaaaaaaaaaaatttttttatttatttttccccatttttttttttaaaaaaacccaaaaaaaaaagaatttttctttttttaaaaaaaaaaaaaaggccccaaaaaagggggggggggggggttaaaaaaaaaaaaagagaaattttttttaaaaaaaagagccccccccctttttttttttctttttttttttttttttccccaattggcaaaaaagggaggggtggttttttttagaaaaattatttgtccaaaaaaagaggattgttgttttctccccccaaaaaaaaaagggggaaaaaaatatattttatgttccccgccccccccccccccggggggggggtaaaaaaaaatgtgtgtgctcgtattataaaaaaaaaaaaaaaaaaaaataatttttttttattttttttttttttttttttttttttttatttttttattttttttaataaaaaaagaaaaaaaaaaaaaaataaattttttttacaacccaaatatttgttttttttttttttgttttgttttttttttatttttttttaaaaaaaaaaaaaacaaaaaaaaaaaaaaacccgccccgcctctttttttttttttttttttttttaaaaaaaaaaacaattttaaaaaaaaaaaaagaaaaaaaacagggaaaccccccttcggggagggtttttttttttgtttttttttttttggttttttttttttaggggggggaaaaaaaaaaaaaatttttaagttttttaaaagggggggtttttaaaagggacaaaaacttttttgggggaaaaattttaatttttttggaaaaaaaaaaataaaaaaaaaaatttttttgttttttttccaaaatttttttttaaaaaaggggaacaactggaagggacagggaaaaggggtccaattttttttttttgaagctccggtcccattaaatttccccggagatttttgcaactggaaccccaggatttcgtttttgggaaaacagttctttgcgggcttccaattggctggattgcgtgattatgtgnccattccacagctattattttcncaaataaatcataattaatattaattttaataccancaaaacgattttcggggtctgaatgattcacgactttgtgcaagtagcaacaaaattcttcaatttaatttnnatctctctctcttctctctctctctgtgagaaaattttatcggataatttttgcacaaataaaaattataaaaaaaagataatttattctttcatcttttagatcattattttgccttaatttttgccctcccccactaatatttaaaagtgaacaattttgcatgagaaattctttcaaataacgaatcgctcaatgcaatttttaatgtttttcagtgggatctattagaaatcttttaaactatgccgagttcataacatttaaaaaaatgtatgttaaaagtacaaccaaacaagtatcaacaatttgaacaatgtcaattttgatttgatttgtggcaataattcctttttctgaattcttaattggaaatgaagccaactgaaaatttgaagtaattttttggaaatttgggtaaattgaacgagaatttcacgccggttgaaattccgaataatcaaaaaatcagaataggtataaattttttagagattaacttatagataggtttgtaaagaatatgggctaaaaagctccgaaatatggaataacagctcaaaaattgccaaatatggcctaaaaactgccagaaaatcgtaacactcaaaaatccaaaaatatgtatatattcacacaccgtttcaaaaaacgagacatgaaccaataaagagagagttcagagaaaaaaacatctctatttttggcgtactatttctttgtctctgttaatagagaaaacccgaattcacttcatcctgtttaacttttttttctacttgttaaatccacaataaattttgcaaatcgatagagaaaaatattataaacatttttaacgcacgaattttaaataaaaatattcatgttgcacaacggactcgaacccccgcctttgtcccttcactatcttacaaaaacaactgagccacacatgcaaatcttttttggaactgggaggcaaaaattgaaacggtgtgttcaatatttgcctaaacaaacttaaaaaatatcccaaaaattacaaaaactcaaaaaaactaaaaaaaccaaatttttattaaatcctagcttcacaatataaaatcagatacatcttaattttttttggtaataatctcattactgttgtcagcgaatttggtaaatgtcctgcgtatttttgggaaagcttggatggcattggtaataggcgtacgctatcatctatataaatgatgattaaaactgcttttattaaggtcaaaaatttaaaaaaaaattaataaaattaattttcgggattgattattttaaaataagcagttttaacagaaccggcaaaaacagacattaatttatgaattgtatcaattctcgaaaaaatgttttcaacaatcgtacttttattcaagtttttgagaaaaaatttatggaaaaatgggctgtactatagtctaccacccacaaacaaaatgaataaaattgataccatttgttctctcgtggcctgtaatgctcaggaaaaatactcctgaggttcggaaatggcaaaaaaccggtttttgaaccgngtttaataatggaaaaattgaggaaaaggggggctcctgaccctttaa

SEQ ID NO: 21681 - DNA, 1724 bp, Heterodera glycines
ttgatgatgtgaatgccttaacgcggggaagggggattgtttcttacatatttgtaagatttttgttttaggcatgattcgataggcatgataaaaaaggtttcaaaaatcacgataggcatgataaaaaaggtttcaaaaatcatgggtaaaaatgcaaaaatatccgaattttgaatataaaacatacggccggtattgcttttgcattatagttttaaggttaatgtgtgaaaagtgaaaagataaaccgtctgatcgacgcttccacacataatgctccatttggtagtccatctttttggtgccgatgtgcgattcgcacaccaaaaatttcattgcgtcatcgtccgtcagtttgaagacgtcaagacagcttgacatgttggaggcagaaaataagtcgtataatctgaaaaaatggttactgttaggaccaaacgtataaaattgagtgaatctgagtttatggggaaacgaattttcgagaaatggacaagagagggaagtaagtaactagtatttggttaggtcataataaaagttaagactaaaaattcgaaataaatacagtttatttgtattgttttaattccaaggcgtgttaatttaacttggtgcattttgtacggttaatcggcacaacgaatcaaaagaaaaacaaaacaagagatgaactaaaaggaaagaaagagagagtgagcagagaaaaaaaaaaatttttgatttcgctgtttttgcgctaaattcaaaaattgattgaagtgctttttgtgttgtctgcttttttatcgccacatacagtatgggacaaaagtataataatagtaatcaaacagtatcacagatttttttttaatcgagataaggttattttaggggttacagggtcggagaatacgattcagatatccatttcgacccaattccgaacccctgacgaacaaaaatcgaaaattcaaattttcatattcgcatttttggtctaaaactggtttaaattttttattgaaacatagatgaataatttagtttgtttcctcacatttaaaccatttcagaccaaaaatgcgaaactctaaaaatttgaaatttcgactttttgttcgaaatctggtccatggttaggatttgggtcgaaaggatatcagaatcggattcgccgatcctgaaaacccataaaatgactttaatctctagaaaacaatttctttttttcgaaaggggggggggggaaccattggcactattaccgggctctggctggttaaaagtatatacagtaatcaaattctgctagtctaattttggtcgaacacttctaaaatgaaaaatgtttttaaaatacctaaatgctaattgtaagcaatttgaacgcatatgaaaaaagggatacttacgtaaatttatttcagtggtataaaacaaagttggaaaatattgatcataggccccaaactcgaaaatgcttaaaaacggtcagaatcgatgtaaagaggttcgaaatgggttggaaaaatagaattatgggcgcgcttgccctttttcaggctgaataagggccggaattggagtgccaaactcttgtgagactcaagtgatcgcactatagaaagcacgctaaagacattttaaacctgttttgatggtaattttggagctgatcacgaacatgacctttattttggaaattgccaaccccgaaacgcaaattcaaacaaaaa

SEQ ID NO: 21682 - DNA, 1260 bp, Heterodera glycines
ctttaatttctaaaaatttagcttaagttttatcaatccataaaaataacattttttaaaattctaatgtaaagctgaatttttttattaaacttcctaaacctttcctaaagaaatgaaatacgatataaattctaaattggaaatattctaaaaaataaaaataaaatttggctttagatggcttgtaaagaaccactaaaaataaaataattttttattcagaaataatatcgcaatttaaaaatatgaaaataaaaagtcaaaattcagaaaacttgaatatatttagaaatttagacattattttagttaatattgttgtgtatttactacaacaataaaaatgtttggtttttaaccaaagcaaatgttgtccaataaataaataaataatttattaaacaaataaatatggaggacagcagggaataaataaataaaataatgaaatggtggaatgaatgggagaatgcccggagtgagggaaagggagacatatttatggggctggtcaaggggcgggacgagagacaataagagagggagtgaaagggaaaatataatcaataatcggtgtggtcccttatccaacacctcccttctttggaaaagtccctcctgcgcgagatgtcatggccggacgatgtcgtacttcggcttcgacgggtccatgtccaatcgctgaggtgccctcttggcgcgtgctgatgttcgcggcgcattttgacttcggccaattggagatttggctttttcaatctccttaatgggggtctgattcgtttggtccccagccaaatcatttccattttcttggccaagttgcggtgtctccatttctactgggaaacggcggcgaatttggttgacaaggcggtggactgcgcaacggagcgtcggaacgtcgactcgataagtcggagagttgccaactctctcgataatcgtcgccggcaaccaatttgccttattgcctttcaaattccaaatgaaaactggctctccattttggaaagtgatgggcttggcgccgtttttgtcgttgaattgccgtttcatcttttgacggtaattttgttgaaaattgccaaaatttttcaaatcaactttcggcattttctgattggtgggatggaccaatgaaattttggttcgcatccggcgtccaaggaataattggtcgggagagtgtccgtcgagcactgcacttggcgttgttctgtaggccaaaaagtgctttgggaatccaattctttg

SEQ ID NO: 21683 - DNA, 2582 bp, Heterodera glycines
  misc_feature (44)..(44): n is a, c, g, or t
  misc_feature (136)..(137): n is a, c, g, or t
  misc_feature (143)..(144): n is a, c, g, or t
tttcagtcgtcgttttgatgaagcagtgccatgccgtgcgattnggttctggtcgatggatcttggtgtaccagtgtgatggtcaatggtgtccattgcgcggtgagtgcgggtgtgtcgggcagaatggtgagtnntctggnnccttcagttccccagagtgtgctgcgtgggtggaacacccaaaggacgtcgtgtcctcttctgtggtgatgggcttttgggccagcggatcaacttgattcctgggcgtggccgttgttgtggacgtgatctgtacgctgtagttgttcggtagtccattgtccgtggcattggcgtcgtcgtggttgtccaggcgttcggccatgtggtagctttggttgaccacgagcgtgttttggttgtggtcgccgttgtgcgtggtggacttgtcgtcgttgtcatttgtgtcgttgtccatggcggatttgttggtgccggtggagtcgttgtttggcttaggctccgatttagggcgagaactttgtcgatgtatcgctggacgtatggactgtgtttgttgccgttcttttgtcacgttccatgaagatgttgagaaagttgaaaaggtggccgccgtgccatgctttgatttccgcaattcgtttttgtcggattggttgtacttgtgccgaaccgatgaagagaaggcaaaggaggctgatcagcattagcgagctgatcacgtgttgacttgttgacggtccgggccgggctgaacttgtttatgttgacgtcccgggttcttgatccaactccattggttccggcatcgtttgtttgatccggttagcgattcgtcgtgcttcacagatttctcggttgaaaacaaagaagccggctttcagttcacgggtgacgtcgatcagatggtccgagctttggagaagatttccgccgtgcgattgttgagtcgttcaatccattctccgtagccgctttgttattcgctttctgttgtgattggccgaaacttcacttgcttgtgtgccggttgattgtatagttcgccaaatcggtcgcatgagttgcgccagacattgatgacctcggccaaatgctggtctcgtgcgatttgtcgtccgctgtccgcaacttgttgttggtagaacatttgcgcgacttcttccactgttgtgtcggcttgaatgtagccttcgtgcgccgcccaaatctcttccgctggcaagttcatgttgcgtgtcagccagttgaagagcagtgcctcgaagaaattgttggcacggaagttttggaattcttccatttgaaatcggttgcctgcggtggaaccgtaagtcgctgttttggcacaagttgtgtgcgtgttgtcacatggctgaaacaggttgaattggctgtgcgtgtttggtttggagtcggccatgcggtattcttcgagttttggcgattgtggtcgttgcggttttgttgggtgcttcgtttgttccgtatttgttgccggtgtcgttgtgtcgtcgattgttatgatctccggctgttcttcggttggtactgcttgaaggaagatcacatcttctggcaccatgtgtgagtagtatctgccttccacgaagcggaactcagcaaatggtcgttttcctccatacattcgcgagacgctgagttgtaggcgatcggatttgtgatgaatcatccatcgcccttgatcttccagttcatggagttctcggagaacacgtcctctttgccatgctgacgtccaattctccggcccgtaaatgcgttgaacgtagctgagcagcgtttcgttttcctctggccattcgtctcttgaccgttgccgtttttcttgcatgtcgattgtcttttttctgccgatgcgatgtcgttccagctctttgtcctctttgtcctttgttgattgctgctttgatttcgttggctgatctgtttcttccggttgtttctctgttggatccggctgatccataagatcgtagtcaaattgtcgtgccaattcttgccaagccttactgcgtgtttgttgattgatggcacgttgttcgtcgttttgttgtctttcgatttgttggcgtttggtttctcgttgttgctcttctgttgttgaatgtggcacttcttgaatttctttttgctgccgcttttcgggttgaagatgtcgatttgcttcttgttgacttttcttcaccattcgttgttcatgctcgatcttttcatgacgtggtgccttctgcacttttcggctttcctcgatggcctttgtggtggccttgctgcttccttgttggtccgagatggcttgaaataacttgcgtaagcctgagtcttgtagttgcttgcggcgtttgtgttgtccttgtaatggactttgctgctgaccgatgggtcgtaacagtgctgagcgtcgtttcggaattttgaacttcttctttgggcgtggttgttgactttcgtcgtcgctgccggcaagagaaactgagtcgtccatgaccgatgcgatgaagctgtgcactgcttgaattggttgctcatgaatctcagcgattggtggcttttccacttctttgaattcatct

SEQ ID NO: 21684 - DNA, 1748 bp, Heterodera glycines
agtgaaatttttaaataatatattaatgaacaaattaaagttgcaaatttacttaaaaaattattaccaatttttcgttagcttcaataataaatgggcacaactgggtgtcctagcccagaacgtccgtcctcgggaacagaggagggatccggaaaatggtacaccgcaggggtgtgacttgtctcagaaaagacgagagcgagagtttggcgagaggcgagagtccccaaaaagacgagagcgagagtttggcgagaggcgagagtaccaaaaatggcgagagttggcgagaggcgagagacgagaggcgagagttgtcccacccctggtacaccggcagaaaatttgacatcgaaacttagattttaaaaataatgaacactgattttgtttctacacagcgtcccgaaaatgagcatctgtacaaaaaaaaaaatgtgtgggtaagtggatttgtaagataataaagagaaaagcggtggatgttcgactccgttcctcaacaccaatattttaattatttcttccagaaaatgggaaattgactttttacaaataataattttgtaaggtttttgccaacaaattggacaatttggtagcatttaaaaactctttatgagaaaaagctttttctaagcaaaatattcattatttctaaaaatctaagtttgatctcatattttcccagtgtcacattttcttaaaatgaaaggctttctatcgatgtcgcattttcagggagccttttagtcaactcctcaaagaatgaaatgctttcatcattttgttaaacattatttttcaataaaaataggcaatatccatggctgctataataatttaatatacatatgcatgttataatgtcatagcaaatcctactggtgctgcaattataactatgatcattaattattattatttagtgagaatctacttttaaatgtaatttacaaagtagacaatgtccacggatgatagctaatataaaattataaattttatattagctatagttgctataatgcattatcaaattataaaagtaggaaaatatcaatataaaaggcaatcatttgttaaaaaattagaaccaatttttatttctttaagaattttttgactcattttaaagcaaatgtgaaggttctcaaaaaatctcactaatcttttttttaatgaattttaatttgttttgtctaaaaatttgaagaacaaaaatacaagtccaggttaggcatgaaaatcctggatttcctgtaaaatatttttagatgtttctaagtgaataattatttttttaaatttatttaaaattttagcaaaaacattctctaaaatggctaatttcttcaacattccccgtcgacaaacaattcaacttttactaattattattttatttaaaatgacgcttcaacaaggtgatctaattttttggtttttggcattataatctctttttatggtcgacattccgtaaattctttccaataaaatatcggaattttttcataaagttgttgaaaaaaatgttattaattttatcgaaaacaaaaaaatctcccaaaaaattgaagaaaaacataaatttctaacgaaattttctggattttttaaaaaatgattttttcccatttcaaaaatttatttgatttctattttagactcgctcattgaaactaaacaattgattgaccaagcaacgagtttgtttaaccaaataaaaaagggaaactttg

SEQ ID NO: 21685 - DNA, 1179 bp, Heterodera glycines
gaatgtcattgaaagttggtgggttgagtcccattgtttggaatgccggagattttagtcccagagattggaatgccggagaattgagtcccagtattggaatgctggtggcctgattttcagtgattggaatgtcattgaaagttgttgggctgagtcccaatgtttagaatgccgcagatttgagtcccagtgtttggaatgccggagatttgagtcccagtgtttggaatgccagagatttgagttccagtgattggaaagcctgagaattgagtcccagagattgaaatgctggtgggttgagtcccagtgtctggaatgccggagatttgagtcaccgagattgaaatgctggtgggttgagtcccagagattgaaatgctggtgggttgagtcccagagattggaatgccaatgaaagttggtgggttgagtcccaatgtttggaatgccggagatttgagtcccagaaattgaaatgttggtgggttgagtcccagcgattggaaagcctgagaattgagtctcagagcttgaaatgctggtgggttgagtcccagagatttgaatgacattgaaatgctggtgggttgagtcccagtgtctggaatgccggagatttgagtcccagagattgaaatgctggtgtgttgagtcccagagattgaaatgctggtgggttgagtctcagagattgaaatgctgctggtgggttgagtcccagagattggaatgccattgaaagttggtgggttgagtcccagtgtctggaatgccggagatttgagtcccagacattgaaatgctggtgtgttgagtcccagagattgaaatgctggtgggttgagtcccagagattggaatgccattgaaagttggtgggttaagtcccagtgtttggaatgccagagatttgagtcccagagattgaaatgctggtgggttgagtcccagcgattggaatgccggagaattgagtcccagtattggaatgctggtggcctgattttcagtgattggaatgtcattgaaagttggtgggctgagtcccaatgtttagaatgccgcagaattgagtcccagagattgaaatgctggtgggttgagtcccagtgtctggaatgccagagatttgagttcccagtgattggaaagcctgagaattgagtcccagag

SEQ ID NO: 21686 - DNA, 316 bp, Heterodera glycines
tcaaaatttataaattaaacgaaaacatattataaggggtcttgaggttgctgaacacgattatgacagccattttgaccaaatttgaacaccgaaccctaattatgaagcatgttggtcctcaaaatcgttaaaactatttctaaaccagcagtcagaaaatggtaaaagaacgtcaaatataaaagattgaatttagcttattgcgctaaaaaaccgccgcacactcgactccggcggccagtaggtggggcgagactacaggctacggaagaagtccgcgcgtgatccgcaggctggtgactgattggcgggg

SEQ ID NO: 21687 - DNA, 1065 bp, Heterodera glycines
agaacattttttataaataagagcagctcgcaatcctgggtaaaacgaagacaatgagcacgaaaagagatatttttgcttaattttgaaatgagatttcgcagacaggcaatgcttttcggtgttaatttatgaatttataatgacgcaattatcgtatttatttcaggattgcattttaccatattaggatttacggttctgccaccgttcccggctcaaaacttaggccatgtttcagggaagaccccgacccgaactcctaaatttgaacacatttcggggtataatacgaccccgacctcgtaaatttaagccatatatactgccaaaaaattaaattatagaaatgtaattcctcttttaagcaatgttgcactggacctaaattccaaaaatagttaggacaaatctgttaacaatttcaagatttttttttatcagtggcgcctttcggcaccacaggccaccctccttttactgtcaacccaaccgattttggccaaactgatgaacggaagaaacaaaaaaaggtgatcggatggtgaaccgaagagacattattttaaattctttctttttcacttaatgtttaaaattgttttattcgagttattattagggctaggatttttacgttttaaaatgtttttttgcggcttatttatggcgagaagtccaaaaatagcattttctccgaacaattttcggtttagaacgaattataaaaacacatattttggcatttttttggatttagcacatatttcagcatttttagcatatattttattacatatttcagtatttttagcacataaaatcccagccctagttattattagggaccggatttatatggacaaaaaaatccaaaatatggattataatatggacgaaaaaaccgcaaaatatggacaaaaaatacgaaaatatggacaaaaagtttctgaaaaattggtttgaatttttgaaaaaattcataaacccataattttttttgtcaaaaaaagaaaaaaaatctatttaatacatgaattatagaatttgataaatgaggcatcc

SEQ ID NO: 21688 - DNA, 1646 bp, Heterodera glycines
taatgcaaatgtattctttggtctctcggggttaaccacccgaacacctccccttttaaatgatctaacggggcgagtatcgcgcaggtggttgccgtcggcgataagggtagcgtcgttgtggcgtcggcgatcgaacggcaggcgtcggcgattgagcggcttgaatgacgtcctgctgctcttcttcgattggctgttcttccacttcgttttgagcattgatcgggtcaggcctattctctatgtcctgcccattttggtgtccatttaccattggtgccatttgaattggcaaattgaattctccattcaaaatgtttaaagggtcctcgacgatttgggtcgcctttcggaacctcagctgattcgcatgatagcgaccgctggatccgtcttcaaatttcacattgtaaatgacacccgtacatccgcagatcgttccggctttccaactttgtgaaagacgatgtcgggcccaaactgcgtcctttgatgcgaaaatttgtggacgcgtgccaaatcggcgattgaatttcttctccattgcctgatcacgttcgatcggctgaattggaggcggcttcagtaggtctaatgttgttcttggcttccgtcccaggagcatttcggctggacttttcaagtccggcaatgaatcgttgggggttgtccgatgtgtgaccaaaaatgtctcaattatttccttcactgatgacattccctcccctgttaattttctgaaggcacgcttaaacgtgtcaacaaatctctccgcttgtccattggacatgggatgatacggagccgagaacaaatggttaattcaattggccgctgtgaatttggcaaattccgtgcttttgaattgtgtgccgtgaagccaaatatcgtagtttttcaattgtaaccgccgttgaaattgttgacatttcgaaaacctcggggtatttcgagtaagagtcaacaacaatctggaaatgcttcccgaaaacggtccggcaaaatccatgtgcacgcgttgccaagggcctgatgtttttggccatgactgtaaatttgtcttaattggcgcttttgcagcagcctgacatggcacacattcacggacaaaatcttcaatgtcctgatcgatttttggccagaaaacgtattgacgtgccagctgcttcatccttttcatgccgggatgtcctttgtgcagcaatttcagaatctttgactggaagactttcgggattaccactctttctccaaacatgaggcatcccttttcaattgaaagttcttcctttcttcggcaaaaatcacggaccatttggttttccttgtccatggccttttcatttggccaaccatttttgaaaaagaaaaaagctttttatttttttttccttagaaaattgtaataaaaaaagagaaaaatgttgggatcggtactctattgtcagcccatattattttcattcctttatttctctccccttattctctcctctatttctcttcccttctgtcccccataaataccctgcgtcctctgacctccccgtcattcagttgtcaaccatttattttgcttatattgtttcaatcaatattcgccctttgtcctccgtccctcttctcttcatttatttatttgt

SEQ ID NO: 21689 - DNA, 1615 bp, Heterodera glycines
  misc_feature (6)..(6): n is a, c, g, or t
  misc_feature (33)..(33): n is a, c, g, or t
  misc_feature (42)..(42): n is a, c, g, or t
  misc_feature (46)..(46): n is a, c, g, or t
cgcttncattgtaaataagggacggcagatcanttataaaanttanaaagagtaatggccctaagacacttccctggggcactcctgaaaatattttgaaactttctgacaattcttcgtcaattttaactttaaaactccgattttttaaaaagttagttaaaaattttgaatttttccttcaattccaatctttttggttttttgaagtaataaatcaattggaacagaatcaaacgccttgacaaaatcaatatagatgatgtcaatttgctgattcatttgtatcgaattatatatatcgtccatcgtttttaatatttgggttgtagtcgatctattttttaaaaacccaaattgttctttattaaaaaattctatactattcagaaattctaaaattttgctactcaaaattcgttcaaaaactctgcaaatagtgctggttaatgaaaccggcctataatttaatggatccgttttttcgccctttttgaaaattggtacaactaatgatgttcgccatatttccggaatttgaccggaatccaaaatcaatctaaatatatcagctaatattttggtaattggctctgcacaattttttaataaaatgtaaggaacattatccggtgaagtggaatttcgcctggggagctttcttaatatattccaaattattcccgcattcaattcaatgtcaaaaagtttaattttattctgtgctgattgagttaatggaccattaacaattgaattttctaaaaatgatttttgaaatgtttctgctaatactttgcatttttgctcattactggaatacatatttccagcactatcaattaaagtaggaatttcataattttttgataatttatttcgaataaatttgttaactgagttttgccattgggaaataatttttgactctttttcatttctaaattggttcaattgttttttcatttcccttgaaattattttgtaatttaaaataatctcacttttatcgggaaacttttttacaagcttatgcaaacgtaatttctctgaaaataagtctcttattttttgaggatacgattgttttattatcgattttagaggcctattgggtataaacgtatcatataatttcagaactttatttaaaaattctttatacttttgttcaacggtgtacactgagtttattgataaatcaattcgattttcaagtaccgctagatttaattttgcaaaattaatatttttaaaatctcttctataaactctgtgattattgttgtgtagtgaatttattatatatttaaattcacgccaaatgatgatcatttattgttatactgtatcacccaattattgtccatttaatgagtggacttcgttcactcataatcttttccttattcattcatttttgtcaacacacacagcaacaatggcaattgctccttcaccagttattgattaattcctctgactcatcacttcgttctccacttttactattttgaataaatattgtctttacaattttgttgtgccaatcgcacgacacaacaactggcgcagtgagcatttcttttcaatttcaaatcattttgagtatttg

SEQ ID NO: 21690 - DNA, 2760 bp, Heterodera glycines
ccactatgtccttgcaaatcggcatacccgtccttggaaacggagcatggacgatgggagccctgcgatataccaatgtgcacttttgaacaaatacaaaagtaaattgttttaaaaaataaaaggccggatttaaaagcaattaaagacaattatctgctttcttttaagcaatagcgatcttttagcacataaaaaatttctggcttttgattcataaaaaatgcttggagttttggcagttttttttgcagatatttgcttttttaaaaataattcttttttccaaaataatagctttttggcactaaattcatgacaaattagcataaatgatcaaatttctctcaggctcctttgagcattgtagcatattattattaaaaataaatgtgtatgtgagtcagtccttatacttaattattattcttactattttccgacaaaagaaaatagttttaaccaaaaagcagcaaagttatttttgttagcaaattgtgttagcaaatttatttgaataattgttaattggatattatgtaaatattaaacagcgtttttttcatttttgaaacataatttagcttataatcgtttatcaaatttttattaaaaaattttttttttcgtgtaaattgattttcaattaaaatattttttttgttacctgtttttttcctacattcttaaaaatatttataaaaatataaaaccgaaacattaaatctattaaaaaatcagattgcgcgaaaccaatggccgttgtgcaaaatgcggcgacccgcactcttatttttgcgtaatttgctgtggctttttttcattcaacaatgacgggtacatgtcaagaactgtctatttatattgttgcgatacccggtgccattactcttgctggtaaaatgctgacaaattcaatacatatttatatatatatataatttttataatagtttaaaaatattttattatacttaggtttacacctgaagcaatgggctcctgtccgtttaaatgtggaagtgaatggaatggtttcaaagttttgcttgataggtgagaaaataattctttttccttaattggatggtttgattttttgtaaaacttttcttatatattgaaaatattttaacaagaacaaaaagaaaaataaacccccaaaaagcgacatttggctatttataaaaatccacgttgaatttggttaaaattttctattttttagctttaaatctactttttggtagatttatcgatttttaagttattttttaagcaaattttgaatatatacacatttttaagaatttatgaggatttaaaagctttttttcatccatatttggccatttctgagctttttagtaaatgttttatgtctatattggaccattttttataagcataataataataataatgaagcataaataatttatttaattcataaaacagaaaagtttgttgcgttactgcaccattggaccctgtgtttattgatgaagagcgtaaaaaatgtaaactcaatggaaagcattttgaacctgtttttgcctcaatattaccggaaagcaataattttgataccttttcaggtaaaaatacgcaaataataaaacaaatatttaattacaattaaaaattatcctaaaatattgaaatatattttttaaaattagataataatactaatttctgattagagtaattaaatattattttcatttaaaataaacgcaaaaaattcttttataaatataataaagtattaatcgaatgcacccatttattaatttttgtaaaagtacatacatatttttcggcttaacaagcatttaataaaaaattgtaaaaagtataagcaatttaaatggaaagctttttcgttgttttggtacagtttttaaagtttatataattttttcttcaaaatttcaaaaaaatctcaactattcatttaattttattctaaattaattcttataggaatgttttttttaaatatattatttcataattattcttaaaaaatccgaatatttaagttgtattagtctgtcactctacaattcaaattccgaagagaattgtgatgccttgcgcgctctttatgtaaagactctgcgcgcaatgcttgaagatccggaaaaagccggcattaacatgacacatttcaaaacaaaggacaactttttgaaattttctacttggttttggttgtctacgatgacttttatgaagccttttgtttatatttcgagttttggttttaatgcctaggcacctatttttgtgcctatttcgccatttttggcacctatttttagggttttcgaaaaaatccatttcagagccgattatgctgtaacagaattagaagctcttctaacaattagattttgagcaaaatgaaagtcgagttgaacaatctcaattttgccatttttcatcaaatatttcgatttaaatatcttttaggaagaattttttaattatgcataaaattaaatccaaatttgaatggatgcgcgagtgggtcaaaagtgagcttcattgccgaaaatcttgacaaatttttgatttgcaattgcaaaaacaactgacaaaatttatgatgaataaaacttttaaattaatttgcacccctaattttcaagttttttttttgtgcgtatttagtgcatatttcactattttatttgcatatttatgcgtatattttggccacttttcgtgcatattttttgcagccctggc

SEQ ID NO: 21691 - DNA, 1855 bp, Heterodera glycines
caaagactaaattagggtatttcaaagggattaacatcctatttttgtaggtatttaaaaatggaatttcttccctttgaaatagccttctttctcaatttgcgagtgaaatttatttgtttgtatttttatgtgtaaactaatgctatcataaagtgctttttttgttgggtcagttttacattgcctatacagtctggccttctctttgatggaggccaataaatgcgttggatatttaggggtcaaatcttttttcttaatttttttcattggaatacactcgtttaaggtttctagcaatgtattattaaaggcgttgtatttttcgttcacactaaaatgctcgttagataaagcgctaattctagaagaaaccataatattaaaaagagaaacattcgacggaaaaaaccgtcgagtgtaaaagaagtttgttttttgtagtgtttttggaatagtcaatgtgaaaatttgcgctaaatgatccgatgaaaaaacaccaccttcaatagtacattgctttacaatttgatcatttgccggcaaaactaagtctaaccacgaatttcccctggtgggtccactcgtggcattgaaaaaagtaagcttactaaaaaagtggcaaaaaatttcaccaaatttactcatagaaatgggctgcccttccttccataccaggtctttattcggaaaattaaaatcacccaacacaacacaattatggctatagaatgtttctaaaaatttaaaaagttccttggtttgtctatatgttgtcttgggtggtcgataaacaagcacaaatctaattgattttagtttttgtaattgaaaaaccaaaatttcgcaattatattttgtttcagaaaatttaacaaaaaactcaatttctttcttaattaaaacaccgcaaccacccccacgtgttaatttttgagattttctatgacaaaaaataaagttataattttcgattatccatggactaaagaggattgggttttcctcctttgtccacgtttcagttaacagacaaatttctatgttattatttactaaatttaaagatatttcatcaattttgttgtaaattgatctaatattaactaaataggctttaacgtcccctttttctcttattggattattaggtttaacatgcttaagaccggaaaaatgcgaatttattaatgttttatgaatgtgatttggtaaaacagcaagtcaattggtgttatttttaaatgccgcaatgtctgacctcagcatcactttgtccgcgtacaccacccactcgccgccatcttcctttcttttcctgctacactcttcttgcagcacacgtcgggccttgagttcctcttggctgagtgaagggcgaattcggatgttgctcatccccaatttttgactgatttgcgcgcgcactttgttccactgtgccaaggtttgtttctgatgtttggagcacccgaaaattactttcatcaacctcgggcggttttgacctgtctttgcttggtctggggaacccattctgtaatcagtgatcgggctctagattccaagctcatcgagatctcgtgagatgtccgttcggtccgcagcgtctcgttcgtgtatgaacaactttctcatcttttatatggaaacaacaatattcatccacgctcattcgatcttgtgaccatctttcctttaatctggtggaagaacatcatacacttcaggcccagagaaatcaaatattagaccgtcaagcccacagacatagttttatatattttggccgtctccattccatattttcagaaaattttttaaattttgtcacgatattttttttattttt

SEQ ID NO: 21692 - DNA, 2201 bp, Heterodera glycines
  misc_feature (61)..(61): n is a, c, g, or t
ttttaaaaaacgtaaaatttttcattttctaaattttgaccagaaggacctgaaaaacagnataattaccgtcactgtcccgacctacattaacttaaatattttttgaatattttaatgaggaattaatttccaaaatttcagctatattattctagttctttagccattttaaacatttataatcattcaattaaatatttttgttttacaattaaattttaaatttgtctaaaaactcactcaaggaatgataaaaatttaatttctcatttttattaccataatttagccgcaccgtgaggaattaatttgtaatttaattttaatttctcatttttattaccataatttagccgcaccgtgaggaattaatttgtaatttaattttaatttctcatttttattaccataatttagccgcaccgtttactcatttggcctggcgcttgtttgtctttcatttttttttatttcggcgctcagttggctcctcatttggcccgatcattgggccaaaattgtgataaaaatgattgatggtgatttgtgtggtgcattttccacctccccttggccatttttccccgaccaaattattcttcacgcgatttgcctccgctccgtctccggcggggcgttttggacaatcgattttacataatttttgttttatttttaatttgattgggtgcgactttctgtccagtttaattattttacattttaaaaataaaatgttacgagaaaaaaatattaattatttcattcaaattaattaaattccttcattgaataattcttgttaattaattttgataatttaaactgttaattaaatgtatattatttaattctgactaataattattcttaattatcacattaatcaaatataatctgcaattatggttattatttttaataatctagttttactgactatttttaatgtaaaacttatttcattagtttgggtaattgttgcaaataatttttctaataaaaaattgtaattaattaattaattatagatttattatgttcaaatgttttttaattataattgatgttcttgcccaaccaattaccaactcagcttaaaaatcaacaccaaaacagtgaaaaaggtcaaagaaaacggaacaaaatgcagagaataattgggaagaaaagtgagaaatttattaaaataaatttaataaaaaaatcatttagaaattttttaaaacgaaagtttttgggtttaatttacaaaaaaaaaaaacattatttaaattagacgaaatattttaattgcgaatttaaaataaaaaaccaaatatttttgaaaaacttattttcataattttgtcgttccatataaactaaaaatagtggaattatttatttaaaatttaaaaatattattaaaaaacagaaaaagcgtatgatcgtgccgatgaaatgttggcaccgccagcgtcgccaacatctgccagtccgatagaacggccattgaacagcaacaatgccaatctgatggtgcgcggatgggcacgaatttcgggacggaaacggcaccgtcggaaagtgccaaatttggagagcaataacaacagcagcaacaattttggcgtgacaagacgtgaatcaggcacaatgccgtacaacatacaggtggaataaaaaataattgttaatttactggcgccacttgcaaagtccttttgcattttgttatttgacaaatccaacctcttcagatagatgccaaattttgaatttaatattattaaatatcaattcaatcttattttaggctggcactatgtgtggtccaatccgatttagctttttatcttaatccatcagcccctatctgacaaataaataataaaataaatagtctactgtaaccgtacccccagatcaaaaacacattattttttatgtttttttttttaaattttaattttaaaagccaaaaaatctgtgtttaattatcttaaaaaatttttaattgggaaattaaaccaaggacgaattgaaaacaaattcagaatggacgtcgtgaaagtgggttctctgtcgaaagcacttggccaatgattagagccaattcgaatttgtcacgagtggcgcatttgtcggaaaacaccggcagaacggaggatgaaacagaaaggaaacggtaagaattaattgataccgtataatta

SEQ ID NO: 21693 - DNA, 1732 bp, Heterodera glycines
aggtgctaaaaactgccaaaataagtaggttttaggttctaaaaaacccccaaaataggtgctaaaaatgggaaaataggtgccaaaaagttccgaatttaggggtgtaaaatcgaaaattttcatcaaaaagcaaaaatattttgccaagtcattaaggatatacataattttcaaaatcaaaaattatcgtcaagaaaataaaataaataaattttggagataaatttttgagaaatttttcatttcttaggggcgcatttttgaaaattttctggtcgattcttagggatgtattttttgaaaaaatttttgggtcggttcttaggggtgtatttttcttttttattgcatttttgttaacaaattttgggcaaaacgccaaaataggtgaaaataagtttttttaaatttttttaggttttttaggtgctaaaaataaaaacctagaaaataggtgctaataactcgaaaagtagcttaacaacagcccaaaaaaacatgtttttcgtgcgtttcaggccacggggagctcaggaaaaaaatatgtaaaaacctaaaaatcgaagccctaaccatcacatccctagtaatcactttttcacgctcttttactctgtatgcattagtcattgacccaccatccaaagacaattcggattagaagagtgatcagaagcaactgtatttgtgtgaaaatcaaaaagaattttaaaatggctttttctgagtatttttcacaatgtatcgatgccagggctccccttattgaaatttaatttcagttttttttcaaaaccatttattttttcgttaaactgttcataaaattcaaattttgcacttcgtttaggccattgtctccaccagcggcgtgtcgaagcaaaaggtgccgaattgtgcggaagagaaatataattgagaatgatttgcttttttcgagatattattgatgctcatttttgctcgttaatttttttactttaaatttcaaaaaatacaaattaaaaatatttgtctctctacccataccccgcatttttttcggctggcggtgacattggtaaaaaataattcagagtaaaatatggacaattttaaaaatttgcacaaaaattaaaaggagagttgattcatcttattcatgcgaactcagtcaatattagaacagggagaggatttttagatgctaaaaattgcgaaataggtacctaaatagttgctaaacacaccgattcaaaaaacgagatatgtaccaatgatgtctctttggtgtactattttttatctctgttattagtagggcctgtaattatatggacataaaatcgcgaaatatggccataaaatatagacaacaaatcgtgaaatatggacataaaattgcacaaaattccttaacattttattggttgaaattacatatgagatacatttccaaattttgaggtgaaaaactcattcgattgtcaaaaaagcctcatttagcatacaaaaaagccttatttttggtcttaaggcctcatttttacaatttttttttcaaaacacgttcaaaatgttcgtatgaggattcagtcattttagctcgtttttaaggcacattttaatgcatatttgggcattttcaggttattagtgcattgggggatttttagagcatattttatgcgcatatttggatgtttgggcagaaatcgattggacgtaaacattgaaaaaaagactattg

SEQ ID NO: 21694 - DNA, 2197 bp, Heterodera glycines
tttgttcggccttccgtggattgaggaatttgagcccccccccgggaaattttgtatccacagagcaccaaaggaaagactaacgcgtcaatcaacgccaatgtcgtaaaggcaccaaacccggcgattggcatcacggacgaatcctcgctcaccgctgtgttgcaaaacgattttgaggaagtttttaagagcggacttggccactgcgcaatcaaggcgcatctgattctgaaaccggatgcccgacccattttctgtaaagctcgaccagtcccccatggtgctatcgaagcagtcgacaccgaactggaccgcctcttgcagatcggcgccatcaaaccggtagaattcagccattgggctgccccgattttggccgtcaaaaagaaaaatggaaagacccgggtgtgcatcaacttttcgaccggattaaacgattcgatcgaattgaatcgccatcctcttccgaggcccgacgtaatttatgcagctttgaatggagcagcatttttctcgaatctcgacctgagagatgcgtacctccaaatggaattggacgaaaaatcgaaaccgctctgcacaatcaacacccaccgcggcctatttcagtgccaacgtctcccatttggcgttaaatcggcaccgtccatttttcagcacctgatggaccaaatctgcgcaggaattccaggggtcttctcttatttggatgattgcctaatcgcctcaaagaccctggaagaccacttcaatgcgcttcacacgcttttccaacgcattaaggactttggcctacgaattcaactcgaaaaatgcaaattcctccaaaaataattactttttctcggccacatcgtatcttcaaatggcatacgccccgacccagcgcgctcagaggcaattcagaaaatgccagcgccgcacgacaaaacgaccctccgttcatttttgggagcgctcaattattacggacgttttgttaaaccaatgcgagaaaccagggcgccattggaccaactcctcagaaaggatgaatcctggagttgggagatgaccaacagtccgcgttcgagaaagcgaaggcaattatggtttcagaacttctgctgacccactacgaccccacacttccgatcgtcgtagcggcagacgcgtcaaaagatggcatcggcgccacaatcagccacattttccagacaaaaaggaaaaagtcatcgagcacgcctcaacagttctgaccaacgcgcagcagaactacagccaaattgagaaagaagctttggcgcttgtgttcgcagttcaaaaattccaccggatgcttttcgggcggaaatttacactgttcacggaccataagccattgctggccatcttcggctccaagaaaggcatccccatttatgccgccagccgactccaaagatgggccctaatcatggccaattacgattttgagatacggtacatcaacaccgcatcatttggccaggctgacgttctctcacgcctcatcgcaaattatccccgaccagaggaggatattttgatcgccaacatctgcaccgaaactgagtgctacataagcaccattctgcaaaccaaaacggaacaacttccagttacagcagacgaaatcgcagaggtgacaccgaaagatgagattttaaagaaaattttggcattcacccaatcgaattggccaaagaaatgcagcgacccggacatcgcaccgtattttccaaaaagggaaaacattttggaaatcgagggctgtttgctctaccaaaatcgcgttgttgttccccaatcgctccgcaaccgaatgctgaagtccctgcacatggcacaccccggaattgtgcgcatgaaggcactcgcccgccaacacgtctattggccgggcatggactcggaaattgaacggattgtccgtcaatgtgaagaatgccaaaaggctcaaaaagcaccgataaaggcaccgcttgccccttggactccaaccgacaaggtgttccaacgggtacacatcgattttgcgggaccatgccaagacggtcacgtctatttcattttggtggactcattctccaaatggccggaggtctaccaaatgaattcaatgacggccgcggcaaccgtcttcacactccgttcaatcatccaccgactcggcattcctgaagaaatttttcgg

SEQ ID NO: 21695 - DNA, 1150 bp, Heterodera glycines
ttaggcgaaacagtcttcagtcggcagaacttcggaaaactcggcccacatatggtttccactgcttctttgcgatgtcgtaccacaactttttgttgcacttcgcatatgtcaggccaagcggtgcattgtctttgttgaaggcaaagtacgctgtaagctgagtcacgcgctcttcgcctcttgccctccggtcttcttcggcttgtgctgcttcacaaactgcattcaagtcttcctcctcatctttaaggccaaattccacagcaatccggtgtccacttggaccatgcacgtccagctcatcgaccttatcataattaatattgcattttaattgttctaatatagctacttcgtgtgaacgtcgcacaagcttcgctccagttagcgagagataggcttccattgaagttatgtagcgagcaaggcgaatttgatggaactcatcgtaatccaccttctgttgcttttccggcccgcccttcacttcaataaaggccatgtccgctcccttcatcacgtatttgcacaaatacttagtgcaaccttctcctgccacaaactcggtgttgatgcttaatttgttaacttattgtgcaactattgaaatctcactaactgagatttgtatttggcagaaaggaatgcgttgaaggggacaacttgtcggttgtcgacgcggacaatcttcccacttttgtccttatactggatgaaccggccatagttgtctggattttttgacgcttccttttcggttaacgctggcggccgacgcttgtaccgagggtacgcagtttcggagtagacatcgtcataggaaaagggcttctttaattagtaaggttgaaaaatttaatgcacatttctatctaaccggaaaacgttttgtacatttcccgtcaacaatgcaacgccgaattgaacatgtgtggatattctttgttgtaattgtgttgtacaactgccgccgtaatatgacttctggcgatcgcccagacggattttccggaatttcggccgaaatgtactggaccatgtagtcttcgggcgtcatgatgattcctccactccgtactctgtcccaatcaaggatgagcgcaaaatggacatgtggcaggcctctttaattattgttgactaatcg

SEQ ID NO: 21696 - DNA, 1860 bp, Heterodera glycines
aattttttagaaaagttattttttgcctttcttatcgcggagagccttaagccaattgataatggagctcggcagaattagacgtcggcgttcttgatgctgcttcatgaattgaactttttgcgcttccattcgattgttgtagctgatggtgtacaactgggcaagtgtccgccaatcccaaagccaatgaccatctcgccagttgtagttgagccctcttatgtgcgccatgtagcgaaaccattgagatctcgacacttgatcacggcgatggaattgttgttcttgttcagccccaaggaactcttcctcctcgccaaggtcttcatcagcgtccaaaagcatattgtccttgtccctgatctgtctgtatgttgagtcaaaacgttcattcttcaacagcacaagtttaattccgtactctaaaaacatggaaatagaaaaactgaaaaggaaaccatttttcaccatagccaaattgcccgaacggaaatagaagagggaaaagagcaggatcgatgttcctattccaccacttcattgagcgcactttagtctcgtctcggcccatcaaaatgatgtcgtattcgctgactggaataacattcgcaccagtgtccaggtaaaactaaatatttatcaaaatttctaccttaagaataatttgattggcttttgattcctacttgtgcgacaagacggctcccagcggcagtttcagtgccaagtcgcccaggatgaatttgcttcacgtttgctctgtcgtctgcatgcaaatttgcaggtgcttgcgcgacatcactttcaaccgttcgttctgcacccgttttgtcggtgtctacgagaagcatccgtaattgcacacgttcttcagctggtagttgccgatatgtttcagcagcagactcgtagactacagcaagcaagtgatgctcacgcagaattctgtgaagcgcatccatgaccgagtcctcaaaaaaaaaactaaatttttgctaggaccttcctatgcttacatcgagagaattctctgtagaaatgtctgtaattcgagttcttgcttcagccggcggaattgtgaagagctggccgtgaaggtgcggcatattcccttcgggcggattgtagtcccacaacacatagcttatcatgttgttgcacttgataattcgatgaatgtcgatcttctcggtcgttctgttgatgttgacgtgtccaaaagctaactggctgttgtaggccagtgtgtgttgaaataacgaagccctccagcttttgtactgctcagctgggttccggaggatgttttcaagctctccaggccgctcttgcaattttttaaagcgttgtaggagattgacccgtcctttggcacaacatttagaataagcctttgggcctgtcgactcagatggcaagagaagtgcattgcagtagggacaaagcggtgtttccttgtaaaatcagttagaccctttcatgacattatattttttacttggctccttaaagaagtgtagtatgatggcagatggttggccttttttgagccgcatccaaaacccaaatgcgatgaatgcattgttgcgcactgatcagtaaccggagcaactggcttccttgaagacacaattgtctgcccgcttgttcttgatgcctgcgtgccaattcttgaactgcggcgaggaaccaaggaaggaggtggcatgagttgtgagtccaacaatgcttgatcaaccgaaccggaaacgattcttttcggaattttggcagaattctttggctcggaaacagcagatgctggcatgtcggctttctgaggtaggtcgtcaataactccccctcttcttgccaatg

SEQ ID NO: 21697 - DNA, 1890 bp, Heterodera glycines
  misc_feature (5)..(5): n is a, c, g, or t
  misc_feature (35)..(35): n is a, c, g, or t
ataanttgaaaagcaaatgcatctcaaaattattntggtaataatctctttactgtcgtcagcgaaatttttttttgtagcgagcaaaatgcctaaaaaatttgctaaagtttcgaaaactttctttttttggggtgtatttttttataattttcaaaaagtcactttttagtggtttttttcgcttttttgcatttttgtcaaaatttccaaaaaatggtataaatatggattaaaaacgcaaaaaggcgaaatatggatttatatggacaaaagacctaaataaatcaaaaaattttaatgcgtgcaaaatgatacaatataaaaataaattagcttttataaaatttgtctcaaacagtgaagattcgtcaatgaatctgaattcctgaaaatcaaaagctagaatgctgatttgaaaaatgtttcaaaaacgaattgacgaatactccacgggtggcgtaccacgcggctgacgccaaccgtgcggtcgacgatcccaagaagtttgcgcggaagcggccagcgatggttgctgctttttggaattggtgatcggtgcctcggccgtaggctttacatgaaatttattgattagcctgtgtgtacgcatgctcatatgtaaaaattcttccaacttactaagtttcaagcgtagtgtaactatttgttacacatagggcaaaatcaattcacatgtaaggaatccttacataataggaaaacttgcgacatatcaatagaacactaatttagagcttgtaaagttgcttatataccttgtttgatgtaaggattgtcgaaggcttttgcaggaggccatttcaccatttcaaggcttttcaacttgaacgcgatgtccttcttttgcgcattccttttgaggcgtccacaagcttttaccagtgcagctacttctccttccagctgctgacgcctttgctcaacctcaagacgttgatcttgctttcccttgcaccaaatggccacatgtttgatgattgtgttgcgattttgattagagagaggcatgacgactaagggaaaaaagcttagcaaagtggtataaaaaattaagtaaaaatcatagttattttttaaaaaccttttgctaaaaacatgtaacctaatttacaggtaaatttattgctgacacaataaaaaaaataaatgatgaagtggggggtgagaagaagacccgccgggtaaaaaacctcaatgatttgagggaaaaaacggcaggggtctttagctgggagacagggtagtgtaagcattgcatctatatggtattatgtaatttttctcatctaacagcaatgcttacactagcatatcctccagctatggctatgtggagaacaaatatgatataaaattttgtggccggcgggcagactgtattccttcattttaattttcaaaacattcggccacccgccggccaccacccacccgcccgtcccaatggggacagccgcggggggtgacaaaacaaaaatatatgaataatcaatgaaaaaaattagtggggggtcttctccgcctcctcctcctcagccagctgcatcagccttctgacgatgctgctcttggcgtccagatggtcgacagaatgaccggttgccaacgtcagcagcgctgcgggcatccgctgtaaaaaatttcttaaaacattgcacatgtaagtacggctgacaaaactaaccccaagggaacgaaggtgctcccgctcctcttgctgacgcaatttgtcctccgcctcttgctgacgcaatttggcttcctccgcctcttgctgacgcaatttggcggcggtcttcgcttcttgctgacgtcggcgcacgatcttcccgtctaaaaagccgcaaaattaaattacaaaacaaa

SEQ ID NO: 21698 - DNA, 1392 bp, Heterodera glycines
gtttccgcgtatttaacccggtttggagcaaaaacccagtcggaaaattggggcgttacggtaaaagtgaaaaaatttttcacttttttttgttcaaaattttttttgtttgttttgatacagaatttgtttttttaacagatggtacgaatgacaaaaaaaacacaaaaaaaaaagtgagattttgaattttatcaaaaaaccaaatgcttaatgtgtccatcattctatatcaaaacaaacaaaaataaattttgaccaaaaaaaaaagtgaaaaaattttcaaaatagatcacttttacagtagcgccaaaatttgtatgttcgaacttttgttcgaattcgggttcggaaaatacaccccccaagaatcgacctaaaaattttcaaaaaatgcaccccacccttaaatcccgaaatgtacttcatttctaactacaatccgtgaataaaattatttgccttaattttaactaatttacatagagaaaatatcaattttaataaatttcacccctacattttaaactttttcgcccctatttttgcccctaatttgcgaattttttgcccttatttaggtccttaaattagaatttttccaacctaaaaatcccatccctagtgatcagcgaccccgaaaatccgtggaaacatattttcatgactttaaaaaacaaaaaaagtttttcgaaaaaatggggggtaccatctatagtattaccaaaataaattatttattaaatcatataaaagatttctagggtggttttcggagtcgctgatcacgaatctgacatcattttatggtgcgaaaataactcgaattcgggtccgggattcgaaattggccgaaatggatgccggattcgtgatcagcgacccccaaaacccctgcaaacgtttttagggcaaaaaaatttttgaaaatttttttccaaaaaagggggggggcaaactacagtattaccgaaaaaagttatagccaaaaacatgctgggacccaaacgtgagggcccaattgaccggttccggtacacactgtttcaaaaaacgagatgtgtaccaataaatagagagtgccagagaaaaacaatatctttttttctctaattttttgtctccttttggcgtactatctaatatttttattattaggaaaaacaacatttatttcgccacatatttttttctactcatacaatttagcatatcgatagagaaaaatattatgaatatttttaacgctcgagttttatttttttacgctccgatttaaaattatccaaaaaacaaaatttcaaacgcttatatcttttttcaaactaataaaaatgcttagcatttgcttaggaaaagcttctactcatcaagagctttcgaaaataccaa

SEQ ID NO: 21699 - DNA, 2055 bp, Heterodera glycines
  misc_feature (105)..(105): n is a, c, g, or t
  misc_feature (1875)..(1875): n is a, c, g, or t
attcgcataacatttgtaattaagtttgtttacacattttccagaaaactaaagctcaatttgttaataagcgttttttttagttaattttttaattttaaattnaatattccttatttcttcaattatttttgaatacttgttcattttccatctgttttattcttggaatttgacttttttttaaatttgcaattgtcttttttcagagttgtgcttttacttttataatttttttaattaaaattttattcttaagaaattggcttttcattttatgccgagtttcggatcaattttccaaattcccggtatagttttactttaattttgacacccaaaatcaattacaaatttcattctcatttactcttcacaattttttattgttttataattttacacttttttcattgtttccgttttcttctattataaattgaggaatcttttgactaattacctaattgccttttttatctttttgttttttataaattttcgtaaggttaaaaaccatttattttttggcatgctacatttaaaaatgattaccttactttagttaaagtttttccgttttttattgtgtctgttttatttatagctctactgtgccgttgatgagtgtaaatatcacgattaattaatactctttggaaggcccaattaagcaattgctctgcttaaaattaacttgcttgaaaactgtgtaggcttttttatttgatcatttagcatatgcaaaacctaaaaaatcaaaattgttgaatcttattacttttctcttttgacctttcatcacattttcatgttaattacatttaaattatcatacgcattcatgcgcctgcagttctgatcagtgctagacttattaatctataacgattgggcaattctaagtacgttcgcgtttttgaataaattttaaaataaaggaaattttgggggttcgttggtgtctataggcatcgacgcgcaaatttgaaaatttctgcgtttttgtacagattcaacaaaaaaagatacattttttgggttttagcctaacttatttgcatttgttttttggacccaataacatggccaaatatactaattactattttctttcttgaatattgtttgtggcctattcttaattgtcaataacaatggcttttcacatgcaaaatagttatcccttaaatcaaatactttgtgattagttttctcttctactgaacattatataattataattttaagtgcgctcaaattgctcattatatcacttcaaggtcttatcgtcaaatcatacaatcaccgtaaagcataatattaagcattttcattctatttttgtcttatccgtagaaagtcgcaaaaacttaaatatagacaacgtcagccacaatcattatattcaattatccattttgatgaatcttgtaaattttttttattgtatctaggtcccggccggtaattaaaacctttttggtatctgcaatggtaccagttttcaaaataataagtaccagtaattcttggaaatttaggaacagggaaagaaatttcaaaagtgtagaacatcaatttataaacaattattttttattttgttatatcttttggttaaaagctattaagaaaaggacaaaatttgcataaattttaaaaattaattgggcattttggatccattttttggaaaaatatgttgacaaattgcaatgaaaaagatcgtcaattaattttaaaaaacaggaaaattctataaaaatttttacagcgagtctttggaattttaagacacttaaaatcgttgaattataaaattgtgcagaattttaaatttcacaaatttattaaacgggactttttggctgngaaaaccggaaacttttccagtcccggtcaaaaccgggacttcggtactcagttgtacgtgttttcagtaccgggtcccgtaaaactcagtttttatatctgtccatccatgattttatttttaatcattttaatatgtaattttctacttattataattcatcacggcattttctgttt

SEQ ID NO: 21700 - DNA, 3465 bp, Heterodera glycines
atttttatttatttaagcaattcatctacaaagggcagggcggcaacacaaacaatttcccatcaaagaagctttgtgatcaagtgtgcaaggtgaagttgcgcaccagaggggcgaccatggtagagtgagtgcttctcgaaagtcacggtattgagtcattactcttgacttgagaaaaaaaactcgtcaaaaagcctcaaatctcgagaaatttgggtctcgagcagcactagcgccagggacgtacccataccaatgggggaggggggagggtaacccaggggctcgtggatatggacaaggatgcagattgcagaacatttcagtgttcggtgatcaaattttacaaaaaaaaaaggatttaaaaaaacataaaaatcattttttatcataaaataaatattttttatcctaaaataattgaaattttgtaataatctcacaaattcttcattttcccggcggggtttattacagtgttttcctcacctatccattggtttttcctaaaaatcttaatttatatttctgtcgaaccttccgtccctaaaagttttggatgccctttcaaaatgcgaatgattttttaactttagccctaaatgaatgaatgatgaatgtgatgagtcggacggagaaagaatgtgctgcaacccaagaagagaattcaaagaaaaaaggagatggaaatgatttaaatttgtcaaaaaataaataaattcatagcggtagaaaatttttgataaataaatcatttttaaaaattcaaatttactttgaattaagtaagggaccggaacttttaattaataatttaaattctttaattaaaattcttaaaaaatattttatttcaaaaattcatttcttgtttcttttttaaaattcatttttctttttaatgtctgacaaatttgagtaagttgaaaattgctgagtttccattgaccaattgcttctattttaggaaactggcatttaatcttttctaatgggatggcatttgagtgccgagcattggcatttcaggcattttttgtccattttgttgagttcaagccattttttgctgtgctctttgccatatggttttatagttaaacacattcactatttaagactaatgactaataacaaatttgttaagtaggtttctctatttgagagtaattagtcaaccaaaaaaaaaagaagtatttaattacctttttatatgataaaaaagaaaaaaactcgtcataatatgttcgcccattttttcttgcatgctcattattctaaagttttatgttaatactaatttatttatatttattttactgcgggaataaattatgtttcatcattcgagactaattattcatcctaataaattaatctttttaaatttattttgtttttatatgaaaaaatgtctcgtccattcttttttgtttcaaattaacttaacatttattattttacttaaatttttgcatcagtaaatattcttcttttttttccttctctaattccccggcggtggaggaaattattttaataaaaactaaaaaagaattttcccttccgcggggggtctgtcattggcattcgtccgtggtggcattcatcaaatttacagccagcagcagcagtagaccaatttaatgtcgtcgtccatgttttatgcgcacgcaaaaataaaaaatgtgaaaagatcaaagattcgaaaaaaaagttaggattaaattggggaggacattctcaccggggaaatgctttgttttttgagtgtttcttcaaccgtggcactttcgtcccgaacattcccatgccatcgatgccaatgctcgcaaaatttaaatgataagatgccaattattaaaatttaattttgggaaaatcctaaaaaagctgcttccgtttcatttggatttcgtataagaaaatatttaattttttaaacatgaattaaaactggagtttttggattatgttttaaagcggcctatcattttctttacgctatttttacagaaattttttcattgtctccaattttttttttgtagctcacttttacatttttaatttttaaaattattaaaatatatgtgcatctttcaaaattttgcactttatgcctaaatgtacaaaaataaaaccaatcatttaccatcacatcataattattaatgcctactaaatgagtctaaatgccagacactaagcttatctttttatgatttggttgtaaaaatcggcttaaatcaaaatgcacaaaatggttgtgtcctactacaagtgatgagctgaatgcattttgttggtagtaaagattttatgccggaagcgaaggattaattctggcaaaaatgcatgcgaaaatttactcacatattaagcaaatatccgtaaattattaacagatcaaaaatatatgtgagataaccggcttaattacggttatacctataattattagtaattttacaaatgtttatttatttatttttgaattaagagaataaaattattcataatctctcctatacagtgggtagcaaaaatttcatgcgttttttatacaataaaaatactatttttttcaatcgaactgtgcctggccatagagttttgtaatattttgtaacagttttttatgggctttttcatgtgctacttactgtaaaacagttcattgccaaatttccaaaaaaaaaaaaaattgtttccccaatttatcagcatccaccccaatttttaggggtgcaaaaagtttttgatcagtcacccaaaatcatattaggaggaatgtttttcagattttttggaatttgagaaattatggctggtgctttccggcgcattaattttgcatcattaaaaactgggatggttgctgaaatttgaaaaaaaacaactttatttttttatttttggaaataattggacaataaactgattaacagttaacaaatttaattttggcgtttaatttttccccaatattttatttcatttttataaatttatattttatttaaaaaaaagagtgcaataaacttctttcattaatgtttccattctttcagctattctccccggtcccccgaggggttttctgtctgttctcaattaacgtttttgtccggtaaaattaaattaggaatggaattgcattccattcttattggtccttcataaattatatttgcatattaaagaaaattgtctaataattaaatttatataaaacaaaaatatgcttgattattaaaaattttatgtacttcaacataattatgtttccgttttttaaagcattgcgtttaaatccccaaaattgaaagccgtataattatttcacacactattataattgtctttccggcggatggatttgggttctgtgtacataagtatttaatagttcaacttttagaattatgcatttttttataatttgaaagttgaagcaaa

SEQ ID NO: 21701 - DNA, 1177 bp, Heterodera glycines
agcaacaacaacatgaagatgagcagcagaaagaccgtaccacaattttgattgcgccccgaatttggtggaaccgtcagcgttatgaagtgtttcctcaaatttctttggttgtgtatgatcgtcgccgggaaccaatgaacatgacaatcgatgaattgaaacacaaactcacccagttcctctatcgtccaatcaatcgtcttcaaaattgtaagtttgatgtagatacatatatggatggatggcagtgacggcagggaactccgattttcgaaaaattattgggccttggaaatccggtttccaaaaaaattttgagcattggattccgattcgaaaatttttgaacctcgaatttctcaaaaagtttgggcttcggaattccgaatgtttgggttctcggaatgccattcctgataattccaattcaattttttcagccgtgaatttcttctgcaagattttcgcaaatgaagtgatccatcaaaaagtgcttgcgtcactgcgaccaaaggatgttggacgaatggaatcagtcagcgtctccttgaaaaatattttgctctccggatcagtggacaatgctttttggaaagtgcattatgaacgactttttggcaagggtatatatttttttttgtttattgttgatttatgggtttttgaatgacaaaaaatactttttcgagggtttagtaggggtcaataaagaaatatttattggtttcgtttccattttagttcaagatgaccgacaaattccatatcgtgagcgttttggtgaaaaaatgagatggcaagcgaatgctgcacgcatgcttatggcgattcctcttcgagagccaaaaaccgttgatgttcctgacgagtaagtgaattgattgataatttagtaatttcatggacccgaaattcacaaatttttttgttttgtaggcctaagtcttcacctactgacccactttcaccatacgacccgtcccatccgcgtcctacacaaccggactatcccgacatgcgtgattatgatccgcgttcatttaaacctcctgaggcgaacgatgacccgcttcgactgcatccgatactgcccgctgcgccgtatgcaccaccgggcacgggcctccaccctcccagcctaatgcgcccactccaccgcccacctctttacccc

SEQ ID NO: 21702 - DNA, 990 bp, Heterodera glycines
  misc_feature (72)..(73): n is a, c, g, or t
cctcgaccttcacagcctaatgcgcccactcgaccgccacctacttaccccgacattggcagacgtatctgnnatcctcttccgcaccagccgacgaacccgtacagcgactggccctatggacctgcagcaccgactggatccggcggatatatgggcggttatgatggtggagtgtatgatcctgaccagcctgggaactcgaattatgacccatatggaagaggaggatcggacgacggcaaccacggacacgatggtccaggatcttctggtggcggtggcggcggattttttggtccttatctataagaagttcggatggaagtctatttgcttgttgctatgcaattgtttccattgtataatatgtaatgtggttaacgggtattcattcatttaacacatacattggcatatgtcaaccatactatttgtttcaataaaatatatcgcaatattggatgacatcattttgtaaaaatgttaatttacatgctttactttgtttgccttaatatttacaaaaattgcggttttggcgggctaaaaattattcttttattttcaaaaatatcctaaaaataaatgagttttagaaattgcccgaatattttttttaattaaaaattttaaatactatttgtgttcgcttgtatgccaaattctgcttcaacaccaatggaagagtttgaggaaatggtcgctgttcttcagcttgatggcgtccttgactttgacgcggtgcgaagagcagtcagttctggtgcaatccgagtgcgcgaatgtgacgcggaaacgcccatggttcaggtgtctgaattttgactccgatatacattccgaaccgagttcgaacaaaataaaagttttctgatactgagttaatgaaattttgtttgaatttttgtctggagctcgcaatttgtcgagccgatgccagattcatgctcagaaattccgagaaatgtgttttcttaacttataaaa

SEQ ID NO: 21703 - DNA, 462 bp, Heterodera glycines
tccctgtctgatcagttctcccctcccctctccgcttcatgtctgatcagttctcccctccccctcttcgctcactgtctgatcagttctcccctcccctctccgcttcatgtctgatcagttctcccctccccctctccgctccctgtctgataagttctcccctccccctctccgcttcctgtctgatcagttctcccctccccctctccgctccctgtctgataagttctcccctccccctctccgcttcctgtctgatcagttctcccctcccctctccgcttcatgtctgatcagttctcccctccccctctccgctccctgtctgataagttctcccctccccctctccgcttcatgtctgatcagttctcccctccccctctccgctccctgtctgataagttctcccctccccctctccgcttcctgtctgatcagttctcccctccccctctc

SEQ ID NO: 21704 - DNA, 2264 bp, Heterodera glycines
  misc_feature (1120)..(1120): n is a, c, g, or t
  misc_feature (1126)..(1126): n is a, c, g, or t
  misc_feature (2234)..(2234): n is a, c, g, or t
acaaaaaaaatgaaatttcaaaaaagggtgctggctgcgcccatcgcggcggttggtgagacgggtgctttttgctttttggccccctttttgcgccctctccggcggcggcagcacacgcacaaaaagcgacggtgaagcggtgacgacgaagcaatcatcaatccatccttctcctaccgctcgtcccaattttttcttcctttgtgtccccccattttttgccatttcgtctcagtcactttttggcccctccgccgctcctttgtcgcgcaattgccgcctaacactgccgccccgcggatggatgagtcatcactgtttaagtgagcgaagtgacgacggtggcaccgccgccgccgcgtccaaaaaatttctgccgaccccaccggaaggggtgccgccgttacgcgttctgttggttgccgctcccctcacaatccccccccccctccctctctttctcttcccaccgttttcgacgacgacgaaacgaacgttgacaacgaagcagaagagaagtagaagattgatgttttttagcaggagtacaacaattttttggcgcagtctttgtcctttaccctccgcccgtccgttttttcattcgttttttttttgtgtgaggacacttataaaattgatgattacccaccaccaccacacaaaaacactccaaaaggggggcacactctcttcagccccccccccctgctctttttgtcccattttggtgatggaacgacgggcggtgacggggggccaaactctgacattttaattgcacaaatgtgtcattattttatttattattatttgttttttgggtgtccctcccactgttttttcaatgtgtgagatgcgatgatcaaacacacttattatgcatatgcccgcgtttagtctaacactttgtccgttttgtccttgttcccggcggaattggaatttttcgcgcctttccctcggctcatcgcaaatcgaacagcttaagccgacctccgtccgctctcgccaccaattgatgctacgattgttatcagcaaagatggcacgagaggggcaaaatggggggggggggtgagagggtgtttcacccacatgaaaggggtcccaaccnccacanccgaacacacacacaacactcatcatcataaccccatttctcgcgccttttatcggcgcgcgatatttgtgccccgaccagtcgagagtgacgagcgcaaaatgtgaggcaaaggtcgtcgaaagtgcgacgatcggcgcaaaacggattaagaaacggtgataatgaggaggaaagagaccatgtttggcggtgagtttaaaattaaaaaaataagcaaataaagaaattgaaaaattgagaaaaataaatgaagaaaaatttggaaatgatggattaatcgagagataaagaaaacccaaatgtcaaaatgaattttcctattttgaatttggatactgtcggtttggcctgtagcagcaatatgtcattattttccacctttgcggatatgccgacgggcaaagtttgtgctccgtttgtgggcgatttgattggtccgccggtgtcccctcgggctcaattcccctaccccccaaaatgccatcattcatcatccatcaaaacagtcacttccttactctctgtttattgtcttcctctcccttcatcaaccaattcccattatggccatcctttccatcttcttcatcagttacccctcccaattcccccaccgcgccatttatgtgctcttccccccctttttttcctaaaatctgtgccgccgtaggtcatcagaggcattctcatcccatcaatgtgctgctgctgttgtgttgcgtctttttcgaatattctccccggagggcccaaagatggcgtcactccaatgtgcccccgcccccccccccttattcttcggcccctttgccccggagggacgagttcattcatccgccgctccctcctcccccattatccctcccctttcattctctcggccaattgcgcacatgagcaacacacagaacacacaatgtgcgctcgtcgttcgcctcctcctcttcctccttggcattattattcattttacagtgccggcatgcacagcagctgttggaggacgacgaattgaaagaggagaacccaacggagcccaaaatctcagagagagagaccaccatttgaatgaatcagaatgtcccctaattaattataggccgantaataaatggtgatggtgatgggatgtcgg

SEQ ID NO: 21705 - DNA, 1167 bp, Heterodera glycines
gtcccccccaaccagatgcgcacagatttaggggagacagaatctctcgggaatagcttccatatagtgtgtactataattgtgcgttggatttgcgctccacataattgttagagtaccacaaacgcacacttgaaaatatctatttttttgttttcggcgcagtccccccgaaccgatgcgcacagatatatggggagaccgaatccttcgggaatagcttccatatagtctgtactttaattctgcgttggatttttgctccccataattgtttgagtacaccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccatgacctgtttgagtaccccaaacggacacttgaaaaaatcgattcttttgttttcggcgcagtccccccgaaccgatgc

SEQ ID NO: 21706 - DNA, 1195 bp, Heterodera glycines
gacaaaggcccggacattggcacaaaatgccatccgccggcgtctacagcacccgcgccttcaccggacccctcctcctcctcctcctcctccagtcgctgtgccaacggcacgtccggcaccgtctcctgtacggaaggcaacggagggaagaagaaaagttgagcggcacaagcttgttggatgttacggcatgaagacgtcggaaaagcagccgaatcggaggcgaaaatcggaggattggacaaaagaaaaaggagaaggaagggacacagcggaagagaagggaaaaaatggggaagagaaggcaaacggaagagggaaacatccatcggacggagaaaaggcggcgtatcaaagggaattactaagagaaagaaaccggggaaatgagaaattaggtaattgtgtcgaataattcacctacatatattcctttttcaaatagtgattacgaatttgacataataatggtcttatgatgtcatctaatccatgattttatcaaatctatgactttcacgtcatggaaaggacccgaacttgacacgggggtcagtggcagttcgtacaatgaattctaagcctttgaatgcactttctattgtacgaactgccatgaaaccgacctgggtattaaaaaagaactccaattgtcaagaaaaaatttttgaaggcttttgccaataaaatcttaaagtccttggcatcattcggagactaacgaagaggagaagcttctaatcgcaattcccatattaaaaatggattatgagtgactcattttacagattgccggaaattaattgagttatctgtcgaagcaaaaaatggcaaaaaaaacagataaaaacaaatgagcagaaaaagtgatgcaagttttgcttttatttattgaaagaatgcgtcaaggtcagctgataagaagaatgggcacacagaacagaaggcgaagaaagcaaaaagaaaatatttattggtggaaaatgccaagtgaatccatcaattaggggggggggggggataaacaattgggatgatttttggggatttggaaagtattgggcaaattggtggggatgaaacaccctcaatgttatccaatacgatcaaagacccattgcttgttcgttgtttgcgtcccctgcatcataaaacacgccccagcgaagatgtatttacaccatatatcttt

SEQ ID NO: 21707 - DNA, 1856 bp, Heterodera glycines
ttcagctacattgaccatgccgtgatcacatttctcaatgccaacaagagaatctttgacagaattggcaccaatttggaattgtgtatttggggttgtcgctaaatactaaatttcattaatttgactaagtttatgctaagttatgattaattttagcaaattaaattaaaataattaaatttaattattacgaacattgatacttttgtcacttcggctcaccacgatttcgacagtaaaaatttttcaatcgtgagctgaacatttgaaaaaaaaaaaaatttcggcccgaagacaaaaaaaggaagatcttcggcgattctgccctccgccgaaacgtgatgattagagatcgacattttgaaaaatgcctggacctggacctggacctggattccatgttggacctggacctggatttcctggacaaaaatccaggaaaatccaggtccaggaaaaatccaggctcctcgagacctggatccaggcctggacctggattttttgaaatttattttaaaaaccaaaaaaatgtttgaaaaaattaattatttgcgtagaagcatctaaaaatatctaataaataataataatgtgtttttaaatttatttaatctgttttttaaaacttgaaaaaacatcggtctgcacgagcgtctggaagagcaattttgccctatagcggcgcccaaccgctcgttccataaatcccgatctctggcacttttatcgatcattttttgacattttgtttaatttaattcgaaaattatttttgtctaattagatagtttaatagttccaaacaaagggggggggatgagggcatctaatttattaccaaaaacaagttttataatttaaaaatgagcaacagtcatcagcagaaacgtgaagaatttcaaaaatattgcaaaaaaaaaaaaatttttttttttgattggttcaccatgtttctttttaatgagtggattttttctcattaattttgtccaccataccctaaaaaaacggtattgttaataggtttgtcgcaattaacagtgtgcacaatgtttttaacatttactgagttttttttgttcaaattgatcacatcatttgggccaagaatttgatttcaaaggaattttgcgctatatgttaaattttgaagcagtaaattcattttgatattcttactttaatgtggaaatgagttaaagaaataaatgctaattttattttacattttacaaaccttttttgtatgacgttcttcgaatatacataaaatattttgtttaaattttcttaatttaaccgattttcattttattttaagttcggaatcagcaatcaaagcctatgaaaatttccggaatcattgtaatcaatcaattatgagcatctttttattttcaaataaatcttaaatattgatcctatgaagggaaaaaattaatttaaaaaaacattaaaattaaatataattaaattaggcaaaataacaaaaatatgatcataaattaaaaattataaatttgggcacaacaattaatacatttaataattgcatatattttataatttcgaaaaacaggaacagcttaaaaaattgattaaaattcaaattaacttcaatcaaattgtttaattattaaaatcatttaatttttaattatattattattattttacatgttattttaaatttgatttgaatatttttttacatattaccacattttcatttaaatgttttatcagatttgtcaccaaaaaacacctgatttgtcatctcatggacaaaaatcacaaatttttgacattaaagccgaaaactttgagtgatatgaataagaaataataat

SEQ ID NO: 21708 - DNA, 1035 bp, Heterodera glycines
  misc_feature (897)..(897): n is a, c, g, or t
  misc_feature (967)..(967): n is a, c, g, or t
  misc_feature (1007)..(1007): n is a, c, g, or t
tacctcttctaatcgctgttgtacctcttctaatcactgttgcacctcttctaatcactgttgtacctcttctaatcaatgttgtacctcttctaatcactgttgtacctcttctaatcactgttgtacctcttctaatcacttttgtacctcttttaatcactgttgtaccttttctaatcgcttttgtacttcttctaatcacttttgtacctcttttaatcactgttgtacctcttttaatcacttttgtacctcttctaatcactgttgtacctcttctaatcactgttgtacctcttctaatctctgtaaggccaacaaaatttgaataacgggcgcgaagcgcccgtatgaaccaacaaactttaaataacgggcgcgaagcgcccgtccaaggccaacaaatttaaaaacgggcgcgaagcgcccgtctgagtccatcaaaatttaataacgggcgcgaagcgcccgtccgactcaacacaatttaaaaaacggccgcgaagcggccgaaaagcacaacaaaaattagaaacgggcgcgaagcgcccgtctgagtccatcaaaatttaataacgggcgcgaagcgcccgtccgactcaacacaatttaaaaaacggccgcgaagcggccgaaaagcacaacaaaaattagaaacgggcgcgaagcgcccgtctgaggccgcgaagcagcctaaaaatcgctgataattttttaaaaattccaaatcttttcacaacccgatagctaatctaggtagcgaagctcaagaagcgcgaagcgctttttcccagctaaatagccgacggttcacgcacccgctagttatatatacgttagaatgataaggagtttcgtttcaaaaactaatttgagaagaacgggaatagctgnggggctgaaattttgcacacaggggtaactcgagacggcgcatccgggaaaatacggatttttttgtccngtggccaactgagtcccagcggctcgaaaactgactttgnccgcagtctcagtgttacgaaatttttt

SEQ ID NO: 21709 - DNA, 1271 bp, Heterodera glycines
gattccttcgttttttttttgaatttcgccttcatacacctttatcattggaaaaaacataggtgtaagaaaacgctcctcacccatcccattaatagttactagtccttatttataaggacggttgacattgattgtcctggtgtcaagcccatgttaaagcaggcgtgcgatctgtcccaattaggaggatccaaatccgacaaaatgaaaaagtcctgatttgtcatccaatttatccttggttttgaaaatgttcagatcgcacccctgcgttccaagcatccgcatcaaatgattttgcttaattgtccccaacattttatgtgagtacaacaaacacactgactgactgattgattaatgatgatcatcctttgacattttgtctctatgttccgtttttttgacaattttattaattattatatgtagaatttcttgtagaactttgacaaatgaataaacaaaacaaaaaaacagtctcaaaaatggcaaaattgtaaagcaatggcattggcacttaaaaaggcagtaaacacttacgactttgcattttcgggtcaaattcaacaaaaaaaaaatttattattaaaatatgtattatatattattttttggaaaagagcacgaaagtagattttaagcataaacttcaacaaaaatttcgaaatattttctaaaacaaattgcaaaacgaacatttttgcggcctcaccccttctctctcccactgataaggagtggagggggaggaggtgttaaacgttatgataatgataataatgatgactaaattaccaaaatcaaattcttggggggagggcacaaaaatttacgacggaatgggcacaaagggcggcgacaagtgattcgaaacaaaatcatttttccacgattcgatcggcaaacagaaaaaaaaaatgtgaatggcccacgtcaatgatcacactcaaaccgaaaaataaatttttgaaattttttgttttgttttttttcggtgttggccattaaaagggacagacgaataagaaaaataaaacatttggccaattccgtggaattgcttcgagaatgattctttctcataataataggcttgcttaagaatgatttttcgagaattttggtcatctctaagaactgagacgaaataaaaaaggatttataatatccatttccattgtcaatgtatttaaattcgtcctaagatctccggcttttggggatcttatagcgccatgtaaatcaagtagtgaaattattttata

SEQ ID NO: 21710 - DNA, 2189 bp, Heterodera glycines
tttttgaagagatttgtttttctccaatttcagattcatctttaagaaaataaatatttaagcctaaaattaatctattgtaaatttgccaaattcggcggcatttggtcagtttggagcagccgatgcccccccccccccggcgggcatggcattaatcatccgcgggtctgctgactgcttccttccgcccccggggcgatgctgggaaagtgagtagggaagaagtaaaagtgacggaggactttcaaaatgaattttggaaattgctaaaatgtttaattggattgatcgatcaatggcaaaagaaacaaaaacatttcaaccggcaaattggtacagagaaaattgttaaataatttatttgaattcagaaaagggaaccaaaatgtgatcaaattgcaatgagaaaagccgttcttctcggatatttttgaaattagtttgttaaggatctcaaatttgttaattaatgacgcattggtctttaaaaataaaatatgccttttgaataacatccggcacttgtataaaatttgtcattatgccacaggttaaaacttttttatcaaatgcccttgaattttgaagtaaaatggccgggcccccgagctttggcattggctgggcccatgcttccgttcaaaaaatccgtttgccggacctcagcacaaccaagcagcagctcacaatcagtttatcgagtggtctcaccactttgaccactcctttaaaaaagaaacaaatatactgtaattggattattgtaggtatcatctaacgcttgggtttcaaatcatcttactacagtatctcttttcaagaaattctgacgcgttttcaactgatctgttacgccaggaaatgcgttaaaataaatataaaaacgatttatgcatattttattatgttttattttgccaaaaatattaatgggtgttaattgctccgctgtggccaatgcccgtgccaattattgtcctaatcatcgcactaatcgctgtcatcatcccaatcagcgttagaagcattgtctgcttcttcgtgcccctttccccgttgcttttgctccgttgcaatgcttcggcggatggcccaacggatttttgtggttggcccgacgaggcggcggaggacggcactgcccggcggcggtgccattcggacattggcgtgaagcggacggaggacgaccggtcggagcccgcgtggcaatactttcggcgctaaaattcaattaaaaattttatttaaaatcaatttgtaaaaggcatacctcacaaatgcactcctgaatgtccaccttttcgtgcaatcttcaaaatgaaaatagaagaaatgttcacggtcttttaatatttggatacggtaagggacttggtaaggatgagactatttaaaagtttcccgtttctgccccattttggcataacgtcatatggttcctaaaattgctaaagccatgcaatacttctaccctttttttgttttttaggtcaaaaatgtcaaacagttgtgatcagaagaggcgaatttcaccgactgttcgttcatttttggcaccttttgcacacattgtctccacgccgtgccaacacttccgcgtccacggcgccgaagcgttcggcacagccgcgcattgtgaaagcggaacccgagccgtgatcagtgagaataagcgtcttggagggggggggggcatttcgactttcgaaataaaaataaattttttgatgccctcctctcccacctgacaatggctgaaccccctgcaaatttgccggggcaattcgtccaactcgcgcggctccacacaatctctgcgcacaatttgcgccgttgggaaatgcgcgcgtcgaatttccaacaaatttttcacctttttaaggcgaggggaaaataaatttattctttgtcaatttatccattttctgtaggtttttgctgcactgtttgaaatccttgggaaaattggaaatcctatgtttttttgagatcgacctgcgcctgggtctaggcctcgaggggcctggatttttctggttttttgtccaggaaatacaggtccaggcttttttcaaaatgccgatctctatcttttcgccccatggggtgtgtgtgccgtgtgtcgtgcccaccaaccactctttgcattggctctgagatggcattccatgggctggcacagt

SEQ ID NO: 21711 - DNA, 852 bp, Heterodera glycines
atttggatttttgacttttgttcgaattcgggatttcgaattggccgaaatggatgccggattcgtgatcagcgacctcgaaaagcccaggaaatttgttttatgacattaaaatttttgaaattttttttttcaaaaagggggggggataaactacactattacccagaaaagcactgaccgattggagatggccggacaaaatcgggtcgagaaatgaaagcgaaatggcacaaagcacaacgccaaataccatcaggccacagggacggaatcttcagcatgcccaacattcccagggggtcctcggaaaaatcatctaaacaaaaaggaaacatttgaaaaaacgaccgaaaaggctgaaatttctcacagacctttgacctcatcgatgagaaaataggcaagaatagtggcagccaacagcagcgagccgagcacaaagaaaggcacttggaaaccgccgaaattgtcgtacaaaacaccgccaatcagtgggccgacagtgaagccgaaacccgcgacggtttccataaagccataaaaaaggaattaatttgcttttaatgcctcaaatcactcaccacaataacggatattcggccgggaaatgacttggcacttattgccaacgacgcagtcagaaagcacgcctcgccaagcgcctcgatgaaacggtcccagaagaagtggaagccgtcatgtatccaattcagagtactgtgaaaacggaaggatataacggacgaaatgggaatggaaggaacaacacattcagcatgggcaaggcttatgaagctgaagcagttcagttttggaaacaatgatgactatgaggaaggaacccaaaat

SEQ ID NO: 21712 - DNA, 1815 bp, Heterodera glycines
ggaagtttgggcactacttattaatttaaaataagaaacttttaaaattcgtgtattacgctgagattcattcttaaaaacccaaaacagtcttaaaaatttatattgcttgaaaattaaaaagaaaaatctgtaactattatcagtcgataacttatagctatttaaaagtaggttagaagtgaatataacaattttcgcttgcgtttagacccgaatacctttttatgagactgaaaacatcgagaaacatttattaattgagtggacatttcattaaaagcttacattccaaatttgcttaaaatttactatgctataattagatttataacctttttacacatttaattatttttatttttttgaaagccttccctttggtgtttaaaaaacgatcattgtgagaaaagatcattatttaaaaacccatcaaaatgggcctaatttaaaaaatcatcattatagttaaaatcaacattttccgcaaaaccgttaccaaattaattagaataatttactttaataaatattaataaagatgaataaagttttataacaacataaaaatatcactgtataattgaaattattctaattaattttggaaagcttttgcagaaaatattagttttaactataatgacgcttttttaaattatgcccattttgattttttttttataaatgaggacatagcagcatatttttgactccaaaaggacacaaaattcttatttattttgccactgtcgatctgattttaaaccccgattcgaaactccgaatttttggttgcattttctcaatgacatttccccttcgtattagcgaaagcattttttgtgactttttttgacttttttacactttttgggattttatgacttttttgagtttttgcgacttttttagtgatttttttgactttttggggtaaatttgaattttagcgaagaaaatgccgaaaaatacaaagaaaattcagtaaaataaaatttggatcgataaaaagacaatgaaacctggatgaattttttcttaattgttggaagaatttcttttctattcatattttaggtacctatttataaaattaagcgcctaaaaataagatcaaaatgttattctataaattattaaaaatgtttatcaaaaatttaaatgaatgaattgaattatgaataaatttgctttccatggtaattaataatgttcggacatattactattaataattctgttgattataatttgatgaataagaatagattaaattttaacacaaaatattataaattaaatatgtgattccggaaataaaattaaatatgtacaacaaaggttctaaaattaaaatctactaaactatgaaataaaatcactaaaataacttttaaatggatcattcaattaattaactacgccgtgataatttgaaaattgaaattataaattaaaatacaataaaaataattacaatataaaatagtgctaaatacaaaacagtaataaataataaaaaatttacaaactaagattaaaaaaactggtaattttttttcttcacaaatttttatgaaaattttgcagacttattataaaccaaaaattaaatttaaataaatataatttgacaaaaccaagtcctgcaattgagtgacgagatcatgaaattttataaggcaaaataaatttacaataaagtaaagaacattaatatgcatgataataaataaagcaaattattaataaacatttaacaattttaatcaaaacaatcaaaaatattagatatcaatttaggtaaaagaa

SEQ ID NO: 21713 - DNA, 1427 bp, Heterodera glycines
ttttgagtatattatttttataaaatactttttcagaagggagttctgattttttttctgaaaaatcgaatttttccagaaattctggaataacttttttattttggaagatagaaattccaaataaatctcataaaattctcccaatttttctctatttttaaagctttattccactaaatttgaccaaaaacgaagagatttatgaattttcgaaatttcacaggattttccggggctcaaattttgacgatttttcaaaaaattttaaccaccttccaaaaagtctgaaacgcaaaataaagcgtatatacgtattcagcaccataaattaggccataaaaatgcattttggctaatttaggagcaaaaaaatttttcatgaaatgcaaaaccatggggtcccccctatggttttgagtttcaaaatcacaattaattttataactttttttaaactcatggtaaaaacatgagataaagtacattagatagagcttaaaattttctacaaaaatgctctaagacaaatttccgctaaaatcaacgcctgacgagttataagcctcaaactgaaatggggagctcaattccggaaaatttttctatttccggaaaattttgaaattttttcaaaaatgccaccaatcgatagagctcgaaaaacggttgcttgaaagtggtctccgttttcctgggaaaaatctgcaaaaaataataaaattcaaaaacgaaaaattttcgagggggcctagctcgaaaaattttgaaaattttcaaaatctgaaaacgccatcggatgcagctttaaaaactacacaaatgctcaagcggcgccaacccgctccgcttaacccccagcgagttattcccgaaaaacgtaaaaccggcattttgagcgccgttcagtcgccaatttctacaggctcggcatttgatctgatcaaaaagtgatcagtgacaaagttgtagccaacatgtctggggtgtgccctctcagcagactttttccgctcccggtttccaggaaaaagttacagcccgaaaaccgagctcgtttttcaaagtccgccgtttcagcgccgctggcgctcagttggcctccggaccggaatttccttatttttcccagatgcgccgtcaaaagttacccctgcctgcaaaatttcagccccctccgggcaaaccacggggacttataggacttcgttgctagtgcatgcgcggacgccaagggattttcggtctacaggcatcgcgaggaggcattcataattttgtggaggactttcggccgcttcgcggcctcaaagggtgctccgcgcccttttgtattctaaggtttaattcggccgcttcgcggcctcaaagggcgctccgcaccctttttatatttaaggtttaattcggccgcttcgcggcctcag

SEQ ID NO: 21714 - DNA, 1993 bp, Heterodera glycines
tgttgcttcctttcggggaaagcgaaaagcccctggctcccctagcttgggaaggccttaaaaaagtgtttaaactgtttctaaatatttaaattacaatagatcttggctcttttgtgccagccttcatcttggtgtcgctgagcaacttaagagcattcctgtagcacgtggccaacgacaacttttgttgatcagtcactgaaccgccaaccctcgggccaatcgcatgcgcaatgtctaaatttccaaaatttcatttttgtaaccaacatctattggctattacattggacatcatttgctaaggcgccaaaggttggtgtcattataacacatccatcggcaattggtcctccgttggaagcgagtatcacatccaaaagagccttcagtttgatgtgctcaggtgcgcatgcccggtgaatcgcatcatcaactccgcctccttttgtcaaggtgttgtttgctgcgttgacaatcatgaagactttctgcttcgtgatgtcgcctttcaccagtgttattttggcgagatgttgttttgtcacgctgctttccaacaaaacatcagaagtcgaagaagagaaggttcttgttcgtgatgttggtgtcttgaacattggctgtgcgggcgaagctcttagcagatcatcttcaggctcattgtcagatggtggatggtgtgggaactttgaaaaattttcaaaaaaattcaaaaaccgattatattactggatcgcttgggtcgtcgggaagcgacacatccattgagacatcatcttcttcgtcgagcaattcccgcatgacgacgtttttgacgcgccgatcattgcgggtggtgcagactcggatgctgttagcgtctcgcacccgcgacaatgccacataaagctgcccatgggagaaacactgggcggaatcgagcagcacaccaactcttgccaatgtttgtccttcaaattattttcaaccataaattttaaaaatcaatatattaaccctgcgatttgttgattgtcatcacgcttccaggacgcagaggaaattggatgcgctcgcacttgaatggaccttcatgaggtgccttcggatcaccaccaaaagtgaagcgtgccgcatgtagatcgtgttcattgccgacatgtgttcccgtgagaatacggcatctgatgatgttgtcgaaaagttcagtgacttgcacccgcgttccattgcagagcccttcttccaaggagatgttgcggatgatcatcatcactgcaccgacgcgaacgcgaagaatatgttccggaatccccggaggagtcatccggctcagattttcgtggtccgcatcggcggcaacattctccaattcgttctcccccgtctcatccaccaacggaagggtcactgcatggtagacacgctcggccgtgttgagtcgttcctttatcggaaaaagcttacaactaatctatcgactttttctaccattattatttcattcaatgtcagcgtgtcgcggttcagagggcacagaattgctcgttccgcaagctgtttccagttgttggttggatttgttagcaggtccgccggaaaaatctcgttgatgagctcatcccgggatggctgaaccatcaaagacggcaacttgacacggccttgactgtcgttgatggtaccagtgccaacgcgcttcaaaaatgctcgataatgatgttggccgggcagtaagcggtggttggcacgcagtcgcacagttgtaaagttgacgaacaatgacgaattcttgactgaagcctcgagttgatgccggtcggtccctccgggaatgacaggggtcaactgcttccagtcccctccaatgagtacgaccttaaattgttagctcaaaaactcaaaagcaaatgtcaactgtgataccttccaggcaaatggaatttccttgagcttatccggcgcacctaaagaggaaggcggtccacaaattcaagaacatccttgt

SEQ ID NO: 21715 - DNA, 1479 bp, Heterodera glycines
  misc_feature (1454)..(1454): n is a, c, g, or t
acaacccatgaaccctcagatggtccatcctttgtggaaacgctggagtccgtcgcgtttggccctaatgaaattgcgtccgcccgtgtccactgggcactctttaccagcatatgattcaccgggggcggaggtccctttcctgtggaatcgctttaaagtgtctcagaagtgttgctttgcttgccaagtacatttgatggagcagagtgaagtcgaccacaggtacccttctccaactaaattgcacgaacatcaatgagtggtggggggggggggggggaaatgcaatttggtcccaccccctcccccctcacttccgaaatagaaaaatgaaaattttttattaaaaaataggaaaatacgaaataacatcaaaaatctcaaaattgtccccggcagagcctatcggcatagtcctccggacccaaaattcacttacaaattaaaatttaaaactggacccaaaaatagcaaatttctcggaaaatctgaaaaaataattttttgacaatttcaccgagaaattttccaattttcaaactgaaaaatttttaaattttaatttctccaaaatttcaaataccccctcccacacttatatgccttttggaaaaatttcaccagcctaaatgcacatttttaaggcatttgccagcgcgtcctctccagtcaattttatcattggcattgggcattcgcttccgataaatgagcatattgatctgatcaatgtgtgtacccgggagcgattagtgttgaaacattttgctggtgatgaacacaattcattgttgatccgttgtccaatttcacgcgatgagcacaaatgggcccagtgggagaaggaggcgattgagtggcacttttgtgacaaatggaacagaattatcatttcataattaattgatcagcagaggatgtaatgacgttgggtggatgatcaattttattttatttgaaatttaatgtgacggaaaaaaatatttggattgagagaagaaaaaatttcttgaaaaaaaaattaatcaatccagcggagccaaattttaaattaaaaaagggctcaagattgaaaatttggccatttaaggacaaaatctgttaatataaatagcacacaaattaaaaaaaaattcacgcctgccctctggcacaaaaaaaaataggaaaaataatgcggtaaaaaaggtaatatttgcagatcacaccttaattaaggaattgtaggaaaactttcgaattcaaaaataataataataattttagattttatcataaaagaaaaattgtgaaaaatttgatttcgaaaagtttggattaaccaaattttttgaataattcaaaaaaaaattttttagaatttctcacagtaaaaaaattttcgtgtttcgcatttcgtattttttaaagaaatattttattatttcttacccaaaatgcagggacggccnccaagggggggggggggggtacgcg

SEQ ID NO: 21716 - DNA, 1205 bp, Heterodera glycines
tcggtagtattacggaagaaattttaatggaggttttattcaaaagagcaaataaccaccttaaaataaatgggggctaattcgccaagttcttgtggaagcggaatacactcaaattgacatgtgtgtagttctcgaatatttatggcggtctgagtttttaatgcgtcattacgataggaattaatgatgccaaacccacctcaacaaatacacagtccatgccgtcctctcctttttcgtcccgccacatcgccaccaatcccttcatccacaatttcatctcttcatacacatcctcatccatctgcacaagactcgcacaatgtgccattggcgcaatgtaacaatgctcaggggaaagaccgtcccaattgaccacggagagatatgtctgaaaaggaaaaaacgccattcggttgttgttttaattagcatgatatagcttaaagaagtgtgaatttcgttgacctacagtaccgtacctttaggccataggcaacaatactgtgtttctcaaacagtttgctgttgatacattttgaacaggattcgagagtacgttcgaccaacttatgctctgaaattacaaatcagtttcatttaaagtctgtgaatgttagaacactgcctattgcagtttttacgtgacagattccgttttcaaaaaacgtaaaattaacgatgagtttgggattgaacttttcgattcctcgcaagatcaaatttgttccaaaacaaagaataaaaagtttataaaaaaccatcttctacaaaatgtaattaaataaatgaaacggcagcatgtttttttaaattattctctttcagttgaaggtcaattcccttaacacatttaatcagtttgaagacacatttggaacaaacagcgaagaaattaatgacgtaatcgtgtttctcaaataaacagttgaacgatggtttctctctctcttaatcactcacatttttttcttgtttgatttatcccctccccgttcgtcccattcttttaacaaattctcgcaattcttttttgtcgtatttaaaggcgctccaaatgatatccctttgacacattacactaaaggaatccgattattcgcattagacagctcaaagtcgccactgttaacaaagtgttgcttattagcctatgttgctacgttgtttcagcagtacgaatgtccaaaaggagcatttca

SEQ ID NO: 21717 - DNA, 930 bp, Heterodera glycines
ttaatattatgaaatctctgtccagctttgaatgaattttctgaatttttattggcgctaaaattactataggaattgctattaaaaatgattatacacttaaaaattcatttttatgttagcaatatttatatattttgctaaaaattgtaacggaaattgaggatggaatttcgtcctctgtgtgcatcaaacattcattgcgaaatgctcaaaaatttaaaaataatttcaaatgaattttgcctatctgtttacccgagtaaataataaaatttctttagcatattattcaaagcttttttgtaaggttttctttttgttctgcggttgtttggcttagaaaatgtaggaggtgaatagagagattaattaattaaattttcatcacagttatttgaagctgttggatatacgttaatattatgaaatctctgtccagctttgaatgaattttctgaatttttattggcgctaaaattactataggatttgctattaaaaatgattatacacttaaaaattcatttttatgttagcaatatttatatagtttgctaaaaattgtaacggaaattgaggatggaatttcgtcctctgtgtgcatcaaacattcattgcgaaatgctcaaaaatttaaaaataatttcaaatgaattttgcctatctgtttacccgagtaaataataaaaattttttagcatattattcaaagcttttttgtaaggttttctttttgttctgcggttgtttggcttagaaaatgtaggaggtgaatagagattaattaattaaattttaatcacagttatttgaagctgttggatatacgttaatattatgaaatctctgtccagctttgaatgaattttctgaatttttattggcgctaaaattactataggatttgctattaaaaatgattataca

SEQ ID NO: 21718 - DNA, 2018 bp, Heterodera glycines
aaattgaaattcccctacaatattttggcaagggcgcaatcatcccttggctttagagggggaggtgcgaaggcgccgcccgaaattttcactaattttttaacaaattttcactgaaattggcgattcttaagtcaaattttaaaagaaaaaggtaaaattgataagacaacatgcccaacattttgtttcattggtggtgccaactcgggaccgaaatgccgttgtcgctgttgtcgccgtcagcgacctgtcgccagaatcgccgccagtcgcggccacggcattgtttttaacaaaggcaacagtttgagtttatgtggtacatattttttcactcaatactgatgagtagccgatttgggaagtttttgctcatgaaatttgccccatttttgcgctaaacattcgccggttaggctttaatgatggtgctaattttggcaatttgcttcgtctcatttcgccacaaatctctccgatttcaacctgcgtttaatctctctcatctggtcttctgttgcagatgggatttgtgatttcgatgggccaatgtaacttctgctgctggccaagcgttgtccaaatggttgcttgcacactccgaggaaatgacaggctacggtcagcatgaattgttgtgccatggcatctattgtattctccgcgaatatgctcagagcttttcccttttatcattagccattttatcaacgattactcacaatgaatttcgtatacacataaatacaatgaattgaatggaaatggacgcatttgcgcgaaagcaatggtcaaataatacatacgaacaatcatactcaatacaatattgaaatggcatagtgccaacgtcttttcggtcacataatcacatcaaacaatcaattaatccattcatttctgtcacataatcgccattcgtttgctgctactgttgttgctgaccacccggcgcgggagaagctgtgttgagaagactgaaaaaaggaattgtattgcaaattataactcattggcattttattagtgcatttagtttatgagtccaatcaactgccttagtttttggcaccatagtccttctgtccattttaaaataaaccatacagttttggtatcagttgaaagcactaagtctaagcatttgttgattggattcataaacaaaatggatattttttttaaattgttcaccgttcgtcgaattcgccatctttgatcacaatgtcaattgggttcggtcgagcattgattagagcgctcacaatttgccaatttcgatgatcccatccaattggacaacgggtgagcacaaaatgacgcggaacgatttgtcgaagagtcagttcttctccggtgacttcattgttcaactcaaatggcacagcgatgtcaatttgcctctttggaaacccaagaaacacgcgaaaagaaacaggagaagaagcaatgcgaaatgcctaaaatgggacaaaaaatcattgaaacacaaaaatcagaaaaaccaattaaaaggaacactcacattttggagttcatccatcgccgcaaaccagttttctccaacagaattgacattacaatcaagcaattttggcacaccgtccggacgaggcgtcaacagccatttggtcagcgcttggtcatccgacgcattagcattgtcaccgagcggaaaaacgaacggcataacacggtctacagttgtgtagagaagtgccggagaatcgcagagaatggacggggccaactgacgcaagccgtgaagaacgattttgtttaatttcaggagacaaatcgaattgccgagcattggccaaattgtgaacagcacaaattccaaaattcgaagattttcagtgacaatgtccaaattgatcgaactgacggggaaaagacggcgaaaaccgccgagaaatgtgatgacattttggtcgatgtaactgaaaggcacaaaatgtgatggtcacaacaattcaaatccaatccatttttacgcgatcgtaatgcgtctg

SEQ ID NO: 21719 - DNA, 1494 bp, Heterodera glycines
aattccttcacaaattctttttgtttacgttggccatataaacttttgaattcatcaattctttcagtgaattcatattttttcttttcataaaaactattttccatctttttaattttatttaaattcatttcttttttccatttatatattttttcgcgatttgtgcctaataattttccaattttcgtctcaattttaattctgtcattgctttgtaattttcctttttctctcaaattttctttaatcgcttcatattttcgaattgtttctattttgtgttgatcatttgggtcatttccattttcttcatccaattgaccaacaaaaaaaatattttcattttgctccatttggtcttcaagttttatcgatttttcttcactcttatttttgtcccattcgttaccgaatatttcatcaaagtttggtcggattttgccggtttcaatttcaaaaataagaaaaacataaattattaaattgcataagaacatttttactattttgatatgtttatctcatataaaagctttaaatatgaatttatacaatctaatattacttagaaaattaagaaaaatccatattctcctgaattttatgatctctcctctgaaatttttattttcttaaaacaacaaaatttcgcgcgaaatgtatgttttttccattacaaaaatttcaaaaaatttttaaacatattctaattgttttgaacggtgggcggggttaacttccgaataatatataggatttgtcttcaataaacattttcttgatcgcccaaaccgacatttttttttgcctatttacgtgcaattgaatattgaatgctctaaactagagcccggcgggatcgggactcccgcgggattttacgggagtcccgctcccgactcccgcttttttcggtgaacgggatttttaacgggagcgggatttttacgggattcccgttcgggactcccgtcccggaaaattttgaactcccgatcccgctcccggaaatttttacccaaaaacgggagtaaaaatgcactggtaagaattgattttttttggtaaaaataatactttttcatgggatcgacccagttccctaccgccaattccctacggattactccgcagacaactatgcggtactcctacaatctcttacgaccgacaacatatagctaatgatccacttgagggaccggaacattcattaagctaataccaaaagaaaattttggcaccatttttgccgattgtgattttttgtcttttttctcacttgaaagagtccgtcaccactccatgaccggttcagactcttgcaattctcaggcaatgctgtcagatgtatttataaatggcatgcaatgtttgggataagaaatggaacctgttgtgctcccggacaaatagtgtgtataacgaggaaaggctaatgaactgtgaaagtgtaggaaatgcatgacaattttgtcaaaaaattgatca

SEQ ID NO: 21720 - DNA, 1568 bp, Heterodera glycines
cctccccctccgccccacccctcaaattcccaaaaagtttttttgaaaaacagccgcaaaaaatggttttaaaaagcaaaaaatctcgttgagggtattttgaaaaatgcgtaaattgcttaggagaaataataaatatttggataaaagtcgggacaaaacgccgtcatgtcaaaagcgccgaaaaatcccgtaaaatctattaacttatagatttttcaaagaaaaaattctagaaaatctttttataagaaaattctaagaaaaaaaaatttttttgagaaaatttcctcatcaattgcacgtcttttagctaaaccaatgttttaatttatttattttttgcttttcaatttaaattacatttgattgatgcactttgacaattctctggtgcactgattttcattttaccgtacatcaattgtttgcttgggcctggcttactgtcattcgaacaatatggtgaagtacggccccaaccagcaacaacaaaggttgactgatcattggtgcctgaaaatataagcaaaatatttttaattttaaaaaagtatttaaaattatttggcaaccatattccattaaacaaatgggacgagcacttgctgtgaatgcaattgggttcttcaactaaaaattttattgtattaaattacattttatattgtgtctatcaaaaagaataatgatctaaaaaactcaaaaaatttgcgatcctactttagtggagttaattaaatgtcaaaaaatcaaataaaaaatttcttttctccaaaatcacaaattgagtcttttaaagaggggttttcatgcttatctcatcgtattaaggtgcaaaccttaatattaaaatatttattattcaattagctcaatacatatgtacactccgattaattgggcatagattgtcaacgcaataaattgcgaagtgaaatgcgtaggatggtaaaaaacaacagcatatgatgacgaatatgaagacatgaataattaaaatcaaatttattaactctattatgcattcctatgataaatcttttaaaaaatatatattaaaaatcttttaatttttgaataaagaaagtgttttccactttacaaaatagtgaattttccaatcatttttttcattttggtttttaaattaaattttataatcaaaatcaaggtcgtggttattgcgttgcatttaatttgcatttcataagttttcgccatcatttaattaattttgaagtgtaaaagctcttgaaaaaaatgaaaaactgtaaaaaaaaattttctcgtattgtaccaaaaaaaaaagttttattcatttttattaaattagacgaataatttaaaacatttatttccctcaatcaattagccataatttaattggttgtgcttgttgatatgaatcaaatttgccatcattttattaattaactttgctgttgttctcgctatcggcaagctttttgtttttgttcgtccatttgttattaagttcatcttaattataaattctatttatttaagttatttttaatgtaatttgaagtaacgaaaataatttt

SEQ ID NO: 21721 - DNA, 815 bp, Heterodera glycines
gggagacgggggcgattcacgggatttcagattaagccttgctggggagacgggggcgattaacgtgattttcagattaagccctgctggggagacgggggcgattaacgtgattttcagattaagccctgctggggagacgggggcgattcacgggattttcagattaagctctgctggggagacgggggcgattcacgggattttcagattaagctctgctggggagacgggggcgattaacgtgattttcagattaagccctgctggggagacgggggcgattcacgggattttcagattaagctctgctggggagacgggggcgattcacgtgattttcagattaagccctgctggggagacgggggcgattcacgggattttcagattaagccctgctggggagacgggggcgattcacgggattttcagattaagccctgctggggagacgggggcgattaacgtgattttcagattaagccctgctggggagacgggggcgattcacgggattttcagattaagctctgctggggagacgggggcgattcacgggattttcagattaagccctgctggggagacgggggcgattcacgggattttcagattaagccctgctggggagacgggggcgattcacgggattttcagattaagctctgctggggagacgggggcgattaacgtgattttcagattaagccctgctggggagacgggggcgattcacgggattttcagattaagccctgctggggagacgggggcgattacgtgattttcagattaagccctgctggggagac

SEQ ID NO: 21722 - DNA, 1346 bp, Heterodera glycines
accttatccggcataatggcatgtgtctgtttggcggccgtcatttgcaacgcattgccttcatggccatcagcgcaggttctggaaagagaaaaattgagcaaaactgtcccatcagttacaattgtcctatagtctcctgcaattgaccattgtcattagtataatgatggaaattagtgacagaatttttgctaattacctgattttaatgatggtgtctgatatgaggtccatcagcagaaagcaatcttgggccacctgtttccaatcggtggggttaccattgccataaaaaggtagttgcagctgtgattccatgcaaacgatgaatggaaacggattttccatgtaacggatcgtacaagacggaaatgcaaaagtaaaaattcaaaagtaaaaatggagggggggggcaaagtgcaatttttcaaaaatataatttcctctagcaaaactcgtactgtacaatatcggaaaatccgtattgtataatatctttgttctggaattctaacatgaaaccgtaggagctagagattgagcccctcggcgggcaattccgatttcaattaaatgcccttctacgaaagggaccaataaatccgttcctatgcgctgttcggaatctctgtgctaaaatagcttgcttcgctctgctgctgatcggtaccaaacaactcactgatcaaagattggtatgctatgattagtaccaggaatttgttgatttggcactcgaatttgccgtgttggcagacgatggcaccgttctgctgaaaaagtcattcttcacaccttcaaatgattgctttccccttgtgcacttcgttaaccgttgctttgccaaacggcaccaattccaaccgaatgcgctgcccgaattcgtcgtgcgcgtccgacaacggcccgagaaggaagcgtaccgagtcaggacctttggcaatgtcaattagaagaccaattagggggaaatttcggacacacaaataaaacttacacaacgcctcaaaaaggacgcaaatttggacaaaatcactgcgacctttgagaacagaagaagccaaaacaacggaaaagacggaaagtgaggacaaacagaggacaaaaagtgaggggcagctcatctcaaaattggttaattttatcaatggactatcgggcgaagggaacggcggaaagcactcattggcatgggattagggagggttttgagaaaatcggaacggcattctgggccaccttaaaggtgtgtacagctattttccttagcaccttttccaggggcacctttaaagggaggggggggggggaaggcgtaagcagagggctaaaagcctcccccc

SEQ ID NO: 21723 - DNA, 861 bp, Heterodera glycines
  misc_feature (263)..(264): n is a, c, g, or t
cccccccgaaatcccaaaaagtaaaaagtttcaatgttttttttaattttaagcaattttcttcacaaaattgcattaaaattttcctggcggcgcctgtcggcaccgccggacccccattttaccaaatttatgaaaaatggagattaaaatggcaaaaaaatagtaattttttggaaaaaagggctaaaaaatttgtaaaatacaccataaaaagaaaaatacatccataaaaatcgaatttttgacttcagtcccccccnnccccccgaagccaagggtatggctacgcccttggggggggggggggggtatcaccgtacgtatatacatatgtacagtattttgaacgtaaaagatttctgttacaaagttcattcttccaattatttatttttgtgcaaatcagttcgaatggccgaccaataaaatttttctagtggctccaagccaccggactaaaattctaaaagttttgagggttgaaaaaacaacaacttttctaatgacttttttaattaattgctttacatacctaagataattcaatcttttaaatattttagcgaatggaaaagaaaatgtattcaatagaaaagatttgtacaaggaaagatttctttcctgtttttatttgacaactcacaaatttattattttggtgaatcatattttttgtcaaatgttaacaaatgaatacggtcaattttttccgagtggaaaattctcagaaaaaaactaatgcatttgaaaaatattatatattcagtcaattgtattgtcaatggctcatttaatgagaatcttttcgaagagcattattccgggcaatgaaaacaaaagttgaattcatttatttca

SEQ ID NO: 21724 - DNA, 1128 bp, Heterodera glycines
atttcccactcagaaatcatggtcacacccctttgcctctaaattacaaaatcacttttatttctataacttttttcaaaaatgtgataataagctaaattcaaatttataaaatagagcaaaaaattgcggattttttgagtatattatttttataaaatactttttcagaagggagttctgaaaaatatgaccaaaagcgaagtgagttatgaattttcgaaatttcactggatttttcggggctcaaattttgacgttttttcaaaaaattttaaacaccttccaaaaaatctgaaacgcaaaataaagcgtatatacgtattcagcacctcaaattatgccataaaaatgcattttggctaatttaggagtaaaaaaatttttcgtgaaatgcaaaaccatggggtcccccctatggttttgagttcgctacctagactgtgaagcgattcaaattgatcgatttggttggagagatttttttgaatttttaaaaaattattaggggtttttagtccacatcgaggctcacgacgggcgcttcgcgcccgtttttcaaattttgttggttcatacgggcgcttcgtaccagttattcaaaattttttggccttacagagattagaagaggtacaacagtgattaaaagaggtacaaaagcgattagaagaggttcaacagtgattaaaagaggtacaaaagcgattataagaggtacaaaagtgaattaaaaaaggtacaacagtgattagaagtggtacaaaaggattagaagaggttcaacagtgatcagaagaggtacaacagtgattagaagaggtacaacagtgattaaaagacgtcaaaagtgattaaaagaggtacaaaagtgaattaaaaaaggtacaacagtgatcagaagaggtacaacagtgattagaagaggtacaacagtgattaaaagacgtcaaaagtgattaaaagaggtacaaaagtgaattaagaaggtacaacagtgatcagaagaggtacaacagtgattacaagaggtacaacagtgattaaaagacgtcaaaagtgataaaagaggtacaaaagtgatgagaagaggtataaaagtgattaaaagaggtacaatagtgatta

SEQ ID NO: 21725 - DNA, 1253 bp, Heterodera glycines
  misc_feature (1220)..(1220): n is a, c, g, or t
aagatcattgattagacgcggtccaaaagtgattagaagaggtacaacatggtttaaaattaaataaataatgaaaagtttttataaaaatcgattgcattttaatttaaaatttttttataataaaatactctttttattcattaaatataattttgaaaattaataattgaatatttattttgaaatgaaattcattttttataaattcaaaaaataaataatgaaattaaataaattaattaaataatttataaaaatcttgaaattaaataaacattaaaaataacccaaaaatacaaagaaaaataatgtacaccgcccggattcgaacttccccccccccctcaaaatgatgcctcagaatccccaatcacacagggattctgatgtctgaacgatgtcaaaagtaaaatctgatcacgtattcgtgatcagcgtcataaaatacccctaaagacatgtttttggaatattttcggtaaaaaaatttttcaactcaaaaatcctatgctcacccctttggtcccgaaaccaaaaatcacttttatttttataacaattcgcaaaaaagagataaaaatgtaaaataaaatttatattatagagaaaaaaattgcggatttttgtagtattttacttttacagaatgacttttcagaagggagttctgaatttttttctgaaaaatctaaaatttccagaatttctggaataactttttttctttagaagatagaaatcccaaataaatcccataaaattctcccgattttttgctatttttaaagctttaattcacttaaattgaccggtcctccattgagttatgaattttcaaattttagcccaaaatcctgagggtcaaaaaattgccaaatatttttgaatttttaaaaaattctaaaatttcctaaactgaaaattaacatcagattcgtgctcagcacatcaaaataccccagaaaaatatttttgacccccattttcaacccaaaaaaaattttcgaaaatttctagggggcctagctcgaaaatttttgaaaatttccggcaatatggcacaccatttgatagagcttaaaaaactctacaattttgccctaaggagttttttcgataaaaccaacccctaacgagttatggacccgggactcaaatgtcccgctcaggccaaaaattttttctatttccgggaaaaaatcgaaatttttccgaanaaataccagtcgatagagctcgaaaaactatgt

SEQ ID NO: 21726 - DNA, 1891 bp, Heterodera glycines
tttttttttttcttacattttttaatttaatttttgtccaggggcacccggttgaattagttttgcctgattttgtgcactcaacaacggggccatgtgctgcatcgggggggcgctttctaatagggtgaagaaacaaatcgctaaatgaaaaaaattcgtttattcagcaattttatggaaaattttttgcaaatcttggatttatttcatcataaaaattttgaatcgcaatttcttgaaattttcttatcaaaattttctcttggatttttttttgttaatttcgtttaaataattttttggaaaaacttcttacttaataaaattttgaaaaatcgctgagaattttttcaattttttctaagttttgaaaaaaaatttaggggggggggcgatctgctatttttttaatttaaaaataatattatttctcattattttttgctgcagttggcacacaaaaatgccgacgacgacgagcagcagcagaaggtcacgctgggcgttgaacgctttgcactgcccgaactgctgattcggcctggcgatgttgaagtccagcaaatgggcatcccagaagcattgtgtgctgtcattgaacggctgccaaagggtgcggcggggggcaggggtttaaccgaaggcttttacttaaaaaaagatgtgataccaccgtgtgtgtgctgtacccaatcccgcattttttgggaattgcgggatttgctggattaatcccgcgggaccccgtctcacgcaatgccgcagcgggatctgcaaatttaaaatttcaggctctaatattcactcgccgtagggggcggagcaggtcacccccgcctcgaaattttttaaaaattgttagaattttttttttgaaaaaaactgagtttttaaaaatttttagggctgggggaaatgaagtgcacctcgtagcggaggagaagaaggagtacttttgcttattgctttcagaaatgcagctgttgatagcgcggaacattgtgctgaccggagggaacgccctcttcccgggctatcgcaaaagaatgtaaaaattttgaaaaaaacaaagactcacattttaccaagaaatagtgtaatactgttgtttgtcccccctttttaaataaaaaattttcaataaaaacaaatttcctatggtttccgagggactaggtcgtttcggcgccgccatttcggcgctagcccatgttttttgtgtataccttttttctttgtaagcaaaatcaaacaatcttggtatcattcgaaagtccttcacatgctctactagccttacaaaaaaaaaccaacaaaattctagcctttaaaaaattattaagaaaaaacttcaaaaattttgacttttttgaaattttcatgtatatccgaggttcaccaattcaactgattccgatcaaattcattcaaattgttgaatttcgaaatttctttttttattgcagaattgttggttttcagtaaaccgatttagaactcaaaaactcgaaaattgaactttcgacttagtgttcgaattcggacccggagtttggaagcggtcaaaatggacgccggtttcgtgatcagcgacctctaaaaaccacaggaaacttgtttttatgaaattaaaatttttgaacgttttcaaaaaagggcggggacaaactcaataatcaaaaattgtttcttagccctttatttcaatttttattttttatcatatttattttttgctaattggcagtgagcaggaattgcgttccatgatgcccgaacagttcactcttggtgttcagcaaccgtccgacccgatttgccacgcgtgggaatgtgcacgcgacgcaatccaacaacaacagcacgatggtgcggaaatgcacaaaaa

SEQ ID NO: 21727 - DNA, 1213 bp, Heterodera glycines
acaaaaaaaaacgtttaggtagtattgtaatgtatatattattctttcttaatgaagtgattattaaaatttttgatttaagtgattttctcatttttttcaattgtcgtgactagaaaaattgtactgttgtttttgaattgcacaaatattctgctgtttgtttgtgacatcattcgaaatgaggcaaattgtgctaattgcctcaaaaaagaacaaaatgtaaagcaattataattttaattgttccaaattcatttaatttatttaccaaaaatagtttccacattttcagttggttttgtactgattttttgatggacattttccccttttttgaccatgccgaactcggcctcaaattggcactgatttcgccccatttcgatgttttagtggacaaacatttcgatggcaaatcagaattgacactttggagatcaatcacaattcgtaaggacattgtcgcaaaagtgccaaagttgtgtgtgtttcttagtgccaattctgttgaatttccattgcccgaccattcgctgcctaacaaaattcgctttaagaacctacggattgagtaattcaaatataaaaagaaagaaaatcacttcttttcaccattttcagatacattgatcattccgtcatcgcttttctccgttccaatcaccaaatttgggacaaaagaggcatcaatttgcgaaagttacggtactccctgcgggtgcatatcaaggctggccgtgatcacggatcacggaaatcacggggtttctgagatgccgtgatctcggatcacgggtcacggattttttcaatttttccgtgattttgatccgtgattggcattttatgtactgaatttttattgaaacgaaaataggaaattattgtgaaaagagaaattgtttgagaaaaataaataaataaattcatgtctgttagtgaagaacacatgtatatatagcctagtggttaagccctccgtcattcattgtttgccccttgggttcattccccattgggatagcagaatttacatatttttttttgataattttaattgaatttaattaataagaaaatttcttaacagtgaaaattattttctttagtttttaaatatccatataccaataaattaacccaatgattaaacatattttggacaaaatctgttaacaaattcactccaaatatcaaaattttttcccgg

SEQ ID NO: 21728 - DNA, 321 bp, Heterodera glycines
aaatcgggcattttccaagttttttgcttgtcctatgccaatggcacccgtcaaattttcatttttgtaccaccaccgtcactgacccaatggtactgaattgttccgcgcccattccttcccccaaaatttgccctccgtccgatgcccccccccacccacccaccacaacaaccgcccaattcctgatccactttcactttttcgcatgcggagcaaacgacaatgacagccgactacgcgcggacggggcggaagggggggagatgaccatccgacaaaatcagaaaaaatcggaggtgcccatcgcggtccccccgc

SEQ ID NO: 21729 - DNA, 1021 bp, Heterodera glycines
ttcaaaaatatttaaagaaatctacaatattatattagtattttttagtttttaaattttattctttaagaacatttattattgcataattcctgaagaaataacattttgtaattcttcatttgtttttcatcattttccaaaatggccaataattttttatttaaattccaaaatatttcaataaattaccaaaaattaaaaatatattttatttttcaatttttaataaatattaaatttaattatattttttttaattataaaattatactaatcaattgccattccaaaattttgtttgaatcttttttaaaattatttttaattttattttccaaaatgttccaattaccaaaaatacaattgcatttaataattgtttttcattttccaaattgttccacaaataccaaaaattttccctaaacacccccccccccctttcgtcgtcatcatcagcaacacataatgtgttctgcttctgcttctacttttgctgctggtaaccttgatccgattttgctttctcttctgttctcccaattttcgctgaccgttgcgcgccgccgcccgcgccattcgccccggggggacgctatttttggacgacgcattccgtcccctccccgcccccctcaaatgtccatcggcggtgtctctcgtcgtcatctccacttttcgccccgaaaattgagtgtccccgtcccctgggggtcagcagcccccgccccgggggcggtggattccccgtccgatcacttcgtccgtccgtttttgatgggtcccccccctccctccgtccgactgtcctcctctgatcactttccctttttcctttttgccccccctcggcggcggattttttttcatttatgtcggacaattgcgccccaaaatttctttcactctctttttatgggcacgcgacgcaatttgtggcgtgtctcgcctctcgtcgcccccgaaggcgacgaacaatttaaaaatgccagcagaattgaaagggaaaagccagacc

SEQ ID NO: 21730 - DNA, 960 bp, Heterodera glycines
tttaaatttaattaaagtttaatgtcgaatcataaaaactatttctttttaagagctttaaatatcgtacacgagctacataatttaactcgaaaaactaaaaaaaattttaaaaggcaaatgagattaaacggttttcctttttttacatttagttcacatttttccgatgagtcatccaccatcaatctctttcagcttctctcattcctctccttcctcctccttcttctcctcctgctcctcctcttcctccttctcctccgtcgccatttccaacctttcgattacgcacctcaattttttctgcgtttgctcactttcgcctctctcttttggcatttgtatttcaatttcggctaatattctcttcattcttccgatgtcctcctttcccagcaaactgagaatgtccgaactgaaaaggtcgaaaagccgcgaaagagccgccgaatgagtctcacaatcagaagaagtcagctaaaaaaggaaaagaaacagaaaaggaaagggaaaaagcgcaaaaaacgaaaagcgatgcgaaaaattgaaaggggtgcaaatttcggtcgctgttttcgggtggttcgcttttccgtcatcggtgcccacctctttgctaattgattcttctgacaaattgccgttgccgccccctccctttggcattctctgcttcgcattgtccccgctgctccgttggcttatgaatgggttcttcctctcctcctccgtcccccgtcctttccctttggcttttcccttttcacttttccttcctcccccacaaatcgctcttctcaacaacagttccacccttttaatatgtgccattttttgctcattttcttcagaaagcatttgacgaatgtgccatcggaggagcgaatgcattgcggacacaaaaaaaatgccacaaattggcaggccaaggcaaacctttggaaatgggcaggaaaa

SEQ ID NO: 21731 - DNA, 1942 bp, Heterodera glycines
tttccaatggcaccactttcaaagatgaacagataggcaaactttgaggggaaatgcgctcccccgccgccctcgcccctttcgccgctctctcccaaatgtttcccttccctttgctcttccgtttgaaatgccttaacttcgcaactttttcatttcaatttgaatgtcttcacctgattagccaatttgttcactttgtcaacgcattcctccacttctgctgggtttaatcccaaccgataagaaacgcgcattttgccaaggtcagaggagaaatcggtggaatggacgaagaattgggagatgagcaaacggacggggaaaagagtgtaatgactgaaggaaaagcattttgaaagaaaaaaaggcaaatgaagaacggacatggaactccaaatggcatcggcacaaagagaggcgaaaaagggacaatcagtggagagggcgcaaaaattgcgaagcaacgcgcaaccgaccaaagaaaggttctgagagggaaaacaaagagtgacaaccgaaagcaaagcttacgccccctttggaaacgcaatggacggacagccgaaggagaagccgaaggaggaagaagcgccaaagagaggggagaggggagggggagagcagaagaacaaccgaacgatgggcgaggagggagacgagcagaagcttaaggcaacggacgccggatgcactcagcggaagggccagcgaattgccaacatcggacgacagaacggcacaaaaacaaaaagaggcgaaaggagtgccttaaggagataaacagcgatcaaaaaagggaaaaggggggggggaacggacggaccgaacttagtcgaaagctccccaaggaaattgccaaaattaagcgttagccgcgactgattggtcacgttgaagctgtcatttctgttgttcagcatggccttcagcaattgctgcagaagattgaaggagtgcagggcaacaactttacaaggggaagtcggactgagatggcaaatgggcaaattggagggccaagtggagtctgaaagtgccgtcatttttctttcaatgattggtccatttgcttttggcccaccttcgcttttccgttgtccgcttccaaccttggcgccgccttcaccttcgtccaaccattttgacattatcggacatccctcggccattccctcccgctgatcactcaaaagcgttcgcaaatccgtcaactgattgacataaccatctgcatccgcttcctccgtatttctctgcccattagccattgttattttccgtttgtcctcccattttcggttgatcatttcaatgaaagccaaaggaagttcaattggagcagtaaataggaagtcgatcagaacacattcagaacgttccaaaagagagaccaattgctcaaaaattgatgaattgtcgtcaattgacaaagacagaaaaagggacaaagcgtcgacaaaaccagaaaatgcgatcagtagaacgaatggcttcgaaatagccaagaatttctcaaaaatgtccaaaatcagtgccaccaatggacaatttggactttcctttacatttcttcgtataagctgctgaaatagaacagcgaatcgtacaaaaaagctaagaattcattgcctgaattgtgccaaacaaagggtcccacgcggaacagatcatttcgctattttggcccacgaagctgagaaggacttgaccgacttgcagaaatgtttcggacacgcaaagtgagtccgaaccggcaatttgagagaaggcggagaaaagaaacgaattccatccgaagactgtcatacgcggctgatcacttggccattccaattgcaaaagtgctttgatcacttcgttcactccgtcaacggccctccgattcacttctcgtggaatcgaattggcagaagcacactgaaacataaaatgaagaaaa

SEQ ID NO: 21732 - DNA, 583 bp, Heterodera glycines
tgattttgaaacagggattacattatttattttaataaattcagtttaattgtctttttcaaataattgaagaagagaatggatgtggtaaaaaaagcagcaaaaatgaactccgaaaaccaaaatcaacgaattgttttttaattcattctccggcgccacctttcgttttcgcccttcggacatcgaacagttgcgggagattttgtctgccgaaggctaataactttttgaaaatgattttaaatatgcaattagtcatgcttaacgcttttgtgcacatttattgacactttacgctcattttctatgcacagaatgataatggagggactaaagcaaagggaaaatgaaaaggcaaggaattcaaaaggacaacgaaatgccattctgaacggtcgctggtcagaaataacttttccaataggtggacagacgcggagtgaaggagggcgggcggtaactgttgtaatgtctgacattgctggtttggccgtggaaataccaagggaccctaaaaaggcggtgaattgggaggggagagagggggggggggggggaagagatatggacgtaatatatg

SEQ ID NO: 21733 - DNA, 466 bp, Heterodera glycines
tgtcgatgaaaggtggggggtaaagtgagcttgactttagagtacgcggagaagggaatggcttttcggaattggcaggtggtctcccctccccccccccttcccctgtcagcccaaacactccgtccgacccgcaacagccaaacaatccgtcccaactcgtcggtcggtttggccaagtgatcgcttcgctttgcccgtccgtccgtgttcccttctccccaattgttggctcatcagacacatgctctccccccttcccgcccccccattctccgcccacggattctcccaattcctttcctccgattatccctttttgtttatgtgctttctctcttccgatcactttcgtcgcctttttctctcactgatcgctttactctccactgatcggcatcgattgtcctgataagtcagtcatttcggtgccgaatgtttgaagtctttgcgaattaagaattag

SEQ ID NO: 21734 - DNA, 1336 bp, Heterodera glycines
ccctaagtgttctctattagcgtacaaaatttggaaatttttgttaaggttcaaaaaagttatggtcagaagagttcaacaaaccaaattttccaactttttttatactgaacaaaattttttgaaattttgcaggctaatagcgcatctgaagggctttcgaatgataccaagaatgttggatttggttggcaaagaaaaaagttatagtccaaaaactccgccccacgcgaaaacggcctggcccgcatggggcaggctcccgtgtcggtccagttttgccggatcgaaaatgggcgcccgacaaaggcacaccacgcgccccctccgtcggtttacctgttgtcaaaagagctcacgtccgaaacggggatggcctgcacccgccaagtgttgttagaattgtcggcgaacaccaccaagcaaatgccgacattctccaggcccaattcattttccaattggaaaaaatgttccttccatggcggaaccacaccgcttttggggaacaaaattatccttccgcttggatgggcctaattaaatttatttttcagtttgtcccacccctttttttgcctcatttcgcctttcgatagcttctatgacaatgtttctggccgggatccacgcactgtggaggtaacgaatgcgctcctcgaattccgcgccgacaattgccatggcattgtgaaagcccttttccgggtccggcttttggtcattccatgccgggttgcaattccgcactcgcgagtccaaagtgctcgacatttggtacctgacaaattcaaaaccgtcgtttctacgatgggatttgaatgaaccattttcaattaaaaccccaaaaattgaatgttttgcccaagtgaatgtctccgctcttttacctcggcgttccgtcgtactgtttaattccgttgtcaattgcgtcgactccctcaacaaatttacgatacacgtgctcgtatagtctgtccatgtccgcgtcatcctccgccaaattcaaaatgttagcgatcaacgattttccgtaatgggcgtaaatgagaccagccgaactcagtttggtctataattgaaaatttgtgaaataaaattattctactgaaaaagaaacctgaaacggaaggcgggcaaccgaatgcattgactcagcaaaatcactgaaggaaaaattcaaaatagacaaaacattgttaaaagtatgcctaggagcgtgggcgttgtgaaaggttgggtgaactccaacggatcagtggcttctcaattcggtaatccttcggaattggtgtcccgacgggaaaaagagaaaaattttcttttaactttttct

SEQ ID NO: 21735 - DNA, 785 bp, Heterodera glycines
gaaaaatacactcttaagaatcgaacaaaaattgagcaaaaaaatttactatctgctaattgcagtgcacaaggagtaggactgggatttataaggccaaaaaaccaaaatagttacgtaataaatattttttaaaaattaaaaatttttgccaagaaagtgaatttttgagaaaattttttcatttcttatgagtgtatttttaaagatttgtggatcggtttttaggggtatatttttctcaaattttttcaattgattcttaggggatgtaattttcgtttttattgcacttttattgagaaattttccaaaaaatctcgaaatagtgaaaaaattagcgacaaaatgccaaaatagtgaattttcactattttagtggcgaagcgccaaaatagtgatttctagtgaccgataatgacatcagaatcgaaaatttctaatgcagaaatgcgttttttgagcttctttcttcaaatcgattgagcaaaaaaaagaagttaaatcacgataagtagcgaccctagtaatttgtctgccaaagaaaattggttttctatgccaattaattaatccccgacatgcaaaaaagacattctctaaagcataatattttcggctctagtgcactttatgagtccaatcaattgacaatacctggtttttatacaataactttattcatgtttgaacaacccctatctttttggcatcattcgaaagcacacagtctaacgaagctaaaacatataaaatctcaacggttaagtaattatgaaaaaaga

SEQ ID NO: 21736 - DNA, 2300 bp, Heterodera glycines
ccccccccccctcctcacatttcttaaaaccaaaatttttttacatataaaaatttgatgaccccataagaatgaatgatggtctgatttgtgtgaagttagggcgaggcatcagaagaagcaagcagcagatcattcatgtccatgccctcctcccaaaaacctgttttcaagtgctcaaccctccgccccccccccctccccttcccgtcttccttttaagcccatccaactgacacccgtccgcatttgctgctccgctcatccccccttcccattacttgctaattgactgattgatgctaatatgatactgaatatgtgattctgatcgtttttccccacgctgctttttgcttttgctctcccattgattcattcgttcatttgcttatccctccaatgtctgtcaattcgccgtttgtcactttcgcttctcccccctttcctccccttcctttctcggattatcatttttcagattcattttttctctgattcattcattcatttctctttttttgttattttctcctcccgtcagccagccaacagaacaaacaaaacaaaaaatgtgtggaaataatatttacataataatgtgtgacttttctttgctcttccaatttcgtcatttgcttttttctttttttcgtttttcttttcattaattatttaaaaaatttggttcattttttcgatccttcccaaattcgtcccctttcctccgtctgacatttccttgggattgacagttccattccgccgatgttatctcctcatttgtcagtcagtctttcgcttcttcccactgtttctttcgtttcagtcgcttcggtttggtcattttgcttcaatcaaaatttataatataattttaaaattcgctgtcattcatttttgaagaacttttccgagtctcgacaaatgttgaaacattcgaaagtgccgaaatgtaacaaccgataaacaactttgccaattgtcagctttgttgcatcaatgatgcctcaatgctcaatgatttttttttacctcagggaaataattgattaattggtgattaatcgccccttccctccgttcgcaatttttgcccctttgcccccccccccccccccatttgccattttcttcgttcatttgttcgtttttcattctttccttcgccgtgccttcgcttcgcttggcttccgctgcctcggaacaaagaacagaaaaagttgggaaagcagcagcagaacccgtcccatgtccacgtccaagaatcgttttgcttatgaatggcgtaacattcccattcaatcattcattttccatcgttcctttggttgcgtgtgaactgagaaccatccccatcagaaacggacgaaaaacaattacctcgttaattgattcgccctacccaattcacgagggtttcgtttaaagtggttaattatgtgctttgataatggttgatgggcactgtccggggttaattattccgtaatcaatcgttacatgaacagagagagagatggggcgaaggagagagagagagagagagggcagagagagcgagaaaaacatgggaggggtctgtaacttaaatgcctgtgctttcgaataccgtaaaactgtgaattggttttgcgtgactaccatggtccattcatgtctattcaaaattctgcttgtttggcgttatgtttattttattccatatgatttccccgaatcccctggggcgctttttcttttccgtgtttttatttggcctgactttttcatttctctttccccatttctcatcgcttttccctaataattttgttcaaatttctctcccccacagattttcatcttcacaaatctcagcttgtcaacaacaactcatttaaaccatggaccaccgctataaggccattattataggcaaatccgaccagcatctgtccgacatgtgtctgaaactgtggctcatcggcgagtggaaatgcgtggacatcaaattcggccgatatggcgggtacaatctgctggacccggtcgatgtcggcgactttgtcgagctgtacgacggtggtggaccaattcgaaggcttcctccgggaccggcactgcccaaaacgcgaatcctcgacggaagcaatggcactcgcagctgcttgaaggtgggggcacttgcatttgggtccttttttggcattttttttgaaaaataggtaaaaatgccatgggcagaaagtgccaattgcctttttttgcaggatttccatcaaaaatgttcgaaatgagattttagaaagtattttcat

SEQ ID NO: 21737 - DNA, 1514 bp, Heterodera glycines
  misc_feature (1495)..(1495): n is a, c, g, or t
  misc_feature (1502)..(1502): n is a, c, g, or t
catttacgcaacaaaaccaattcaaatgcacgaaatattcacctgataacaaatggcaatcgagggcgctgatcacggatattacatcagatttatcatatgacatcattaaatctatgattttatttcatgtctatgatttttcatcaagttttttttcattttttaaaattatagttccaagaaatattttatggggttatcggagtcgttaatcacgaatatttcatccattccgactaattcctaaacccgaattcgaacaaaaaatcgaaagttcaaatttccgaaatttggatttatgtttcgaaaatgcttatatgatttttttttaattgcaggaatgatggtttttggtttgtttccatgcatttaaaccattttcgaaacataaatccaatttcgaaaatttgaactttctattttttgtcggaatccggcttcggggttcgaatagggtcgaaatggatgtcagaatcggattcaccgacccagaaaaccctagaaacgcctttttcgcgccaaaaaaaaatgaattttttttttcaaaaaggtgtgataccatctaaactattaccgaattaggatatctgttactttatgtcaacaaaaaattggcacaattttttaagaaatggatgagtcaatggggtgctgaccagggatgaacgaaatttcgtttcgtgtttcgtttttttttaaattttggtttttcgttttcgttttcgtcaggcgaaatttggactgaaatatttacaccattagaatgactttttccgtaaaaaataagacatctcactagaaatgttgtgctctagtgctgcaaactgcaatttggtgcattaaggttcgagaaaccataagcccgaactttatttacatttttattatttaatttacggtttaatcattatttttcttctcatactcgaacgtaccaaaaaagcaaaatcaggaacgggaaaaaatacgggaatccagtcccgctatttttcgttttcccattcccgtagattttttaattgaaataattaataataaaattctcaaacttaaaaattatttttctttattttttaaaacagccaaaaaaacccacaaattaacaaatgattggtaattttttatagaaaacccgcggcattttttttttctggtgcccaaaattttcggtcgtgcagcaagcgagccgcattgttttaaggctttatgtaattgtttgtttatgcacactttttcgaccagtatttccggcgtcaaaacggaacattgcttcgaacacgtcggaggccgaggccagaattgttttatgggcgggaattagctaaaaaatagacaagttattaaacaaattagaccatgttccttattttcaattaaaattcaaattagtattaaatgtttaaccactcgcttctttttcgtcgctttccccaaccaaaaaatgaatgtccgccccattgctgaacaaaagtctcatacgttccaccaatgnttttcgngtttgacctgca

SEQ ID NO: 21738 - DNA, 2205 bp, Heterodera glycines
  misc_feature (2182)..(2182): n is a, c, g, or t
aggcacccctcagcgaatacttgctatagagcaatcattcaaaggccattttgtagagaattttgtgctctttctgttcgtcatattcatcttctatggaaaatttttcccaaccccctagaatttttttttaggaatttactcagattttcgtattttttcacccgcaaaaattttgtgtttaatgccttttttatggcataaaatgaatacaaaatgcttaaaggatgtctgtacgttatcttagtgctgattgctgttagtttgattcggttgggcaaatgttagaggcgatttaagccttttggcccttaatttctcctgaaaacttagaaaattcaacataactctccccaaaagacatatttctgtatgcaaaataaacagaaatgtgaaaaaagatttgttctttcttatttagcttgttttatcagtttctttttggtagttgttgagatttttcttagttttccaaagtgtctctattttaaattaacacgccaattttggaaaaaaattcgtaaaatttttttccgtcgtcatttcgtcttcttattgttagaatcttaatattttcagaattgctacgtacagttaaaaattcagctcgatcggttcatgggaagtggtcaaactcccaaaaaacagggtgtctttattttaaattaacacagagtattctttaaaacgtggtttctcctcaattttttgttcattaccttcgttatattttctgctatgtctccactattcttcaacatgtcctacgtctgttgttcattatggtgttattaagtatctgaaaacctaaatgttctctaatatctattatcttgccaaatttcaaaaaatttcgttaagttttaaataatttatgagtagggtttgtaattatatggaaatccatatttttttcctggactgtgggaggcctgaaatgcacgaaaaacatgtttttagcttggtttgaagcttctaggatggagttccatatccatatttccatatttttccatattttcgcatttttgtccatattttgagatttttccaaaaaaacctctattagaacggcccccatcagccaaattggccttttggaccccaaaaaccggaaattttccaaaaaatctttttttagcaaattttcacgagaatattgaataagtttcaattttctgaaaaattgataaatttgtatcaaaaataaactaaaaaaagcgaaaatttcgcttttcgggttgatttttcagtaaaaattagtaaattttagctttatcatgtttttttcttttagaatgatttttaatacaatattagcccttttatatgtattttagtaaaatttaattaatttgaagaaatttttggaaaatttacccttcaattcggaaaatttatgtccatatttttgcaattttattttcgcgatttttggtccatattttatggccatattttgcgattttatatccatatattccctgccctatttatgagcaataatgtccaaaaatcttgtttttaggttcttctggccataactctttttttaaagtcaaacagaaatttttgaaattttgaaggctaatagaaaataaatggccattgaatgatatcaataattaaaaattatgttactttttagctgaataattttttgtcaaaaattgtgaacgccagaacggccaaaatgtcaatttacttttgggccaaactttcttggtcccacccccaagagggtggttttagaacaaataaatatggcatatacgcatattgttcaaggatttgtccatattcacactgtacatttacatttgttctattcacctcactttcccatggcgcccatttcgccggtcgtttttccccttgtccccactatattttaccgttatttgttcgttccaccatcggtgatgatgagaacttggattagaatgaaattcaatttaaaaatggattcattccatcagccgcccacccattcgttcattctttcgttcgttcgtcattcgttttgcccaatcctttctttccttctcacaacagaattaatttgttcgctgctgcagcaaatactttcacaaataaaaaacacactttctttgatgaatccttgccgcccatctccgccgcctcaatttatatgcaattaaaggttagtagggcttccaanttatatggaaatccaatattttt

SEQ ID NO: 21739 - DNA, 2483 bp, Heterodera glycines
gaattggacgcgaggcaaaaaatcgtatagtatttttcatatgcttaaacaatcattgccatgtcttagtgttgtttgtcagatgcataagtgcaatcacatttttatacacacattggtgttggcataaatctcatttttatgcgaatttccccttattaggctgtcagcaataaattggcactctgccaaaagtgggcatgccaaaatgcttacaggcaaacaaagatttatgaccatgccaaaattgggcgcatagttccatagcgtgtatagtgggctataatagtcatagaagtatattattatgagaaaaacagaaatctatttctctatatgaatattggcactgtattttgccgatctctttcactggtgtatctcataattgcaggaacattttatttatgtatgactgactctctttctctgatgtagcccatatttggacgaacattttatgtatgtatgactgactctctttctctgatgtatcccatatttgcacagatattttatttctctgcccactctcttcattggcatgtgctatctgattttttgtttgaccgtcttccatgcgatattgcttcgcatttgcatgccgtgcagtcttttcgctgaaagtgccaatataaaagcggtgccaaactcagccaatgacacttcattttcaaactactctctctcactaattgttgcacattccccaattttatttcttccttagtaagtagtattggtgcacaatgcgcacttttctgttcatagccgtagtcgggttgatgttggccgtcatcttggagaatggtattaaaaatttaaaaaagattttaatttgtcataaatttatttatattattttagtaaatgcgactgggaaaaattcgccgtcaaagggtgatgacgataaattattatttactataattaatgtaaatttaaaagcaaattatatacaaaaatttttgcgaatcttaattcttagtgtcggtgggaggatgcaattttttgaaaaattgaatatctgaaacaataataatttttattattagatagtagtccgagaaaatcgcccttctaaattattatcattagggctgctaattttatttaaaaaatttgcgaattatgtaaataaaatatgtataaaaaatgctaaaatatgtatgaaatatgtacaaaaacccccaaattgtactaaaatatgtaaataaaaatttttaaatggtcatttttttggataaaattcttcgtaaaaagtgaactaatcacaaaatgccttgaattttcaaaaaacaataaaaattggttgttagatagtaaacatatttttcacgattttaggaaaacagtcgctagacagtccaaaccataaaaaagaccctaaaaatggacatcccaagtttgaagcagaacttatttttgggcaggggaaccttcaaaaccctggttaccggaaaccccttttttttcccaaaacccaaaattttttttttaaaattaaattgaaaaatttaaaaattttttaaaaaaaattttaaatattttttttttaacaaaatatttttttcaaaaaggggataacacaaaaaaatttttgtttatttttttttttttttccccccaaaaaggggccccaaaaaaaaaaagggggggggaaaaaaaggaaaaattaaaaaaaaaaaatttttacagggggtatatataatttttaaaaaaaaaaaaaaaaaaaggggtgtttaaaaaaaaaaaaaaaatattttttttctttttttaaaaaaaacaccccccccccaaacacacaaaaaaaatttttttccccccttttttttgtcccttttttttttggggcccgaaaaaaagggaaaaaaatttgtttttttttttttcctcctaaaaattattttttttttttattatattggaaaaaaaaaaaaaaaaaaaaaaaaatattaaataataaaaaaaaaaaacctcccttctttcttgctgctcgaaacaaaaaagaaaagagaaagagggggggttgtttttttttatttttttttttttttttttttttttttttttttatttaaaaaaaaaaaaagaagggaggggggggggggggggggggggggggggggggcccctttttttttttttttttttttaaaaaaaaaaaaaaaaaaaaaaaaaaaataaatatcttccccccccccccccccccccccccccccccgggggagggggggggggggggggaggttggtgttccccccccccccccccccccccccccaaaaaaacaaaaaaaaaaaaaaaatttttttttttttttttttttttttttttttttttgggggggggggcacaaacaccccccccccccccggtgttttttttttaaaaaaaacccccctttttttttttttttttttttttttttttgggggggggggaaaaaaaaaaaaaaaaaaaaaaatatttttttttttttt

SEQ ID NO: 21740 - DNA, 822 bp, Heterodera glycines
tggctgagtgcacctgggggaaaagaaattgtaaaattgccaatgaaagacgggggggggggagaaaggattaatggataattaattatttatgggtatttaattgataaaattgggactattttttaattttctactattttcgtagtgtctctttctctccaactttttgtgccatttacacgacaaaatgcgaccattctcgacatgtttagtaatctaatacacaatatcagccctgtttttcacggcattatccagattaatttttttttttggcgctgtgtcagtaaatccgcctattgggcactctttttttagtcttagtggcacggcggtgccaaaattagttttattgagtgaattaattaatgattgatggcatggcattcacaccgctaagcggaagataatgtcggagcagtgatcgtgttgagacggcagggaaaagacttttgatggcacccaaaacagcggcaaaaaatggccgatgggcaggcgaaagagacggagccggcggagaggcgccactcattagacactcattttactatttaattggaaaattggaaacaaaattaattttaaagcctaattattaatagttagatacaattttattaagaaaaatcgaaaaatgtaaattgaaaattttgggttgatgaaaaaagttttggccctaatagtaatttttatttctaacaaaaaattaaattgcgaaaagcgattaattctcaattagtgatacatccttcatttttatcatcagtgatatttccccatagtttaagcaaactcaaattccccttttttaaatccaag

SEQ ID NO: 21741 - DNA, 1241 bp, Heterodera glycines
aaaagttcgaagaataagtttttgagttccttctggtgtcaataatttttttttgaaaacttaacgaaaattttacaaattaataataaacatacagagttatcgaataacaccaagaatgcttaatttgatttacattgaacaaagttatggtccaaaaagtattccggcgacgttttggggtgcaccaaatacaaaacatttagggctatcaaatgacatcaagaattaaaaatatagttgctttttagcaaagttataaaaaaatttttttattttgattgttttttgagtgacgtcataacactgtatgaaactgacgggaaaagtatagaaaaaacagaaagggaaagccaaacaaaacaaatgattttaaagacacctccaggggaaaattcaaaaaagaaaggaattttaattaatgaaataattggagcaattgagccgagcctcctttataattgaaggaagattttgtcgatactgtgaataaaaaaatcaattgatgcaatgggcgcagtgtgtgcgaaatacggcgccgccggggaaacaaaaaaaatggcagaggagggaaaagaggagagaaatagagtgggattaaagaaggaaagagtttacgcgtccaatcaatgtccatcctcagtttcttaagccataactccgcacctcgggagcatttttgctgaacattacagaccacaagagaacaaatggtatccattttattcattttttgcggctcttagactataaaacagccctttttaattttatcaagctaatagagaacacttagagctatcgaataacaccaagaatgtttaatttggatacttctaaaaaagttataacacattaaactcgtcaaattatttttggtcttttttatggtcgggtaaactgaatagagcccaattaaatgtttaaaggattgttttaatgaaaatttttaattggacgtataaaagtcgatggatgcataaactgaactagagccgaatgcttttcatctattggcaagacattgatcattttttggatgcaattatgctttaaagtggcccttgccttgttgttcgattgcatttaaattgagatgttttaaaattattctattaaaaagttaagtatacacaggtgtctaattctttttctagtgtaccttcatgaggaaaagctttaatccagagaataatccgataataccgtgacagattagggtgtcacagaacacacaagcc

SEQ ID NO: 21742 - DNA, 1402 bp, Heterodera glycines
aattgggttcaaaaaaattttaagagaatttttgattacttctttgaagtcttgaatttatttgacaaatccaagacttcatactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctctatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtacaaccgttttagaaatagcgtagaaaacagcttcgatatcaagaaaccaaatcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattattttgaagtcttgaatttatttgacaaatccaagacttaaaactgggagaagcaaggggctgtggctgggggcctaaaatttgggcccacattggagaattaattctgatttctgaaaaagtcccagaaataactattttttctttccataccttcttgtagagctcgagctgctctttccatggtcttatcccggtctcgatccgtgccgaactcacaaaggtatggagtgaatgtgaaatattgttttccccaccaggcattttttctgaaaaccggattcaaaaatctggggtt

SEQ ID NO: 21743 - DNA, 1434 bp, Heterodera glycines
tttattgtcacaattagcttgttagattaataggaaacaccttctaattttaaagcgagatttggcaggcacagatcacttcttttccacatacatttccgattttttgtggcgtaagcaatttggaggaccggatattttttataatttgtggtctcaaatcgctgaattgtacccaataaacacataaagcaccttttatttgtcatttaaagcatttctgacaataaaagagaaaaaaaaaattgaaaaatttgaaaaaaaaaaaagggggatacaaactgaattagtaccgaccaaaaaaggcccaccgcagatgatgttgtcgtgcgagtacatggccaactcctggtcagcgcggatgtcgaacagtcggcatgtggcgtcgtcggagccggtggcgaaggcgtgcccattggggaagaactgaacgaacgggaggaaaagtgccatcagaggaaacaagtcgagaaacgggattaaaaagatggcaaaagggtcgggaatgggatcttgccggaattgaaacctcccattttcatgtttcccaatcgactgcattttcattgctaattgtccgtaccgaaacggcgtttatgtccgactcgtgcccggggaatgtctgcttgcacatcccttcgcggatgtcccacagtttggcggatgcgtcgcacgcgccggagatgaacgtgcgcatgtcgggcgaaagcgacagagacatgacgtcaccggtgtggccggtgaacgcggtcacttgctgtcccgtttcaatgtcccaaagggcactaaaatgggacaaaggaaatggacgaattaattggtttttgagtgaattcaatgggaaatgccaaaatgatcgtttttcaatttggcaaatggcccgaggggactcaattggccgtctgctgactgactgaccaagtcatgtcgccggaggaggtgacgatttggttgtcgtccaagaagcggcagcaggacaaatacccggtgtgaccaggcaactcgcgcgacactcgcacatttccctcgcgcgtcttcagcgagtaaatgctgcaaatgttgtccaatccgccgcatgcgacgaacgatccgctgggggcgtacgcgcaagtcatcacccaggaagacagcagcggaatggcatgtacctgaagaaaattgacatatcagcatgtactgcttgaactcggctcactttgttcgtggtgtacgagtcccacacaattaatttgccgtcctgagaagccgaaactaaattccgcgagtcggacgcccaatgcatggcgtagattttggccatgtgtcccctgagaattcgtcggttccgcagctgaatgcgcccgttggactctaaattagcggctgccaatgccaatgtcgtatccttggcttgtttccgcgcttcctgaacccgattaagcattgatcagtgac

SEQ ID NO: 21744 - DNA, 1588 bp, Heterodera glycines
gggagagcggaccggaaaaggacggaagatcgtaagggtgggacggaccaccggcggaggccgagaccaagctgcttcttgccccccccccccctattgtccccttcgtccttgggacagttcaagcgtgacttttgcgcatttatttcccttgagcgcttgtgactgagaaggcataaaatgagaagcggatagcactgcaggaagaggaagaggaagaaggaggaggagaagggggaactgttgctggacgaatggacaaatggcgaattatttatttatttgttaagtcaacgaaagggaagaggttgacgacagatgaagaggaagagaagagaagatggaaaagtgaagatgaagaggaaagggaaaggggaagatatagaggaagagaaaagagaagaggagtggaaggaaggaaaggaaaggaagaaatagtaaaaaagagaatgatcagagaaaaagaaagtaaataattataattacggaagaagcttggtagaggaaaagcttaataaaattcttttttatttcttctccttcccacttcgccctccccaaatttccttctttggtcccttctctctcatttagtgccaatttgtgccctaaaatgacggccaaagaatggacgaatgaatgcgtagtgaccaagcaaaggcacaagaaagcatggcaagatcatgctgggaattgaggacagggcactcgacagacgaaatggcaatttgagggggacgggggggaggggacacccgaaacattaaataggcaatttgatgagagagaccattgggaacggagggaggggataatagaagaggaatggatgagcaaatgatgattttttggtattagactaattaatgggtccaaaaatgcgctcccgtctcctccgccctttctttgtccaaaaattgaaaatgacgggttactcttataatgattttaaacggattggccaactcagctaacatttgcatttcggcgatggtttacgattacataatggcggcgtacggacaaaaatgcgacaaaaaggcaaatcaagcttaagagaaaaaggaaagcaaagaatgaaagaacattaaaccattcgattcgaccataaaccatttctaattttgtttccaatgtttatccatttactataaatgaattgtgaaccaaatgcgcaagggatggtgttcaagaccgatgacggccggcagggacgaactcaggatttgggttaggggaggggacaacaaggaaaaaagaaaattttcaacaaaaatactattttcccataaaatttcggatgcggaagggtattttttggagggggacgaaaataggggttttgctgaaaattttcgattttgttcacttatattactcaaaatgattaaatttataccaacagactattgtttttgtgtttttagctattgtgaaacttgcatttttcgtctttcaaaaaaaacgtctgagggcgatggaaatttttttgttttttgaaatttgagtgtatttgtcaaaaagttttttatcgagacatcccttgcaaatgtatggaaacaaacgagcaaaggacgaaaagctttat

SEQ ID NO: 21745 - DNA, 921 bp, Heterodera glycines
  misc_feature (23)..(23): n is a, c, g, or t
tgcattcattaaaggccttaatntcgtttataaatattacatggagctcgaaaaattatttattacctgagtatgaatggttttcagatcactcgaaaaactgctatcatgtttttttaaagcttgaagctcaaacattttgttgcaatcatttcgcaacttgttggcaccgtttttcacggtatcagcaaaaaatctggcctcttgtaaggtttatggttctagttcttgctggaaattaaaaacactttaatttttcccaatatttatttattattgtttttgaaaatggaaatcgcatatcatatttcttaatagtcctttatataagtctgataaagtaccttttaatgatgggttgaataagccccaagggcccaatttaataaacagagtaaagtataaaaaaaacatcaaataacaaaaaatagtaaaggcaaaaatgaatttagctaaatccgctttcaatttattttaatgaacattactgaccgttataagagttaaagcatgttcatctacaccaatcattgtaaaatattcacacttttgatgagaatctacctgcgagtgtctgaaattttataaacttttattttttatataatcataaagcttgtgttattggagcttatataataattagatttaggaattttgaaatgaacgggacaagggcggactttcataattttctatttattttgggattcattagtaaatatcatgtattttaattccatattaatataacctagaaattttaactttaggcaattttatggatcagttttgatataacattaaggctttattttttaagtattaaatgttaaaattttgttgatttttttgctttccttttcgatcactttacagcgtaattaaaagaacttttttgcgaagcaggactcaattttt

SEQ ID NO: 21746 - DNA, 1465 bp, Heterodera glycines
cagcgtaataaaaagactttttttgcgagtcaggactcaattttttaaattaatgaaggttggacgccacccaggaaaattgtttaggttttaaattatattaaatatgaagcaggagtcgggaaaggtcagtaatttgaggcggtgacctgttgataggcgacgtgacgcacagcaatttactgaacagataagtgtgatggcctttctcggaaactcggctgtgaacactcaaattgataaaagggcaaaagtgaatgttttatagcttaaagtggcatgggattgaggggcatgaattaattaaagaaataaatttgaaaatgtggcaagaaggaaccaccagcaatcggaatatcacaatgttgttcgaattattgagagagggtggggagatgggcgtgagataatcggctgtcgagaccagggctaggcatatgtgtttttaattacgcaaatttatccctttattactgtgatttttcaattactgaaatcagtaatttttaaaaacaaaaataataaagtcagtttattaggcttatacgttattttttttgctttaaaaaaagcaccaacgaatcaatctatttttaattggaccctaaaaatttaaaaaatttacaattattcttaatcaatttttaaatttcaataatctgcttatcagtgctttttgtcgaccagtttttcgagctattgatgtaggttgtgtacggggtgagacgtgactggattttcaattatgaaaccagtaatctataattaggtgaacttttacttaagtaaatttataacacgtaattaaggggcttaaaaatactgtaatcagagaaatacgtaatccctaaatttaggaatttttcaattatggaactctgtaatatgaattacaaggagcgagcctaaaaaaccataattaccgaaatccataattacagaaattttttaatacggaaaagttaatatgaattacggggaaccaaaaaacgccgtaattacggaaacccataaactttaataattaaactatattagccatatatcctttttgctaagtcgatgctctatcatcattaataaataggtgcttttataatttttcccaaaattggaatgaaaaaacaaagaaaaccctgtgttaaggacgaagagaagaaagctcaactgacatgtggaatgcctcaattgacatgtggggtacaagttcatcaccgtggagtaagcaaatctaactttttgccggggctgccaactctaatgatttatcatcattttgctgagttcaatgggtcaatgatattcttttgagttgaagattttctgatttttgaaataaatcctcaaaaagggccatttttacgtaaaattgctaccaaaattccaaagttttcaagaaattccaaaaaattttctcagcgtgcctatcggcaccgccgaaccaaataacttattcttcttaaaa

SEQ ID NO: 21747 - DNA, 2118 bp, Heterodera glycines
tattcctacggcaccgtcggcccactcacgcccaaaatttaaaaaaaaaatggtcgccgaattacaggctttacagtaattatgcgtggctttgtatttgttttctaaaattcaaaatctggcattaaaatgcggaaaaccctaaaaaacatgtgttcccccttactttcatttaaaatttgaccttcatccatagaaattgactgattcgcaataaattctttggtcctcagtaggtcaagagttgtaagtgttgttctgtaaaatttgaaatgtaagccttttcaattaaaagataaatggaatatatcagggatgttgcgtctcatttctcgcctttctcgttctctcatttattttggtagcaacatccctggatattattccttaaaagtacaaatgattggaaggcgttccattgtcacatgttccattgctcacaaccaatccgttttccgcctgaacagtgatcggagcagcgcaatttccaatgaccgctggtacggctgacgaaacattggcattggtgacgttgttttcaattggtaatgatgaagaagccttctcataagcatggtccgcttcaactatttcgtttgatgccctaagaatttgacgtgacgaatgggcgacataatgcgcagaaaccaaaggcgaaggttttgttgagaggacactgaaaagcgtatgtaatattttttaagcacatggcacacctttcttttgaaccgtgaggtgtttgtggggcgtcatttaatttgcgtcgttcttcaaagtgatttttgcaccattttgaaacctcgtctaatgagaaacgagtttgactctttttttgatcatccaacacttaccacagtgtaagttctttccaaaattgttttcgtttttggccatgtgaatgggagtttggccacaatatttagtgttttggcggaaatgagaataacatttctgattgtgagaattttgaagatgcgaactgatttttagcctaaaccaagaaaacatgcagaaattcaaaaaaaaaaaaaaaaacgaaaaatggctaccttttgtcagtcccgcgtgtattcggctgaactgccctatgaaatggacgcacccgcgcacaaacaaaagtcgtctcgtcattctctcgcctccgtgtctcgtcacttttaagccctaaataatgtttaaatagatcacataaagaaggttctatatctcttgggtcattggtgaaaataaatttccgactttttgttcgggttttttttcgaaaaatagggggggggggagcaaaacaaagtaatagccgatatataagtcgaaagttctcattggattcttatggttaatactgctcgaaattgctacattttgccttttaattgtccgatatttttgttttaaatttcaaggccttgaaaaaaaaaaaaaaaaaagaccatgatcgaaattcgatgcttgttcttctttgataaagtcacatttcgcttcgttatttggcccaataggcaaattatgacagtgttgaagttgggaggaagaagtcgggtaatctgccgacgacaatggtaaggattttgaaaatgatttgtttgagtgataaatgggctgaatttagaaacttttttgattaaatttatgacaaaaattacatgtgacagtgaagagttgatcacgctttctgcctctttggttgaattgcttacattatgtttgtaaaatggtgtccgtttagctttttgttgagtgtccgacagacattttttggccgattcttcgctttccaatggctcctcctcttttttctttttttccaatgaaacttccttcttcctcttttcatcttccaccctctttctcttccgtggcctcccaacaccgttttttgtcggtttttgagttgtaacagtcacagtttctccatttttagttgaaattgtgtcttgatttgactcagaactgtgaagaaattttcgtaacctctcgggaacttaattcaatgcataaggaaataatacaatttcgtaaattttaatgacaaaaatatttctaaagtggtaaatcctaaccgtaaggctgttttggcaatgccatcaaatgagaaagcgcgtcattttgcgtttggca

SEQ ID NO: 21748 - DNA, 1390 bp, Heterodera glycines
ttttaacttaagataaatttaaatatttaatatctctttcaaaaaaacgcttgttcaaaagcaagctaattttttagtaattattacttcaaagaaatttcacattcgattcgaagcgtgtgatgatcgcaagtgtaaaagtgcaatattatttgttaagatattatgtaattattctacgcgttttcagtgaaggcttacgcaatattatgctcgtctggcaattacagtaaataagttaaatggatttactttttctaattgaaaataaattttaacacacctaaataacgttagcttctcagttctccgaagtggctatcacattgtacctagcatcccataaccaatgcctctaaataaatagctatgcatcatttcatattttcccatattaaaaaaaacacttcgtggcctcggtgcttcgcgcccgcttcaaaatatgttacatgttacatgaaaacggagggagttcatgaatttcctctcttagcatgtaacatgtaacatgtattaacataataaaagcaatgaatttttgaaaagttattaaggggttctaggcagctttacgccctaagatgggcgcttcgcgcccatttcttaatttgtggggctcataagaacacttcgcggcctcagtgcttcgcgcccgcttcaaaatatgttacatgttacatgaaaacggagggagttcatgaatttcctctcttagcatgtaacatgtaacatgtattaatataatgaaagcaatgaatttttgaaaagttattaaggggttgtaggcagctttacgccctaagatgggcgcttcgcgcccatttctaaatttgtggggctcgtaagaacacttcgtggcctcggtgcttcgcgcccgcttcaaaatatgttacatgttacatgaaaacggagggagttcatgaatttcctctcttagcatgtaacatgtaacatgtattaacataatgaaagcaatgaatttttgaaaagttattaaggggttgtaggcagctttacgccctaagatgggcgcttcgcgcccatttctaaatttgtggggctcgtaagaacacttcgtggcctcggtgcttcgcgcccgcttcaaaatatgttacatgttacatgaaaacggagggagttcatgaatttcctctcttagcatgtaacatgtaacatgtattaacataatgaaagcaatgaatttttgaaaagttattaaggggttctaggcagctttacgccctaagatgggcgcttcgcgcccatttcttaatttgtggggctcataagaacacttcgcggcctcagtgcttcgcgcccgcttcaaaatatgttacatgttacatgaaaacggagggagttcatgaatttcctctcttagcatgtaaca

SEQ ID NO: 21749 - DNA, 1470 bp, Heterodera glycines
gcccctctctggtagaatgccccctccaataaaatgcccccctaaaacacagtttttaatggaaaaacgatcaattttattaaaaaagaaaataaatttgatcaaaatattattcattagcaacgtcgacagagacatcgctttcgtcttgtcccaaatcatcttgctcaagtgctttcacaacattttcttcatttcgacgttgattcagaagatgaagcccatttggtatggctccgtccgccttaaaacacttgaaaaatacacaaaatactccaaataggcgaccttaaaaacattgatcatctcatcgtttcttccatcaatttcatccgtaattccacatgacaaaaaagatttggcaatcagttccttcgagagtaagttccaggcggtgacaatccattgcagatacgtctccattggcggagccttcatatttccggacgacgttgtttctttctctcctttcaccatccattcatcgtaaatttgcctgattttgttcttaaacggtgcgttccaacacacgtctggtggctaaaatgtttttttgggtttaaattgaattgtctactacttgaatgtatttgtaccaccgggaataacagcagattcgatggataaacgccggagtgtctgcttggtatcgtcactgatgtgacaacgaaagctgtcccaaacgagaagccgggtcccgaatgcaaaaccgccaagcaccttaattacataatttctttaaagacaaataagcattcgcacttcctctaaaaactttgtcgttagttcgttgtttatccatgtacggcaacaccagcacaacactaaatcgttcttaaaacgtttgataatgtctggcacaggtctcttcttaggcagtaaaacaaatggtcgcagcttcgtcccgtcagatcttgccgtcaacatcaccgtcacccttgccttttcatggcctgttgttagcaccgtaacggacttggcacccgtctcagaaacgcaatttccgccagttggatcaagccaaacagctgtctcatcgcacgcaaagacagcagtgtaactaaaattagaatatgcgtgaaaacttttccgctaatcattactttttttcatgccataatttttgaacatagacaataaaattgacaattgcttcggcgtaatcatcgggtggtttttgtgcaagtgttgttggtttgcgcaacgaaaagttgtggcggctcataaatttctccaaccatccatgactacttgcctaaaaactgacaatatgatttaaattacttaaattcttacagaaaaattttccaaatttttgtagttgtcgctgatttgttgtgcccttgaaaaaaccatggtgcgcgtcacgcgtaacttcttcctgtagaagttcgctcaaccaattcgctagagcatcatcgaaattggcgtctaacaatttccttccggcaccagagatgcgcatacgct

SEQ ID NO: 21750 - DNA, 1552 bp, Heterodera glycines
  misc_feature (99)..(99): n is a, c, g, or t
tatatatatatttgctaaatttgagtgaatagcaacacgtacaataaaaaaaatacaaaagaaagcctaagcttagacccaagaaaacctagccaaacntaaagcttttagacctaccaccctaaattttacgcattaataaatattttggtgttttttcgtaatatttttaaaaatatttattatttttcaaatcccaatcctagataattaaaataaaaattttatatttgcatgattctttcccaataatttttagacttagactgcatttccgcgttctatgaggaggaagatgaatggacacaaagattctgggaaaaatgaagaaatccttcatttgaccgttggaaattttcattaaaatttggattttttaaaaatcttaaaaaattatgcacaaaaatatgaactgaaaatttttgaatatttttgtttaaacttttttttcaattttgggtaatgctctgaatttatttcattttcttttcccctggcggaattttaactaatttttattaagaagatttctagaattatcgaaaaaaaatttcatgtaaacatattagtagtatatggtgccaaaaccgagcgggtagcggtaggacccctccaaaatcccaagcctattgaaggggtgtttttcctttgaagttgccgcccgcgcaaaatcccgcgcctattgaaggggtgttttcctttgaagatgccgcccgctcacatcctgagcctatgggatgttctttgaactctgccgccttgcggattttaatttacccaaatccgtgcgggtgttttttcaccccgcgccgcgcagcgccgcgggaaggtcatcaatcatccacctgtcaccaaagtgacaggtgaaggaaattcaatttaacttttgcaaattttaatcttttgtttcaaaacctttagcgttttattttctcaatcctgaaaaaattttttatgatgatttttctgatcctgaaattaaaaattcttttttgaaaattagccaaaatcgtgaggggttttcatttcctctccgccccgccggtgcgccgcgatgccggcgccgcgcgaagtaatcgataacaaaataaatacccaacagaactataaattgggggaccgtcccaataaatgaaatttttttatcgtctccctaacttcttttgagccattttcaaataggggagaatatgatgatacatttcctcaatttcagaattgtttttagttcccgtaattacgactttaccggtccagaaaattaacgctgtaatgcttttaccccgcttgaaatttaaaccgcaaaatatttccggttcataaaatgcacgacgattttttcgaaactcgttcagttcaatttcacgtccgaatttaaaggtcgaaacaatattttcaaccgtgtgtccggtgtaagaagcccccggacaccccgagcccttaattatttctataaattttttaatagcattgtcacagtctatcagacttttcgtccccagacatatcaaagggccggattcccataataatgccgtggctttgatgggag

SEQ ID NO: 21751 - DNA, 1715 bp, Heterodera glycines
atttcaaatttacggatcccgctgcgggattgtggtattttggaaatttcgaaaattagaattaaattttgaaaatctccaaaaaactaaatatacctggcaattttaaaaaagaattttttagaggctggcggtatacgtgaaaaggggttaatgggttgataaagatttttaatggtcagagggttggagagagatatgcggacaaattgttaatgggatcattccgtaaatttaacgattttatttttaagtcgttttttgcggcgcgctttttgaaaaacttttcgggtatagaggatccggcggtgccgataggcgccgccagaaaattttgtcaatttcttaactgattttgtccaaaaaatgaccaaatatcacatctttggactcaatttctaccgagtgaataagtaaaagccggtccggcttgccgacaggcgccgccgagaaattttttgcaaattttagatgaaatttgagagaaaaatggctttaatttgattgaatttgttaaaaaattattcaaaatatttggcattttgtccttaaaatattcaaaaaaatcaataaaatcccgcagaatcccgcacaaaaaatcaaatttacaggtcacgttgcgggatttgaactcaaaatatccaccagcacggggattttgacgccatacagcaacacggttcaactcactgattagctgtactttccccttttataatcaaacgagcggagcaagattaatccgggggtggtaaggggtggggtgagccgagagaaaaataaatttagggcgcatgagtcggggagaaaaagcgggggtggataagataaatcctgggtgcgggttgagcagagagaaaaataaatttagggtggattagtcggggaggagaaaaagcgggggggggggtaagataaacccgggtgggaggtaattcggggaggaaataagccctggggtgattccgctgggagatgagtcctcccttctcagacaagacacccgattatacccacctctagcgtaattattgaacgctgcattcccagcgtctcaaacacgggccgataatcaatgtccacaaattcagtggagtcgaaccggcgcattttttgcgcaagacgacgttctttttcagatgcttcgtgtctttgcaccttagcaaaagattttttattatagattcttaaattttataatgaattaataatcagagaattcttccctgtaatggcccatcgctctgtttttgaacagctatcgcattcacaattacaagacaggcttccctttgactccccttccatcctaggaattgacgaaagaactgcagcagcgactgggaggaacaaaaggccttcaaaaatgcaaatcaacggaaaacggccagcagattttgaataggagaaccgaagacaaccatcgaacggccatttcgtgcattagttccacccatcccttctccccctcggatcagttccctccccctccccgggttaatttcccccaaccctctgcgttattaggtcacgttagcttaggtagacaaggggtgtaaatttcgtaaaaatgtactgtgctccgagcaattccgtaaaactctacgagaatcaaaacagcactggtaaagatgagaaacttgtgcgaaaatgtaaagaaaaagcaatattttatcgaaaaatagatttaatttttctttagtaaatgtaaacgg

SEQ ID NO: 21752 - DNA, 2185 bp, Heterodera glycines
aaaaaacaataaaatttatgaatttaaattaaaatatattcttttataaaaatacccaagttttctctttcgactcagttcttatatttcctgagacattaaaaaaatttattgcctgtttttattgcttgaaataagagtaaaggcaagaaaattaaatcaaaaatgagaattataatgcataatttttaattttttgttcgaatttatagttggcggtcgataccgacagcttttttttaaaccaaaaacagatgctcaaagtacacggaacttttcgagaaccggtcccggtgccaggatctgaaaagctttcaattatcataccggcaccagtctcgaatcccgaaaaatcaaatttttatttattcaacccgaataaattcagtttttcatttctggatggattttcaattgccatcagccaagatggatggagaggatttgttaggccggcctcgacattgaatccgaaatctcttccccaaccccacctgctgctgcttctgctgttcagagtcagtcagtccattcattttcactgatcctcccccccccctttctcctccctcttcttcgtcctctattctgtggcagcatttgcagcttttcaccaccaaatcatccccaccattgtcggcggatgagcagggggggggggaaggcttgttaaaagctcttgaatgggcccgttttctgctgtatggactaaaattacacatcatccgctgttgctgttgatgctgctgcttatttgctctatgtccaatctttttttctccgatcactctctaacaaatgctttgtctctgatcacactttttatccctgctgatcaaacccattcattcatactcattttttgtctgttttccccacaccctcttcttgttctcgggggcgggaaaagagcaaaaaaattgacaacggcacagagagcacagtgaaatttctctgctgatcaacacactctcgttgatcactctctttctctgtgttcacccggtctgatcagcagcgatcattactctctctccctctctttctctgtgtgctctcccgggtctaatcaacagcagaagcataggccaacttcttgtttccgggcccatttatcttttttgatttgctgtatgtgccgccacagcagaagactctgcccccacaacagtgaagcgtaggcggatattttcgcctctgttgccttcctttgtttctctgtgctgctctctcaatttgccatactcttttcacaaagcccatcatctgtctggccactctctcagtttgccacagacacttcgctgattattaatgcccatccacccatctcttgtcctcccccaccccccatattcccatcaggcaaaatgctgctgcttgcttgcggataagtaatgaatgactcgacggacgtgcctctcatcgccccgccaattggcagtggaaactctaaaaacagcagcccacagggcataagctcccaaatccatgcccgctgctcctttctccgtaaatttaggctatctcctgagggatttgttaattagacacagcgacgacagtaatggttcttccatacccaattaagatgatagtaaataaattttcacaaaaacattttttatccgatgcgtacaattcttagattcttatcgaagtataaaaattttagtcttaaatcataagaaaatccaggaaaatttggcaatatcccttaatcttcccagttctaatcctgctggagattgtgtcggggtcgtccttaattgactttcttggacattgcttatcacatttttgcgtaaaagctacctatttacttttatgacgggtgtccgaatgccattcccttgtttcttatattttgacttcttaaaaaatatatttaaaactttaattgaatttaaattttaaaacaaaaatattttcgcatttttacccatggcactgtttttttccaattgtttattctttccttttcttccaaaatgtgaaaattgagatgccgagacggtggggcaactcgacgaaattgccttgtcctagcccattttcatcccttttgctttttgtgttcgttaattttaaatgaacacatttctctcacattgtgttcgttttgttggccccccccctccccccactctcagtagggccaatgtgtcatggccaatttttatgg

SEQ ID NO: 21753 - DNA, 1310 bp, Heterodera glycines
ggatttttaattttttaactattttttctgcggccttattttagacgagaaatgcacgaaaaacacaattttcgctcggaaatttttcgttttaacgccactattcatcactaggaatcactatttgtagcttcgccactaaaaaaaaacaattttgaaagttgtctactaaaataattttttgccactattttggcgtttcgtcattatttttgccactattttggcattttttggaaaatttcctaaaaaatgcaataaaaacgaaaaatacacccctaagaatcgacttaaaagattcaaaaaatacacccctaagaatcgaccaaaaaattttaaaaatacacccctaagaattggaaaattttctcaaaaattctttcccaaaattttttttcttgctcaatatttgctaagaaaatattggaaaggacatttgtaactgcaatcagtgaacaaaattgtttgccttaattttaaattaggtattttcaaattttaaaaaattacaccccctaaatttggaactttttcgccacttttttgtcactattttgccatttttttgtcactatttattaattattttggggttttttgccactaaaaatcccagccctactgatcatcaatttaaattttcggccaatttgtgatttttttttcaaaaattcggccgcgcagcgtccgaaaagcacatcaaaaattagaaacgggcgcgaagcgcccgtctgaggccgcgaagcagcctaaaaatcaccgaatttaaaaaacgggtgcgtagcgcccgtctgaggccgcgaagcggcctaaaaatcgctgataattttttaaaaattccaaatcttttcacaacccgatagctaatctaggtagcgaagctcccaaagcgcgaagcgctttatcccagctaaatagccgacggttcacgcacccgctagttttgatatacgttatattgacaaggagtttcgtttcaaaaactaatttgagcttaacggctaatgggacgggtctgaaagtagtggaagggtcttacaactttttgaggagaattcgggaaaactataggtttttttctccgagggccaactgagtaccggggactgatttgtcacttttgtttgcatttgaaggcccctaactttttttgtaaaactcgaatcaaaaagtgcccgctgtgagggcactccgccaaagtgtcctctaaatgctggtattttttaaatttttttttgagcaaacccctggcctgcaaaaaatggcaactgaagcgtgcacaaaaagtacacttcagtaccaggcgaata

SEQ ID NO: 21754 - DNA, 2010 bp, Heterodera glycines
aattaaagaacgggcgcgaagcgcccgtcctgaggcccttaaacggacgaatgttctcaaaaaattaaaagacgggcgcgaagcgcccgtcctgaggccgcgaagcggccgaatatcccccacaaaatttaaaaagagcgcgaagcgcccgtcctgaggccgcgaagcggccgaatatcccccaaaaaaattacaaaacgggcgcgaagcgcccgtctgaggccgcgaagcggccgaatgcacttgctcatcacttatcaaacgcgcatgcactagcaacgaagtcctttgcgcgaagcgctcatgtcagcgcccgcccatatataccaaaagtatactgcccacaacatcccccattgtgcaacacgctagttactatatacgttatattgacaaggagtttcgttgctaaaaccattttctcccggccgaaggccgggagcgccctgaaagtagtggaagggtcttacaactttttgaggagcatccgggaaaactatagagaaaaattcagcgcggccaactgagtcccagcggctgatttctcattttttcgagcatttgagggcccctaactttttttctaaaaccctgaccaaaaaattcccgctgtgagggcactccgcagaagtgtcctctataatccagtattttttattttttgatcagaccaaatcccggacctgtacagacacggagactcagttaatttttttttcccacttcagtaccaggcgaataactcattaggctttgagctgagcgcagggtggccagcagacttattgtagagctttaaaagcccgatttttccaaattttaaaatttcgaaaattttcaaaatttttcgagctaggcctaaaaaacggttttcgggtttttgaattttaggattttttaacgaattttcccagaaaaacgaagaccacttccaaaacatagtttttcgagctctatcgattggtaatttttttggaaaattttcgattttttcccggaaattgaaaaaaattttggcctgagcgggacatttgagtcccgggcctataactcgtcaggggttgattttagcgaaaaattgacttaggacatttttgtagagcattttaaatgctatcgaatggtgtactacatgtttggaaaatttcaaaaattttcgagctaggccccctagaaattttcaaaaattttttttgggttgaaaaagggtgtgaaaaatatttttctggggtaaaataaggtgctgagtacgaatatgatgtctattttaagtttcagaattttgggaattttttaaaaattctttattttttggcaattttttggccctcgggattttggcctaatatttgaaaattcataactaacctcagggtaagtcaattttcatacaacaaagctttaaaaatagagaaaaatcaggagaattttatgggatttatttaggttttctaacatcaatatgaaaaaagttattccagaaattctggaaattttagatttttcagaaaaaaattcgtaactgccttctgaaaagaaatttgagaaaagtaaaatactacaaaaatccacaatttttttctctataatataaattttattttaaatttttatcacatttttgcgaattgttataaaaataaaagtgattttgggattcgggtccaaaggggggagcacatgatttttgagttgagaaattttttcaccaaaaatcttccaaaaatatgtctttaggggttattagggccgctgatcacgaatacgtgatcagattttacttctgacatcgttaagccctcagaatccccgtgtgattggggattctgaggcatcattttgaggggggggaagttcgaatccgggcggtgtaacattatttttctgtgcatttttacgttatttttaatgattttaattaatttaaaatattttgttgagttaataaataaaaaattatatttaaattaatgtttttttgatgaataaattttataagtttaaattaat

SEQ ID NO: 21755 - DNA, 1905 bp, Heterodera glycines
  misc_feature (1763)..(1763): n is a, c, g, or t
  misc_feature (1875)..(1876): n is a, c, g, or t
ccccccccccccctctcttggcatcccatcgctttccgttcaaaccttttgcgacagtgtcactttgccgccgattccgttgtccgtccgtttagccgcgttcgcttcgtcccttttgagaagaacgcgccaagtctttttctgctgttctgagtcatcccctgtttggtcgtcgtcactttttcccctcatgcgcgactcgccagaaaaataaattacgcccggtaaagtgacacttgtgacgatggccatgccttcggtaaattttggaaaacgcattctgtatctaaaacgaagtcagcaaatctcgaatattttttcaaaaaagcccgttttaccaggcgacccggtccaaaattttagccgggcgcccgccggacagcggactttttgaaatttatggaacgaaattaaaaatcgcgaaataagggcaaaaataagtacgaaacgccaaaatatgttcaaaaacttattttaaggacgaacatgtaaaatatggatttttaagggagaaggtccaaaataagtacatacctatttctaaggtcgactaagtgcgataaaaagcaaaaatttcgaatgtgtttttcgtgcatttttcggagttaaagccgcagaaaaatgatgtttcattccttcgctattctccgttgtccttttctctccctctccctcgctgttcagtcattttcctctgtcttctttcgcctccactctttcccttcctccgtttgcctttcctttttctcttttctgttgacacaatcctttgccttctttcctttgctgccgcctgttttctttgttgctgttgccaacggcaaattctttctcccctttccctttctctccactcttttcccctcctctcttcctctcccctttcatcattcacggggttattatcattctctttcccttcctcttttccactcgtttttattaattttttgggccattttgattttatctattgctcaatttccaatgcatttgttttatatcgtacaatacaaacagcagaaaaggcgtcactgctcactatcattgccatcgacaaccgcactttgccagcacataacagccatcaaaaaattccattgccaattgaatgtattgacaaaattgaactgcattacacgcttatcattgtggttgaaggatcataataaattcataagctttcctaaatatcattattatttatacagttgtgggtttttgggtaggaaaagcagtttttcattttttacgagatttgttaaattaatgtgtaacacccccaaagtgtatgatgaccaagacgtacgttggagttcagtgagaatgagtgtgtggtggtgtctctgttcgttatggtctccgtccccatttatgtgcatcaaagaactcgcaagtttttgttcaaaaaaataccgaaatacaacaacgggaaaggaatcaaaatttcaaatttttctcacctaccgcgcgttatttgcgcaaaatacgaaattttcagccccaaatgaatggtcaacaccaaaaatggtcatggtatctctcatatggtagtgttcttctgtttggtgctcaccattggttgttggccttcaaatggtggatggacaccatttggatttgtacatttgggtggtcttgggctcaaaaatgcggacctgctggtaagggtcgtttcggacggaattggtggctattccgccgagaaacaccaattttcattgattgaaaagaagcactcgtctgctggtttctcttaattntcattcgcttttctcgtgtcatctccttagataatttaccatgaatggttttcattttcaatttctcgaattctctcccactctttctaaacgattttctctttaccaatgnncatttccctaaatttttagatttgatctg

SEQ ID NO: 21756 - DNA, 1497 bp, Heterodera glycines
tgagtccgtccttggttctcgatttgtagtcctttctgcggttgcgtggtgactccttttgttttcgtcgtcgttctcgtggttaccgtcgtttcgggagttcgtagagtagtcattactgtactggcactggtactcgtacgtactgtcgtcgttgctgccgaagtttgagtcgtaccacttgtttgcatccgcgcctttttgtaccattcccggatatgcgcaatggacatatccgccgctgttgtcggcaaagtgggcgtgatttgccccctcttgtcgaggctcatccgaggtaccgttggctccgtaattccaacgagttcctccattcgtagaggtcttccgaaaggatttacaggaatccatctatcgtttcgttccggccgaatgacttgtccgttgatcaccgttggttgcaacagtgtgatcaataacatgatcagcattatcatccctgttgaaaataattttgatattccaattggccgggaacatcttttcacgcaacggtttgtcaccaaaatggacgaaccagctcgagccttcttccacaaattccttggccaccagctcagcggcttcttggttactcacaaccaataccctcttgctttggagatgacagtccttccagtactccttggctctcagtttggtcaaggtctggccgaatctctccgtgagattcctgagccaattctcaaattgctcctctgcacttatcacattcgttttcattggcacatcctctagaccaactggtccatagatttttcctttccactcttgtccaaaaacttggcacgaattgtcccatgccgtcagcacacactcgagttgcttctgtggtatcgttttctcattgttttggagcactttcgtccaccaattcttcaatgaatcctcaatctcgcttccgcttcccagcaaggcgcaccaattttcattgaatttcttggcgtgcatacgtcctagccaatcaaatgcgaaggcttgggccaggcagaccgcctttgattcggcttgcgggattttggttagccggccgtgggacagacttcccatggtgcaattcctttgacaaccttcatgtctttttacaccaggctcacatcgcgtaaacagcgaataattgatggtacgtcggtagccgggacttgctggtgccagctttattctgccagggttctcttcagcttgttgcccttttttccttcttttcaactgttcgtccaacggatctctggctttgagtcgtcgctgggaccgcacgggctcctttgactgactctcgtcccgtgctcgcttgtcattccgaatttgcccttccatctccgaacttggggccagcaattcggttgtggcgccatttggttgccgtagcggagaaatgtcatgggcacgtggatgtcgatacttccgcccagtttggatctcattaaggtgccgtccacggtgccatttccgccttttgttgatcccttggtgcggggc

SEQ ID NO: 21757 - DNA, 2420 bp, Heterodera glycines
tttggaaaattttccggtttttgaggtcaaaaaggccctttaactgttgggggacgttctattagaggttttttggaactatgtcaaaatatgcacatataatatgcacgaaatgccaaaatatgcacaaatatgcaaatatgcatatggaaagtcatcctagaagcttcaaaacaagctaaaaacatgtttttcgtgcgtttcaggcctcccagagtccaggaaaaaaatatgcatgtgcatataattggactccctagtcatctgttaataaatcttagtaaaatttttaaaatttctcccccaaatttcacaattttttctctttacacaaaaataaggtggctggatatttcgacaatgaccgtttcgccaatgaccatttacgactatatcatatcgccaaaatttaaaatatcaaattaaatataataaaatgaatataaaaaataataaataaatttaaaaaaatttcaatgaaatttaaagagaaaaaggtagttatattttttaaatttaatgaatgcattatctatcgcctattgtgtatgattattaatagtgaagaaagaagacaaaatgagacggacctataatataaatccaaaatgaaaccatttatttaaattattgtagtgtcctctttttacccaggcggcaatcctgaagaatggttgtccctaatttttaatttttttttaaattttgtgctcaaaaccagtttttaggcgtttttgagggtgttgataacggatcttaactcgggtttgcccaattccgaactccggacccgaattcgaacaaaaaaaaattgagtttttttaatcaagaataattttttcagggtaaaagcttctaattcattatcaactatttaggtgtaaaacaatgtttcaatttttaattaaataaaaaataagcaatttgcgccgaaaattgacaaactaaagccattctcataatgctattttgaaaaaaacgaaaaaaaaacttttttatattgatcccaaatccgcaccgtccatataattttgcagaaatttgaattttatttaaaaaaatatatttaattttattgtcgaaacggcattgtcgaaaaggtattgtcgaaaaggtattgtcgaaaaggtattgtcgaaacggtcattgtcgaaatgtccgggagccaaaataaataaaacattttctttgttagattggcagggcgaggaatgaaaaaattgatttcacaattgctgagcatcagagaatttcgcgttatgcttgtcgaattgtggcggagcgcaatgcgccggccaatgtgtacatttatgcagctggatttgatcaggaaaacaatgtataatagaatatatgaaaaaaaattatataaaaaaagaaaaatttaaacaaaaaaaaatagaaaaactctataaaaatttaagtaaaaaaattcgagtgttaggtagagaccggaaatttcaaatttgcggatcctgttgcaggattggaattcaaaattttttacaggacaggatccggcaggattaatcctgcaaatcctgcaatcctgcaaatcctgcatttaaaatctgcaggatcctgcgcaggattgcggattttaggaaatttcaaaaaattctgtattaataaaaaatctttcaaagtataaaaaagtattcaaatatatttttaaaccaaaaaatgatgaagatgaaaaattaataacgtttttttgcttacactccaagcaatcgactgaatcttctttaatgcgtttaaaaagaccgatttgccaaattgggtggctcataataatagcttaaattaaagtaaaataatttttatttaaatttctttgcaaaaaagccataatccattatgtatagggatgggatttttaggcacaaaaaatcgcgaaataggcacttaaaaaggcagaaaaatcctaaaataggcaagaaaatagtaaaaaaaattttattaacgctttttaggtagcaaaacacataaaaaattcaattgtataaacttttttcgaataaggataagtttttaaacgaaaaatttttattaagaaaaaaatttttgaaaaaagaaagtttctgaatatttggcattctatttttaaaaattttcaaaaaatcaatgcaggatcctgctgaatcctgcataaaaatcagatttgcgggtcctgttgcaggattggaattcaaaattttttacaggaaaggatccggcaggattaatcctgcaaatcctgtaaatcctgtattttccaaaatatgcaggattgcggactgggatcatgcaaaatcctgcgcaggatcctgtcctgcgccggtctatagtgttaggtatttgagaaaatgacggcaaaaaatttttccataaaacagcaaaatttggacaaatgaaacatgaattgaaaatcattaaaa

SEQ ID NO: 21758 - DNA, 1923 bp, Heterodera glycines
tttcagctgacatcgggggggggggggggacttttggcgggaggaggggagaggcaatatttttggccataattacctgtagccagtttttaaagaccaaaattggacacgtaaatttaggattgtggggggggggggtcttttgcgccgtgaggtaattatgggggggggatgtgcaaagtgaggtcaattgttaagtacaaggaacgtgcaaaaaaataaagattttgggattttgggaggtgtgttttttgccgtgaggtaattatgggggggggcaaatgtgcaaagttaagtaaaatgaacatataaataaataaagatgattgaatgcctatagaaatgggagggagggcggctggatttaacaatgtggacatgataatggcacaattgtcgaggctgtcattgggtaatttgccttgccgtatgcatttatgccaaaaactggatacacggcaaggatattgccgtatataaggcgccccaaaaatctattcacacatcactccatccaagacaatcccaccctttccggtgcccctgctgaacattcgcatggcctacccctctctctctctttcccgtcataagccattaatttgtcctcatttaaatgttgaaataattatttcaaattttgattcattattaaaaaaataaattaaatttaaaatgtaggactcccctaacataaaatttttcaaatttccaccctaaactcaaacccccccccgtccaaccttcctctgttgcttctctctttctctctctatcctctctctctctcctctctctcccgtcgtaggcctattaccagacagcacaaaaaaggcattttttacttacagtaaaaaactttttttttttgaacgaaagccctaaccttccacttcaaaatgattattaatttcgtttctaggatattttttaaaatttgtaggcttattattagggcttgtaattatatggacataaaatcgcaaaatatggccataaaatatggacaacaaatcgcgaaatatggacataaaatagcaaaaatctcaaaatatggacataaatttttccaaattgatggtataatttgtcaatatttcttcaaatttgttaaatatatatgtagtaaaatcttcaaaatggttaaatatggtattaaaatcattttagatgaaaaaaacatgataaagctaaaaattaatcatttttagcgaaaaatcaacccaaaaagcgaaatttagttttttctgcttatttttgagaccaaaaataacaatttttaagaaaatttaaatttttccaatattctctggaaaaattttgtaaaactgattttttgaaaaattttccgttttttgaggtcaaaaaggcaaatttatctgttgggggccgttctgttagaggttttttggaaaaatgccaaaatatgggcataaaatatggacataaatgccaaaatatggaaaaatatggaaatatggacataaattgccaaatatggagaaatatggaaaatatggatatagaaatacgtcctagaggcttcaaactaagctaaaaacatgtttttcgtgcgtttcaggcctcccatagtccaggaaaaaaatatggatttccatataattacaggccctacttattatgataaggttgagaaaatttaactacccctttacaccaatggccataatgaattaatgtttagtgaaataacattaaacttggccagtttgtcaaattcaatatgttctttaagattaagcaaaaagagaaatttttaaaccaaaatcgtgagatttcagggcagacccttatggctaaatttcaggtgtccttggccaaacttaaattcacggaaaatttcaaaataaatctccttcctatttgtatggtctttagaccctaaaatttaataataatgca

SEQ ID NO: 21759 - DNA, 1974 bp, Heterodera glycines
  misc_feature (21)..(21): n is a, c, g, or t
  misc_feature (32)..(32): n is a, c, g, or t
caatttttgttcatttgtcgntcgtcccttgntcagttgcgctgcttccgctcgccatgttcgctctgttccatgccattgccttcctgcaaaggatggactccgagttgggctggcattcatccctgattctcaagttggcacagttcaaagcgcagcacaccgccaacattctgtccaccgttgcgtgtgccgaaatatttctgttccctcttctcgtcgccatgattttcacgtgcgttttaagtctcgaaaacttaatgattttttttaatttctaagtttaaaattaaaaaaaaacaatttcgggtggaaattaagtgctccaccccattggcacaccatcgggtccctaggtcgctgaaaaaacccacgaaaagcaacaacaaaaaaaccatttctttcaacttcatttatttttcatgttttttagtctccaatttcacgtcccataatctcttccttgaattattattggattttgcaggggaaaagccaacatcttcgctccgattgtttactatcaatttctggtattccgttggctgtccgtgcgcaacccgtacactcggtaaatcatccaataaaatggcgttttttgcgaaaaataattccattttttaaataatttaattattgctaattcccgcccccattttgctcatcagggcgatgttctctcagctgcgcctcgccgtgctgtctgttgctgaccacgcgcgttgtcccggcccaattcgtgcgctcgtccacaaggcggtcgcactggtcgaacgcctcggacaggcccatgtgcagcgtgtccagcagtgacatttgtgatgctgacgacacacattcattttcagtcgattgtccgctccgccgatgttctcacaaaaccccagcagttgtgacccctccaattttgatttgtctcccccaaaaaatccaaccattacttttttgatgctgctggaattgttacaaaaagtgtaatcatcagggagcggattttaggggcgaaaaattccaatttgggagccctaaatatgcgaaagattccaaaataatggcataatttttctatagtgtattctttttgaaaataaattaaaatagaatgcaaatattttgttcattgtttgccatttggggcggaaattcaaaatatggatttctagggtcaaataggggcattaaaacgagaaaattttgcgttaaaaatggtttttttttgtgattttctcattgaattaaagccgcagaaaatatttagaacccctaaaaatccgctccttaccccccccccccccctcagtgtttcccccacctttcttttcccttccctattttttcgattcgccagccaagcgaaatattgctgacctttctgttattgtgttttttacacattgttttgtttcattttattttgatacaatagctttagtgtgttgtttttcacaaatcatagaaaatggcagaccaatttgattcaatttttgattggggataattgtgccgtgtttttggtgttgtgcaacactggcacttttttaaacttcctctccaattctaaacttgccaagccctacagtttcgaaatgtgccgtccaattggtcacacatttcaatgggcagggtacgccgtttgaatgtgatgtcctgcaggaatgccctcctccatattagctgactgtctgtgtccctcccgtccatccccatccctcccttttggttagcatgggatggtcacttccattcaattcccaattccgttgcattatcaattctcccctccccccccccccctccaaaattcgtcagccaatgtttgtgtaaaatgagaggggagagagtgtgtggggtggtggcgctggggtctgttgagtcatctcctcgtcctcctccccgtcgtcggtcggtcggcgcttcgtccgtggccctctctccgctacgccttcggtgtgtttgctttaccgggggaggggg

SEQ ID NO: 21760 - DNA, 2377 bp, Heterodera glycines
tgacaataatatataatacgttgaattaaatgttttttaccaccctggaaaaaaagtgtgtacatgaaaataattttcatttcttattatttttccgataactaacaaaggaagtggcgttaaaatatttgaggtcattttgtgtttaaatatttaatatatagcaattttccatgataaatggaataattagataaataattaaaaaatgtgttaaatttttaaaatttaactaaatttatctattaaaaaaactttatatacagaagatgataatgatgtatatataattcagtctacatttaaatattaaataacataaatccgaagaaattaaaactccacacacatgtcgtaaagcaatgatgaatcttcctggtgtccgtcttgtcgtgatttaataataaaaaaaggccaaaaactaaatcaaattaatcattaattattattatgaaaaaagtctaatatacgggtatttgtggcgctgatcacgaatatgacctttattttccgaaattccgaacccgaattcgaacaaaaaaccgagattcacaaattacaaggaaaacatgtttttaggggttttcaaggtcgctgaaaagtgaagaaaaataatttctaattattaaattgctaatttgaattaaaaaaataaaaaatgtttaatggataaaattatctttaaaaatattgaaatatttttaaggtatgtataattcagcattgttttaattcagtttttagagagcaatttacaaataaataaatccaaaaattcgtgattgcaaaaaaacaggcaacctaaatcaaacacgcatattctatgaaaagaacaaataaaaataatttttaatatttaaaataattctaataatatttttctccacttcctgaagtagcaacaaagaaatataatagctatgatatctaaaaatttaagctaaggtctcaatagaagattagtataaatatacaatgtaaaatttaaattaatttgtcaataaaaaataaaacaataatcagtgaaaattatccgagtatgtatagatctgacttttcgttatttacccggtatactcactttataaatccgttgttttcattatgtaaatatattgtgtttaaattgtcatatattccgatactctaccaaattttccgcgaacaactctttaagtaaattattaaactaaaatagaaaaatatactaatataattattaataaataaaaaaaattttcacgacaaaaatcaaagaaaaaaaatattgtaagtttatcaaaaacaatgaaaaattctgcaaaatatttgtatcgtttatataattattatattattaataattaagtaaaagctcaaataaatcgtaaataaattttaattaaatctaaaattttgacggatcgggattccgcccgatcctccttcggataggggcactttttatcgccccttcggtggccttccctcccgcagtcggagcaggtaggcggcttttgtgccacctccttcgcttcggagtctatcagaatccgaagatccttcccctttctccgggtgctattgcttaccgcccgtaccgcgtccaccagatccagcggatttcctttgactcccctttgacaaaggagaatcttgtcatttgcgaaaatgatgcgtcggacaattctccctcagtggaggaagaggacgacttagtaattttattgaatacgcgggaagtgatttctcccttctccttttttgaatgagtaaacggacattccaaactgtccgcaattgccattacattttgcacgagaaatattgaaaaaataatgtaaatagtcggaatgctgctcaggcttcccgatccttcgttttgactcagaccaaaatccgagttttgactatttggtgtttcccgttgttcggtccaattctggtcagtggttaactgagtctgtcctcgagccactggtggctctgagaattcccggaggttccggtcccctccaggatccgtatcgtcctgtcgtaatggacggtttatttgttggggaatttcagtctccccctcaaaataacataaatccaccacttctgtggggaaataatccatgtgaatttcgccacggcggggactaaaccccccacattcttgtaccaatggtacaagaagattgatagttattccctgttcctcataatgtctgaggacggtgaatccagataaatgttcgttctttctgcgccactacgtgataatccatcgaagattatttcacggttagtggcgaggtggttggtggttaaaaatgcgctattcattaggaagtcccgaggagggcttcagcagatcgtctttctcttttgtgcccaatgatttccccatgac

SEQ ID NO: 21761 - DNA, 2091 bp, Heterodera glycines
attattgctcttttctaacatagcatccgaatgattattatttttctattttttattaatcttttccatcttttgtccgctgtcgatgagttggagcgtgtgttccgcgtgtccgagtcagtaccagaaggctacagtatcggcttcatccatggccaaccctcggaggacccaacaaaacagaattttttcatcgtatttcctccaagcattgatggcaaagacaatagagcggcagaaaaggtgggattaattgatcaaaaataatgaaaacaaattttagttggcaaattattttagatttcctcaattttcatagaaatttttttttataacggaaagtgaggtccattaagtgatataattaactggtaaccaaaatccgagattttgaactaaaaaaacattgagttttcttagttcgagactctcgaccagaggcccgtgccaggagagggctggaaattccctccttaatgaaaaatgaaaaccttttaagaatttgtatcaatttcctcaacatagaattttttaaattttcaaatattgaattagtcatttttgggtaaaattgcgcctatatttttgagaaattacaaaattacatcggacaaaaaatttgtttggggcgctgaagagaaaaaaaaagtaagttttcgaatttgaatgcggcggcgaattaaatgtttttttttgtgagaaacaaaaagttttcccatcaatcaatttggacaaggtctttttgtgacagcaacagccagcaagcagttcgttccttgttctgctccgacgttttttgttttatgcagaaaataataataatttgtacgctacaaaatgaccttgataatgggcaaagatggaaaattatccataaaattgggagaaggaatattgctatattaaatcgtagagctcatcgagctgtacaaaatgctggtacaggcacgcttagcttgggttggccatcgacagggtcgggggcgaggctgagggtcctccggcagatgtgcccgagccatgacgggctccaagtgaatggatcaagaaccggacccggcctgggagatagctcttgaaaaactgaacaaaaaattgttcttaaccgggccggtccggattccggatcaggcacttttggtgccccgaaagtggtgcgataggcttccggaaaatgaccaatcaatcactgagttttttttcgcatcgtctcagcacggttgtaatatattatatgtgccgtaacagattgaatttgtttgggtcaaaataattagaactgacgaatcggtcaactcattcattgatagaaaattgaaaaaagctgagctattccatggttctgtaaaatcgggattttcttagcaagaaaccgatttaaaactaggaaatccgattttgattatcttcacacttaacaatttgcgaaaatatgtaaaatgtgatttggataaaagagttatttaatttatattaatttaattttattaaaaatttttttattgttttttcagttactccatgttgacgaacgtactggggaaattgcacttgggcatggccaaaccctggattatgaacgtgaacatcagctttatgtgttggctgttcccgtggacgggtcgacccccgtttcactgatcattgaagtccaagacgaaaatgacaacatgccacaattccctgatcaaaattttcgggtaacaataatgtttgtcaatgccctcaaaaatttcggaaatcggcaattgaaatctcgaaggcccagaaatttcggcaatcggaattccaattccagaaattcggaaatcctcactctgaaatcggaattccgagcccaaaaatgttggaaagccccaatcgtaaaattgatattccgacacatccctgctggtgggaaaatgtaaattcttgccatgctgaacttgatggcgtggaaaggtccttttttcaaggacgctcatattaatagttctttgttcaagaaacttttttccaagcactaacaaatgaaataattgatataatggaatttattttttaattgattttgcatcaatttttcatggacatttcaaaaatttgatgtaa

SEQ ID NO: 21762 - DNA, 1704 bp, Heterodera glycines
  misc_feature (117)..(117): n is a, c, g, or t
gtaatgaacgcggaggagcccaaatgcaacgagacaaaattcgaccatttccatttggaaaatgaaaaaggagcaaataaaaaataaggcaacgtaaaagggaacaattaaaatatntaattaataatgaatgattaaggctgggatttttatgtttttacatcagtgatggcgagagaagcccaaaaatagcattttctccgaacaatttttgatttaaagcaacttttaaaacataaaaacgcatagttcggggtttgtcatgtattttacacatattttggcatttttgagcaaaatttgtaagaagaaaaaacaagaaaattgaaaaatataaccctaaaatcagctttcttgtcatttcttacagcatttctaaaatttatttgtttattctgaatgctgaaagtagccaaattgaattcttaattcatcattggattttgaagttccctgctgggaacttttaattataaaacaattttattagaaaaaacgaccaattttaaccccgaacacttcgaaaggtatttgatttgcaattgtgcggacgaaaatataaagaataagattttttggatttttatacataaatacactatattttaccaattttgagcacatattttggatttttagcacatattttattatatatttcaggggtttagcacataaaaatctcagccttaacgatgattgactatctttagaaattaatgtcaattgacacgcaaagtaagacgaaaaaaggagtcgaaattcctaacaatggaacgtatcacttcaatttcgaaaacccagcactgaacaaatgggaaattagcaatttagaagaaaaagtagcaaagaatgaatacaataaatttattaaattacttaaaaaaaataaaataataattattatttaaaaaaagtaggaaaaacagtcaagtaaagaaaatcaatttaaaaaagagataataataaaacaaaggcaatatgcgtgtactgtcatagtcaaaagtgtacggaaagtcatttaaataaattaatatcaatgtatcgcaggactgaaaatctgaaaaattcttaagagatgaaaattttttgagtgggcctatatgataagagcacaaaattcgctatgggttacgacttatacccggtgagataggggctgatcaataggatttgatcagtcctattttttagtattttgtagacgaaatggaagtacccacagatatggaaaagtcggacagactttcgtttatattgcaaattgtagaaaaatttgtgctctttcttataggcctattcattttttgtagaagtttacaactccctgttttttttgaccaaccaaaaataatttctttgtattcgtcaaaagtactaaacagccttattaacctgcaaaatttaaaaattttttgtcatgtgcaaaacaacaaaccatgtttttgaattcttttgggcataattttgaaattcgatattaatttggattagaacgaaaaaaaaatcttccggcggccttttgtcctgcgacctttttaaaatgaagcaaatggccgaacacttttgaccattaattaccgtattcaattttttctgtaggaaaagcaacaaaaaatgcatcggcaaaatgtgatacttcaaaacaaaggagcacaaacagaagcgaacaaagaaaaagtgcataattaaatgaaaaaacaa

SEQ ID NO: 21763 - DNA, 1934 bp, Heterodera glycines
tatttgatttattttctctatcgaagactttcgaccccatccgaacaggacaacattggccgaactgcttgaacggcaccagcaccccaatgcgggcaatgacactgcacatgagcaccactcggtgtgggtaacggaagatgtgctgggagctgtgccgacattataactggacagtggcggattggcgagaagcggacgacaagcttggcatcggtttcaccattgtgctcaaaaaagacatgattgggcaaacatttggcaaaatgaatgaacaattacagtagttctgggcgttgattaggcattggatactgtacattttctgcatacgtgcaataaggaatattataaacaaattttctcattattgttcttatgataaaattctttacgtgattaatttttcaagaaataattgctaaattttttaaaaatttaataatttttacaaatttttcctggtggcgtttgtcggcaccgccggaccccattttcaatattttaagaaaattccaccccaaaatagtcaaaaattgtaatttttgcgaaaaacagataccaattcaatgatgttcggtaataataatattattatttttagtgtatcgatttttatgactattaagctaccaatttttcgagttattatgtcatcaattttaattggtattgtctgccgttgaaatttttatgaatgaaaaatttcaaaaaaaacaaatgcattaaattaatccctgagccgttaataaatgacaaaatgtgattttccctgaggcatattcagaaatgatcattgatcaaccacaaaatatgtaccacccaataattttgctcatttgatccttcttcattcattgtctccgctccgttctttagtgaacaccagcgacggcgataacaggggcggcaacaatgggctgcgcgacattttcacgcagttgttgcggagtgttgatctgctgatgatgttgagtgttaaaaattttgttaaaatttacaattcttcacacgacgtctaccggctgttcaagcagttgttgctgctgacgttgctgtgcttgttgctcgtctttctgcaactcctctgatgcatctgcgaatccgccgccgtggccaagacgtgcgcgacgctcggcctggcgcaccttggcctccaggattgcttggttggcacgcgcttctgcctccagtttggcttggcggacacggttctccacgttgcgcactcgcatctccgcttctaactttgcctggcgctcgcgtgcctgtgaattttttgttttggataggacagttaatctgatcagtgatcagcgatcagcatccaggctttacggagtaaaaattctttttaattcccttttaaattttccaaatttaaaaattcccttacctggatttcgactaaacgcgcttgtctctccgcctcgagtttggcaacacgtgcacgctccttaatgcgcagctcttcaagacgagcacgctccagcgcaaggctgggctcctgttgcttgttttcctgctgctcaaactgttggatttcgtgttgctccttctgctggtgttgttgctctccttggaaagtcctcatgctgtcctgctccattttttgttgttgctctccttggaaagtcctcatgctgtcttgctccagtttttgttgttgctctccttggaaagtcctgctgttgccctgctccaacttctgtttctgctgctgttgttgctctccttggaaagtcctcatgctgtcttgctccagtttttgttgttgctctccttggaaagtcctgctgttgccctgctccaacttctgtttctgctgctgttgttgctctccttggaaagtcctcgcattgtcctgctccaccttctgttgttgcaaatccctcaaagtgactcggctgtcctgcccccaacttcttttgttg

SEQ ID NO: 21764 - DNA, 1794 bp, Heterodera glycines
  misc_feature (1761)..(1761): n is a, c, g, or t
attttaggattaatcggggagggcgttgagctccccacgggattctggacatgaataagattaaagaacaggataaaccccttattgttaatacttgacgatttaatgcttaatatgcagaatactttcctcgatctactctttaccaggggctcccataattggaacgtaagcgtaatttttgtaacccagagtctctatggtcgggacatcaaaacggcaagagcgaacgcccattatctggttttaatgcgtaacccttccggacaattacaagtgaggacactggggtcacaactgttcccaaaaagactgaattatttcatggatgcatatcatgatgcgaccaataatcaatttagttatctcatgattaacatgcacccaaattctgaggaggaattcagattatgtagcaaaatttttccagatgagactctggaaatttatttaccaattgaatagtatataagaatatgaatttaaattaaattaaaaatgtataaatttagctccgaagtgaaggagaatacagcgttcctaaagaagcttgcctccaccagatcagaacaaaagaagaacgaattaatcgaaaacgctacagctgaccaaattttggcaatcgttgaaatttgtgcaaatatattgagttttagttttaaactcacgaccaaacaaaaaagaagattggcacaatacgctgatttctatagagaaattgctaaatctcgttcagaaaaaacggcaagaaaaaggatacagcaggggagtggtatagccctgggagctgtcttggtcccggtactaagtgttttagctcaacatttattagaaaaaataacatcatgaaatttgcaaagaaaatgttaataattcccgaggccgaatatttggctctgcggagtgcgatgaatagtggtgattatctccaaaatgaaaaagcgagtttagacgcaaaaatttctcagaatttacaagatcctggcataagcgaggacctcaaggcgaagagacacgattggctctataaagaaagacgtacggtaaaggggatacttgaaaatagaccacagaaggtagtgattgagaatcatgtacctggtccgaacgttgcaccatatctgggcctcaataaccaatccaaaccacaggagaccgatgaaccccggaaaataattattcctaggaaaagacttaaagagcaaactcctgatcttgaatcagataatgatacacttgaggagttaagtccggaaccccaaacaacatccacattaaaaacacccattccgatcaaaactattatacacccgacccttttaaacggtctttttaggtatgtaaaagaaaacaaagatttatttaaaattacggcggctggaaaggtacagtcgaacatgaatttgccgattgaaaacagtaattatagagatgttttgttgtatctcgcggggaagaaagatgaaacaccccggggtgcaaaatttcttaaagatcggttactgaaggatccaacagtaaaagacatggttgataaatcaaaggtaatgtggggacgtggaaggaaaaaggcaataaaatctataaaaacacccggcatagcacgagagaagaaacccttcaaaccactaatatgggcaagactgtagagaaaattttatcaaaaatttattttaatttaaaatctccggcaagttttgcggggattcaaaaaattttaaatgaggccaaaaagattgacccggaaattacgaccgatgnacgttaataattttctcgaaaaacagagaacat

SEQ ID NO: 21765 - DNA, 2208 bp, Heterodera glycines
tctattaatcccgcagtctccaattatcccccagtctaagaggtgttttgaaaaataatccctctatcataatcccccagtctctaattatccccccttttctgaggaggttgaaaaataatcccccatgggctataattagagcatatacggtatttttcaattttttgtcttatttatgtaaataaaacaaacgtttaaaatactgattttcttatcaatgcgaagaaaaaacattacaattagcttaagagcttgcaaattttaaaagatttgtctcgtacaatttttaaaaaatatatatgtattttttgtaaaaaataaaaatacatataaaaatttattcgagtcaccttaaaaatttatttttcaaaatggtacatagtaatgaagtaaagtttaaaattgcctctcacatacataggatatcaaatgcttatcgacagacagtctcttctgtcttattaagccgttctcttgtgcaaaactgaagtttcgctctcatcccccttcacaatggcaatcgcatggctcagaatcggctcaatcacttcaaatccctctctcactgcttttgggcttcccggcaaattgataatcagacaattggcagcaattccttcatgaaaatgatatttctatggcaatatttcctacaatttgagtccacccgcggtgagacgggtgagagcagcgaatggcgtaatgtcaagccctttcttcagaagtgccacagcgattctacatgcataaactttggttgcccccggcattgcttttaacactttaccctgggcattccctctcaatgacttctttggtcgcttcgggcgtcacatccctttttgagaaccttaattaattgttgctaaatttaatccggctaaaactaatccaattagtccattcaattaattaattagttattgtaccctgttccaccgctggtcaaaatgcagtcaactttggtggaatattcacgtagatattcaacgattttgcttttctcgtccggcactattgtgtaatttgcaacggtcactttttgccctcttctgattaaaagcgaattctgcagaagttcgaccaacaaaggaccacttttgtccattttgtggtccttgtcagacgaatcactcacaacgagaacagcaaaatccattgatatttaaataaaaatatgaaaaacgatgattgataatgtgataaattcaataaaaaaacgaaagataaaaagacaaataaataaataatggttttgttattatttacaaaatttaaatttcattttaagcactccatccgtttatttccttctcacccatttaatctcaaaaactgaattaatccaattttgtcatggatccgtccgccgtttcttcttcgtccagcaccgatcagcaacaaaatgcggaagaggcgcaaaagggcgatttgacattggcacagcaaattgcggaggacaaacagaaaatgtttgaacgctcccagcagtaccaacaggaaattgaggacgaagtaaaaaattgggaggagaaaaacgaattgggaagcttttatgggttttttctggacagaaagaaacttagtcagcaaatttaaatcactttccttttcctttcagattcgcaagactcagccgttggtttcgtccaagcaaaacgtcagttttatccttaaaatttcactcgtttgtttaggggtgtattttatacgaatatttcgatttcaccactaaatggcaatgtttgttgtcctttcattttctttgctttttctccctccgccctttcccgtggcttctccaattaactgttttcattaatattcagattgtccatttggttggcgaatttgatgagaagacgagctctcagtacttcaaaaaggcgacggtatcacaaaaaagccaacatttttcttattattctctgttttcttttaggagcttgccggcgtttactcggacattcggcgaatccgtggcgatggcaattgcttttaccgcgctgtactcaccgcccaactcgagcgctgttttgaggacgccgaggagctgaaaaggttggaaatggcagacaacagcagcagaacatcactggttctgttcaaaaagcacttattctgatagaaaatcttaggcattgggccggagaatggcgaaaaagccattttttgatagttttttaaaagtaaatgattaaatta

SEQ ID NO: 21766 - DNA, 2010 bp, Heterodera glycines
  misc_feature (1847)..(1847): n is a, c, g, or t
  misc_feature (1862)..(1863): n is a, c, g, or t
  misc_feature (1866)..(1867): n is a, c, g, or t
  misc_feature (1880)..(1881): n is a, c, g, or t
  misc_feature (1893)..(1893): n is a, c, g, or t
  misc_feature (1984)..(1984): n is a, c, g, or t
  misc_feature (1993)..(1993): n is a, c, g, or t
ggacatatggagggttttaaaataacacaaaaagatttttctgcaattaaactttttgagatttttacacttcattatcgaaaagttatgttactcagtaaatattttttttcagttttgcttaattttaataatgtaatacttagtcgatcatttaatccccctaaataatttgaataagtaattctaaaaatttttcaatgaaaacaataaaaaaaaatacaaaaaataaataccatagcggcatctgcacgaaatgccgaagcaccagcgacaccctctaaaataaaaaaatttcaaaaataaaaaaaacatttaattaccctgaagccatcgcatcatttcgtccaaaaaatagtcactgttcgcatcacatcgtacataagagcctgctgtgcttggacaagcctgtaaaatttttttaaaaaataacaaaaattaaatggttttgcctgatttgccggttgtccaaagaaagcggattgcataattgtgccatccgcgttcaaatttgtgccaacaccacggccaaacaaactttggcgcatcatcagacgaaagaaaacgccggcacgaaggccaggaattgcgtcctgagtgatctgaacgggggccaaaaaaggatacaatttagataccagcactcgattttttggttttattcaaattttaatcgacaaaaaacgatcgagaaaattcaagtttttcggttttttgatttattttgtcaaccgaaccactttttgctttctaaaaaattcaatagtgttttaatgttgcttgactcatcattaagggaagcctcttgattggtgcctaattaccctgataatggctctaatttaaagcattaggttcaatacttaattaattattgccctaatttgtgacctgctgtttgcataaatatggagcaatcattgctgggtcttgtacccgtggccaatccgtgctgtccgggccaacattgatggttgggccttggtccaacacagtggcaaagcccaaatatccattcacagaaatctgagcattatttatatctttatattttaataattttaaaaaattaaaaaatatattttacactaaaataatttaaatttttactgatttttttcttataaataaatatttatttaaataaagaaaataaaattataatatctttgcttaaaatataaaaattagaaaaaattatttatttgaattacgaactaaaataaaaatttacgattatgttaaaagaaatttttataaataaacatatttgaacttttgaaaaataaatttcaaaattaaatgtttagagcattaatataaaaaaatgcaaaaaataaaattaatatttgcttaaaaataaacatgaaattaggtaattacaaaaataaattatataataataatcttattcttactgttgtgtagttgtaaaggcccccgtaaaatgggaagaacagatgaaggtcaatggtctgaccggacgtcaggaaccctggtgacacttcaaggtcgccattttcgggtccaaaaggcaccaaatttactacaaaatgtatttttcaaattaattattgtcaatgaaaccattatattttaatttttggtatcattcaaaagcctaatattttctatttgtctacaaaattaaaaaaaattttcagaaaacttatgtcaataatatttctatctaatagaaaatacttagagctacgaaagatatcaagtattaaaaatttggttattcttaagaaaaatagaataatttttcgtcaaaaatttcctttttggtgttttttcagtaacgactaggcaccaataatcagccattttcagaataaattcancaaattaactaagannaannttgatatgataanntacagtaaattntttacttttattttagatatttcctgaatatttttttcacagtcaatttttcatttattattgaaaaataaatgataaataccatagtccnatcattggncaaaaacactgacagta

SEQ ID NO: 21767 - DNA, 1742 bp, Heterodera glycines
  misc_feature (57)..(57): n is a, c, g, or t
  misc_feature (73)..(73): n is a, c, g, or t
  misc_feature (83)..(84): n is a, c, g, or t
agaccgagagtgattagacaaggtgtggtcaatgcttatgctgctggatcacatgangaatgcacaagaaaanccaaacttgnnccctagagtgttagatgtgaattttgtgatgccttgcattttgtagaagagaaagtcaatggtcgcggcaattcttttaaggattgttgccactatggcaaagtttttgttcctgagattcctgagcaggattttcctgaggaattaagggatttgtttatgaaatttgatgcgagacatttgaatttttttaagaacattcgacatttgaatagttctgtatcatttgtttctatgaacccgcttaggtatagatatccgtgtaatcgagggccgtattgcttccgcatttacggtcagatttatcatcgaatgaatttggctttgaaccctgaaaatggcgatgaacctgcttacgggcagattttcatcgttgatgctgaacaagcgatgagatcaatgaggcaaggcaatgtcgatgttgaccctcaattgctgataacagtgtatgaagtgatcagaaatatgaatgtttttgctgaagcatatatgatgatgaaagatgaggaagaagaagaagctgagagagcaagaaatgagatgcgagagccgaccgagatcaaacttttgtttgataccggaagacaattggacagacgtttggggtacaatgtacccagagcgaatgaagttgcagctgtttatgttcctggggcagatggtgaagtacctaatgccaagattgtgattagggaacgtggaaaggaattgaagattttgaagagtacagattcaatggtgactccaatgacttacccgttgttttatccgcgtggtacgcttggttggaaccctgaaatgaagcatagaaatagtaacagaagagtaacgaggttgcagtatgtatgctatacattagcaattagagaaagagagtttaacccgattttatacggtggaaagctctttcaacagtattgtgttgacgaatatgttaagattgaaggagatcgaatgaattggataaagtgtaatcagaaaaagattttggctgatgcatataagaatgttgataatatgttaatgagaagagcacaagaaagaggtttgccactgggaaggaaggtcattcttcctccaagtatgacaaatagtccgagatatgttgagaagcattttcaagatgcgatggccgttgttagacggtttggtaaaccagatatgtttttgactatgacatgtaatccgcaatgggaagagatttcagagaatttgtttcatgaacaaaagtcaagtgatagaccagatttggttgtaagagtttttaacttaaaagttaaagctattatgaatgagatagtcaagaaaaaggtttttggcgaagtgattgcatggatgtatccggtagagaaccaaggacggggactaccgcacatccatttgcttttgacattggcggagcaagacaaattgattaatggtgaagatgttgaaaagaagggaattagtgcgagaataccggataaagaacatgaatatggtttgtttgatttggtgaaaaggtttatgatccatggcccatgtggtaatttgaacccaaattgcccatgcatggaagagtttgttgacaagaatggtattaaaggaaggaaatgctctaagggatatcctaaagcatttcaagaagagacagttgttctgaaaatggttggctttgt

SEQ ID NO: 21768 - DNA, 1663 bp, Heterodera glycines
aaaaaaatagttttcgaaaatgaaaacgaaccttaaatttttatttttcacgaaaacgaaacacgaaacgaaaattaaaattttaaaactcgaaaacgaaacgaaaattttttcttggacgaaaacgaaacacgaaaacgaaaaaataaccgttttcgtacgaaacgaaacgaaaaacacgaaaattttttgtatttatttaatccataataaaaacatttaaatttttaaattgtgtcttcaaactaagggaatgaagatcctagtagttggaaaggctgatatggctctaataagttaatttctaattcagaaacccgaattcgaacaaaaaaaaattttaaaatttgaattttgccacagaaaattattattatttggttttttaaaattttattttgaaagtttttagagggttggtgtccggctgtgcacataggagaggccggaaaaaattgaaattaattaaatacagggctcccaacagaaaaatttgaaaaatgagcatttagctaacaaaaaacttgcatttaaaaaatgattttgagcctattttttgacaaaaataaggaaaattttaatttttgacctttttacatttttcactgaaaattggcaattttaatggcagacttagaaaattttgaaattttcaatgaattttaaagaaaaatgtggcatgtaacatacgagatgacttattttttccaaaaaaagtcattcttaagggtgtaaatattttcgtctttttcgtccaaattccgtttgacgaaaacgaaaacgaaacgaaaatttaaaatttttaaatacgaaaacgaaacgaaacgaaaattttttgacggacgaaaacgaaaacacgaaaacgaaactcaaaaagtgacgaaaaaagggaacgacacgaaaacgacacgaaatttcgcacacccctgctccccctccgtttccgcgctgccagggaagggcggaggaggagatgctttttgtacacactttttgctgattaagatacgatggaaaaatgggcggagcgcggggggatggagagcggagacagagtttgggagaagcaacggtcgagagtaaaattaagaaaatccaatatgtgaaagcaaagtaaggaaccgatgaaattaatgaagcaatgaagaaaaaaaaaggatccgaaaagtgctttttgatgatgaaatttatttaaatctcaaagagaagcgaatgctgtatgaaaatgttaagcaaaaaaccgatgaatcaatttcacctattaaaagcggaaataagccgcagaaattgacatcatttggagaggtggcgacgaacttcctcctgaaggaagaagattaaattacgggtggaaaaatgaagaaacggaataatgaataagaaaaaagaaaagaatttaaaacaataataaaaagctaaggcctattacataacaaccgcctgctgaccccaaccaatttattgatttttttcaaatataaaacaaaaagttaaaattagttggataaaatcattaattgtttttatttcaaagctctccattgttggagtggagcaatgaacaacagtggcctagaaaaaccagcagcagcatttgccatcaaagagtgcaaaacaactgacaaaatttgtacatttggaaaatgtgcggctggtactaaat

SEQ ID NO: 21769 - DNA, 1525 bp, Heterodera glycines
  misc_feature (17)..(17): n is a, c, g, or t
  misc_feature (84)..(84): n is a, c, g, or t
aaaatgaatttttattnttaaaacctacttttaaaaattatgataaaatataaaattaaaataccggctgttaatgcaaaaaanttgcggcttttttcttgtgttttaatttgtgaaaacacaatttcagaacggagttctgatttttttgaaaatcgaaagtttccagaattctggaaaatttttcatctttaatttataaaaactagagtccggtaaaaaattttttccgggaacgggaaaacgaaaaacaacggggcgggattcccgtgttttcccgcgggaatctcgttcccgccggactctaataaaaaccaaataaaaaattttattcttcctgtaccaagggtacccgcattagcaagatgccaataaggatattatccatgcaaattttctaattttatttttgttcgagttcgggtcagcggttcgaaattgggaaaaatgggtgctgtattcgtgatcagcgaccctaaaaaccccttaaaacttattttataaaacacatttataggcatttaaaaatgttcttcagacgcttcttccgactcgataaatacgcgaatggccgaccattcgttggtttatccatgcaaataacttttcttatttctcttttcgtgcatttagtatttgattggggcaataaatgcaagttttgatgaacaatgatattttcgactttttgttcgaatttggagttcggggttcggaattggcgagaaagggtgtcatattcgtgatcaatagggagtccaattatatggaaatccgtatttttttcctggactgtgggaggcctgaaacatacaaaaaacatgtttttagcttggtttgaagcttctaggaaggatttataaatccatatttttccgtatttcgcgatttatgtcaatatttccatatttgtcctttccaaaaaacctctaataaaacggtctccatcagctaaatttggattttgacccttaaagacagggaaattttccaaaaagtcattttttaacgaaattttgtcgagaatattgattaaatttatttattttttaattggtaagtttatgtcaaaaataagcaaaaaagccaaaatttcgctttttgggttgatttttcgctaaaaaagagtaaattttagttgtatcatgttttttttcttctaaaatggttttaataccacatttagccattttttgtaagttttacaatattttagcaaattttgaaaaatttatttccatattttgcgattttggtccatattttatggccatatttcgcgattttatatccatatttttggactccctaattgatgacatggaaaatgtactcattcatataaatgtatttattccgcaatgataataaatgaccataaaacatgcataaacagggcaaacatattacaattataaaaaatacacatatatatggcatatttaaatagaacaacaaccatttgtgggagaattacattcagcaaaacaatgccacagggatatggacatacatatatacatac

SEQ ID NO: 21770 - DNA, 1476 bp, Heterodera glycines
aaaaatcacaaatttttaatgaaaatctgctaaaaatggctcaaaatcacaaaatttggtcattttttggacaaaatctgttaacaaaccgcatttaaaaccgcaaaaaatttcccggcggcgcctatcggcaccgccggaccccctgtcccccaaaaattttttttggaaaaaccgcgccacataaaaaacgggtgtgaaaagcaaaaaaaaaaaaaaaggtcgtcgcccgggggaggtgccccccccaagccaaaatcctgggaccgtccctggggaaaagtcaccgggggggagggtttctctgacaaggggccaacttagtccaaaatatcgcccgctgttttcagttgcgtgtgacccgggcggagccactcgttttggaagcggagatcgaacttggctctaaacaccttaacgaaggcggcacaatgcatggcggattcgtcgccacactcgtggacatcggtaaacaaaaattaactttgttttaaaaaattacataaacggttctaatgaactcagtgtcatgctgtgccgttgaattgactgcgccgaacagttcgttgacgtcactgttcgtctcgataaggtgaatgttttcgtgttcgcccgtttaaacggattttgttaaaaatcgtcgattgtaaattaattaatttccaccgcccaattttgcaattgggacattaactaatgattccgtcccgatttaagttatttgctgcccgcaaaaattggagagagaatcgtcatcaaatcggagtgtctgaaggtcggacgaagcatcacattcacagagacaacgatcagtcggaagagagacggcgccgttcttgccaagggcaagcataacatttccatggcacgaaattcggacggaacccatcaaagggggaaagaggggaacaattaatcaatccgtcatcaaatgtgtgaaaattcaccttttgtattgtatattggaagatgccgcaaaacagactaccatttcattatattgtaccatttgagcgagaaaagacacacaaacaaacaatctttgcataatataaatttgcgtttttggtggagaggcataaacaaaggaggaactgattgtgaggaactgttcaagcagtagctataatggtgcagaggaaaatgtgggaaatgttgtgtgacaaacaaacggacaaataaaataacattaggaaaaagccggtaagaatcgaataaaaatgtcgaatgaagtagggagtgacgtgccgcaaccattgatcaattcatcaccatcatcattcacttatccaccaatccgaatcgtagcacattagcatatcatcatcattcatcactgcatcatccggctaatgctctccaactcgtcaacatcggcgaaagggtcggccgactgttggtgctgtgacgccgcgggtgacgacaattgtcgctgcttctgctgcggctctccgcctagcgccgaaaagcgagaga

SEQ ID NO: 21771 - DNA, 1646 bp, Heterodera glycines
aaaggtagccgaatcaaattttggaaattccatgactttttctgattcttcaaaatgcttaacaattgtttatgttagaaaaattttgaagagatcaaaagatgcccaattggcaggcaaaaagataaaaataattttggaaaatagtcactttataatttttttctttttttataaagaaatagtatgtaaaatgaaagatacttttttatctgcgctctctaatcatgtccagcagacatttgcgcctatgaacccgatttggtcaaaggcgcaattgtctggggcgcaaatgttgggttatttattgaacatttctcatttttcgagtcagtcagtgtatggacgcgtaaaaatcaatgcattgctaatggacggctcggattatatcacgattgttccacacagggctcccaactgaaaattttcaaaatcagcatttggccaacaaaaaatcataaaatcaccattttggataattttaatccaaatgaagaaaaaccaataaaaacgttcgttttttgcggtgcgctttttccagaaaacttttttgggcgggggtgccggcggtgccggtaggcgcagccgggaaaaatttttgaaaagttgagtgaaagtagatatgtatcagatttttatcaaaaatgaacggtttttgccatttttagccaattgtataagaaaaaagtttttgagcccgacggtgccgataggcaccgcagggaaaaaattggaaattttgacaatttttaaagattttttccaaaaagcaacataaatcagcaaaactgaaattttcgctttgaacttataagaatattaaaaatggagaaactaattatttataaacaacctaagcaataaaatttctaagaataaaaaattacacaatagaaaaatcaacgtatcgccataaatttgaaaatttgggagttttttgtagcatttttacataaaactggccatttttaaggtattttcccaaaaatcaccataaatcaccccgggaaaattttgttaacagattttgtccaaaaaattacaaaattttgcgattttgagcaaattttgcaagaaaaatagggatttttagggtccggcggtgccgataggcgccgccgggaaatttttaaaaatttcagttcaatttattaacagaaattgtacaaaacttgctagttttttgaaaaaaaaaattaaaaaaatttccgacttttcatcaaaaatttcggaagtcggaattccgaccccaaaaatgtgaaaccggaagtctttccgtgccatacctggtgcctatcgacatctgcgagaaattttatgaaatttaatgcgatttggtaacagattttgtctaaaattgaccaaatgacgcagtttttgactcaatttctacaggattattaagaaaagcctatccggcggtgccgataggcgccgccgggaaaatttcacaaattttgaatgaaatttgcgatgaaaaatgagttaactttaattaaatttattatttaatttatttaaaaatatttggcattctgtcttagaaaaattttcaaaaaaatcaataaaatcccgcataatcccgcacaaaaaatcaaatttgcggatcccgctgcgggattggaactcaaaattctttgcgggac

SEQ ID NO: 21772 - DNA, 1046 bp, Heterodera glycines
  misc_feature (978)..(978): n is a, c, g, or t
aatgtcccttatattattatacaaatcgaaagaccaaattctttcgggccataactttaaaaaaatcggtccatttttttaagcattgacattatccaaaacagagccattaaaaacaaaattgattcagccaatataaaaaatatttatataaaaaaattcatattctacttgcatatagtcctcaaatactaccataattaacaaattgaaggtttaaaaaaaaagtcatatcccgaaaaatttagctcagaatcctatgaaactgcccttcccccagcgacagtcctagagttttgatttttttttgtgtttttaggtgattcggtgggacaaaaagttttaatttttttttcaattttctcaaaaaactaccttttatttttaccattttcagaaaactccatcgtccgccagcgatggcactgacccgacggagttggacccggagaagacactacggttcctgctacagtactccaccaacatcaaaccgcgaccgtagccacaccgtatgccccttctgttactgctgtgctaatgatgatgatgattatggatgaaaatgaagcttacttgccagaaaaatatttaatttctttttttaataatttatggaaaataaacgcgtagtttaaattttaaatggaaaaaatacaatttgaatgattcaattagttgcgcaattaaaccagccgagagcccaccgaaaacttttcgaaataagcaaattgctggtcaaaaaaaggcgattataaaccctaaattttcattttttggataaaaataaatattgtaagaatgtttttcatcaagtttcaataaccttatcattttgagcgatttggacagaattattacgagattttgaccaaaaatggattctttgaggcgtttataaaaaataatttaaaagatcgctaatccgactgtgccgggaaactttatgggttttttccattttattaccacttggcngaatttaagaaaagctcatgtttcagaatttatgaaaccaccaagcatatatatatatatatatttat

SEQ ID NO: 21773 - DNA, 1017 bp, Heterodera glycines
ctgtgccgggaaaactttatgggttttttccattttatttccacttgccggaatttaggaaaagctccatgtttcagaatttatgaaaccaccaaagcatatatatatatatatatttatataacaattaaaatcacattgaaaatttatacatcaataaaaagaataaacagatttacaaaaataacaacaaactgcaaaatataaaataaataaatataatatgatacattattattagggctgccaattttatgtaaatacatatttttcctggattctccatgctctaattggtaggaaaaacatagaagaattcgtgaacaaattcaatttggacattgatcaatttttaatcgttgagaaaaagacaattgttttttttattgtttcaatatgctggaatttgctaatagtttcttcgttttaaaacattggaaaataaagtttaaatgctttattccatttttttgattattaaactttgatcatttttttctttctatttctattttaatataagagatttgaaaatttgaattttcaaagtttctttcgaacttcgtctttttgatgaattttttctctttttaatcctacttgaaaatatatttcctggtgtttttcagggttgcttaacacgaatatgatattctttttttgtaacaaaagaaaaatatttttaaaaaatccgaaaaataaccaacttgaaagcattccaaagttaaatatatcaaaaatatttgaaatttcatcgactcgacctcgattttcgcctttgacccaaaaacgaatcggtgtaataaaaatgaatcggatcaaaaacgaatcgttacaaaacgaatccacgaaaaacgaattgggggtcgttaatgcgattggtcatttgctccggcaacaggtgggcgggtggacggtgtcgaggtcattggcatggcataattagtattaattagtttataatggaaattcattcatacactcactttacgattgcaaatattgtataagtgtaaa

SEQ ID NO: 21774 - DNA, 2212 bp, Heterodera glycines
ttgtcattatttttcttcctttgtttgtcatttttgccttacaatttcttcgtcgtccatcctatgtccatgtccaagtctatgtccatctccaagtccaagtccatgtccatctccaagtccaagtccatctccaagtccaagtccatgtccatgttcatttccctcttcctcctccccctcctcttcctcctcattgatgttgttgttgtttccgcttctcatccgtgctaatggtgttgcacagcaatacgttttcatgtagcttaatgtgcacctgaaaaaattaattattaattttcattataaaattttaaaaaaaaataataatttaatcttttcattaaaaaaaatatttttattaaattcaaaacaattgaaatttgagtcatattctttgtacggaagagcaaaaaagtgacacccacgaactcttgtccatggcctaattagatatacatatataccttttaaataattaaatttgtgagtaaagcgaataaaatcacacatataaataaattatctttttaaatttgtgtcaccttttcgagcagcactccgttgcaattccactctttttggtggtgccaaaaactgaaaaatatgtaaaattgcaaaaaattaaccacaaattatactaataaacgcaacgccaaataaagtttaatggccagataagcgcctgagatttcagtgccaaggcatatataaatgccaagaaatgttagtgccaaggcatatgcaaatgccagaaattgccgatgcagttctaattcaggtgaggggggggggctctaattcaaaaaatacggtgccagaaatttcagtgctaaagcatatatacttgctaaatcagtgccacctacagtattcgtggctaaataggtactgaaaagcacgatagccaaacccttacttttgtaggggtaactgccgcgctttgcccatctcagcccttcttgatcagtcggcgaggatttcaaatgctcttccgcttctgcttcttctccgtcccgtgcccaatcagtcggcaccgatggcaccaccaaatgatgccttagcattgcttcccattgtcgtcccacaaatttctcgtcatttcgcccattgggggccatcacaatttgggcaaagtccacaggcagtgaggaggatgaggaggaccctttgggagaccaattaattaatgagacatataaaacttttgcccaaattggccaacaatttggtctaccccctgactgatcagtaatcaaattcatttggtagcttgatcaggagactaacatctgatcgaagaaaaaatattttatattttctaaaaagataatgaaaaaagaaaaaccgagtgattctagccaaaattgcccgatcacgatcaccagtgattcgggattttcacctggaccggatttcaggattaaagccacaatctttccggacctgtccgggtgcatttccaaaattacccggatcagggaatcagcagcggattccgggaaaacctgaccgggttcggtgctgttccagtttttagttagacggaaatgagtatttttttatcacaatggagctcatatgctaattttcagcgcccaaacggggattttgttatgcctcgggccaaaattttcaaaaatttattcatcacaccgccttgaatttttatcattgctaattctcgaagcatttccactcacttttcttcgtcaacacaaatccaccgcacaattgctgcttgcaaattgcgtttaacatctgtgaacaaaaaaaaagagaagcatttgtcaatctagaacataaaagtttatactcgcccgccggtgggcttcgaacccaagacctttccattccgtgcaattctctaacccactgagccacgggcgctcccttttagacattctcccatatcctttatctcactttctcccacacatcgctcgcttcctatggcatcacaacaaaatggaaaaaattttcattccaagatgccaaataattttaaaaaattcgaatgccaaatttgaaaaaagaaaaatccgacaaaatactgaccattgtcagctttaaaccgcacagacggaaaccgcccgctccctccaacgcattgggggcggaagagagcagcaaaaggacgaacaaaaaggggagaaagcggaagcgcggtatggcggactgtgaagcaatgcgtctgttgaagctgaaccag

SEQ ID NO: 21775 - DNA, 1889 bp, Heterodera glycines
tgttcttttttggacaaaatctgttaataaattgcactataattttcaaaattttcccggcggcgccttaacggcaccgccgaccctcctctcaaaaagcaattttgggaaaataatgtggcaaaaaaattgaaaatttgatagcagattacaacttaattaggaattttggagaacttccaaatttaaaaaaaaattaattttttaaattaaatatttagataaaaacaaatttgaaaataaattgatttagcttattttttagttgattaaattttgataatgattcaaaaattatagaatttttcaataaaaaaattttctttcgcgtttgtattttcgtttttagggcactttaatttttgggtgaaaattatattattcgtctttgcggaattttttgtcactaaaaactttttaagtgagagtcacaaaatggataactttttaattcacttaactttacaatgaacagcattaagatttgttaatttgtacatatttattttagaggaaattaatgcagcaattggtaaaaacaaggtgctaggtcgatgcgaaaaaaactcagtgattgataaattaaataaataaattaataattcaattcacaaaatcacggcgccgtccggttaaccctaatgtacggcgggacgcaagtcattttcaatttttttttaatttttcaatttttcacatcacttctcgccaattttctccatttgtagtagacacagccggacgcaattgatgccattttgtagagctcatcgaactgtacaaaaaagccgctggtaccggcacgcttaacttgggttggccatcgacagggtcgggggcgaggctgagggtcctccggcagatgtgcccgacccatgacgggctccaaatgaatggatcgagaaccggacccggcctgggagatagcccatgaaaaactgaacaaaaaattgttcttaaccgggccggtccgggttccggatcaggcacttttggtgccccgaaagtggtgcgatcggcttccggaaaatgaccaatcaatcactgagttttttttcgcatcgtctcagcacgaaaagcaacagcaatcgttgagttcatttgtgacagacagcatctattggaagcaaaaaagcatcgtttaaggaaaatctgagaagattttttggaaaattctattgggaatttatttatttatttgtcgactatttcagttggatttgtactgatatttggctggacactctcccctttacaccaactacaactcccacaaccacaacaacaagcgtaaagcaatatttgttcggcattgacattggatgtaagaaagaaatatttaatgggttgaaaatgattgaagaacatagcggagaggggagaaaattgaaaattttaaataaaattttggggaaaaaaatttttaacaaaatgtggaactatggaaataattaggacaaaaaaacaaataattcaattcattcagccaaaaaatttgagaagccatgtgaaaagaactgctttttggcatcagaattaatgtatgtttattgtttacaatttataatttgaataataacttaatttagcaattttagagcaaaagtggtggaagcgattgactctgaagaaaagaaataatggcgaaaatggcatttaaaataaataaattattttacatttttatgaggctatccgagtcatctaatgaacatattcaaattggtaattgattattttcgattttttcataataaaaagtcatattttatgtgcggcattaaaatgagcaaacattaatggaaaatgcactataaattaattaaattatgcttatgggaaagataatcctcttggtccttggcccaatagaaataatggcttaacta

SEQ ID NO: 21776 - DNA, 1424 bp, Heterodera glycines
  misc_feature (55)..(55): n is a, c, g, or t
  misc_feature (57)..(57): n is a, c, g, or t
  misc_feature (59)..(59): n is a, c, g, or t
ccagaagagccataatcccaatcaggattgctgaaatctatcctaggatcaatgngngnttaagattcgtctttcacataacttgaagaacaataaagtggatacgtctattggtgcacattctatattttgctgaatgatgttatcaggtggcgaccaataagtggcccgacatgaaagccggagaggagactctcctccagtaatgggaaaacgaatggttttaagtaatttctggtcccacatatcccatcacaacataattctatgtttttagacccttctggggcctctattttgacccccttcatattacaggttatccacgatgactgattcgactgctgatttgctgttgaaagggcgaaagcgtcggcaatcggtgccccaaggagaatgaaaatcgccaccatggacaacaaataagttggagacgatgttaatgctcggggcgtcttgctagcccgttgaatttgaataggcggatttttcgcccatcttaatttggccttgggccgaattggctcattgatcaattcttgccccatttcgacgggttcttctgatcgctgatttctcgttaattcttcatttgacttctcatttccctcccgggaatctccccgcggtgacagggcctggtttaagtctttattgtccggatttacctctaagggaactaattttgagaccggacgtgtccaaatatgtccatttggcattttaatttcggcactacgggcatgcccttcgggactactcagtcccacaattctccccattggccatgtgtttcgtggatattcgtcgcgttccactaaaacaatatgcccgagttcgggttggacattagcaataaggtgcggtcctttatgtgctgtttgattacgctcccggaggaggagcaaatattcgctggaccagcggtcccaaaaatttctaatggatttagctgttgcccaccatctggtggctaatttttcagcagccgatggacgataactttcgtcttccatatcagttccttcaaattcaaggtttgctctaggagcaataaaatcgattggtctgagcggcagaggaccgtcagactcatctgatacaaaagtgatcggtcttgagttgatcgaggcctcggcctccgctaaaaatgtgtttatctcctcccagctcaagagtcgtcggcctaaaactctccgaaaacagttctttatgtgagaatttagtcgttcatatactccgcccgaccatgggctaaatgcggggattagcgtccatttgatggacacttcagtgtttttctcaaagtgttttggccaacacaaattgagaaccgtgatctgaaaggatcgattttggaagtcctcttcgcgcgacaaagttaagggaggcaagcaaaaaatgctctgctgacatggacgaca

SEQ ID NO: 21777 - DNA, 2497 bp, Heterodera glycines
gttcaatcaatctgaagtccttttatcagatcacggccacataaatttcgtctagtgcctttgaagacgtaaatggtggcctccatcttttgctttttgtaggccacacagactttgaatgatccaatcactcctttgattggaatcccaccaaatgccataagaactgtcgggcatttgtaattgtccagttttgggtgtccaatgttttcccaatcttcataactcaaaagagtaacatcagcgcctgtgtccagttcgaaatttgcagtctttttatggacctgcaacgcgatcatttgaggcggaactgacactaaattgcaatcagcttgtgcaacgctgacaactttgcaattttcagtgaccacattggccgttttcttcttgaattgcgtcttagcacttgaaaactttcccgaattgtacttgttatgtacttcatttttgcacatttttgcccaatgcccaatcattccgcacttgctgcatttgtccttctgattttgacatttattggcccaatgatttgttgaaccacaacgaaaacattgaccttttgacccgccccttggctttgggtgtgtcaccttggcaatttcagcttgcttccctccaaaatcattgccaattgtgcgagcgtctttctcggactgttacagtaagactgctgtctctactgcgtccttgaatgccattgccttccctttgatcagttcagtgcggaccatatcactgctaatgccgttaataaataacgcgcataagcacatttcaatgctgtttctgtcccactcggccttagcgattaagctccgtaattggattgcaaaatcacgaattgacatacctgaggactgtgtggccgaaaaaagctcatgccttttagcagcgagcgtttttgattcaccaaaacgctctttcattagcttcacaatttcactgaaaggcaaagttcggacatcatcgggttgtgccatcattcgcaactcctcataaatcgctccaatctccgtgaagagtagcagctttttagtgctttcatccgtgattcctcggagtttaatgaaaaactcgaaccgttcctcccaggtgtaccaagacatctcatctctggggaataggcaccagggccttttccgacttttcccaccgcttgtggcattgttgagccatttgtgccagtcagttaaaaactgaaacactccaacttcaatttaggagggcacttttgttgaattcggcgaatgacgaaaaacctcgtctcgaggaaccgcacaccgtcttggtgatttaggtttttcgacgatttaaccgcgtcttgcggaccgaacaccacctgggcgatttggtttttttgatgagtcggaagattggcctcttctccgctttgttgctgtttgctgactgctgactgcgccagaaaactgttgtgtccgacaacagtttataaataattttatttggagcaaaacaattacaattaaatgcagagcaaagggaagaagtcaatagcacaaaataatatgaatgaagctgggaagaagagggaagggggagaagggaagacttaaataacaaatgagagggggtggggcaacttcaaaatcgtatataaaattagggttacgggcccgggtatttgggcaaataccgggtcagggtattgccgggtccagaaaagccgggtcagagtcctagtttttaaaccgagtccaggtcctgaaaaatccaaaaaaatctaaaaatttttcatgagaataaaataaatattttaatgaaatatatttttataaacaaactttattatttgtccattttttttgccattcgaaccacctttttgcgttgcgttttctaaaacttaggggacagttggggtccggcggtgccggtaggcgccgccggaaaaattttgaaattttgagtgagatttgttaacaaaatttgtcaaaaaattatcaaaattttttgttaaatttgcggttttaggctgtttaaaaaagagaaaaaaaaatttttaaattgaaatattttttataattaaaatttcaattgaaaaataatttaaagaaattattaaaaaaattatgtactgttgaggaattgaacccaagagaaaaataatgaaaggcagatttttctgactgctcaaaagttcaatctttaggggtgtattttcaactctcgcctctcgtccgaaaaaacgagaggcgagagtaccaaaaatggcgagagttggcgagagttggcgagatacgagaggcgagagttgtcccacccctgatgcagactcttacagcagaattcgaaaatcgcaaatccctctacaatatacaagagcctgtgcttatcatttgattttcaaaatttaacgagatttatttttaaaattcacaaacaaataattcaaagctaagacagaatttagtatttagtggcccaaaacaaatcacaaatgtgctctttggtatttttgagttgcaaccagccctac

SEQ ID NO: 21778 - DNA, 1002 bp, Heterodera glycines
attcaccaattgcttggcggttgaatcgcccatccaactcttggcttctcgatcaaatgtcggcgatggatgagttgggctcgaatgacttcaaatgcccacggcgctttagcaaagaattcttgccatgccaattgttcagtttggctttcttctccgaatggcagttttggcggcgcgatttggagaagctgatagccgctttcctccagagttcgccacaatttccgacacgtgcgaacgcgcatttcgatcacttccatcaaattttctgcggacgggagcatgtccgaaggcaccatgtcgccacgggcaccaataaacagcacaaattcatggccggtccaccaaacgacgagatgccgttgtcgaaccaaattttttgagcagaaatgcacagaacagtgcttgaagcggcgttgtcacctctttagcgccaattccgattttgcgatttaggacggcatcaaaatcggcaacgaccaactgcgtgcagtgctcatggccttccccagagcaaattgtggtccaaaaacaagttccgtcgccaagacagtactcgtcgcacttggccgcttcttttccgtccgcccctgaaaaattcattgtccctaatgaataaaccacttccttatcagtctcattttcaaaattaatctcgccatttttgatttcttccgagacacaaattaagccaattaaattcttaaatttggcttttccttttggcaaaattgaattgtttgggatcccagggggaacacgaatcattctttcgattggcacagaaattggatcagcttttaatttatcagcagggaccactctagctgaacttccggtcatttcaatgatttggtaaggcccaaaatggttccaagctaattttcggtgtgaggcttgtgctttcgttgaatggacgacaatcataactctgtccccccggcttaaatttttcgcgcgtcacggtttgggcgggaattaaatttccaatttgttttt

SEQ ID NO: 21779 - DNA, 1853 bp, Heterodera glycines
  misc_feature (207)..(207): n is a, c, g, or t
  misc_feature (1833)..(1833): n is a, c, g, or t
aaaacttatactcagaatttgtagagaacaaaaagacctttcgaatgagttattgaatgcttggagaaattaagtttttcgttttttacgattttttgaaatttaattactggcccctacgggtcatgtgcactttttttcatcctaggaaaaataaaatttttaagtttattttctgtcgggaccgcaattctacacctttgcccntttcaaataacaaaggcacacttttgcgggccgcccttcttgttcgtcttgtgatggatgttgttccacaccggcacatttttgcgacccgtagtcactgaatcgccaattgtgaagatcagccggcgagtgaaagccaattggagcattttgagcacaagagttccttccgcgttattcggcagataggcgatgcgagtggtcgaactgtacggctgcccggggcgaatgtgtccatccttaacatttagaaataagcgacggaacaaatacgggtcgggaaaagacatacaatctgaattccagcaggaatatggtaagtgatttcatggaatccctttgcgtctctgtgtccggcgacataccccgggatttgcttcaccgtcatagtagcttaaatcatcaaatgctttttaattaaattaaaaccaaaatcaccattggcgggctggtaaccgacacattcgccataccaaagcatgcacagaggacactgtcgcttcacagcaaaggcggactgaagaaaaaagaaactaattaaagtgtgacttttgcacatgaatcaactgattgtgagataatttcaataaaaatagggaagagaagtaaaagtgggcgaatttcgaaaggggggaggtacgtccccaacttctcccgatttgatgtgcttttagttacaaaaatagacgcctcggaaatacctttatgcattccttgtggaataagtgagagcagagagacagctgcacaacaacatcgtcgtcgcactcctcgcgcatgtcactcaaacaaatggagcacggcattgaggagtcgtccagacaaacgttgggatggcgcatagatgaactcgacgcttggtttttcttttgagacggaggaagcccggcctgagaagcggcgtaagaagtcgatggtttgtccgacgattgggagtttccgtcctcggttttcagttgttcgactgggacaatggaccaaaactgtttctcctgttccctggtaagtgcgtctgctcttcggttggcatcttcgtcggattggtcctcgtcgtcgctatccatcgcatcgctcccatcatccgtcttaaaagtccaatttacaaatgaatgttgtgatgaaaagatggtcattggccggggttcccctttggcttgggcttggagttcctcccccttcctttgtgtcagcccctctcatcactttttgtcccctcaattgaccaactgcccctcccctttctgccaccctcaattcccctggcccgttcgttcattcattctgttaattgttcaactttgtttcgcttggcttggtttttactcaacaaataaaggggacatcgaacagcgaatttggggatttggtgttttgggccaatttggccagcccggggctgcgacgaggggccccattttgggtgtccccgagtcccaacagaccccagagtatagggcattgtcatggcgctcctgggtggatccgaacatttcgcttcactaatttttctcccaatttgttccccttaaaatcccattttcttcgcccattattagcattatttttttatgatttgtaataattagcgttttaatttttcacattttgcgaagccattatttctcncgttcgtttattaattttgc

SEQ ID NO: 21780 - DNA, 1820 bp, Heterodera glycines
tggttcttcactgttttttcaatttcattttctgatgccccccccgcatccatttcctcttgctctaaattgtggtccgcatattttatccataatggttcatccgaatcccgaagtgggagaataacgggaccattaaatgttttaactttttcctggtgaacttttttcaattttcccttttcgtccaatgtttgcattttttctttttcaatccaacaacacgatatggacctgtccatttttggtcaaatttgtgtttaagtacttccttttttaacagtactaagtcgccaatttcaaaatttctgaaatttgctttccttatttggtcattttcggctttgtttttctccagggctttcaaaatttcttcctttacaattttccatgcgattgatgccttttcagtgtgttttcgtgtataaacggaaatgtccgacaaaaattcattacttgaaggcaatttcaaaatttgatcagtgggtagtcggggttcacgcaaataaattataaaatagggtgaatattttgttgcagtatgtattgatgtattataagtaaaaattgcatgatttaatatttcatcccaattgtccccttgtgaatttattgtcgtggaaatatatttgccaatattctcattgaaccttcggccattccatttgactgctgatgataagcagtggacataatatgttcaaatccataaattttttcaaatttccgaaaatttgtgaaataaattgccttccctggtctgtgaccactgtttctggtgtagaatgttggtgaattacaatttctatgaatgtctcggccaccgtttccgcacgttggtcggaaattgcctttgccattacccattttgaaaaactgtctatggctaggaaaatgtactgatttcctttttcggttttttcaatgggcccatcaaatcacaatgaattctttgaaagggtccttccgtggatttaattggaacacttggtgctgctttaacttgaccaggaaaaatttttcttttttggcaaaattcacaggtttcatttagcagttttatgtcttctttaattccatcccagtaaaatcgattttttatttcgggccatgttttttcaaagccaaaatgtccttcgttgtgaaaaattcggaaaattcgttcccttagtgggtaaggaattatcagtttaggattttcagaatttgtttttccttttttgtagtaaattgcgtcatttattaagccataattttcaattatttttctccattttggctccccctcaggaaatttccccgttttcagtatgttaaatatttttgataattcttttacttttctttgttcttccaaaatttcttttaaagaaatttttgcttttaacgcttccattttttcattttattttgcttccccgcttcggtctactgccgataaaattatttggtttttattttcctcctcattttcaattgaacaatcaattcctggcacattgtaccgtgataaaaaatcggccaccttgttttttctgccagggcgataaataatttccaaatcaaagctttgcagagttatctgatatttttctaacctcccttttaattcttttgttttcatcattcccgtcaaagcactgcaatcggttatcaattttgttgtccccgatccaacgatgtaaggggaaaattccttgacggaatagaccaatcctagtgcttctctctctatagaggggtaatttgtctcatgtttatttaacgctctcgccgggggggccaccgggccattttcttggagtaacactgctcccaat

SEQ ID NO: 21781 - DNA, 1763 bp, Heterodera glycines
  misc_feature (16)..(16): n is a, c, g, or t
  misc_feature (38)..(38): n is a, c, g, or t
cgtcatcgaatttctntcgttcaaacaagcaaattttntgcgaaaggcaccaacatggatttatatttggattttgatgatgtgtatgacaacaacggcattgtccagtcaatttggagtgtttttgcacgcgaattttggcccatttttgcgccaaacattcgccatttgactgttcccattggccatcaactggacgatttgcgtcatcacatttcaccgagaattttcaccgattgcaatcaattggattcaatcgattccgattctcggttgctcgatgcaattggtgatgatgggccaaatgcaactgttggccaagcattgtccaaatggttgcgcattccgacaacaaatgggcagccgaaacaatttcgtgatgatgaatcgtcagaaaccaatgaatgggtcaacaatttcaagaaggtatggtgccaatattttcgtaaaaaagattgttaaaaacttggactggcggcgcctaatttcgatcaattgcgaatcccggacccgaattcgaacaagaagccgaaagtccaaattttaaattcgcatttttgcttcaaaatcggtttaaacaaatggaaataaactgaaagccattattctttcaataaaagataggtaatttaataataagccgtttttagacaaaaaaaaaatgcgaaattcgaaaatttgaactttctattttttgttcgaattcgggtcaggggttcggaattggtctaaatggaagccatattcgtgattagcgattccaaaacccccatggttacatttttattgtcttttaacatcaacaaaaaatccatgtggcctaaactgtataattaccgactcattttggattgattgccatttgggttttaatttaccattttttaggaatttctccgtgccaacacttcttcggccagctacataattcaattcaaaacatacaccacctcagttgcgcagtttgaattggtgaacgaacggactaatgaaatgctgacattgaaggcagaagacgatgttgtatacacacatattaattgtgagttgaagcgatgccaaattgggcagacaattcaatgggaggacaaaaagacggacaatttgaacaatgtcgacatttcgcttcatggaaattgcattgggtgaggaggagtggcaacagcttttgcttttatttgtctcgtcacatttaaatttgcacttcgtttaggccattgtttccgccaaagacgggccaaattaacgcaaaaaatctcctgcaaatgaatcccgggcccagctgagaaatgattgatcattaggaatggaaactgattggataattgctcctcacatttgatacttctttcgtttgaatacattttatttgactgggtttttggcttttacatcagaaatgtatttgtttaccaaatccaataaacttagtatcattcgaaaactctttctcgattggcttcccaaaaatcacaaagacaaatcgacatgtaaaaaagttataaaataaaaatatgcaaaaattctgattttttgtgattttattgttgtaacttttttgcgaggtgttcaatcgcttagaaataacttatcaacggcttctaaacatatagagctttccaatgatatgtactaaatttataaaaattggtcaacaaagaaaaaagttatgttatgttattttttttcataaaaaatttcggtactaatgcactttaccagacataactttttttttgtcataacagtcgtgtcccgacatt

SEQ ID NO: 21782 - DNA, 2018 bp, Heterodera glycines
atcacttctctttctcccctccctcactctgtgtttgtttctgcgcatgtattcctcgatcagttcgattggaaattctctttcccgtccatttaagctcgtcgtttgaagcgaggaggaggagggaccgttgcgcaactgaacagattgcggagaatcgaaggagaggggcgtagcaacgtcggcggagatatggccaatgccattgcgcaatggcacagcgtcgacgacggcgggcgacaaaatgcgcgcgggcattggcacgtaaccactgaatggaatgtcaaaaatgaatgaggtgctaattattgattatttgagagtcaattaattcctcttcgtccttaccctccaccgttcaatgtcctgctttgttgctgatgttgcaaattgacaaaatcatgctgttgctgcatcagatgttctcccattgccgcgttcgcttctccgatcatcaaaagccccggcccttcgccgttctcttccattggcataaaagtgttcaaatttggcacataaatttccccgccgattggcgaagtgtttacgatcattgaagacgacgaaagaggcgctgaacgaaaccgttaattgtttttgctttagcaacaatttttttgcttcaactgaccattagcatcgccattattgttgttgttgcttcctcctgtcttatgcttatcgcccgttcggttgtaagccctcctgcggtatctgtcgtcaaaattctttgatcagtgatcaaattggcaaccaaaccaatcacttacgggtgaccgaccatgttgaattccccggtcaaaagcagtctgcttctctccgggcatttgtgctggtacagattggaacggaatttgtatgtctaaattgaaatcatttaattaatttttgtttaacaggtgctgctatttctcattaattgaccttgctaattgcccccactcactttcatgcaaaagcgacacttaaaaggacggtcgttgctgtgcttaaccgcgtgctgcttcaaataccacaccgaattgaacagttttccgcagtctttgcaggcgcactgttggttcttctccagcgtgatgctgaggttgtccacgtcctgcggagagatgataatcggaggcggcggaggggcggaaaattcggaagacggagagcgggcggcggtgcgactaaagcggtggggagggaaaggaggaaaaaataagagacgaaatgccaaaccgacaaacaaatgatcacctttcctccgaactgctcgccctcttctgcttcttctccttcggctgctgctcactttgttccccctggggcgtttcttcgctcattgcactcgccgcccctgcggccatcgcttggccctcttcgccgtagccattgctgttcatcccaagtaggaactgttccaccgcttctgtcggcaggaattccgccttcaccaccggcacaaatctcccgaggcaatcttccgccgcaatattcggcactctttcagaccgttgttgatgttgtaattgttcgctgattaggtgtcgctgctgttccgcaacactttccgacttttttgtcccttcgttttcggccctttcgttggccaatgccatcgaattggccaccaattgtctgcccatacacaagtctccatcactcagtgtgcccaattcctgtaggtccactagctcatcctcttcgagcagtccgtccccattaaaaaattgttgccggtgggccttttccgattgcggacgacgcgtgtggaaaagtgccgccaaatgaatggactcgtcgtcgggtgagccaaccccggcactgtgctccatttgcatcgcttaattggggggaaacggtgaaagcattgtaattatttatttctcatggtgaatggaataatgtttcaagatgatcattggacaaaaaaccagtgaccaaaaaaataacccaaatattaatataaaaaactgattaaattgaggaaaaaagtgatcaagcggaataatcaaggctctgacaatatcaaacgc

SEQ ID NO: 21783 - DNA, 2148 bp, Heterodera glycines
aacaaagagattattgagcatttacaatttttgttataagaaattccaagaaaataaattaaacaatttttctgcgatttttttaagaaaatttttgaaaaatatttttcgtgaaattttttttataaaactttcaaagttttttaaatttcaaatatgtgcaaatagacggcattgcatgctccataatccaaaaattttaacacagtaatgctaagtgtgagttagactactgtaataattgtaatatataatttggaggcaaactgtaagcttaagccttttgttctgcctgcctccacccagtaaagtaccaggattgagctcgcgcacttaccgctgctttccacctcagcgcgtgggtcggcacgaacttccaccggcacgccattcttgctccaagtgatttccgggcgtggactggccgcgtagggcaccagcagcttggccggctcacccaccagcacagtcatgtcgcgtgccaacattcccatggtgatcaacggcttgcaggcggacggtgcggccacaattggcacggagttttcgctccactcgccttggcccgccgcgttcacggcggccacgcggaactcgtaggtgtgctgcggtttgacgccggtcaccttcagtgatggcaattttagtgtttttttttggacaaatttcaacaattttccacggagcaggtcgtccccccccatcccgaaaatttcttgaaaaaaatgttcttgaaatttttcaaaaaatcttaggaaatttattcataagaaaatttcaagaaaaaattttttttgatgatgacctactattttttttttaatttttaaaaacatcactgaaaatttttcaaaaaaatttttttaagtttcttatgaaaaatttcctaaaacctttttagaaattttctaagttgaaaatttaaacaaaaaattcggggaatgcgaggcgggaggaaactacgcgttgaatgaaaggcacccgtttcccccaccttgcaacgcgtgtccggcacattgccaaacgcggccttctcccacggcgcgttggtgccatgctcacgcttctccaggacatagccagtgatcggcgcaccgccatcccgcaacgggcgtgcccattggagcgtgattgagtcgtaggcggtgtgcagtggctctggtgcgcctggcggtccgggcacatcgaatggcgccttggccagcagcggatcctccgcgtccagcggctcgcccacgccgaactggttctcggcacaaacgcggaactcgtagcgttctccgctggtcagtccgcgcacacgcagcgacaggccagccggtgcaccgacgcgctcccagtcaccaccacgtgccgacttgcgctccaccacataattggtcagcggcgaaccgccgtcatccttgggcggactccagtgcagtgtgcacgcgtctgcggcaagctcggagaacagaatgggcccgctcggcttgccgggcacgtccagcacgttcacgttcagcttggcactgtctttgccgtgccgattctgtgccaccactttgtacggtccggcatcgttgcgttttgagtcacgggtggtgaacacaattttgtcgtcctccacttcaatggtggtgcggtcgtcctcaaaaattgtcttgccgttgttcagcacgtccacattcggcttcagccctcccgagctgtacggcagcgtgaaagtgatggtttcgccggcacgcactgtaatttggtaaatttttttaattgactaattaatttatttaaaaataaatataaaaaatactaggaatttaaattaagaacccaaatggtaattagtacatgttctaatgcaatgcgttttttcaaaaaaattcttattgaaggaggcgtttggcgccgccgaaggaaaaattagaaatgttggccttatttttaacaggtttttcttcaaaaattgtcattttttagacaaattttgaaatgtggaattttcaagaatatctccaatttttcaaaatagcaaaaattttagaaaaaacgcatttaaatttctaagcttcggagcatcggaattaagcacaaatcttcgaaaataagcattatgacgaacactaaagtagacagaattaccactttaaaattttagtcccaactttt

SEQ ID NO: 21784 - DNA, 1118 bp, Heterodera glycines
ttgaagcgacgaaagaaatgaaaattgaccaaacgccgaacactttccaagtcgcaaggcaaaaactaatgggaaaattcataaatttaacaatagaaagacataactcacaaaattgacgcacaaattaagcaaaaaatagacaaaaattggaaaatgcggagaagagaaaagggaacagtcgaccgataagtcaaattgacaaaggcataagcgacggaaagaaagggcagacaaaaagcgcagacgaaggccaagcgaaggaactgactgagaaaagcaacaattaggcccaattaggcatcattaaataaacgaaagaaaccgatcgatgcggcaatgggaaaccaaaacagcaggcaaatcaaagcaacggaatgtgagcagaagacagagccaccacagaatgtcttcgggctaaagaacacaattaaaagacattggaaactgcagcagtcatccatcaaatggaaactttttgacaagaatgattcataactttgctcaaaagtaaccaattcgtggtattattttaacggtcttttgagtttatttgcaaggaatgttctgacactcctcgccataagatgcatggacccagacacaccaccttagattatgccaaagtttaatgattgagtcaaaattagcacatcccaatgaagtatcataaatgcgaaaaccaactctgatgtgacgccgagcagcagagaatccaaccgacgaattgactccgtcccttccctccctttccgccatttgatttcgaattttgtatcgccaatcactcgaccgatgtcttccattctgtccaccgagcccaaccccattcagctgatgaatcgtcgacgaattcgcgtcagggttttccattgtcaaggtagcgcataatcgggtaatcctgtattttattggtcccataaaaaaaagagattaaaaaggggtttttatgcaattctgagtagtgctcgggggttttcgtgggcgctgatcaagaatatgacatcaatttcgacctatttcgcattccgaattcgaacaaaagtagaaaattattttttcaccaacattcacatgtattggccaaaatcgattcaaatgcactaaatggccgtgaa

SEQ ID NO: 21785 - DNA, 2414 bp, Heterodera glycines
  misc_feature (22)..(22): n is a, c, g, or t
  misc_feature (39)..(39): n is a, c, g, or t
atttccagacatttggtaaccngacattgtcgggtcacncaattctcgtgccgcaaataacggtaaatgcaaaacaacgaaattaaactaatatcatttaacattttttgaaataaatgttcaggcttttcaaatttgtcatagataattggcctttaagcattaatttgcggacaaaaaaatatttacattcatttgattgacaataatgataattagtgtgtgatggattttgcgattataataataattataataataataagctgtggtcatcataataaatatttttgttttaatttgattaatcgctcactcttcgaaatattccccatctttttttcaattttcgttttaatttcatccaaaatttctttcatattttgcatttgttcctccaaattttgcattttttgcttttttaatttatgcattatctgcctaatttctgtccatttttgcttatcccccatttgagtcagctcaatttcgagcaaatcccattcaatcatttttaaataattttgcgtgtcattttttattttttcttggaattcagaaagcaaattgttaagcatttgcaatatatcttaaagtaaacatttaaaattatgactatgttgagaaggttttttatgaatacataatattttttttcgcaaaactcttaaattgataattaatttagcaaatttaaataggtaaatattttgggaatttattgtagcaatgaattatatttaccagttaagcttaatatttaatatttatgtattttggatttattcaaaattctttgatgttcaagttttaatgtatttaaaattgcatgtatattaatgttttaatttcaacatcattaaattaattcaacaacctttgtccgaattaaaatcgattttgattgctttgacaaaattcacgtaattctcaccaaaatatttcatgtatgcatcttttttgttttcataaattaaaacaaagtttgggtttaatgagcaataaaacctgaaaaatttacaaataaactaattaattttattaaaatttttaattattttacgtaaaataaaaaatacttataaaatataaattagaaattttaaaaactattatataattcgaatcttacgttgatttggcgcacaattgccgttgcttttcacgaaaacgtttaattagcattttaatcgcttcgttatttagtaaataattagttgtctcaatttcttgcaataaatcttcaacaaaatatgccaaaaatgcaaatttatttcgaatttgatttgggcttttcgaaattcgttcgtttgttaaaagaaaattcaaaacatggttaaaaatttttaagtaatcaagttcttccaaaatatattctccatcactgtccatttggtcaagaatttgcaccatttttatcacttcataaactgtgggcgaataagccggcttcgtcaaaattagcaaaaactcataatttcctggtgaaaaaataaatattttaattaattaaacaaattaaggcttttaaacaattgtccttgcttataaggacacatttacccctggcattttcaatttgcagctcatttttattttccaagtacacattatatggcaatttccaagttggcatattgatttcgaccaaatcatttgaaatgttgattttcatgttaaaagacctaaaataataatttaaaatttgcggtaatcagaaacacccccggggatgttccaacgccaataatttaccaaatcttattccaagggttaaacatatttagaaattaattttggaaatagaaattccaattttgaatttgttaacttctgtaagtagttttaattacctaaatgcaattttgagtgtccagtacacagcagggatggcacggaattccgagttccgacttccaacatttttggggtcggaatttcgacttccgaaattttttggtgcctcggaattccattcctggtacacaggattattggaaatttttttattctacagtattttttgttctttttgaatatatcaaaggaaatttctgatcctacagtactatttttgtagttttttttacctatggattttaaaaccagttctgtaagcaaatgtaaatgcctttaaataattaccaataatttggtcattttgttgttcaatttgtacacacaaacggattgccaatgagaaaagcaattccgaaaatgctatatttttttctttccaaaatgaattttggcgttgttcaaactcttgaagcttcaatctttgatcaacagacacaatgttttgtagtgttttcacaaaatccatttctttgacaaggaaaaaaggcgagttttttgcttcactaaattttaaaaattaacaaatctcgatttacttggttaaaccatttttt

SEQ ID NO: 21786 - DNA, 1878 bp, Heterodera glycines
  misc_feature (64)..(64): n is a, c, g, or t
  misc_feature (144)..(144): n is a, c, g, or t
  misc_feature (1747)..(1747): n is a, c, g, or t
atttcaataggatttcctaaaatatgatttgatagccaattaatctcgacgtttctacgagttnaaacaattgaaattttcaaacatttatttaaaataatccaattttgaatgcagaaaattcctgtgcaagaggcctgcccncagggcactcgtcagagttgcgagccatgtgagggaaatgacgaaaagaaagatgcaccctaattctgtaattagcttacaattaacataaaatataaatagcgtattattcattctttccctacaatacatttgtataatttaatagccaaattattgtaataaatttgtcattttttaaagaaatggtaatctatgattcataaatgaaagttatggggtcatttagcattttctccgttttagttaaattagataattggaattttagcttttcacatttttaaatggtaaaacagatgatggaatgccaattacgcaattttaataagtgtgcttttagattaacaagttgctgaactatggtggggataattggcatcaagaaaattgaaggggcaggagaaaattgggcggaattttgcctggatattttgattttgggtggactagtttgggaataacttcagttgtaggtggaacgggtgctcactgttgccccgtttgcttattattcgtggtgtgttaggcaaccgaactccaagattgtttcgtatcgcggccatgtttcgaagaatatggacttaattaacgtctttaccttacggtggcaaatgcacgctttgctcctcttttcgtttctttgttgataataacgtgatttattggaaccattcctacaaatttcctttagcattttcgataattgttttaacggaatttaatgcatttttattgataatatacaaatgcagaattagtcttacaattagacaaaaaaagttgattggatatgaaaaaagaataataaggatgaacaaatagagaggaggaatacattgttcataagtaatcgattttaatattggaattaaacattgattaaaaaataaataaatttttaaaatcattggttagtcttggggatttcatttatattaataattgctaatttttaaatgtatgaaaaatgccaaaagagtgttttatcttttgttttttatttttttgaaaaagtagaaaaatgaaaagttagaaattaaattttcaaagttgtgaaagctttgaaaaaacattatcataaatagagctgccagttatatagaaatctatttttgatcattttctaataaaaaagctcaattcgaacggcccacataaatttggaaaatatatgtctatatttttgtattttatgtccatatttctagatttttggtctatatttcatcaaatatttcgagattatccatatttgccagcactaatcataaatatttaaaaacataaaacaaatataaatgaatgaaaattacattcagataaaatgaatcaagtgatatagattaactttcacagggtcagagttaatatgtgataaaatttggaaattttatggattttaaaactcctaaatttttcgacaaaatttaaaaattaaatgagtaaaaagtagagaaagagatttcaaatcagggacctatttcaattcggatcaagtcctcgacttgatgacttgattttttgcgacatcgactgcaaaaattgtttttcaattaaatcgagtaaaaaatcgagtgccgcactcgattttgacatcaantcctatttttactcgatttttcacttcattttttaaaattatatatctagggaatgcctgaatggaaaaatctcattttttttaccttaaaagtattagaaaatttcactgctatgctaatgatctgtggt

SEQ ID NO: 21787 - DNA, 829 bp, Heterodera glycines
gccggcacgacgccttttttctgctctttggcacgcaaattttttgccacaataattttttcataaaattttgttaaaattgttggcgatggatgtaaagcgggtgatttaattgtttattctctgctgttggtgatgggcaaaaaatgttatttttcacacgatgagagagagagatagacagagagagagaaagaatgtgccacctgtgctgctgtttgttagtgttttgatcaaagaaaatggacaaaaatgagagaaatggtacgtaatcattgcatattatttgtcagtaaagaaacgagagcaatgggggaaatagtgcatggatattacatcccgctgccacccattcctcgccctcttttacaccccatccaaaaaatcaaacgccttttccgatcatatataattgaaagcgctcgccgtcgacgccatgcgatttgctcggcggcgccgtttcgtgccgctcgccctctgtcgtcgggccgaccccgacagagtgggcaatctgccgaaaggcttgcctggcaaaatgtgtggcttcgcccgcatgcgcagtcgtctggacgacgacgccatgtggcaccgcggcgcttgcattcggttggagtcggtttgagcacatcgtcaagttttttttttcaatttgctttaattttttttttttttgaattagcaacagcgggaagaggggtaataagacaagtctgtctaaagccggggtcaaaaggtaagcgcaaactgaaattgtgcatttaaaagccctctcactcaaaaaatgttatcaaaaatctggattcaatgaataaaaaactgttggtgcccc

SEQ ID NO: 21788 - DNA, 863 bp, Heterodera glycines
tgcatatcatgtttgttgctgtgtcccgctccaccaccaacacgtacacacctcggccaagcaccgcaatcagtcggaagtcgtcaatggccagcgccgccggcgttagtgccaccgcggcagccgaaacagtcgtcagaggcggtgccattttttgttgctcgtgtttccgctgttgttgttgttgttgcagcatctgtgcacacaattttaacccatttgatgaccaaaaaccaaacacctcaaggtccccacccgtttccccccccctacaatttgacgactcgcaaaccgaaaaataaatatatttttttttggtaattttttttaccccttaatgacggcaaacacaaaaatttcgatttatacacccaaaaaaaaatcttctggatgggaggggggacggcgggaaaataagctgttccaaaaagaaatatttttttttaaatttttcaaaaccccaatatcatcgccaaaacaatcacccaccgcctgctgttccgcagccgctgctcgcatcagcaacaactgttgttgctgcatgtactgctgctgttgctggtggggtggtgatggttgtactgctccgccgacaccgccgcgcattgccggcgtcccaccgccaccgcgtgccgtcccaatatgctgctgctgcaagagtatgtccaagtgttgaagctgttgttgctgctggtggtggtggtggtcagtttttgctgttgctgcagtggcggcggtgaacactgatggttgttgttgttgtgctgttggtggtggaagtgatggctcaaaatctgaaaaaagccaaattgcagctcaatattccgactgtttaaggggattccccgaccatttgcgctttt

SEQ ID NO: 21789 - DNA, 2224 bp, Heterodera glycines
ttccaaaaactaggaccgggaatatttttactcatttttaatgctaaaaattaaaacaattaattgaaaattcaagaatactaaagtgtactaatgctaagtaatcatcttattttccaatttcctgtttccttcatatttaatgaaacctattaaatataaaaaagttcgttatttaattagtcagggtataaaattgttaatattctaaacaaaaacatgtcataccgtttgattgaccaagagcagcaggcggcaattgaccataagctatctcactcgaatgatcccaattcctgtgatctgaaagagcaaaacaaaaatgaagatgtaaccataatattttaatttatatttcctgttattccacagtcatccttttatcttagctgatactattacacttaattaaaataatataaatttactgactttatctggggggttcgagtccaaaaccctgaatttttaagttttctattctcaaaaaaacatattttaagcttcaattacttaaaatttggcaaattttttaatgaatgaaaactcggatatttttatataaaaaaatgtaatccaaaattccggttcgaaaaagctaggaatctggaatagctggtctgtttattaccataacttgtaggatagtagtccgaatacggttgcacgttatgaatttcgcttagcccattataatactcatattcatctcctccaatgctttcattaaataaacagcaaagcccaatcatggaaataaacacagaaattgagaagctcgaagccatttggttgcaatatctttctatttgagtgattgcgaaccaataaaattttgaaaaattactatttgagagcagaaggaaatttaataataatatataataagtaaagataaagtaaaatattcaaaattgtttctgccttttattgcaattgtttttataaatgtaatttattcaaatgattttcttactgctttatttacgtcatagttaccccattgttacgctttacgctttggaatcatagggaaatttaaatatgaataataatataatagcagttgctttcgtcatgaatgtaaattaattttgtaaataatcgatttttatttatacgtcaaattatttttatttctgctttatttacgtcatagctaccccattgttaacgcttataatattataaaaaataggaaataaattttggaattttgcaggctaatagagaaaacttttggttagcgaatgataccaagattgttaaattggctgacaaaggaaaaggttatatatagtccaaaaagttgattggacccaaagttcggggctcaactgaagaaaaccgatttcggctaaaataaagtatttttagcttggtttggtgcttccgtgttgcgactttttcgccgcaccatttgctccgccaagcaaaaatgggcatttgcaccgatcagtcaaaaatatattttaaaatatttttaccaatttcaacgaattttactcaaattactgtgcaacaacaaaaaagcaataaaagaaatacaaagaaacaaattacaacgattgacaaatagtttttttcactgcgcgcatcagcaccaaaggcaaatttaatgccaaggaaagcaaaaataatggcaatttaattaggcacattaatgtctgtagattatagtttaaataaaattatttggattattttaaaattttaagaacggtgcaaatgggttttgtagggcggcgcaaatgtctatttttactgggcggcgcaagtgtcgaggtgcaaaagtcgcggcgcaaatgtcggtacaccgatgcttctagggtctttttatttccatacttttcacattttttgcatccatatttctgcaattgcaaaaaaaaaaccgaaaaatacacccctaatggaaaatttttggaaaatgcgcccataaatcgaaaaattttgaaaaaataccaaattgtgcaaaaaatttatgtgtttatgtatttttactcaaaccaattttcagaaatttatcttatcgtatttttacaaattaaatgatatttaaaatcaaaatttatttattttttgtctaaaattcaggcacttttgccattgattgtcaatgttatcaatcttttggtcagcgctcaattgttggtcttcaaatttgaagtgtcgtctctaacggtattggctgtccaaaatgtgcgccacccttccgatgcat

SEQ ID NO: 21790 - DNA, 1814 bp, Heterodera glycines
gaagttgacggaagaggaggaagaatgttctgctgctgctgttgaccactcgtcgaaaggtgaagccccaaaagcttatgcgacatttgaagagcacactgtgggttctgctgcacgatgccggccaaaaacatgtcgtcgtcgagccgtgagagcacaaaacgctgttgctcttcaatgaacatggagttattgaaatctgctggtactgttgctgctgcggctggagatgttgctgctgctctgccggttgctggtgctgttgctctgctggttgctgctgctggtggtggtgttggtggtgacgaagaccaaaatgcaaccgcccggtgttggatatttcatgaagaacagcgctatcggagagtccttcctcctcaccaccactttcaactggctgtaaatattgatttaattaatatagttttgttttgaaatttcattattttcagttcaaactcacaattccctccaagttcatgtcggagtggtcttcagacattgaattggccaaaatttggttgagatcgatctgcaaggcggccatcgaaatcggaaagcaaatttgaattgagtaaatgctgtaaaaataaaagttatgaaatagtaaaaaaatgaattcaaattaaataaaaaataaatgaatatttatgaagagagaaaattaataaagggattaaataaataaagaaatttcaaaatgtaaaaatgattggaatttatgaagaacgcaaaagtgttatgacagaataatgacaagcaaacaagtgaagaatcagtcaaggattaacaaaacaaaatttttgaatttggtcgcctaaattagctgagcggaagggattactagaagaagaaaattgcagaattcaaaaaatgaaggggattaacaaaatgcaaagtacaattaattataaataaataataaataaatatttccaatgaatttaataaaattatatttaaatatatttttttcccaaactttttacatgaagcatcgaaaataatttaaattctataataaccaaaaaagcgaaagaaaaggacaaaaaggaaaataaaataaaaattttttgaattttgtcgacaaaattagctgagcagcaagttcaagagagagataatgtttttctattgaatttaataatagttattaaacacatttttatgtttaaaaacatttacatgaaaaacatttcaagttaagttaaaataaatggaattatcgaaaagataaaaattaaataaaaattttcaaaatgtaaaaatgattggcatatattatgaagaacggcaaaattgttaaatgacagaataatggcaaaccaacaaaatgaagaatcagttaaggattaacaaaacaaaattttgaatttggtcgtctaaattagctgagcggcaagggattagtataagaagaaaattgcagaattcaaaaaatggaaggggattaacaaaatgcaaaagtacaattataagagaaaaaaataaagatttcgaatgatttaataaaattatatttaaatatatttttatgttttcaaacttttacaaaaagcaacaaaaatattttaattctaaaactaacaaaaaaaatcaaaaaaggcaaaaaagtattaattaaaaaaaattttaaatttggtcggcaaaattagctgagcggcaaggatcaattgccgtaggcaaaaaaggagcatccaatgaaaaggggaggagggactaattaaatataaatagtaccaaaaatgtgacaaattctcattttgcttttcagttaacacttatttgtttatcaatttagcctttatattttt

SEQ ID NO: 21791 - DNA, 1321 bp, Heterodera glycines
  misc_feature (1286)..(1287): n is a, c, g, or t
aggggtgcaaccctttgatgttgccgcccacggacccgtgcctatgggaggggtgcagccctttgatgttgccgcccgtggacccatgcctaggggaggggtgcatccctttgatgttgccgcccagaacccaaacctattggaccactttaaagttcccgcccagaaccaaaatctattggaccactttgaagttgcctcccacccaaatccgatttcccaaaaccgtgcggtttttttttgcccaacccatccctcctcgccgatgttgccgccgcgcaaattaatcgataatgacaccgccctaccctccccatcgttgtcagtcgcgcaaataaatcaataataacatccaccaccctccccgccgatgctgatgccgcaagaagtaatcgataattaataaatacacaacagaaccataaattgagggaccgtcccaataaattaaaaatttttatcgtctctttaaattcttttgagccattttcagatagggcagcatataatggtacatttcgtcaatttcagaattgtttttagttcccgtaattacgactttaccggtccagaaaaataacgctgtcatgcttttaccccgcttgaaatttaaaccgcaaaatatttctggttcataaaaggcacgacgattttttctaaattcgtttagttcaatctcatgtccgaatttaaaggtcgaaacaatattttcaaccgtatgcccggtgtaagaagcccccggacaccccgagcccttaattatttctataaaatttttaatagcattttcacagtctatcagacttttcgtccccagacatatcattttcccggattcccataataatgccgtggctttgatgtggcttgtacatttgataaccgcggcattgaattttctagggttatacttaaattcgcattcggtgatcgtcagagagtttagtttaattccggtaccgagattagcgagagcaattatattgacgattatcggtttttgcatttttgatacaatgtaccaatcaaatggtcctttcatccctttatataccccttctataaatagtagccaaaaataaaattaaattgaaaaatgaactgcccgcataaaattaagtgttgtcattactgtccctgtcattacgagatttgtaagagatgtaaaaaacacagtcttttgcatttcggtacatcattttttgataatttctggctatgccccaaatgcgcgaaatatgttccctatgaaaatataaataggtcaaataaataagaggaattannaaatgttcgcggtccgttcactctaattctctcg

SEQ ID NO: 21792 - DNA, 1965 bp, Heterodera glycines
  misc_feature (6)..(6): n is a, c, g, or t
  misc_feature (1823)..(1823): n is a, c, g, or t
gaaatnagtgaaaaaatcgttacaaaacgccaaaatagtgaattttcactattttagtgacgaagcgtgaaaatagtgatttctagtgaccgatagtgagatccaaatcgaaaaattttaacgcagaaatgcgttttttgagttcctttcttcaaaacaattgagcagaaaaaatagttaaatcactaaaagtagcggccctaatgatcagtgatcaatggtcgaggagaagtatgagcattcgaattaattttataaaaaattttaaattaaccgggccacactaattttataaattgatcaatcaatcactcacgctgatcaaatttttaaaatcaaagaatgatgccaaattatcgtacataagcacatgacggcataattcttgatcattctcaattaaattttatatgcttgttttgggttatgatctgctctggtcacaacgaatttaatcaaaaaataaatgccaatggttcattttgagcaaattgaccacggtaacaaagcaacaattcattagaggcaataagaggagaaaggactgaaaattagtgagagggagaaaaagaggaaattccttgaaaatttagaggaatttcaacttttccaggcagagccaagagaattggtagatgacgctttttgtgccaggacaattgggcaactgtgccgtcctcgccgcttttgcttctcccggcacccaccggcttgtccttgtccagaccggccatcacttcggccaccacggtgagcaggtcgtcgatgcgcatgtccacctcgtccatggcgttcagtcgctggtccaacgagggcgggcacttctcctcaatgccctccatcagctgctccaccggcggcatcggctcgacggaggagggcccagcgctggcgacggcggcggcactcccagcggtgccatcggcggaagaaatgggagcaattgtggaggaggacattaatgtatagtgagggggcaaaagcaaaatacggtttttgaactagttgaagtcacaatcaattttgtctagaaaaaacaacaaaatcggccccagaaaatatggtagggtagaaatgggatacggtatttaactgtaaaaatacaatcaaaaggatgccaagttcaataattgataatgatagccatttctgagttgagaaaatggtatctgttttagggcccggatttgaattctctctctttttctgaataaataagcgcagaatgggcagacatcttagctttttgctcctcattcatccttcctacatattttaaaattaacaaaccttagtaacccgtttcaaaaaaatcatcaaattaattagctgacgcaaatttcctacgagaaatccgggccctaaaacagaaaaagtaacgtgaaaatttggttggaccaaaatgtgaattaacaaattttaaagtaaatttagaaaacccaaaaagcaacgaaaaacacatcggaaatgaacaaaaataaaatggaaagaattaactgtccatcaattgaacaatttgaaaaattaaattttgtggcatatttatttttatcatttgcattcattaattatatgttgttcaacaccatcttcatgatcattaatcatcatcctatccgctccgtgctcattcttcgtcctcttttccagcatatgggtcggtcggtggttggaactgttcgcgctccttgcgccaccgggcaacaacattctgcggcaagtcctccacccggtcgtagtagcgacgctttggacgtgtcaaactgtgcggaggaattgggagaagtgatcagaaaaaataacacccaaatgggtgatcagcncacaagaaaaggatgaacaacagagagagcaaattggaattggcttttgtgccgcccccccccccccgaccttctcacatcatatcgttgcgttcgtcccgctccgggtccatgaccaatactcgtccatcagtgccacctc

SEQ ID NO: 21793 - DNA, 3074 bp, Heterodera glycines
gcgtgttacaatttttggcgctaaattcaaatttgaattttcgcgtcaatactcggtgggtggaggggcgcttgctggggaggaggggagggggcgcgctttggggtgtggggcggtgccgtaggtgtaaggcctatgttattttaattaaattttattttaaattaaattttaactattattttaaattaaataattctcaaataattatttcccatcagtgggaggggcgcactcattgagagaagagatgaaatttattatatgaaatgtgaaaaataaatttaaaaaatgagaactgatgggaggggagggattagcagtgggggcaatgcggtgtgcatttttgtttccaatggttgacgattaggcgctttcttttgtctcgttcggtgtgcttcggaacagaggacgcggaagaggaagtggtggatgaagaagcggaagagcaggaggacaccgagctgaacgcggttcccggcctgctgtctccaaacagaactgcctccgctgcatgaatttgttgtggtgaaagcagtttgtacgcggcgcgtacacattctctaggaatgcaacgtgaacacgttggcgtcttattgggggggggtttacatttataggtaaaagtgggtttaggctaccgtttgcaaaacatcgcacaacggttgaggcgccggggcatcatcgagcgggacaatttggagtgccggtgccggagggggcgcaaatgcgtgctgctggccgaattgaagagaagggagttccaaggcgccctgaagccgaggaaacggcgagttgatgaaaaatggtggaaaagcgggccgcagaggagacatgttgtgaaaatgcatctggagtacgctaacggcattgtcgacaatctgcgaaatcatcggccgaggcggcagcagcagttgttgttgatgttgtgccgggaacaattgctgcggttgttgttgttgtgccgggaacaattgttgcgggtgttgttgtgccgggaacaattgttgcgggtgttgttgtgccgggaagtttgtcaattgttcgccgtcaatgtccagctcaatctccacgtctgccggtggggcttcggcggcagccggtagaacaacaacgggtgccggagggacaacggcggcggcagccggctgtacaatggcgggtgccggctgggcagccgcgggaaagaggcgctccttaacatgtgagtgagcactcattttgcgctaaattttttggcacattaccacatcaacacgctgcccattaattattccaaataaggaaaagtcctcattcccacgtccattttttgcaaaaacgctaaatttttgtaaattatcgaatttatgcctaattttctcctacacttggcgcgctttttgcacgttaagccggctgccatccatgtggcgaggtgttcacaaaggtgagcagtctgccgagacagaagccggcctagaaattatgcgtattattaatttatgattttatcaggaattttacatgcgttaggacattttcgtccttcaagtaggacccgccccacttcgtaacgacgtgtggcgtagcgtagtcgatcagataaaagaatctgatacgtccacagagcatacacgcgcagtggtcgtacagcatgatggctgatatctcgaattcctcgctgccgtcatcctcttcagcgatgtcgcgaagtccatgtctcggtgacggtgccggcactaataaacaaaatattaagctcattaaaaatgaggtagccatgaattgatctgtcccatttttcacgcaaaattatcggaatatttggattcagattatcggttttacctatgttgcagaattataaattacttttagaatgactcttaatacataaaatttccccgatcgtcccctcgtttaatcataatttcaccagtttttataacgcacattaaattcaaattttttccgccaccaaatcatgtcagtggggcgcctaaagttgcttattcttttgtgcacaatattcctagcactaatctttgctgatcgccccgagccaaacaaaggaagataacatctgttgtatggccattctgacaatgaaaagacgacaaattgacaaaagaaacaaatttttggagaactaaagtggatggggaaggggggggggtttagcgatcgggccatattccgctggtcatttctccgaatattcgcgccatgcagtggattaaattcaactgcacgctttgtccaattggacttcagtgtttctatccgcgcaagtacgcaaagcctgtgctttgtgcgcatcccagcgtccgtaacatcacggactttttgagcaccgggcagcttggcgaagctgcaacgacaacaacaacaacatttccgacaactgcggaaacggcggcggcgacagaatgcgcacctccgcccgcgcatttgaccgcgtggatcgcggtgtgcacagcgctggtggcgcttttggtgattgcggaggtctgttaattttgggaatttatccgctaaacccctattcctcaattaagcttgtgcgtgcaggattcaaagtgcgcaaatttttgaaggaccgcgccttcaaaaaggggatgctgcgccgacatcgccagcgtgagtttctcgctattacatttttagcaaattgtaattaacaatttgtacaggaatgagcgccgcaaggcgcaaccgccagccggcaagcgcaccgactccgctgattttgccggctatgttggccggcgtttctctgcgcccgacgggcgtcaatttgactgtggaccgggtgtgcaattttaattaaattaaaatctttatatattttaatttctcactcatcaaaattacaatttaaatttaaaggcagcggggcagcgccgcgcggatggtgcaattgaggagggcgaagagcccgtgtacgatgaggtgccgcttgacagcgacatcgtggtcgagatgcgcgacgaagaaaatggggaggaggaggacgaagacagtgatttttaaaggattcggcaagcgaacagtcaccatttaaccaatcgatcgatttttcactttaaaat

SEQ ID NO: 21794 - DNA, 1421 bp, Heterodera glycines
ttttaggcggctggggtttctggacaaaaaaaaatcaaggaaaaatccctgccaaatattcaagttgtttgaagagactccattttttacacattgacatatatttattggacataaaattaaaaaataataattaactgaccaacacccaaatgtgtgttgatggacgcataacgcgctgtacccgtcaaatttttgtggtccctgtatggaatgtgctgcttggtccgctggtcacgataccgtttggccagtccaaagtcaataatctgcaaaaatggaccaatatttacgttttttacgtctaaaagtgccaacagtagtcttacgtagacaagattgccccgcttgccgagacccatcagaaaattgtctaaaagagtgcttttttacaaggccgaataatgtaacatgaaaaaaaaagaaaacctggctttatgtcgcgatggatgaaatccttgctgtgaatgtattggatcctggccaactaaaaaaacattttattgtcattaagaaagaaaatgcatttgtagtattgtactactactgcttgtccaggggacaatttttcatgaaaaaattttaaaattaaaattctttaatactatgttgcctaaaatataaaccccattttgtgggttgaaaaatagaaacaccagggcttatattttataattacggtatgtggaataatcctcaacaatttccgttccaaaaaatacgtaatttatgggtgcaccccaaaatctcgccgccgaaatctcgccgccaaaatctcgccgccggaatctcgccggcctgaatctcgccggccgaaatctcgccgagacaaaatatcgccgccgaaatctcgccgcagaaatttcaaaaaaaaaatttcaaacttagaaatttttcaaggaaaaaattcttagaaaaatttttttataagaaaatttaaataaaaaaattgttgaaaaatttttcagcaattttttttttgaaattttatgaaaatttactgttttttttgaaaaattttcaaaaaaacttagcaaatagttttttttggaattatcttataaaaaaattttctaaaattttttcctggaaaaatatctaagaaataaaattaatgaaaattttcaaacaaattttcttcaattatttcaaacaattaatcatttttggactaaatcatcgaatattaatagaaattcagatttgattttcacatcactttttttcggagcgctttttcaaaaaacttttgggaaagaagggttccggcggcgccgataggcgccgccggggaaaattttaaaaatttgggtgtaatttgataacagattttcaacaaaaaaaggaaggtttttgtgattattaagctcaattggtaggattatcatttaaaaaatgataaaatatgtatcaatttaaaa

SEQ ID NO: 21795 - DNA, 1549 bp, Heterodera glycines
ctgataatgatgacaataataataattatcgtaattatcagtcagtctttttggccgtgaattcatctgctctcgcttttgcttcttctgctgttgtttctgtggataaacaacatttgcggaccgacttttgcggaccgacatttgtgactaaattatcaaaaaaaaagagaaaaaaaaaataaaatgaattttcaaataaattttcgtaattaccaaattgaaataatgactgaaggtgataattaaatagtgcttcttgctctaagctatgtcaatttcgacatactttttttctttaatcggaaaatttacccacaactaaacgaatttattacatatagtttattaggcaaattgattaataaaatgctttatacaaaaatcatatcacaaaatatatagcacgcaaaatttttcgtgtttcacctactagccttagtctaaagagcttagattttgatcaagcatacctaacaattaatatcaagaacaaataaaagatataaaaatatattttatatctttaaaaagcaaaattaaaatgaattactcacattatcaatgacaacataattcttgtaaatcaggaatttataaactaatgcattgcacaagttgatcagatcactacttaaggatgatatgaagtgatcaaattttttgcaccaagaggaattgaaaaaagaactttttggaaaaactttataaatttttcatattttcattcgcattaacttgcttaactccgaaaaatcacatataaaattcaatattcagatgatcatccaatttaagaaaaaaatttttttttgaaaattaaatccagaaattatgacccgcaaaagacggtccgcaaatgtcgcactacgttcaaaatatgtcattcttcttttttaccttttgcaatttgttgtctttctttgactgtctttgtttgtcacttcgaaacatttgacgataaattttggcacataaaaaataaatactaataaaaaacaaataataattaagaataaaaataaaaataatttattaaaaatgaaaaattgaaaaaaaaataataaacaaaatttctatgaaacatttgaattgcattataatcgaacaaacaattgcataaaaatggaaaattaaataataaataataaaattaaaaattgtaaaataatttatcaattttaaaattctaaaataatttatcaattttaaattaatttttgtttgccatctatagaatttggcgttttagtgccaaaataaataaaacagtcttctctttccccctctccccaatgtttggcattctgtccgcccgtccgtcttttcgtctcggtctctgtttaattaacttggcaaaatgtctgatgatggcacccccggcaatggcatttttggcatttttgctgtgttagcccccgcagcgcttaaacatacacacaaaaaagtggccgccgcatcaaatgacgcggcgccgcacctcggggcaaaacaatggcacaaaaaataggcggcaattagagagaggggggggggggggtggcatggt

SEQ ID NO: 21796 - DNA, 2137 bp, Heterodera glycines
  misc_feature (1970)..(1970): n is a, c, g, or t
tttttgaaatgaaatgaatttatgaggttttgcgaaattttaaaggaaatgtctcggtttttttgtccacaaatgggacctgaacaattcgtttttgcccgaaggcaattgtaattttggatgtcggtggatctcttcaaaaatcacctcgtccatcagtccacattcggtagcgaccttacgcacaagtttaacggcatcgatttgttctggtactttctccaacactgctctcttcgattttgcgataatctcctccgagtccaacacggcattgttgaccagttgggtgaccattccgatgtgaggcggcggttgaccccaaagaacactgggtgaggagttggagaaggacattgagtccccggcggatcgctcctttgtgttgtcattaaccaatttctgcacaagtagctctaggcgatccagccgctcaacaattgtggcgttgatcgacgggttgagggaggaaacaagcttttcaagacgattaagccgaataccgatatcatcattgtcttccaaaactggggacattcgacatcttttttgggaggattttggcatttgaatattttggagaatgaatattttggagaatgaatattttggagaatgaatattttttggagaatgaatattttttttggagaatgaatatggaaataaatgaccccaaaaaattccgagaaattgcaaaagaaataattaagcaataatgcatattttccccattgagaggtgtgatttgtttcatttatgtctattgtttttaatttgacacctattctgtgatttgacacttatttttgtgatttttgactgccatttatgttttatttttattctcactttttttctttttacaccactgttagagtgcatagcaccttgtggtttgttcgataaataaataaatatatttaatttgttattttttctgactcacatgccgtttggacccggacccggttgtaaaacttggacccgcccggctttcctgggcccgcaatacccgcttttttgagaggtttttttccaaaaagcacaaaaacttgactcattggctactcaaaaaccgcaaaatgaggctaaagactacaaatatgattgaaaacctaaaacatttttctttttcaacataaataaataaattatctgcatttattttgtcaaaaatttagttgatcaatatttcaaaaaagaaataaagacacgaggagaatgatatgataagtgttcgcgcaaacaaacaagtaaaaaattctgaagaaactttgacagcaagtcaaacaaatgctatcacttcttctgttgaagaatcgcaagagagtatgtttcaaaataatgataactaaaaaattattcaaaatctgcctaaatataaatgatcctaagttgaacatgttcgcacaatggcgcgttctacaatgagatttaaattcaatccacttaatgaagaccagcgtgaagaactgtgtgaaacatggttttacacatcagtaaaattttaaactaaaaagtagagtgccacgggaccgggaatttttgccaaaaccgggaccgggacttgccgggacctgagaagccgggaccgggacctcgattttttttcgggaccgggaccgcaagaaaaaccgggaaccgggaccaaccgggaaattttaaaaattcaaaaaaattttaaaaatttaaaaaaaaattcaaattctaatttatatcaagtgaaaataatacaaaattatttggttttttatttaataaattaaattaatgaaaattttcaaacaaattttcttcaattatttcaaacaattaatcatttttggactaaatcatcgaatattaatagaaattcagatttgattttcacatcactttttttcggagcgctttttcaaaaaacttttgggaaagaaggggtccggcggtgccgataggcgccgccgggggaaattttaaaagtttgngtgcaatttgtttacagattttcaacaaaaaaaggttggtttttgcgattattaagctcaattggtaggattttcatttaaaaaatgataaaatatgtatcaatttaaaaaaactatgagggatcatattttctttataggaaacccacgagtatacaaaaaaaaaa

SEQ ID NO: 21797 - DNA, 2031 bp, Heterodera glycines
  misc_feature (1212)..(1212): n is a, c, g, or t
tttttggagtttttttggcaatacttttttgtgtttcaaataaattttttgaaatttgcagggctattagggactatcaagcgcttttaaaatgatatcaagcttatttaatttgaatgagaaataaaaatgttatagcgtttgccaaagtggccggtcccagaaataaatatttttgatgatggccatcttttttcgaaaaataaaatttttatcggaggaaagattattttagggatttttggggtcggaaaatcgaatctgacattaggtattcccaacctgtcgacccccgaacctggattcaagcaaaaagttcaatattcaaatttctcattgttcgtatgaaaatggtttaaattggattcctgctcgagaatgtgtgccattgcggcaaattgtggccgtaaacaatttttaagatgcaagtcggactttttcttgcccaaaagtatgtccaccctcgtcacccaggaaacatgtctttatgactttttaatttggattccaacaaatgtaattcagtggtgacgcaaagttgtccccctccaaaaaatgggtgcagatccatcgacaaagtaccggaataaaatgtgatggtgtgtggcaatcaaatgcaatggagataagaattaactaacacaaatgcataattgatagtgaataaaaaataagacctggaactggaggaactgaagcaaacctttttgctcgtgaccttttttctatgtactataagtttgctaaccgaaaaaaatgaaaaacagttattcccatagatataattaaaaaatctcttaatttaaaagaagaaaaaattaaagatacaatagaaaagcttaattgtatttctattttttctatctgttttagtattttttctggatttaagaataaaattttttcaattgttttatagttatctaaaaatgtagtttttctgatatagagtcagaagaaaggaagagatataataaaaatattgatgatgttttttttccaattagagaaaaaaattttttttttgcaacgcgccgtggttgcccgacttcagctcggcaaatgttttggttgcgtgccatttgatcatgaaccaatcacgttggtaaatccacatgaagtggtgccattaatgcttcggacagtcaatgaatgaatgacacggcatttgccaaaatccatcaaaaatgagtcccccccgtccccgctttnttgtccacctgatgcaaaagttgcgcattttgccgctccctcagactctgatcgatgaaagtgcgcgactttttcggcaattcgatgctgccctttgtcgcctttcgttgtgccattgtctgtcggttctcctcaaaattggccacacggcggaagattttcacgcacagaccacctcctaattgagtgatgtttttgtccgtcacacccttcgcccccccccgcccccgcccatttccccaccaaaagtggcgatgaccaaaacgccctcctcgcgtcccatgcgtagtgctgttcgagaccaaaaatttcccgagactcgagaccgagactcgaccccgagaccgagaccgaaaaccccgagaccgagacccaaaaaacccgagactcgagacttttttcaaaaattttcctattcgcttaaaaatcgttaaaacattttttgctctattcttaactaatttttggttttttttttaaattttgattcaatttggtacaatatttatcatcgcacctattttggaatttttgacaaaagtgtgctgctaattgacacaaaatgaaccgacgactttaagcagaaaaaaaaatgtgaggcattttcaacttaaaagatttctaatgtaaaactcggttaatcacggaaatgaaaaagtcttttgaaaaccgacaccctagaaagtgatatttcttgatgcgattgaaaatttttcaaaatcagaacatcgggcttaaaaaaaaccagattttggggtctaaaaccagaacatttagcgaaattgcttcaaatcagttatttttaaaataattcgaata

SEQ ID NO: 21798 - DNA, 1797 bp, Heterodera glycines
tcctccctgctaatccttcttttccttttgggatggttttctcttccgctttatatatctctctattcctttctttcttttcttttcctccttctctttcttcctgttcatcccttccccttccgttctttcttccctctcttccatttgagtgggtgattctgattctctcttcctttttctcttcctcctcgcccctcactttcttttctgtcactctttttctttcctcatctcttccatttgttgggatgatgactttctcttccgcttcctcctcttcctcgtccatctcttctccgtcctcccgctgttcttcctcttccgcggcgtttccgcccgcttcgtccgccgtcccctccagcaccatttgcgcttcttccgccccttccggcactccgttcgttcctccgccaccgtccccttccgtccccagaagcaaagagtcgaaatgttcggccgaatctgcgtaattatcacgggcgaactgttcagcagaagacaaaaacttggacgaatggccaaaaaaagaagcggacgaatgaaaaggaagagaaagaagggaaaaaaggagcaaaatcagagggaagagaaagggggcggtaagaggagggcgagagggggaaaagggaagggacattcggcaaaattaattaatcagcactgataaaagggcgatctgaaaaggcaaaggcattgaaaaacgcaatgaaattggaatgaaaatgattttgattgttccaaattttggcattttttggtgcaagactcttggattggatgtgctttcaatcgccgcacaaattttacttttcttttccgcaatgcatgtgcttcgtcagtgtttatcagtgctgatcggtcagtcacctttcatcctccccccccccctctggtcatatccggatcactttcaccgtcattttcctttttcctctcgccgctccctttgttttccaatggaatgactcccggcattcccccccccctcgcgccggaatttaccacccaaaagggcgacccctcaagaataaactcgtaaaataaatattaagtatttatttaaaattcagatggatattattcatttgtaattggaacaatttaaatttaaaattggaaggaatgtttcgattgatttaaaggacatttgatcaatcattgagtcaaaaaaggaatgattggaaacgaatgagcgaaaaaagtgaaatgagaaagaacagcaaagaaagcacagaaatgtgagaaatgggaaggggagagggaattggcattttatgaaagcgaaagacgcaaaagacagtgggaaaacgatcacccggcacagcattcaccagctgatcagtcggtttctcattaaacttcatttggccaaatgagtcccattgatcagtttatgtgtctgtccctcctttcctttgatctttccccccccccctttttttggtttgtcgtctcttccaaacagtgaattcaaatgaagaaaaaaaataatggcaaggtattttgttcattttatagtccgtttcttccttcaaccaggtgcgtaatatagggtgtacaaagggttaggagaagtgtggaagttgtagtaggcacctttcgggtattttccgtattttgtaaccattgcatgaatagtaatgggatagggagagctcagttatcgccccaggacgactagattggattaagtttaagataagttatgctttattatttgcaaataaaatttaaataataattaaatgtaattattccaaactctgatatttttgtcacttcgtcctagcacct

SEQ ID NO: 21799 - DNA, 969 bp, Heterodera glycines
aaatgttggtaccaagttttcggtcaaatccccaagagaaaaaagagatagccattttttcgcaagaattttttcgttagcatttcaaatatcgtgtgagtgttggtagagccacactagagaaggcaaatgttggtaccaagtttgcggtcaaatccccacgagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggaaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggaaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaagagaaaaaagagatagccattttttcggcaagaatttttttcgttagcatttcaaatatcgtgtgagtgtttggtagagccagactagagaaggcaaatgttggtaccaagtttgcggtcaaatccccaggagaaaaaagagatagccattttttcg

SEQ ID NO: 21800 - DNA, 1889 bp, Heterodera glycines
aaaagaggcagcggagaatgacaaattaattccgtacttcaaaaatcagacttttgagcagagagtggccaaagaattggaagaattagcagggatttgtgagacaattgcagagacaaaagggaaaagggaaagtgcaaagacagaaaaggaagagaagaaaagggatgaaaagtcaacgaaagcgagaaaagtggaagaaacgcagtcaaatttgaaaatggtaaagcggacgacatttgaatggcaggaagtgaaaataattaagcccatttggatgcgaaggcattcggaactagagaaaagtgacgactccttcaccaataagatgccgccgaccgctggcgcattccaaattcaaaatttggcattttcatcagggacgatgaaaaatttgagggaggggaagaaaattggcagcagtgagactggcaagaaaaatggcctaatgagaatttggcgatttgataagtacagtgtgaaagtcgccggacaaatcatagtggaaagtgcgaaatggctcaaaacgtggattttcattaaaattccggataaaattcttttggattatcacatttaatttttcaaggacacacggatggaagccaacatttttaaaagccgtcacgccactagctgaaagccttgaaccccaccactcggatgccgaattcgccgttattttcacttaaagacgaggggaccgtctttcttagaggccggggatgtggtattagtgactttttgaccctttatttgattgtttgaatttgtttggcatagtgtttatttgaattgacctcaaatattttgtttttcttctagagtagttggtggattttagtggtcgtttgtgttaattttagccgttttattggtcgttgattgatttgtgtttaatttattttgtgttgactgaatttgttttaatttgaattgtctttttaatcatttgttggataaatttattttgttttggtgtttgtttttaaaagcaggttttgcctaatttcactgacatttatcccctcgtttacaaaatttggaagtgtaaaaagaagaaaccccgacaaattctccttcttttccaacaagacaagaaaaaagtcaatccgaaactcataacccaaattccttatattataaaaaaatatttatttgcctaggctcgtcgaaaaaaagaggaatttctctaatcaaaacagattttttctcgaacagagagccatgttaattacaaaaaatatttctcatctattttgactttagtgactataaaatctaagtttttttcttttagaaaagcatatattagtatttctgcattttgtgtgatcaatcaattggaaaaagggcaaagtgtgcttattgaaccaaaaaatgaaccgacggtaaggaatttaaaaaaaaaaatttaaaaaattacaattttaatttttcccaatttttctcatatttcagttggatttgtactgatgtttggatggacattttcccatctttcgaccgtcctaaacttggtctccaaatggcattgctttctttccgttttgatgttttggtggacaaacattttggtggaaaaagcgaattgacaatttggcgaccaatcgtaattaacaagggcattggaccaaaagcaatgctattagtcgattggaagcctgtggcacttccggaccgtccactgcccaacaaaatccgctttaaagaactttggattctgtaagaacatagagtttcgagtcgaggtcgttttcgcgtggcctgagtttttgaacttaactttttttcattgttcaccaaatccaacattatttgtgtcatttgatagccctaaatgtcctctattagcctgaaaaattccgaaaaattttaattaggttcaa

SEQ ID NO: 21801 - DNA, 2877 bp, Heterodera glycines
  misc_feature (2861)..(2861): n is a, c, g, or t
actggctcctaaaagtgtgatgaagaagcgcaaaaaaccttgccgtgtccgggatttgatacatttaggtacataatatctcctgactaagcattttcgcacggttcgcttgaaagtttagtaaagtgaaaaacaagttaaaatttgaaatttctaaaaatatgctggcaaacccactatatgtatgcctttcccggatacggccaatatcttacaaacaaaaaaaatgaagaaaaccgcaaaattaattaatttaatttacagaagatggaaaatttgcacattccaagctacaaaaaaaaaatttatcttttgaaactgatgatcattgtgaggactggataagaatcagccttttctaacttcttgagctttttacaaataatttacagccgtagtgtttacggatcaatgaaagtggaaagaaccaaaaaaaaaaaaatggcggcgaaaattttgaatctaaatctgttttcttaaaaacattatgccaaaaattagccaattgaaaaatttaaaaaattttgcggttttacaacaaagactaaattgcgttttttcaaataagcagttttgttagcgcggccgcaaagcaatttcaattttcagactcgcccaaagagatttcgaacatgccaaatgagggtccgtcccccttttttggatttccctcatttcgtgccagaaatggcaactttttcatccattttcccccacaaatttcagtttgcacacacactttcttcatccttcctcccatttgctttaccaaattcatgctcatcactttcgtcctccgctgcacaattgccactctcttcttccgcttcctcctcctctctgtcctcttcaaaacgtctcgaaagtcgtcgcaccgcatccctcgtgccacgactcatgcgaacaatgcgccggtcaaatgttggcggcgagttcggcgtacttgacgtgcaggattcggtggcggaggagatcggtgactgacggcggaggaggtggttgtgctgctgacccagcctcaacatctcgtcttcctcgtcatactcttccatttcgttgccatcctgccgttcatcaccctcatatgcatgagcattgttctgctgatatttcggctctgtctgctgttccccgggcgtgctccgtccgcctttgttggtcggcgtggtggagcgcgagctacgctctgtcaacgcgctaccactttcttccgccgaggacatcgactccacgccggatgtactgctcgggcactcctgttccaccggcaacagttcgtcatcctgttgaagcagttcagccacagctgctgtttctgcactttcggagtccgcttcaccgtccccaatggcgggcattcctcccgcaatttccttctttcgcttcatgtccaacatggctagcagcagcagctgacgtgaactgctctcatttggcgcaatgtaaagcaatgttcgctcaataggcatcaccggaagcagcggaattaggggagggattggcacaagtcgacgatcatcgccaaaaaagtgccaattcggcagacgacggaacatcggattatcgaacaacagacgattcgtccgttgttgctgcggtgtcttgctgtgtctgctgacaatgttaatgttactgctgctgctgttgttgttacccagtgacggatggttgggccaaagatggacagtggcaaagcaaatgccatttgatgaagttggtgcaactgcggatgattcttcgacattcgtttctgtcttgatgttgttggacagcgacggcgcttcgcgcgaattgagggacatcaatggcgagaagggcgtccatttggtggcaaatttctgttgttgctgctgttgatgaacattgaacaattgcctgtggctgctgttcagctgctgtttctgctgtccaaacagctcaaatacaacaaattcaggttgcttcgtcgtcgtctgttgctgtacagcttgaacttggggagctgtcgtcgtgctactgctgctgtttggcttagtcatcggaatgaaaagggctggcgcttgggaggtcacgctgttgtcacccacttgcgcagaaatctgtcttccgaaataattttgatgataaaagtgctgtggggtgtgtgttgtctgctgctgctgttgctgatccgtcttggcggtgttggcgatcggaggtgctgccatttttggggggttttgatcactctttgctgatcactttttttggtatgtgtgtgagaatgaggaattgaaggcaaaaatgagagtgatgagagagaggtggcgttgaataaaaatctggctgctctgtttatgtcttttggtgctaccctaatttttgttgtttgggtggatggagcgaagaaaatgtgaggctgatgctgtagatgaaccctaacaaaatgcaaataacaacaaaaaacaatgaaaacaatttgtttttttggtgatggtttgtactgctcgacgtcgtcgtcgtcactgtctgatgagcctcaacagcaaacagtaactccttcttctgttgttgttgttctgttgttgaacttgtcggtgtttatgcttttgctttgtgattagtctcaaccgtttatctccgttttgctgctcgttctgttgttgttggtgttgatccaatgtccggatgaactgctcctttgtctccctctctttccgttgatcctccgttctgtttgacgttgcttcttcgtttgctgttgttttcctcttccgtgccgtcgtcccgttccaaaattggtgctgtttctttcggatgtactccttgaaaatgatgagggtcaacagttgttcctccgtgttgctgctgttactggagctattgttagtgttgttcctcangctccgtcggacggaa

SEQ ID NO: 21802 - DNA, 996 bp, Heterodera glycines
atcctacaagaaatttaagcgaaaaatgcgccaaccccccctcccctccctttcccctccccgtgagtgagtgagtgagtgataagctgttagctgctgataaggccattaatcattttgctgctgcttggtccctttgctttttttgcttttaactgataagcttagtcagaaagtgtcgtttcatttgtacaaatatttcacttaatttgtttgtactttccttctctttctccgtctgtccgttgtccattcccacccaatttcccccctccccccgaaaaaagtccatttgtcccatttctctttctttcccacaaaatgcttttttccatcatttccttcatcattttcttttattcggtttcctctgatcagcaacaaaatgtgtcaccgttgcgcaatgtacgggcacattacgacgccaaaatggacacaattttggtggattgggaatggagtgaaattggacggaaggaaattgagggtgaaagggcgggagaggcggggaagagggtagggggaggaatagagagagagagtggcacagggagagggaggaagagagggaaggagagagggaggaagagagagagtggacagggagggggaggaatagaaggaggaagagagagagagtggacagggagggggaggaatagaaggaggaagagagagagagtggacagggagggggaggaatagaaggaggaagagagagagagtggacagggagggggaggaatagaaggaggaagagagagagagtggacagggagggggaggaatagaaggaggaagagagagagtggacagggagggggaggaatagaaggaggaagagagagagaatgcgacagcgagggaaggaagagagagagagagagagtgcgacggaggaagagagagagaatgcgacagcgagggaagaagagagggagagagagagagagtgggacggaggaagagagagagaatgggacagcgaggggagga

SEQ ID NO: 21803 - DNA, 1021 bp, Heterodera glycines
  misc_feature (1004)..(1004): n is a, c, g, or t
cgctttgttcctaatacttcggtgtttcgaagccattccgcttagggtatttgctgaacccattgaacggggctttgcaactgaacagagcgatccgctggtaatttggatagcgagaaagtcgcaggacaaaggcaatgaaagcggagaaaattcggagaatgggtaggttggcggacttctgttgtttgatgcatggtctttgttttgtgccggttttcagcgcgatttccatggctgatgagcttcttccgccgtacaatttcaccgccaacattctcagtcccggcaaagtgcgtctcgagtggagaacgcctccgctgccctcgccttcgtccgtccctttttacattgtgaatgtccgtcagctaagtgccaatacaggcgatcgcttccctccccaacaggtggacatttacttggcatttccttggcgtttgccgcatttccttggcatttcgtctaatcttcgttttttccttttcgcttcgcgtcgatggcactcattttttgctcggcaatttggtcgctggagaaaactttgagttcacaattcggaccgcgttggatgccgaacgcatttcgtcggcagctgccattgtggaaattgccattccatcaggtgaaatggagcagaaggaaacactgaccttaccggtcaaaatcattgactaactgatcagatagtgatttggtggaggtgggcaaactgatcgtgacttcgcgctttcgtccggacggaaacggagtggtgaacctcacttgggaagtgccgcagcatttgctgggaaagattcaatgtggcaacatttaagaatgcttcgaataatctaagagtttggttttagcctatgaaatgcgttatttggaagcggctcgggcgcaatcagtggcgatgccattttgggaaaggcttttctttcccggcacagcgccaaccgccgaaatttacaacatgaaaccgttgggctgacctcaagaacatattggtccgataatgaatntttctgctgctgttaag

SEQ ID NO: 21804 - DNA, 2189 bp, Heterodera glycines
atgggggtgaaaaatttttttctggggtattttgaggtgctgagcacgaatatgatgtttgttttacgtttcagaatttttggaattttttaaaaattcgaaaatatttttaatttttttggacctcaggattttgggttaaaatttgaaaattcatatctggcctaaggtttgaccaattttgattaaataaagcattaaaaatggagaaaaatcaggagaattttatgggttttatttggattttctagcataaatatgaaaaaagttattccagaaattctggaaaaattcgaatttccagaaaaaaattcagaactcggttctgaaaagtcattcttgaaaagtaaaatactacaaaaatccgcaatttttagccctattttataaattttatttcacttttttatcacatttttaaaaatagatacaaaaataaaagtgattttggtgttcgggaccacaagggggtgaccaggatttttgagtgaaaaaattttttcatcaaaaaccttcaaaaaagatgtctttaggcgttatttgggttgctgatcacgaatgcgtgatcagattttacttctgacatcgttaagaccttagaatccctgtgtgattggggattctgaggcatcattttttttgggggggggggcgaagttcgaatccgcgcggtgtatattattttctatgtatttttgggttatttttaatgttttaattcatttaaaagagtgtttttttcttaataaaaataaaattttttaatttaaattaaattgtttttttgtgaaaaatgttttaaattaaaataataatttatttacttttattaaagaactcctgtattttttaaattagaatttgtaaaattaatttcaatttaattaatattcaatccttgtacatttcaaactttctttttaattaataaaaggaataatttattttattttttaaaatttattaattacattcaatatttaatcttactttttaataaacgatttccttaattatttaattttaaaaccatgattgtaccctttttaaccattattgtaccattccaacaattattgtaccttttcgacagtggttgtacctcatctaatcacttttttacctcttttaacaattttgcacctcttctaatcactgttgtacctcttctaatcacagttgtacctctcctaatcactgttgtacctctcctaatcaccgttgtacctcttctgatcacagttgtccctcttctaatcacagttgtacctcttctaatcaccattgtacctctactaatcacttttgtacctcttctaatcaccgttgtacctctcctaatcacagtggtacctcttctaatccctgtaaggtcaacaaattttgaaaaacgggcgcgaagcgcccgactgaggccgcgaagcggcctaacaagctaaaaaacgggcgcgaagcgcccgtcttgagcctcgatgtggactaaaaacccctaataattttttaaaaattcaaaaaaatctctccaacaaattcaatcaatttgaatcgcttcacagcctaggtagcgaagctcccaaagcgcgaagcgctttttcccagctaaatagccgacggttcacgcacccgctagtatatacgttatattgacaaggagtttcgtttcaaaaactaatttgagcttaacggctaatgggacgggtctgaaactggtggaagggtcttacaactttttgaggagaatccgggaaaactatagaaaaaaattcagcgcggacgactgagtcccggggaccgatttctcactttttcttgcgtttgaaggcccctaactttttttctaaaacccgaattaaaaagtgcccgctgtgagggcactccccacaactgtcctctacatgctggtattttttatttttttattagagccaccccctggcctgcacgcttggctaattgaagtgtgctcaaaatgtacacttcagtaccaggcgaataactcgccaggggttgctttgaccgaaaaattgtttctgagcaaaaatgtgtagtatttgaaaggctatccaaccaagttttaaaatttcgaaaattttgaaaatttttcgagctaggcctaaaaaacggttttcgggtttttgaattttaggattttttaacgatttttcccagagaaacggataccactttcc

SEQ ID NO: 21805 - DNA, 1505 bp, Heterodera glycines
atacgcacatgggtggaagaagacggaaaattgaaaaatgcgggctgtcgggcacttaaggcttggataatgactcagaccccattcccaggcgataacgaaatgcacattcgctcgctgccttcggccgtcattattccatcgggagatcgggccgatcaccgatcggaacagctggaattagggcattcttcgagagatcgggccgattctcgtagaattgttcctaatcgttcggctgatcgtccggccatccgttaccgtccttatgagactaatcgccagggacagtacggtaacgaacgccgtcgggaattccgtctcaatcgccgctgagacacctgttggaccccacctttcggttcttgacttctaaaggcagggacgccttttctgattgttgagggatgttgtagaattttaattataatgactcattagtgttaattaaatttggcataatgtcttgtttcgcgttttttctcacttaaaattgtattctttgttttttctttccatctttcattccaatttttattatctggtaatttttattgttttgcgccgtccaatttcttttgactttaaaattgatattcgtcaaattgtttctcatcgatatttgtcttttggaattaaagtgtttggatttgacattggcctactctgtgtttggtataattgcgtccctgtcttaagtcagtagcaaaagtacaattatacgattacccccccccccaaaatttttaaattttatggtgaataccaagttttttcaaaaatcgttgaaaatttttttttttcttagaattttttatgaaaaactttctatgaatttttgcttgaaaatttctactttctaagaattttttcttgaaaatttctaagttggtaaattaaaaaaaaaaattggggggggggggggggggaacgaactgctccccgccgaaatgcccactctcacccggctgtggcgtggcaacgcaatgcgcataaattccgcccgcctcgttcaaaacggtgctgctgcgcaccgacgcggacagaggcaattcactgcctacggcacgccgccggcgccccgctctgtccacatatttccggcgcaattcggcagcatccatttcggaagcaatgtcctgaaagtcaatgaaaaccaataaatttaatgcaaatttaaaaatatcttaaaattgctgagttggcgaccaccttttttatggaaaaacctaaaaatttaaattagtaggttttagtttccgggacatacctgtgcaagggggggggggataagccaaagggtcttacgatcgaaaattgattttagtcgatcgtagaaaaatgcaatttttaattgaatttattaaaaaataaggcaatttttcgaattgcctataagaaatctttgattaaaatttctattttcatatttacgatcgcctttttcttttcgctgacttttttttctctccttttttcttctttccctcttccttccttcaccc

SEQ ID NO: 21806 - DNA, 1342 bp, Heterodera glycines
atgttttttccctttggtccttccttccacaaatcttcgctaattcatttttttgtatcatgaccatattaaatttaaggaaggaaattcgaacgtgcacgcggtcgccgaaagtctcgcggttacaagaactgaggaattcctgtttcgctttgttgagtatattcccttgtcatgttacctttttgttatggaaatgaaatctttcttatccataatcaaagaaaaaaattgttgattttcttttctgttatttattctttttccaagtagaaggctaaacatgacacaactatgaattgacttggtgaacgaagcctgcatatgaattccaatttgggtgttttgaatcgtcaaaatggatgcaagcttcgttcgcttagcggatggagcagcgaagttatcggaaatgtttattgtggtagtattaccggattttctagcctagaaaaacttttgggtgaacgccccgtgaaaaaatgggtgcccccgcagtcaaccgcctgtggcgctcgtcagacgtcttcctccgccctccgtctcgccccactacttgctccgtcttcgcatgctcccttttgcgaaatttttgcttttaaatggttatttattttggtactgaagtgtccattttctctgggactcagttgtcccagtgcttagatggcattggttcgagtttataccttgttttttagacttagctcatcaagagctttcgaatgataccaaatttgtccgaatttgagtgttttaaaaggtcaggaaccccccttttcacacaaattttcgagttttaaaccggttcaaaaaccggttttttggcatttccgcaactcgagacatatttttccgtgcttagctcctcgagacgaatcgattggtatataatttgacccattttttcacggggcgttcactacagttcacccgaaacaactttaatttagtttataaactcacttaattataaaataaatattcgttagaaaaaagagtgaaacaacacgcgaaaacgtcctggcccgatttttatttgtttataacaaaatgacaataacctcaatttttaaatttgaattttcctcttccatcctaaaaatggacaagggactaaaagaagacttttgcttgtttttataaaagtgtatacatacttatgtattttagcactcggtttaaacccttttcttcatggcttcaaagtattcagaatcggctttcaattcgattgaacaatcgccgtcttgggaaaaatcccgagaagccattcgacgaccgataaaaaagagaaagagcaagtgaaggaatggggaatttactactgctcagcgtttgcttt

SEQ ID NO: 21807 - DNA, 2583 bp, Heterodera glycines
  misc_feature (1181)..(1181): n is a, c, g, or t
  misc_feature (1227)..(1227): n is a, c, g, or t
agaaatcacggggctatataggcacgagatagtcgacactatgccaaaatcccctcgggggatagcaattagcaggagggattaacacaatcaggtttttgttaattgtttagctgaaaaatccgcaattaattccattttccccattgcccccggcaccattaaaaatcaaatgtcccgacccaatcagcaccctaatgagctactactaattatcatgatgatgaatgctttcagtgcccaaatccggcttaatccccctttcctttcccttctccacatgcaaatgctttacattgaacataaaacggagaagaagcagaacaccccgttcccccgattcatcaaatatcaccaaatttgcccccgctaaccccaccaaaattgcccccttaagctacaagcacagataataaattaattaattgttttgccgcccgccgtcgttcaattagcccatgccccgcgggcacaggggcgccgctgctttcgtcggccgcgcgcgcgctgtgcgccaacatttcgcgcacattggagcttaaatgaaggaaccggcttttcctcccatttgttgttgtttgtttttgtttgttgtttggcgttgtgtgtacgtaccaaagacgtgtgacggacgcttttcgaaaagaacgacgacgacggcttcttccaggggcccacaaaatgggaaaaatccactcactttcgcccactttctcccccctgggggggggaggcttttcctaataagccaacattttgccgcccctccccccacccggcttcatctgtcactctttgtctgagcaccccgggggcatcatcatcatattcgtcgatgaatacgatggatggaaaatgatgatgatgatgatgggggtgattatgttgcgcgagcagtaagcaagcacttttcgggggcatgggagaagaagcatctctctctctcctcttcagcaaacagaatggggaagaagcattcattgattcattgcaaatgctttttcttcgcgtccccattgaatggagaaaaaaggaggggcagggacgccctcgaggcaatttttgagggggggtaattatgcacaattaacggaatttgatggtgtaaagcgaagaacaaaagttggtgcagcaaacaagcggaatgtcagtaaaaactgattaaacaatatgccatcgcnaatattggacaatgttatattttcgtgggattaattatacgatcgnatggattaattacggcgcttggcgggaggcgttaattgggcaaatgcaattcaaacggatttccaagcaattattaccaatttaggtggctgcaaattaatgaatctggcaattttaaggcttcggcattagcaattccgatttatccgttaattagacactaattaggagggttctgctggggaaattgaggaatcgccctcgcactgtttttggcaattctcaccttcctggaagtggccgtcatccgtcgcatcggtgccgtcggtgtccatttgttccacgagatgtgccaacgcgtggccgatcagctcatcagctgttgttgatggtgttggcacaaattgtgtttgttgtgctaaaaaattggaaaaatttcgcatcgttccaattactgtaaatctctgatgattattattgtatttcaactaaaatattttgtttaaaattccctaaatttagtgattgatttagagcccgatgtgggacgggaccccgcgcgggatttgcgggatctcaatccccaatcccgcatttttttgaaaatagggattttttggaattagtccttgcgggagatcccatctgctaaattttgaattccaatcccgcagcggaatcagaaaagttgatttttttgaattacaaaatattaggtaggcctatcaaaatttttataaaatttcaaaggcttgccaatcaatgcttggcattttacccaccctcacattcgtcggctgtggcattttcggaagatgattttttgatcaattcagtcttaatttgttgttgtggtggagctgatgatgatggaggagcggaagaagaagatgaggaggaagaggacaaatttgaaagacttccaaaattgaggggcacctgaaaaatttgaattataaaataaattacacatcaatttgcacttccaaaaattttaaatattaaaatgaattaaaaaataaataaaatttaaattcaaaatgcaaaatgcaaaattaatttctgcaaaatataaattaaaaataatgtataaattaaaatcaaaatccaatttaatttttagtaaaattagataaagaaaaatttaaataaccgaaaatcatttgttacctgctgttgctgggccaacaccaccgtgccgttgttattatgggtgttgttgtcagcaaaatgttgttgttgttgttgtagtgccgccggtgccgacggtggcacaaattttgccgtcgttgcctccggcacaccgcctcggaggcgttccatcatttgctggaaagcggctgccacaaacagctgatcaaccaattgatgctgctgctggtgatggtgatgatggtgatttggcgtgctgatcag

SEQ ID NO: 21808 - DNA, 1556 bp, Heterodera glycines
caatgtaatatttgttaaatgtcattagaaaaagtaccgccgcggctggaaattgctcaaaatttaaacaaagcaattaaagatttctttctgatcagattctgcactgaagacgccaaaatcgagggagggcgtagggggatcagggatggacgaaacttcggcttcgagcttcggaaacatcgagttttttgagcttcagcttctgataaattgtcctggatttcgggagaaataatacacccacccctattttctaaaatatgaattacgtgaaaatatttttattttatgccgtctaccgcagttttactttaaacctgattttattttattcgcatttttatcttgctaatcctgtgatttcgtccacttcttttctcacttcatctacgatacttttattctgaacagtagtcagaataagtgatttatgcatgcatatctgatgaaatttatttatgtgataagtaaataaataaaaaatagaatttctaattaacgtgatgataatttttccaaacttgttttttggtcggcgattttttgtaagcaaatttggattaaaaaatttttaaacaggaatacaaaagataacggtccatttgcaccaaaaaagggggccaccatgtacggacaataaatgcacaatattcattatttttttggaagatgtacggacgggagccaaaggagattttcgccgggcacttctcaatgtggtttttatggtgctagtgcgtttcttaaaaactgccagccataaaactaaaaaccatgcacgtttcttaaaactgccctcacccctaatttcaagaaaattcttgaaaaattttgaaaacttgaaaaatatttttaaaaatttttggaatattataaaaacatgggaaaattaatttttattcgtaaattaataaataaaaaattatgaacttttctaaaaaaaatcgttgaattgcattttaatgacttgaaatttaatttctttttggagtttaaaacctattgttaatctattaaacactagaatttcaaaaactaaaaatttttaaattttaatacaaacttttttatatactttgtaaaaaatttaagtattaatattttgatagaaaataattaaagctattgaatgataccataaaatattggttgcagttgagtaaagttatgaattttttttacattttttatttagaaatatttcttcaaaaattctaattttctcttagaatttttcgttgaaaattttctttaagttttttaaaaaaaattaatttttgaaaattttttgaacaattttcaaggatggcagttttaagaaacgcgccagcacggtttttattctgtgccgtcgtaactatgactcatcgcaggtgacaatcaacagttgagcacatgtttccttcggaaaatatgggtgaaaaatagcgtcgaaaatttatacttgacaaatccttcacccaaatgattgtcagagtatatagcaattaaattcatttaattgctttgtttaatgttgagcaatttccagtcgtggcttttctttttcataa

SEQ ID NO: 21809 - DNA, 1747 bp, Heterodera glycines
ttaggccaagtattaaatgggtatttgtctaagccttcaactatatattgtccatgaacaacagtgagtgaacattattattttttcatttgttaagcatatcgataatgatgataaatgcgggaattcaaaaaaatgcgactgtttttgatttataatactgaaaaaagggcgtgaatgaccttagtatttattagtaaaatttagcgaaaaaccaaaatttttaattttataggccatttttataaactcttttaaatctgatccttttttgatgggaagcttaaaataaaccgtctttatagcgcgtgcaatttaaaactgtccaaaggcacattagtgttcttacatggtgcgaaaaagacaaaaaaaagggaagcgaacaattaaaaatatagaagaataccgtaataaatagaccaaagtttataattctatttaagtctagttttttttcttttcgaacattgatttgaaatatttttttgttctaaatgattaaaaaattacaacacaaagcctcaaagatcaaacattatgagaggggtgtcaaaagccaattgcttataatctcatttattaaattttaatttgtactttcaatttatgaataaaagggtcatgtgtttgtttcaaaaatatacgattaatataaattcccattacagcaaattcatgggcattggtacggcaccatggattgcattcctccaaaattgagttgaacccgaacacagattaaaaatgcgacactgagaaaatatgacacaaattttgtttttttaataatagattgatttttgtttctatacagcgtcaggaaattggccaatccttagcaaaaaaaaaattttgtattgtgcctaacaaaggagaggtacccaagtgacgctggaacttccgaatgaaacttacagggtaggtagattaccccccccccactttgtattataaaattttttttatttttgctaaatgaagcttctggccgagatatgaagctttttctttttgatatattaatacctttacaaagaatgaagagccaatgtgagcgtcggtggcctagtggttatgccttccattctttttttcttcttctgaagttcaattcccccaccctgcaaataattgttttggttcttttccctatccaaaatatttttaataaaaaatcaccaaaaggtttctagcacatctaaatttgtttttcctacccaaaatattttttaaactttttaacattaataaatttggtcttaaaatttttttcatttctattcaaccttaattttaactttcatataaattttaaaatttgatagttttggtagaaatgaatgaagcaaaggaatttgtcacattatgcaaatctaataattattagagagggaatttttatttgaaaaattctgaaaatgtgctaaaacccaaaaatatgccaaaatatgttcaaaatatttattgtaaattggaaaaatacagtgtctttatgtaaaatcccagaaaaatctctttctttaacattttcgccgcgtaatcgcaaaacaaatacatttaagatgttcgaggatcttgtaaaagatattaatatatcaaaaaggaaacgcttcatatctcggccagaagcttcatttagcaaaaataaaaaaaattttataatacaaaaggggggggggggggtaatctacctaccctgtaattttcattcggaagtcccaccgtcacttgggtacctctcctttgt

SEQ ID NO: 21810 - DNA, 649 bp, Heterodera glycines
ctctccacctcttccccctcacctctttttccccttctccctccctctcccacctcttccccctcacctctttttccccttctccctccctctcccacctcttccccctcacctctttttccccttctcccctccctccctccctctcccacctctttcccctcacctctttttccccttctccctccctctcccacctcttccccctcacctctttttccccttctccctccctctcccacctcttccccctcacctctttctctcctctctcctccccttttcgcccctttctctccaagtgttcgctcgttcgtttcctttctttctctggtcgctccatcgcttttcctctgtttattgtgtaattctctatttccttataattcgcgcacaatggccctataaaatgcattttgtcccttttctttctcagtttgactaacttccgttcgttccgttggaatgtttaaattcgtccactttttctgctcattggccacttttcccctgctgatctctgccatttgtaagtcctttcgccccctttgccctttaaagtccaattttcccctaattagcttccaattgcttttacttgccacacattgtgctgaacggcggcacttatgacgagttcaatgcttct

SEQ ID NO: 21811 - DNA, 1618 bp, Heterodera glycines
aaaaacgaaatgataataaaataatgatttttagtttacaatctttcagaaaatttgtaaaacatatttgaaaaaaacattttttgactaaaatttatttaaaaataaattaatatttattaaaaaagttttgaattgtagaaggaaattgttttaagcagagttttgaacaaattttggcattttttttttgtttttagcacataacaaaactgaaatggtacaatacgaccctataaataaaccagtgaagaatattattacagaaaagttcaacattttttttaatttattaaggttttttggtaacaaaaccagggttgcctactgaaaattgagtgcaatttgtaaaaggttttcatccaatttttttttttcaaaaatgagcataaatcagcaaagtttctcaaaaaacagctataacggctgatcgaaaatagctgtgcgagctgaagcaaaaggggctaaaatgaaggaaagattgccccaaaacaacattcatccctcccgagtggtggatgtggtctagtggctaagacaacggatccacacgtaaggggccccgatcaaatccggccttccaccccaattttataatagcagcaaagcagaatttggagccctgattatgatgatgaacatggaaaggatttataaaactccaactgaaatcatttgaccaaatatttggataaaaatgggaagaaaaggaagaagaacatttgaatgaaaaaaagaaaatgattaaaaaatattgtaatataaaagagaaaattctgcaaaaacaagaaaatacggagcaaaaaatggagaaaaattgaaagaaaaattggaagaaaactggggtcaaagcaccattatatttataagtggattaaaaaatggaattaaatcaaaacgccaaaaagatacaaataaaaaattgaaattatacaaaaaaagataaaaataaaaaggcataaaattaaaaattattaagaaaaattaaattttaggggtaaatattgatgattttttggcgttgtctgccccccctttcattgacggcatttctttcgcatgtccaactttttgtcgaccgttccaaagttgtggagatggcgtcgctgcactcgcatttcgtccaatctttggctgtcgtggactttgcgcgacgactcaagtgaatttgctgccgatgggcattaactgttagcaattgaattgggttcattgacagctctgaacagcgttgttcggtccgtgatcagctgatgttctgtttggtgccaattgtgcctcaaatggttgaaattgccggtcctttttttgcatttatttttgttaatttgcttctccaattcctttcagactgttctcgtcgtcaaattggcatgctgatgtgcgaagttctgttctcccttttcgatttcccttctccgcctcaatttgactacgccgagaccgacccaatgctaagagagtttcgagcggcgcttcaaaatcatccatatcaaaatagcacagaatctaatgatgaagatgtgctcctagagaataccttctgtaacgtattgaccatttaaaattgagcacttcgggtgtctagaactgaaaccaaaacggatgacaattgatg

SEQ ID NO: 21812 - DNA, 2152 bp, Heterodera glycines
ggggatcctctacgagttaacataaaaaacgacccctttcatccaaaaaatatgttatcagaacaactcaaaaataccaatcataacaaaagcgatcaaaatgacatttaacaaagcaattgccctgactgtttacaaccttttgccaccggtatggagttttagggcccttttatagaagtttgtgccattctttgaggcgaggtactccctcactggctactcgatccatgttgagcctccagaaatgcagaggaagaaaaaatgaaaaatacgactagcccgtataattgaatttatatttctgattattatttttaacgcctccttccctttttgaaggcaaaaccaaaattgacgtaaaaatcaaacttaaaaaatttctgttgggaaaaaaccaatttttcatttctttgttttttttaaagtttccgaatcgtcattttttgctcttgtttcgtttttaatgaaagttttccaaaatgaaaatttaaattttaaaacttgaaaacgaaaaagaaacaaaaattttttcttggacgaaaaagaaacacaaaaacaaaaagataccgttttcatacgaaaaaaacgaaaaacacgaaaatttcgcacaatttatcatttatttaatgtctttgttttgtaaatcatttctttaagtattttttgaattataatgttatttaaaatttttttaaatgaataaaaaattgcttcagcaaagctatttaaatcatggtttatacggcttgcttaaggccttaatattaaacataaatttaaaaagaattatttaaaaattagccattttttgttttaaatttttgcacaaatatattttttcatttatgggcagaaagtgcaaaaaaagggcatgatttccagcattctatctccgatcaaaaaaaaatcatacccatacgaaaatttcaatacaggtcttttttgcagtcaataataaacaggatttattcagttctatgattttcctgatttaaaaacaacctcaaagcaaataaaaaatttattcatttttaaaaattttaaataacattataattcaaaaaatacttaaatataatttatatgtataataattatatgcatttatgaatggaataattaaatttaattattttatttatcaatgagtttttttcgcatcgcccacactgagctatccattatttattagaatctctcaacttatgtaattatgtaaatcaatttaagtgattgtgccgaatgtgcgaatatggcccaaataagtgcatttattttttaaaaacatgcatttgctcatttttaatttcagaccatttttctgcaaacgggcaaaaactaattccaacgtttttaagtgctcctcaattgaatttgtatggactaaaatatcatcaatgtaaaccgttacattcgaaattccttccaaaattttatccatttttcgctggaaaacactcggtgcatttcttaggccaaagggcagctttagcatttggtaaagcccccaaggcgttacaatcccgcatttataggaactttctgaatccagcggaatttgccaaaaacccgacaacaaatccaatgtcgagtaatatttttgtccggaaactcttaaaattgttttgtccattcgtggaatgggatacggatccggaattgttattttatttaatggtctaaaatccacgcatgggcgcaattggccattcgattttttaactaacacaacgttgtgggcccatggcgtacaactctctttaattacgccggcttcgagcattttcccaatgtgcaatttcagctctttctcgtatttttccggtacgggatatggtttgacccgctctggcacatttgaatttgtcaaaatgggagggcatttaattaaacattccccgaggtcataatcatgggtggaaaaaacatctttatgtttttgtaaacataattccaagttcggatcttgctctgtggtttttgccttttcacgttcttttgccatttcacacgcaaatacttttccgtccgttttccgtataagtgcaccggtttggaggtccaaaaacagaggcaattgcctaagggtatttcttccattatcatgtcggacgacccttctcctccaattttagtctcaactacataa

SEQ ID NO: 21813 - DNA, 1927 bp, Heterodera glycines
tttaatgaaaaaaaagtaaaattgagcatttatttaagagagagatttttgtagttcactggtttgttcacgtttatgcctagcacacattgatccaggatcagtatgttgtatcaaggtaaaaagaacagatgaattttggcaaaaaagattaataaatcataaataaataaattgaaattaaaaaataattttaaaaactaaattgaaaatttatttacgaaacttcataaagataatataattaatattataaattcaattttcaatcttttcaacaccataattataaaaatgaaaataaaatttaaaatacttataggttctaatgattatacttgaattaaaatgcaaataaaaaattattagcgtttaaaatattaatttatataaattacgttataaaaattaccctaatattaaaaaggtaaatacattaagatttcgagacataaaaaacatcaatttaaagataaaaataaatctaaatcatgcgaaatggatagcttgaagcgctgtagttgaataaatggaggatgtaacgcttattaaaaagaaaattttttaaaattatttatttaaatcttactcccgaaataaaacaactagaaaacaattatcgtatttgggtttgactaaatgagcattaatgaattaaaggataaatttttaattgttctgatccaattaaataaagcatttcccactactaatgataaagtatttgctttatatgacaaaattattgaaacaataatttcctgtttaaaatatttatatcgtgaaataattaattcttaataaattaaaaacaataaaacacacatatcatgtaaaaataataataattctaatattaatttttaattaaaatcaatgaaattatgatcggtctaaaataattaaatcaggaccgtaatgcggaaaatattaaaatactgatttagtttttaaagacgatgcattctacggaccggtgggaaaataaactaactgaaataattaaaaaagataaatatatatgacacccgaatgctaaaatatctaatatctttatccaataagaaatttattataaatgagttaaaataattctttgttttagagtaaatatactttttaatgagccttaccatatataatccaaaattaaatgtcaaaaataagaaaaaactcaaatgaagaattgtaaaattaaattattattattttaacccaaacgattcacactccccattctaaaactcgaaccgatagctaaaaatttaaagattgattatacattataatagagttgagcggtaatcggtaattgtaaaaaaaccggtaccggtactgaccggtaatgcaaaaaccggtaccggtaccggtaccaactttttccaccggtaccggtaccggtaccggtaaaaaccggtaattttccaacgtaaaaatttttggacaaaatttttcaaatacaaaatttttattcagttttcgcgcgagtgcctgttttttagcattagaattgttcagaagtatatgtatattcaggttgaccaagttttttttttcaaattcaggacatagaacactaaaattcagatatagacctcaaaattcagattattgcaaaacaagggatcagcggccaattttccaattttgcgaaggggtctccggccatgtaaattaatgtaaatcaatgaccttttttttgctttcaacaccgctttttacgcggcacgtttttccaagacttttgggggacaaggagggccggcggtgccgataggcgccgccgggaaaaattttgtaatttttaatgcgatttgttaacagaatttgtaaaaaaaatgaccagttgattaagttttgggtttttaggatgcttaacatgaaagagaaaagttggaatattttttaaaattaaaattttaattaa

SEQ ID NO: 21814 - DNA, 2083 bp, Heterodera glycines
  misc_feature (73)..(74): n is a, c, g, or t
  misc_feature (81)..(81): n is a, c, g, or t
  misc_feature (90)..(90): n is a, c, g, or t
  misc_feature (1943)..(1943): n is a, c, g, or t
tttgagtgagaataaaaatttgtttattttgattttaagcgttactttcggatagttcggtacagacactttnnttaatcncaaatattntcggataacagaattatttattaaattaaaataaatatatatgctaaaagtcacttaatgatcagttttatgtttcatagaccattatttaaattttattctagcttaatttttaaaaactcaaacttttatttatttttttaattttccccgttctgttagaaagaggtctcggctctattgcagtttacacaataaacttatataattttttagccataaaaaattcaatttattaagaagtcgtgcatgtaataataaaattatcctatgaaagtattaatgggtttaaattctctaaaaattattcctgggtaagagtaccacgacaaattccattttttgcaaaatgaattggagatcattttaattacttaagcatttaaataaataaattgtaaagatgatttttgtcattgttcgcattttgaaaaattatatgtattttttaattattgttgcaaattatcactaacaaataaatatcaattgatgagtgtaaatcgaatttcaatttttctcttcattaattcatcttttcattccgaaacataaaaaagagtctgatcagcaacagaattgctgtgatcagtggcagtacagtgattgcacaatacgttgtcaacaataagaacacttcaatcacaccaattggcattatgccttcgttgtcacgacgacgaacgcgtcttttttgatgtgcttttgcaaaaatttttggagtttcgaattgtttaaataaatttttgctatttttctctacattattccaaccatttttgttaatggttgataatttgtcgagaagcgtttcaattagttggcttagcattcgataatctttttcagcaaatttaccattctttgatgaaaattccgtcaatatttttgaaatttcatcaaaaaaattgacaattgcttttaaaatttttcttttattgtcatttttctctgacaagaaattttgaatttgtccctcttctttcttcaatttggccaaaaattgctgaaaattcaattcaaagctttcaatgaatacggatttaattttgagaagattttcattcttggcattacgttcatttttaagaatgcataatttttcaaaatttgcattaatttggccgagttcgcttgggtagtcggtttgttggtcatttttgaatatttcgcatcccttttcaagaacaaattcttcaatttgcctgaatatatttataaattcgaatcgatgaaattttttattatattttttttgaactcggttttttcggtgcatttgcctgtgttgatcagttctaaaaattaattgactaataattaaaaaaaactgaaagttgctcattatttacttaccaattaaaattttcgtttgttctaaattattcgaattgagcaaatcaacggcagagtttaaaattaacaaatgcaaaattatattcatttttaatttaaaatagaaaatattgaaattttttctttaatgatttgaatataaacaaattattaaatgacaaaaaatgattgaaaaataatttcacaaatgtgaccggaaatacgctagcggaaaatgcgtcattgatttattgatacataagtaagatcctgtaaatttttaaaatctaattccttcacccttaaatattaaaagaatgaattctaatgataaaatttaaaagataataattaggtctggggtttttatgtgctaaaaatgctgaaatatgtaccaaaacccaaaaaaagccaaaatatatgctcaaaattggaaaaactaagtgtatttatgcataaaaatccaagaaattcattctttatcgttttcgtccgcacaattacaaatcaaatacatnttggaggtgtttggggataaacttttttccatcagttgagtaagtaccagcaataaagttcgaaatccggtgacgattaatgaagaattgattaggctattttcggcacagaaataataaagaaaattttgaaatgctaa

SEQ ID NO: 21815 - DNA, 1227 bp, Heterodera glycines
ttgtaatgcatgcctttttcatttaacacttacctttttcggctttttatgaaaatttcattcccgagatttttaaaaattctccagccatccccaacattcagaggataatgaggcagcgcaaagacttgcgtgttgttgtgatgagtgcttcgctgaaaaccggcaaatttgcccgttacttttccggctgtcgtaccatgcaaattcccggccgttcatacccagtcgagattaccgtatgtccattttaaaatcatttcgcttggctaattaccccccccccccctattttggttctccgattgggaccttgaagaagacccggaagtgttcattgagagggccgtgtccaaagccatcgccattcataagaaggacgaaccgggcgacattttgatctttctcactgggcaagaggtgccaaaatgaaaatgcttaaaataaaataaaattcgaaaaaggacgtcgaaattggctgcgaaatgcttgaggacgaggccaaaaaatgcggcgcaggccgcgaattggttgggttggagaaaattggctaattatgcatttaaagcgttttcttttctttctcagattgtcttccctctgtacggctcaatgcaacacgaccagtacaatctaatcaagaacacgccattcactgcaaatagtaagcgaatgaaagtgatcctttgaatttgtgccgatgcctttcttaaattctgccattgtgacaatttttgttggtcgttgtgttttgaattgctttcataggccctcgccgttgcattgtggccacaaacgttgcggaaacttcattggttattcctatttattaattatttccttttgaaaattagtgaatgtttaattttgttcggtctaaattcagttggtcaggttcgggaggtacgggtactcgaccaaaaccagacccatatatccggcttttgaacgaaaattttttatccgggaccaattttttctagacctggaaatacccaggctcggccaacccgtgttgaaataatatattttttatctggggaattactcttttcgtaacgcccacagacaaccgatgggacagaataatatgctctaattaaaaatataaattcttattaaaataaaaaataaatagtttgaagaataatccacctagaaaatccaaaatttgcttccggtatgatcccccctcctttctgagggggatgataatgagagaatata

SEQ ID NO: 21816 - DNA, 1425 bp, Heterodera glycines
  misc_feature (1333)..(1333): n is a, c, g, or t
atgcatggtcttcttgaagacggaaaatttgggacaaaactctggcagaggcagctctgtcgcgctggccagatcagatgagatggctttttgtgagcatcatggtctatggccagccgagtaatgccatagaattgtggaacaagtacaaagaccaaatgtacaatccgcaaggcattattactccggcacagcataaagcagcagagcttgaagccctagccgaccttgattggcggctgcacagctgctttaacttaagctgtgtgcattttggcctgccagacccgccaaactcaattgccaaaaatactgacgcggcaattgaagagtttttctttggcgatgatgatttgaatttgcctccagggcaaccaaatcttcgtccacagccaaaagcccctccgccacttaacagcgaccaacagaaggtctttgatgctgttttgttggcaatacagtcgaaccctagggatccgactgtcccccgccgtttcttcatatacggcgatggaggtacaggaaagacattcctgtttggccaaattattaggcgcttgcgaaaggccccatacacctacaaagtgcttgccacggcatccactgggtgtgcagccattttgctgccatatgggaaaacagcccattccacgtttcgtctgggtagagaagtgtcattagacaagctcccaagcattccgctggagagcttctttgcccgtcggattcgtgaggcccaactcatcatcattgatgagatcaccatgcttcacaacacggtgattgaggtcatcgaccgagtgtgcaaagagatggcaattcgccagcacaaggatctcctcttcggagggaaaacagtcattttcagcggtgacttcaaacagtcgctgccggtcgtgcctcatgaaggcttaaccgctcaggtgacagcctgttttcaaacatctccattgtttggtcaattcaccacgatgaaattgaccatcaaccagagattgggcaaaggtcagcaagcgtacttgcaaatgtgccgccaaattgggctcggagaaaccggagagcacttctggattcctcggcagttcctcgttaagagcaaggaagagctgatagactatgtctatcctaacttccaacaactccttggcaatgacaaggagctgctcaatcgtttgattctcgctccgcacattgacacgtgcgacgaagtcaacgacatcatgatggcgaatgtgccaagtcatatgcgggaatacttgtccacggataagccccttgacgaccgcccactggacatcgatgagatcgagtccgaagtggctgcgttgaaccngcgcacagactcgggcatgccccacacagtctccggcttaagtcggatgcgtcgtcgtcctcttatcataaagtgatagggaggactgatca

SEQ ID NO: 21817 - DNA, 1244 bp, Heterodera glycines
aaattttcaaggggggtcacttcccatatagtgccgcgcaacctcttcttcttcaagttaggctaaaagtgaataaaagataggaaaatcagaatctgattgtttggcattttatttttagcgcacattttctttttcaatcaaaaaacaaaaatagagatcgactcttaagaaaaacctgacctgtgtttacgaatggcctgtctttactttctgtataaaagtacagaaaaatgaaaagtacaagtacaacaagttgataaaatttgcctgttcctttaccagagacggtcgtagatattttagtagattttcaccaaaaattgctaattttgtggagttgggaaaaaattggtaattttctttacttttaaaaaaattaagggtaaatagtacggatggtaccaaaaagttaaaattcaaatttttgaattttttatttggtctagaaagggtcgaaatgattttttattagtgaattgtccaattttagtttgtttctcgatatgtaagccatttttagaccaaaaataaaaaattcgaaaatttgaattttcgactttttgctcgaattcgggttcggggttatacatagatcaaaattaatgccagattcggattctccgaccctaaaacccttatatgatcttttctcgaaatttttttttttaaattttgtttttcgaaaaagggggggggggggtaccatccgtcctattgggaccagagcgtttgggccccggggtcatttgggccccaacccaaaaattgaaaaatgtgcttttttaaaaattttctgatgggatgacaaaattttggagatgcgagttcaaaaaatcaatttcacattattttggagtttctccggggaatttctcgcaactatcgaatgaacccgtgaatttctgttaatttttacattttttattgttaaaattattgttgaatttatttttaaaatgtatattttacatttttatgctgaaatttaaaaagttgtttttactgtgatttttcatttttctgcacttggggcccaaacgaccctggggcccaaaaacgagggcccaaacgattacctaagtgcaatgaataacagaacgccaatgtatttattatcaaccaaaaagttttttttttaaagtttcatttatggcctgcctactcgaaatgaaaaggaggggagtaccatttgtagtgtctgtattaccatgttccttattgttttgatatgtcctcttaat

SEQ ID NO: 21818 - DNA, 2538 bp, Heterodera glycines
ggtaatgatgcttgagaccgaaaattttccgagactcgagaccaagactcttgagcaccacggctattcgggatgtaaatttgcattaaaaacttgaaaaaagataacagaattttcctaaaaaaaatctcataaactcatttaaagacactctcatctgatgttgagtgcaaaacagacgacattcgcaaatccccgcatcgggtcggggtgggaaccctaatatttttaaaaagccttgcccttatctccaagaaattatttttttaaatttaaattttttttaaaaaatttcccgctttacatcagcggtactgcggcggcagtcctcctgcgtgcgctcaatttgcgcgctcaaatcgtcgcattggcgccgccagtcgtccagcacgcgctcgtgcgtctcctgcttcttctgccactgcaagatttgggtttgcgcacgctccgcttccgcacgcgcctcttccgcgtcggccaacaactttaatcaaatttaaaattaagataaaaaaattgatttaagaaggaaataattatttttaaatacaattaattaaaaattaatttataaataatatttaaaaaaatatattttaaataacccatgaaaaaacacaaattataatttgtccttaattcatatgactgaattaatgaattcacaaaatgcattgttttaagcagaaagtaattagttaataaaaaccgtaattatattattacaaagtatttaaataaataatttaaatatttaaaaaatttttcattttataataaacgaatttacaaaatgcatttgtttaattagcatgtaattgattaataaaaaattttaattgattattacaacaatgaattaatataaagatttattatctaaataatttattttattttttaatgaattcacttttgaatttgttttctcgacagctgcaattttggagttcagttcagcaaggtggtcactgatttccaactttcggttcatccgacgacggcgttcttcttccaattcatcaacagcaacaaggccttctcctagaggaatatgtaatttttcacatacctaagcttcttataaaaaatgttttttttcattttgtaatttcgcgcaaaaaatgattaatttgagaaattttgaagggtcaaattttgaaaattcaatgggttttaattagttaattaattcgagaattgaaccggcggcgccgaaaggcagagaaaatttaggattgctggaagccaaagactttttttttttgctccactacccctaaatattttttaggattccgaaagtaatatttttagcagtttttcgccagaagttaaccacttttaggtcaaattatgaaaaattccagggaattttgtagtcaggcgtaccggactggcgccgagaggggaaaatgcttcaattttaattaaaatttgcttacgaaaattataaattgcttaaagcgtggggcgggaggtcaaaattaagtttgacacatggaacagattaattaatcataaatattattaattagttaattaatagtttcggtcggcaccttcgaatttgcctcgccattgtgccgcctccgccttggctttgctgagctgcttgagcagttcctctttgccctgcacttcctcgtcaattgcttcacggatttgctcaatgtcatgctccaacgctttcacattggcactgacctataaagaaaaaatgattattttaatttataaaaatgttcgggaatttttaaacaagaattttccaaaaatgccacaggcgtttagaagcaaaattagggcaaaaatttaaaaatttggagaaatttttaacatatttgaccaaaaatatccaattatgtggacccaaaatgctccagttggaaattaaaaatctaaataaatattgaaaacattgttaaaacctaaaaaaatattaattaaaattttaaaaatttttcccaacggtgcatattatgtttttacaccggacggacctccattcgttcttggtgctcctcctccagaattctcttcgcgtcttcaagctgtgccaatgcctgcgccttacgtttgcccatttgatttaattggctttccaattcctaaaatggaaacattttttaaatttatggtaattaatcttttttgtattgatcattattgtacattagaaatgttttcacctcactctgcctttcttggtcacttgcttcagtttgcaaacgagatttggtcgcttgcagttcttggataagtctgaattttgaatttaaatttaaataatgccgcataattcaacatagttaaactataaatttttatttaaaaagaaacgattttaatttgtcaaaaaataatagttactatcaagttttttttttttgctgtccaaatttaattatcaaaatttcaaatcaaatcaaattattttattttttatcaagaaaatagtgctatgcgagtttctcggtctcgagtcaataaatggtatagaatagcgtgaaattttcattctcgtacagtaacaca

SEQ ID NO: 21819 - DNA, 1222 bp, Heterodera glycines
taattagatatctcaggcttgcaaatttgcatgatgatcctatcagcaactttttttaaagcactaattagttgatcgtcgcgccattttttttacccaattttcccacaaatttccacgatttttgacactttttcttcattcaattcatccgtcatcatctgctctctgttggtgattgattttggggagatttctttgtgcttctgctgctgctgatgcggtggtacatcttctaatccattttctgcacttttcttcccccccccccatcccccacccaattgatcaccatatctctcatctgtgcatatcgccgtttttgattattcgcgagcgatttgctgccccctacctcccccaccccttccccgctttttcgtcctttcctttcccacccaacccattcggcaagctgagtccgtcctgactcagtcccagatacctgagaaaaccgaggctgcttagaaaaacgtctaaagtaagaaaagttgaaaaatttggatgggactcaattgatcgagtgagtaacaccattcgttcccatcgagccctctctcctccgcctcaattaaaatttcatttttttaaaattttatgctcagactcaatgtaaggaagaatcaattcccatgtcgttcctcatatcgctctcaattaaatttcactttaattttcaaaaaaaatccacgtcctttaacttggcctcaagcggcgggctggcaaagcctccccacccctgctgcccctaaaattaatttttttttcaaaaattttgctcctcgactgtgaactaaacgggcgggcaatccatatccgatccaatccatgcctatcatttcattaattaaaggttcattttttcaaaatttatgcctcttggagacttaaccaggaggagtgaatcctccccatcccctccctatcaattaaaatttgatttttttcaaaaaaaattcgtctcatctactgggacttaatcggacggacgagtcctccctcaccccacctccctacccccatcagttaaaatttcattttttttttaaatgttgctcccccctatgaatcaaacgggtgaatccatccccgacccgacccctccctcccccgcacattttcccaacactccatccaatctccaaacacatcatcatcatctacagatacacacacaacacacatattgcccccccccccccaaactgactcatcattcaat

SEQ ID NO: 21820 - DNA, 1869 bp, Heterodera glycines
ccccccccccccccccggcacattgtttcccctcaattagaagtggggtcaattggccgtgaatagcgaagaaattactttttcgatgagatgtgcgaagttacaacggcacggacggacaatcgaatcgcatcgtccgtttgttccttacaaattagagtctttcctccctctaatccgcccactctctcatcatttcccttataaacactcaaattctgctgctacggatttgggttgcaaaacgctaattttgagattttggcccccgcgggcgagggattagcgcagagtttgagaagggattaaatgaccaaaagatttgaaaaaggacggcggatgaatggagtgaggtgattaagtgttgaagctgaacgagaacaaacaatacgaagctgatcatcattcatttgtctctttcctactttccaaatttttttttgtataaatttaaattcgggcgtaaaaaattcttacacatgtagagctcaaatagctttcgggtgagctattgaatgtctggagaagtcaagttttcagtgttttatgattttttgaaatttaattattaatccctagggctcatatgagacggaggtctggggttcgagtccgcttggctgcagtttatttattttttgatacttgatgaaaagtcatagtcaaatcaatgatttttcaaaatctgagttcagattcgagatcagcgtattttttaccccagggaaaggcaaaaataaaatttttaactttattctgcagtattatcaaatttccagtggcgtaaggttataaaaagtcaggacaatacggattccggccggacctgcaacggttgtctatctttttttttgtccaaaaattctttcggatttcattcattataaacagaatgaatcgatttcaaattttgtcgaccattcataataattagggattctttttttaggcacaaaaaatcgcaaaaaaggcatcaaataggcacaaaaataggtaaaaaaattttattaacgctttttaggtattaaaacacgtaaaaatttaattgtaaatgaattattaaataatttaaagttttttccagataaggacaaatttttaaaacaaaaatttttattgagaaaagaaattaaattttgggattttttttttgaaaattttttcaattcttaggggtgtattttctgaaattttttttgggtcatttcttagggatatgtttttcgtttttattgcttttttgttaaggatttttcgaaaatcctgcaaataggcacattatgcacaaaaacctcgaaataggcaaaaataggcattataaaagtcatcgtagacatccgaaaccaagcggaaaatgcgtttcccgtgcttatctgtgagtatcaagtgcgcagaaattttaggcatttgcctaaaaaaatatccctaataataataataatcataatgcctttctttttccaccattttttgaattattttaggatttcatactttccttgttttgagctcatccaatcactgcctgggcatattctttttgctttttgaattgaattcgattgtttttctgtttttatagtcatggccatttaaataaaattaagagagcaaagcgaataatcaaagcaaaataaatgatgagatacgaagcacaaataacgaatgggtggtggtaattccgcgcacggccttttgcctttggtgccgccccccccccctttggcccttttcgatgcttaaaattcgttaaaaggcaattatttttctttcttttttctctccgtgcgcacttttcttaattcccggcattttacacattcaaatagtgaatgaatttgcttcttctctttcttctgttaaactgca

SEQ ID NO: 21821 - DNA, 2325 bp, Heterodera glycines
  misc_feature (152)..(152): n is a, c, g, or t
tcaacactgatagcactttattagagtcgagaccggtgatcttttttccttttaatttattttatatgataataagatttttaaaccaaaaatccccattaaaatcaatcatccttggcataatttatagacgtattgaacccaatgttatnttctttgaataaaaattcaattttttgactaaatcatgaaaatttacaaaaaaaaagaaaaataaataaaaatttaccagaaattcataaatttttggtgaaaatatgttacaaaatagaccttaaatttcaaaattcacccggcgctgcctaacggcaccgccggccccccaaaactcctattttttcttaaaaaaatttggcccaaaatcgaaaaaatctatcattttttggacaaaatctgttaacaggcccatccaaattttcaaaatttttcacggcgcctatcggcaccgccgaacccatttctcctaaacgtctttagaaaaagagcgccgcaaaaaaaagaccaaaaaaagatttatacagattttcgctgaaaataggccattttaaatgccttaggttgtgtttttaattaatactatacaaaatatttatgataaaaaaaaataataataagcacataaaattattattacgaaatttaaatatttttaagcaaaaatttataaagttttttgactatttggcataaggcaaaaattgaaaaaccccgaccccgaccccgaaccccgaacgatttggcaaccccgaccccgacacttccaaccccgaaccccgaattttcaaaccccgacgtcggggacgcaaccctaatttgaaattaaaaattcttgccaagaaaatgaatttttgagaaatttgttttattttcttaggagtgtatttttgaaaaattttgggaagattttctggactgtgggaggcctgaaacgcacgaaaaacatgtttttagcttgattagaagcttctatggtgcatttctacatccatatttttccatatcgcaatttatgtccatatttccgaaaaagacatttttagcaaaattttgtcgaaaaaattaattaaatttaaattttcttaaaattggttaatttatgtcaaaaataaactaaacatggaaaatttcggttttttggttggttttctctaaaaattgttttttttctcctaaaacgagtcttataccgtattcagccatttaaaatgtattttactagattttaatgaatttgaagaaatttttgaaaatttacccataaattcggaaaatttatgttcatatttttgccattttatgtccatatttagcgatttttggttcatattttgggaacgggacaaaatctcgcagcagaaatttcaaaaaaatttttttttaacttaaaaatttttcaaggaaaaaattcatagaaaatttttaataaaaaatttaaagaaaaaaatttctgaaattttttagcaatttttttttgaaattttatgatgattactgtttttcgaaaaattttcaaataaaattaataaataatttttttttgaaaatataaaattttctaagaattttttccatcatttttttttgaagcgaatatttgataaatttttatttgaaaaaagtgcattttaattcattttcgtgagtgtaaaatgccccaaaatttcactgaaaatctgttaaaaaatggtcaaaatttatttaccgaaattgagaggattttcttcataaaatacatttgatcactgatttgaattatgatcggttggtcattcttaatattaattcatttcttctgcatctgatcattgattttgttgttttgcacatcactcattttgtcagcagaagacggcccttttgtgatgctttgtccggattcttctgcgaatggtggcggagacaatggccttaattaagcgaaatttgaattatttaaacaaaattaaatgccttttttaattgctcacccaatgcaatcattggcattaaaaaaccaaatggacacattgttacaattgttgtcccaattatcatctttcttttgctgctgcttctcctttttctccccaataattttgcatcgtttcattatccaactgttgtccaattcattttcatttgctttggtcattgtcagcttttcctttgtccattcgttaagaaattcaaatggcaccatttgcattgacggcgcatgaacagaaaaatgggtaattgtttagatggtagcacaccttttttgacaaaattttttataagttttaaaatttgtaataacatgtcttatcggattttcggggtcgctgatcacgaatataacatcct

SEQ ID NO: 21822 - DNA, 2135 bp, Heterodera glycines
agttgtgtttcttcaggacacgaatttgcgaactccttccgacatttgagacggatgtttttgaattcaatttggaactcctaatgaccaatttagatcaattaattaattatttgatttgcgtctctcatcatttgcccacctgctcaaaatgcgatgcagaatttgtggacggattgaaaatcaatagaacaacaatgggaatcaaaagaaaattgagcaaattgcaaagaccacccattgaataaatgattagaaatggacaattattggtcaatttgctaaaagggagtgtatccggctaatgtgtggaaattggaaatgaaagcaaatggaataattaatgggagatcgatcgcagtgaaatgattcgtcggaataattaaaaataattgttttttttttgtgtatttaaccaaatccaggaaattaatttaaaacataggaatgagtatagaaaattatcaaaaagcatcatttactcaaaaatttaacaaataaaaaagtgaagaaaacaaatcaaagagtaaaaaaacatcgaaaaataaagaaataaaaaagaaagaaacattacgaacaaagaaaaaaggaaaaaacagcatctgaatggacaacaaagctgataaaaataatttcaacaataaggtatcaaagaccaaaaaacaattttaaaaaatttttaaaaagaaggagaagaaagagttcgatgctgaaatgtcgatccactaaaagtgccgaattcgtctccgaattggtctttcggcatttatcgtcctcataattagggatgcaatttttagatgccaaaaactgccaaaatagttaggttttacattctaaaaaaaccccaaaataggtgctaaaaatgggaaaataggtgctgaaaattccgaatttttaagggtggaaaatcgaaaattttcttcaaaaaaaaatattatgccaaatcattaatgagatacataaacaattctcgtcaagaaaaatatatatataaaagagatgttttgagaaatttttaatttcttaggggtgtatttaaaaattttgggtcgattcttatgggtgtatttttcgtcgtgccaggtgatttcgacagtaaactatttcgctttttttcactgtctgcgtgtgatttcgacaacgagtgaattcgacaataagtgagttcgacagtatcaaaaaaattgtgaattcgacagagattgattttgacagtaccgaaaaattaaaaaaacacgagtatattcaaaattggagcctaaaaatgaagtgatacagtaatggaaaaaggtcttgactcaggatgtttaaaaattgtaaaatttcaaattttgagtgaaaatttagcgcaccagaatatttcaatccactttatcattctcgtgaataagtcgcctgatcagactttgctcaaaaaaggggcggaaaaaagtcttgactcacacatgcaaaaccaccttatagttcatttacatgcttgcttatcttttggtcctcaacaaaaaattctcttacataaatttgatcagatcactccttcatggtgtcggaaccacaaactacgttaaaaatctttgaaattttcgaaaaaatttcctagggggttgggaaaatttcaatggaattatacttggttgaaaaatggtaaagattataaaggaaagatcagggagagcagaaacacgacccacagccctcgtcgaagatttttaaatcgtgatcctttgatttatattcgagcgtgctcatcagggatggaattcagaggcaccaaaaatttttcggaagtcggaaatcggaattccgaggtccaaaattttttcggaagtcggaattccgaccccaaaaatgtcggaagtcggaactcggaagtcggaatttttcaaaaattttaaatataataaaatttttaaatgttttattagctttaaattttaaaattcttaaccatgtaaaaggtgatttccatactgtttttattatatttctagatttatttgaaaattttttcaatgatttccatcaaaatattttatgtaattttacattattttggatttttttttgggacagttacacccttttttgcggcacgctttatccaaagaaaatttggggaactgggtggaggg

SEQ ID NO: 21823 - DNA, 1806 bp, Heterodera glycines
  misc_feature (34)..(34): n is a, c, g, or t
  misc_feature (48)..(48): n is a, c, g, or t
  misc_feature (50)..(50): n is a, c, g, or t
aaaacaaaaataaatcgatttttcaagtgtcgtntggggtactcaacnanttatggggagcaaaaatccaacgcagaataaagtacaggctatagtgagctatccggaaggattcggtctccccataaatctgggcgcatcggttcagggggactgccccgaaaacccaaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaaattttttagagcaagctagctcggcgctcatttcagtgtaagttagtcctttaccggggagtatccctgcaaagtttggtatgcttctgctcaattagcaaaaaatatgagtgatcaaactttcactaaaaagttaagcctaaattttttggcatatttaaaaagcaattaaaaaatttttaaaattttattcacctccattattgatagaaaaagcatcagagagccttattaacttgtaaataaaatttggtgcgtttcagaaccctttctgaaaaaatatttatgaattaattttgcaaaaaataaataaaaacgaaagactcagattttcgaaaattttttttgagccagctagctcggcgctcatttcagtgtaagttagtcctttaccggggagtatccctgcatagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgccccccccctcccacgcccttcagagcacgacaaatatttcaacaaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtctttttttcaaaataaacttttcaaaccccttttttcgcaccgtgaatggtatttttattgaattctgaaccggtttgagtagattaaactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcc

SEQ ID NO: 21824 - DNA, 1953 bp, Heterodera glycines
  misc_feature (29)..(30): n is a, c, g, or t
  misc_feature (101)..(101): n is a, c, g, or t
tttaatcctcgattatttccaaatcaatnnttcatcaattcttcatcatcttcatcaggttctgtcgatggtgccaaagtcaaacgaccccaaatttcctnttataagcaaaaatttttttgccatttcaccactcagactaaaataaaaaaggctggttttagggattaataggcgcaacaatttgtatggattttcatttaaaaaaaatgataaaaatgtgtcaattaaaataaaactatgagtaaccatattttggtcaaggagactagccactaggcaatccgccccaattgtcgtcgttacttttaaagaatatattaatatatttttaaaattttttccttttaactccaattttcttcactaatttttcactcagacccccattcttaccagtgcttgtttttcccggttgccctaccgggaccgggacctgagcttttcaaaatccgggacctcggaggaccgggaattcccggcccattcccggcccgctcaactctaatttttaaaaaatgcaaactttggccccaatacggaaaaataccaccgaattttatggagagcttaagttttaaattttataataaatttaatttggcgttatgttgttaataatatatttttttgtttgtttttcttatcctccgttccttattttgatgtttttttgtacacctctaccatttgataatcatcattttagggtattcttttaacatcaattttggattccaacaataaaatgattggggaagagcttacggatgttgacaaggttttgccaagacaaaatttcattaattttccaattccattttcaaatttttaggctcgcattgcgtcagacattctgcttcagtcgccgccgggcgagttcaacgaggtgttcaacgacgtgcgcactttgttgcagaacgacgcacttttggaaaagggcgtctgtctggaggcggtccggcgctacaacaaggcacagtttgtgccggtcaaccccgagccgggcgctgaacacccggcacgttttaggccgaataaaaggggggagggacggccaaaccggtgaaaacacgaaaaaattaatataaaattgaaatttcaatgtttttgccgactatcactttttaaaaatgccaactaatattaataattggttttttttggcagactttgatcaccgaacacaacgaattgccggacggacgtttcgtggacccaaaaacgggccgtgttttcaaatacgaccatttgcgaaaggaggcggccgatgcgcagccgtcggggcccaaggaaattgacgaaaaattggagccatggcgaaaggcactgcaaaaagtttgctttttggtactttctccaatttaggacactttttgacgaattttagtattatttaatgagaaaaaattgcggaaaatccaacgcgaatgatttgtccagttcatccacaatcaatctcaattgtgctttttgaggagttggacgagtacatttacgagcatttccatctgaccggcgtcgccactgttttcacgccgttgcagcaccaaaaagagccgaaactcattctatgcattgagtcccatcagttccagccaaaaaactattggtttgcatcaatgtaaaatatctgttgaattttcaaattgctttaggaacggtcgttggcgttccgaatggcattttcccaactttgacggctcttcaaaaacggcggggactctccaaaaatgcacgggcaaattgcgtttgcaggtgcactattatgaagacggaaatgtgcagctgatttcggagaaagaggcgacggtggaagtgaaaatgacggtgagtcacagcacaaaacgatggatcaaatgaaataatgggtaaaacaaaccgcaaaaattggggggaggggaagcagggtctaattagcgttttaattgggtcaaagccgagggcaatgaa

SEQ ID NO: 21825 - DNA, 1317 bp, Heterodera glycines
  misc_feature (32)..(32): n is a, c, g, or t
catgtcaaagaaagaaagtaattctttaaagnaaacaaaaacactttttaaaaattatttaagtgatgtggagatggtactgtatttattagagctcgacaatttgaaaaaacctggacttgagctggattcaatgttggacctgattttcatgcacaaaaatgcaggtccaggaaaaatccaggcttggacctggattttttttaatcttaaagcaaaccacatgtttgaaaaaaataaattaattgcttaataggaacatctaaaagtatctaatagacaataaaatgcgtttacccagcaaaagccaggcctggaccaagtccatgtcgagttttagtttttatgtaatttacaatttctgctcaaatcactttaaaagcacttttattgtatgagcataatttcgttttgcttttataaattttgggttttttgggtacggtgccaaaagtgatcagaaaaaaaaccgataaggggtcaatttttcatttatacaaaaatatttaaaatgatagtggacaaaaagagttttaaaagtaacatattatgccgaatactgcttttggaagtgacagttcagaatgttcccttgtaagtggtcaaacgatgatgcactcgctctagaccgtgtgtccaaaaccctaaacctaacagggctgggcgtaactggattttaattatggaaaatcgtaacccgtaattacgtagttttttaaataacggaaatacaatactcgttattatgggaggaggggggtcgaaaagtgccgtaattagggaatctcggaccatcaaaaccaaagacatttcccactctcgattcgcgtatcaccacaaatacacctaaataggaaaacagttcgatttacctcattttgattaaccagtgcttcgacctccttcctgttgtggtagcaaccagaaaaatcatacaaatatcgttgaacttttttggtgccattggcatatacagacagtaacaccaaactttcggcaattaatctcagcctcacaataatccgggaagaacggcacagttttaacgcatttgctctaaatttggaaagaatttgcaaaagtgagtgtcatcgttttaggttccaaaacctaaagcccaaaaaatgaaccgtattttgtattttgtttggtgccaaaacataaaaaaatgcctaaaaagcgaaccgttttttttgcaaattatcaatcaaacaattttaatatttttagataattgtcgttctgtatgtcgatttggccaaaaatattttcgtatcttgtttatccaaaatatatacccaattcctatggcaatat

SEQ ID NO: 21826 - DNA, 997 bp, Heterodera glycines
aaaaatagaatagatttaaaaatttgaataaaatacccgtcgttgaacgggtggtcgtacatgagcacgtcctccgcccccgttgctgtcgattggtgccggggctgtccttgctggtgcccagcggcaatgccatcatcgaagacggccatttcataagccaaaaaatataataataataataataatctactttaaaaatttaaataaaaaatgctagacaaaatagaagaattttaaaaaacaactgatcagagatggcgcgggaattccgacccgaattttgggctaaatttcaaaacaattcagatttttttttaattaaaaaaaacatttcgccattcaaaaatgttaaaaaatggatgaaaatctgttaaaggcgtgccttaattttggagttgcattggaccgagaattttagaaatacccggaccgggactgccgggacaggaaagccgtggcgggacttggattctcaacaggggaccgggaccaatcgggaatttaaaaaataaataaataatattcaaaaaatttaaagttatttttttaattaatcctaatgactagggctgcaaaaaatatgggatataaaatcgcgaaatatggtcataaatatgggacaaaacaaattgcgaatatggacataaaatggcaaaaatatggatttgtgcaaattgagtgtataatttttcaaactttcttcaaattcgctaaatataaagtaaaactttcaaaaatggctaaatttggtatttaaattcactttgaagaaaaaaaacacgataaagccgaaatttattaattttaaacaaaaaccaacctgaaaagcgaaattttcgctttttgtttatttctgacataaaacctaaaaattttagacaaaatatgaataaaatatcgaaatatggacatcctaaatcgcaaaatatggaaaaatatggaaatattgatatagaaacccattctaaaagcttctgaccaagctaaaaactaa

SEQ ID NO: 21827 - DNA, 1369 bp, Heterodera glycines
  misc_feature (1170)..(1170): n is a, c, g, or t
  misc_feature (1252)..(1252): n is a, c, g, or t
  misc_feature (1315)..(1315): n is a, c, g, or t
  misc_feature (1345)..(1345): n is a, c, g, or t
  misc_feature (1354)..(1354): n is a, c, g, or t
ttgtttatgttctgaacatagtccgctctcttcttttgctcgaaatatatgactggaaaaagtgagtttgcctttttatgtattaaaatttatttcccgttcacacgaccgttattttattttattttttttgcaattgataaaaaacaataattttcccagtgtcttattggggtgcactacgtttccgctctccccgctggttccgcccggacaaaaaatcgctgaaaaattattctttaaaattttctaataaacaaattaattgtaagattttttctttaaaaatttcttagttagtaagttttttaagattaagaagaaaccattttttccaaatatcttctttaatttttggtaaatcctaagctgactagcatcacaaattgttttattttaatgaataaaactaatttcttaaaatggtaattatgacttttcgttcagattctcccgtgaattcatttgcgttctgttggccagccttttgtctttctcactgaccgtccctcttttgtccgcccttccttttgtctccgaactttgtcaaatttccatcggcacttttttctgtttgcttttatcattcttcgcaattgttatttatgccgttgatcgacgcaacccaattttggattctcgaactggcaattccttttggttcgatgagctttccctcgtcgtttgtgtccatttcctcttcttaattttcctctctttggtggttaatccttcgaacattgtcagcgagggactccatcagccgtttagcacttgcaaagttacatttttattttttaattcgatcattaaaccttttttcagtctgatggtcagaatttgtgcaaatttcgcaattctttgtttgactttcattgtttgcccggcggaagaatcgaagattccgaaagtggttttgaatggtatgccatctgtgggactccatttcaaaaccggaccgaattttcagttgttttaaggtaaccaaatttaactatgcgcttttgagtcaataatgatttatttgcctttagcgtgttttgctttttggcttctctgctcctttaccaagcggccgctgcctcgggaaaaacgccacacttttaccgagtggtttatggccgttcagaaaagaagaaaaagaccaaatgattcatcaaatcatgcacnatatttttgatctcgttaaccaattggatatcattttctccaaataaattattcctcggcagaccttttttttgctgttttngtatgtttttagtgatgtttcgtaattatttcccgtaatttatgtattaatagcattttttanagtgtcgttttagagtcattcattttattnccgacatgnacccaaaggcgatgc

SEQ ID NO: 21828 - DNA, 978 bp, Heterodera glycines
tactgcggtctaaacacgtttttggtagaatgcggccagaatttaaaaatacagtttgctatgcttcgcatcacccgcttcaacgggtgctcagtgtaaatatagactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagcctta

SEQ ID NO: 21829 - DNA, 1378 bp, Heterodera glycines
ttcagattccaccaattacttcctcttctctttggcccttgccgatctgctagtttgtgccgtggtgatgcctttctccattttggttgagcttggcaatggtttggctgcgcttttgcacaaatgtctcaaatttcgaattgcttttcccccaggggttttgccgtggacattccgctgggacttcttctcttgtctcgtgtacacttatgccgatgtgttcctctgctcttgctccatcgtccacatgactgtgatctctttcgacagatatttgggtaaattctcaaaattatatttttttaaatgttggcatttgccgtctttcaaaagttccaataaattttcaggcgtttctcaacccctcaaacggcacaacaaacgcaagcgaattgttttgatgaagatttttgttgcttgggttctgtccaccataatctcttcaccgttggccattctctcttttgtggaacagcagaatattttgatggtccgtttaattcccaaattcatacggtatccatccaattgtatacggtactttccctgttcaggaaaatcgttgcggtattcgttctcgctttttcatgctctatggttctggtggggtcgttttttgctttaaatttttgaattcgctcccaattttgcacttttctcagtgttttcctttctcatccctttggccattatggcaattaccaccagccgaacggcccatttactgcagcgtcaggctcttctgttgagctccggcaattccttcggcggattgcgccgaattatggcaccgcagcgcaaaatgggcggacaggcgccgatgatgttcatcgccaacttcagcggggggtttgccaacagcagcacggggaggagcagcaatactacgacgacgacgaacagcaggtggccaaatgggacagaaggacaagccgaacaaagaatggcacgggagaggggggggggagggctaatgacccctcatttgtcagtgattagcgagcggagagtcttttaattgaaacaatttccaattttcagtggcagcagaagccggccactcccaaagccgatgaattgtaatctttcctttagtttatcgccttttaaattgaaagtgatcagctgatctgatcagtttaaacaattgacaaaggtcactcccatcgtttgtccctttgcgccgcttcacccctgcggcggatgcaaagccaaagtgccgcaaactctcccgcaacgatctcccgaatgggggaaaagcaatgtgccattgttcagcaacaaagaagcgatttgaactcaccgatcatcaaaattttgccagtcgcaaccgataggaagagagaaaagaggcacaaataatttaaaaaaagcggaa

SEQ ID NO: 21830 - DNA, 967 bp, Heterodera glycines
gggcaaatttgacgtcccaaaaacccccccaacaattcccaatactgaaattatttaaattaagaataaatcaggcattaatttcattttccatcaactttgcagaggataattaaaatttttgcgtaatttttaaatgaaaaatgggcaaaattgaaacgccaaaatccgaattcctattctcgcttttatgtctgcggttaatatggcaatttcccgattattaatttttctttttttcttaccacggtgttttgtacacgtcatggggtgggtaacggctgtgcgggatatggtaagtgccgccgagcacctcactgtatttgtagtgaggtgaatgccaacgctgttgaaagcttagtccatgttgattgaacaatgcacgcaatggcagctgatcacgatgtacagtatagaaggacatttttcggcgaaaggaaagtaaatatgtgttactgtgggaatgtaggttactgtatggaaaagaatttgcggattgcaactaatttttaatataaactttgttaattattttattagtctttcattggaatgcaaatcgtacagatttcgtgtgaccacaattacaaaatataattgaaggaaaccttctgctgattaagttaaaaattttaggctaaaaaaccgtgcatttcctttgtttaaatttgatgcacttttttacttgttaattcagtcaaacagaaaaaccgaggcataatttatgatatccgccttcagtactgaaaggtggggggaataaaaattttgaaatttagcattatttgataaaggatttaacaccgtaatgaagttttgagggatattgtgcaaaaattttgaaaattcaatctacggaataggtctccaactttgccgataagaattttttttaaaaaaaaagtcaaagaaaatctaataaagtgatcggaatccaactgaaatgttctcatattgatcagaaata

SEQ ID NO: 21831 - DNA, 581 bp, Heterodera glycines
tcggtttccatctgcgtaacgcatcggacactgcgcgaacatttgccgcattgcctagggcgccaattttgattgcatcaacggcacaattttcctcgtctgccaacagtgtgttcagttgttgttcaagaaaatcagaatgcggaacatgtactgcttgaacacctgactggaaaatttctcaaactaggggcaccttgcttaataatctattacaattaatcgtaaaaatgaaaaaccaattaaaagtcacctgaggactttgtgccgttagcattgtgatcactgccataccgtcggcacccaaggccgtgaaagttttaagatcagtttgaatgccggcaccgcctgacggatcggagccagcaatactcagcacagcagcacgatgagaggacattaaaaatctgataaatttccatgctggattaaaaaagagttttcttgcaatagagaaagtattccttcgacgagattctcgattaaaaacaaaattaaaagtgaattctattttaattgtctaatttgtggctcattagaaagaacaataatgccacattttttttattgttaattattag

SEQ ID NO: 21832 - DNA, 1537 bp, Heterodera glycines
gggctgggttaaaggaacgacccatgcgattcttaatgggaccgcattcgatccccagcgaatcgaataagcctttgatttttgaccggtccatctctgcccgctttgctggtgaactgtcgttgtgttctggcatgccaataatgacgacacttctctgtttttccaattcctccgctgaaattggcatgccttcagtggagagagcagtggagcggagttggaaatcgatccattaagcaggtcaatttgagaggacaaagtggtaattagggtattaaaaattggcatttggtcggaggtaaaagaggtctggagttgtttcaatgcttccactgtagtcttgacaaaagtcatttgcgagtcaattaactggtggataccatttttttgggaaattggagaatattcggtttcggggcagggtctttttgtcattgaatatttaaggcaaattgaatatttaaggcgaatgaatatttaaggcgaatgaatatttaaggcgaatgaatatttaaggcgaatgaatatttaaggcgaatgaatatttaaggggcaacttttttttcatctttccattgaaaatttgaaaataattacagtggagaaaaagcagaagaaaatgccaaaaattttggctttattatcgcgaattaaaatctcaggaaaaaagaaaaagacatgaacaaagttggcacacaataagcatttttaatttgctaatattattaattaacattcgtaaatgcagttaaattgaaattttaaaatttaaaaaatttgcaatttctacctattttcaaagaattaataatgtttcgtcgtttttttttaataatttttcaattaatccattccaaaatgtaaaggaatttaattttctgtacatttacaaattgtgcatttatcttttgagaacacattcataaaaatgaatattttaattttttaggtcatcgttttgccgtatgaagttttgttaaccccataaatttttgtgaacaaatccgcaacagaatgctcatttattctctgccatttattcaataaaatttttttttcatttttatctattacaaaaatcactgaattcagagcccaacgttaactttaaaataagagttaatatttcttaaatttcaccagtacttttgggtaaaattcgtcataagcctaagtttaaaataggaatgggaatttaagtcaaatgattttttttctgctggttcaaaatacctttaaaatgaattaaaaagcattttaattttatttgaaacttctgaaaagcatggcttttttctattttggcatttatattacatttttgcatttttatattttttcatatttgaaacaaagtgctgaataatcgagtcactggaaaaaaaagttatttaacttaataaatttccatccctattatcattccacaaattgaaaaaaaagcactgttaattactaagaccgggcccggttaattgtcgcttcggtccgggtagagaatattgattatttatttgaatttacgcgccataca

SEQ ID NO: 21833 - DNA, 1686 bp, Heterodera glycines
  misc_feature (29)..(29): n is a, c, g, or t
  misc_feature (71)..(71): n is a, c, g, or t
  misc_feature (99)..(99): n is a, c, g, or t
  misc_feature (114)..(114): n is a, c, g, or t
ttttttttgaacccaattactaaatttgncgctaaatgcacatttacgcgatagtgacaaagctgtcaccnatgagggcgcttaaatttttataagttntataatatattcatntaattacaatgtttaaaagaatctgtggaacgaatatgcgcggatcaaagggtggaggaatttggcgaaacggaaacattttttaaagtatcaatttcgtgaatgaactttttgctgtgcttcgcgctactttaaatacacaaattagtctgccctctgccgcgctctttgccgcgcggacttttactcataaaaaatgctttttttggtaaacaggcgggcccggggatccttccaagaccataaaaaatttttggacgaaattttgtgcgcaaaagacagatcaacgaacgatcataaaaatttaagccggcccaatttagcctgataatagaagggcacaaatctgatgtttgattcgtcgaattaaaaatatatttagaaagcctaaatttggattttctttaaatttcaaaaattttaatctttgaacccaataaaaaaagtaaatttctaaatttaattttagttagatcaaattggtctttgatcatttatgaaagagcatttaaaatggtatttaaggatgtctttttcctcaaataaatgcacaaaagaattaataaatatattctaaatttccttacttcacccttaaaatttaatttgctcttattttaatgatgcggccacgttccaaatccctttcaaatataaattttgaaattactcaaacaccaatctgccgtttttatctacgctttatggatgcgttatatggtagaaggcgtttatcaactcctcatagaaattttttcccaacaaaaatgaacataggtctttctcagcacttttttcattttaaaatatatttttaaaattttagaagcaaaacatgatcggatttttttgaagcgaaaaaagaacaatcgttgggtgaagattcgacgggtatatccagtattcatcttggcgttaatattatttaaataatttagtcgtcacgtctgctggataaaagaaataatattgataataaaatgaaaatcttttccaattaattaattaattattttttgttttttttggaaaagatgaaaaatgttgattaaattgtatttgtaaaaatttattcgcagataaaataacaaatttaaataattgtagcttacactttgaaggcaatatcaactaaaatgaatggtcaaataattaatccataatattcaaaaagagtacaaatcacatggataggataaacaaattagtttgaattttttcatcatttcatcaatttaaaaataagtacgatttgttgtatcggtggtataatggttagtgtgttttgtttaggacataggagttcaatgctgcgcgaagtagtgcaattaaagcaaattaaggaaaaggaaaaatggccaacaccgaaacaaatggtcgacactaggacaaatggtcgacactagggcaaatggtctaggacaaatggtcgacaactcgggggacgaattgggcgtaggctatttgagcgccaactggcgctcaaatggccggctgagcgctgggactgaaatgtcccggcgctcagatggccccagttacctgaccttacactacttatataatatatat

SEQ ID NO: 21834 - DNA, 1451 bp, Heterodera glycines
ctaatatgagaaaaaaatttacaaaagcctaagcttaggcttagtctaaccataagccattgttcgagttttaacaacgaaatttttagttaaaaactttactgaatacctgacaaaaaaaatagtttttctcttagttattagtacaactattataccatgagaccagggatggcacggaattccgatttccgaaaatttttggggcctcggaatgccatccccgccatggacacaaaatgtcatgggacgcgtaaagtgttgttgggacgcgtaaaatgtgatgggacgcgtaaaatgtcatgggacgcgtaaaatgccatgggacgcgtaaaaccgactagaacccattttttttgacaacttggatttttgtccaaaaaaatgttaatattggttaattaaacaaagactctcaagagcatcggtaattgattttattgactgacccttcaatttctaaaatttttatcaggaaatttttttttattacgtttacacctttaaagagattcaatatgggtcaactccactagtgctgagtcgttataaaagccataaaaagggcgttataaagaaacacatcaaattaaaatttttaacaaaaaaattaccgtaattcttgatatcattcgtagcccggtacttttctgttttgtgacccccccccctgaaattttcaaataaaaagtcatttctagggtaatttgtgccgatgatcacgaatatgacgtttatttttcaaaattccgaacccgaattcgaaaaaaatcgaaattcgtaaattacagggaaaatatatttttaggggtttttgaggtcgctgaaaacggatatgacatccattctaggactaattactaaactgatccactattgttgtaaactgaatactattatgtatgctaagataatctaatattttgacatcaaaatgaattaactaataaagactcgcacaaatccctactttcacgaaagaagtcacttttgcatagaggttcaagaataccgtcagtgcgtcagaattgatgaaagttgaattgcataattgtccgttagtttcatccatcgttttcttcatttcagcgtaattaacaaattcgcttataatacgtttatcggatcccttctccgccaaaatcgttattttttctgccgatttagtgcttatgtaattttcttttaaaaaattattgttgtgtatgtttttgtagaaattccattcgagattgccttctttgtcagtcaaaagagaatactgttttgggccgtcttaaacaacaaagcacaattaattttttataaaatttaccctattatatgatctttcaattttaatgctacattataataaacattttaaataaatataatcctcaccaaaggggccaactgcaaaaataaatttatactggccactcggataaatgacataatctgctttctcc

SEQ ID NO: 21835 - DNA, 867 bp, Heterodera glycines
tgccagtttttagcacctaaaaatatcattcctagttataagtagagaccgacttttgaggcatatgccttttttttctgcgcactagttacggtatattaagcataaagaacacattttccacttgctttgtggcttctaagttgacttttattatgcctttttttcctttttcgggattttcgtgccctaaatgccttttttggcattttgcagttttgttgccttttttagtgttttttttccggaaaattcaattaaaaatgcaataaaatcggaaaaatatacctctaaaaaatgacgaaaaaatttcagaaaaacatctctaagaattgaaaaattttctcaaaaattgatcaccaaaatttattattttttttcttgataaaaaattttatattaaaaaatttcttattcgaaaaatactataaatatttaataattatttaaatggctaaaattaagttttttgaataagttttacgtgttttactccctaaaatacttaataaaaaatttttaaatgccttttttcatgactttttcgggattttcgtgctttttcatgccttttttcaattttttggtgcatattataggtacctttttcgcgatttttggtgcctttttagtcggtctctagttacaagttgtatgcactaaaaaaatgcctaattgcgcatataatattcactaaaaatcccctaaatatgccttaaaaatccagaaaattcctaaaatatgcaataaaatatgccttaaaaattaccccaaatggcttttaaccctcaaaaaatgccaaaattgtgtaaaaatacagaatttactttaaaacatcaaaacaatggctaaggagcgtattttaga

SEQ ID NO: 21836 - DNA, 508 bp, Heterodera glycines
ggtactagtgcagttggtacgccacaaaaaattgttttaagtcctataaaaaaagtttcagggttttcgagggcgctgattatgaatacgacctctatttcgaccaattcagagtcccggactcaaattcgaacatttggtcgaaaagtcaaaaattctcaaaaatcttttttaccaaataaatatgatcaacaatacatatgtcaacaatataggcaattaattttcgcatggacaaattttttttacgttgatctgattaaaagcacagctattccactgatatggaccatataaaaaatttcactgcttaaaaacttctgaggaccattcgaatgccacccatcaggatgagccaaatcccaatagtcgatcaacggaaccacttgctgctgactaggttcggcccccagggctctattatagggacccacccgtttcggcgctcgcgtttcggcgccaaaaaaaattataaaagtttaaatacttggttaaaatctacaaaaaa

SEQ ID NO: 21837 - DNA, 1753 bp, Heterodera glycines
tctgtcgtcccataaatccgatttgcaacattagcaattactttggcaatttgattgggccgattatttgcttgttgagaattaagtgtaagaaagacaattgcaacaatcgcccatgggttaaggtcactgctgaaggctagtacagtgatacaaagaatagcaagagcgattaataaagcgtgaattgtcgaagagtcaattggcgttatggcacgtcgtcgacggctgaatttatcattgccaagagaaaccgctttcttttctgtcacttttttttgtctatctgacgaagccgtgtgcttttggttttttggaattgcttgatttttagctgccttcgttggagcctttgttttttgtgccatcggtgtgttaagtttcgtccgtagcttaggtgaagattgcttttcctgagttgatttaacagatttttaggaaaaatgcaagtttttcgctcatttttgaatatcgaaaggaattagtggttctgggatgccgataaggccggaggaaaaattttgaaacgaattttcctcccatttttttatttgcttaaatttcgtcaaaaagtttcttcattattgttgttgagcccatttttagtatgtttcatgcccgtccacggtaggaatggggtgcggggatccccgtttcctgggataggaaaaacggggaacggggatgaaaatccttccccccccgtccccacacatcctcactcattagaattacctctggattagtttgagtagctttgtcttggtctgatttgcgaactctttgcaaaaaatgtgtccaaagccccatcattaagcccactaattgacttggcattacagtactaccgttgtttgccaccgtactcttgccggttacttttccaattgcttctttttccgtactttgctcaattctctcgtgaattagctttagcacttccatcgcttgcccatatatttgtaaccttacagactttccttgctcatttgcctttggaaatatttgtgccaaaccgtccatcccgccaattccaactttcgccgccgtatcctctttatttttcatcgttttaaatgttttatccaattcattgtccaattcctttaagccttcattttcgcttatttttccattgctgaagttcgtcataagatcagtgttgagtctttggatagtctttgcggatttctcatcgactttgaccagttgagattcaatttccagtaatgagtaaaccgttgttaatgtttcacttaaaaaatgaatattcaatttgaaaaaatccaaaaatcttttttcactaaattataatttgccgaagtaaatttttattccgacagtgccgtaaagtttttctgaattactcgatgccgcaccgaaaatcgactcgagtgccgatattcttgatcatccctactgcaattattccttaatagaattttatttgcatctacaaatgaccgaacatcacataaattctgtgttcagaaatgaattcaattaaatatccttttaaataaaatttggtgtcctttcggtcatgccggcttcaattatgctcgtgattagcattttgccaaaaaaccgcaaactctactagggcagccagattcttagttagcgctaaaactatcctagaattgtttttttttgttgtcagatttatgacaccttttggggtggggtgggcaataatcgaaaaggtgctagcgcgtttgttaaaaactgccactcatgcgcgtttgtaaaa

SEQ ID NO: 21838 - DNA, 539 bp, Heterodera glycines
  misc_feature (490)..(490): n is a, c, g, or t
caaaaaaagatgcctcagaatccccaatcacacagggattctgaggtcttaacgatgtcaaaagtaaaatctgatcccgtattcgtgatcagcggcccaaatggcgactaaagacatgtttttggaagatttttgccgcaaaatttttttcactcaaaaaccatgtgtacccccctcccccccccccccccgcccttcaaaattttgaaaaataaataaaataataggagactcgagaattttgaaaattttttataaaaactgatgacaagctaaggtgataaaacaggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacgtgtaaataaaatttggtgcgtttcaganccctcttctaaaaaaatatttaagaattaatttgcaaaaaataaataaa

SEQ ID NO: 21839 - DNA, 2161 bp, Heterodera glycines
  misc_feature (72)..(72): n is a, c, g, or t
gcaccaatgttaggtcatttttgtgccctccggctggtggcacgtggtcatcaatttggacatgacaattgnctgtcacacaaaactttgcttcggtcgtcaatttgccaaaagtttgtgtggcatacataacacattggttttaatcaccaaaaaaaaagaccgcttgtatgaaatatgacattggtacacggattgattcgtccttgtacccaggggcgcacttgggaactggcccaaaatgtcctttgaatcagtggccataattctcctgacaaatgaattgcacaaaaaaaaatacttggctttttgaggaattgaaaaaaaaaaatttttttttccgttttcatttatgtcctttttgcccaattgaaaggtttggccaaaaacggtgcgcacgcgtcgcgcgttggccgtccattggctgaaggcgttgaagcgcgagcggcccgaactgatggcaacaatttgcagcatcaatcgggagcgtggcttcaccatcccatgggacgacctcagcgaaccgtaaataatttttgcacatattttggcaattaggggattttataaattttgttttgacatcctaagattttttttttttgcattcatatttttcgcttcatggtaacgacacgggccaaatgaagcaacacaaaacttgaacattttgtgaaaattgagtttaagagggaaactttagtaaaattctataatataaaaactgtccaatttcgtttttgtgtcccttaaacttcgctcgaattgggtaaataatagcgtataatattaataattcagggaccaaaaaatggcattgcatttctttttacaaatattttttcggaaatctttttttcatttcttgtcagattcgactcttcgtccagctcttcatcgtcctcctcctcctcctcagatgaagcggatgaatggggggcggccaacacaaatgggaacagcggtggtagtgcaaaacaaattcagcagcagccgaggatgacgacgacgacgccacaaaaatatttgaattgtcacaatttgcacgcattttcgaatggaaatgggtgcagaaatggtatttctttaatttttttttcaatttgtttacattgtgcaccgtaaaattatcccgtgtatagactttataaaatagagaaacatttacaaatttgtcaggtgtgtcgtgttcgtcaacgcgagaaaagcggaaaaaatgctgggattattccgatgccatggcattccatcaacagcagcgtcaaccccagcaccaacactcaaagcggaatgggggcgaaccaacaacaataacaacaacaacaatgcatgttggagatggtggaggtggagaaattggcggcacaacaacaccgaaaaagttgggagcaatttgagttgttttttttgggggggggggggggcaaatcatgcaatttcaccacccggcggtttttcaaacaaatccaaattttaggcggtgtttttaaaaacacttataacctctgcgccgcgcggcgttggcaaatcgttgaacacaaaacaatggtgacggaaaatgcacacacaaacaaactcaatatatagattcgttttttgttttcttttctcataacatgcaaataaagagaattattgtagtagtaataataataataatatttacggtgttgattttgcggtatgcaaaaaatgaatttttcgagttttctgcaacgtaaaatatttatggccaccaaaaccggggtcacccaactcatccatccatacccaatcaatccatccatgtacaagaaatgccgcgatcgatcgctcctaagtaaattgccatgacaacgaccccacatagtgtgatcacgcgccgcaaacattggacaattatgcaccagagagtggtgacaagacgacgaagcattggaatgtttcaaatttcaacccccctgattccgaaacaattgaatcgccactttcgcaacaaatgttgattataagttacctacatatatataacaactgccttctttaaattatgtaagggcatagttcttcatttctttttcttgccgcaatcgctgattgggtccaacccaaatgatccggtgggggtcgattgggcgccgccgattgggcgacgccgtttgggcgccgccgattgggcgcg

SEQ ID NO: 21840 - DNA, 1107 bp, Heterodera glycines
aaatcatctaaatttaatttttgtttatgcggggtcaaattggttatgttttagaaattaatttatttgtttatgatttctttacaccaggcaaataaataaatgaacttcaatattggctggtccacgaatgtcaaatttaaatatttgtttgaattggcacttaccgcaaacgaaacgaaattagtgaatcccaaattggtcaatttgttgtccaacacaaagttactaagtgtcccaacgcaattctccgtcccatttttttgcgagataattctaaaagttgccgaacgaacgcagcagcgccaaagcgaatcttaatggagtattaattattgctgttaattagtactaattaacaattaattgttgttaatatatatattaactattagtaattttgcaccttttttcgaagtatcgcaacaaatgaaaatgcccaaccatttctcattgtcagtgcctccatttttcgtttttatttgtgccactattttccatggtaatccatttatgtacactttttcgctgtaccgactgctcccaacctcctctcgtgcaaattccgacactttttcaatgtccagcaaaagtgtgcccttttttcgatcagaaatccgtccattagtcgaaaatggcattgggaaaagtccgtcggaaatcccatgacaatttggaagggatttgaactgataaacggcgatcacttcatcttttgataaaacaccgaagggaactgtaaatatgtattaacttattgaaaaataaatttaaaaaaacatttttaaaaatcgccacaaaaacaatgaatagtttacggcatctcatcagagaacgagtttgaaattttgacttattttttaccaattttcctcgtaaattccacgtttgacaaaagcggaaagcgaattttgaacagtgccgggccaagcatttgacggcgattctctgctgaacaatcaatgccattttcacggcatttttcatcggcccaacggagtgcctttaaaaaaatttaatggaaataataaatgactaataaaattttagtttttaatttaaattgtaaaataccgcattcccaaatgaatttctcactgatttgca

SEQ ID NO: 21841 - DNA, 985 bp, Heterodera glycines
  misc_feature (15)..(15): n is a, c, g, or t
  misc_feature (875)..(875): n is a, c, g, or t
  misc_feature (945)..(945): n is a, c, g, or t
cgcagtgagaagganatagttgggataaatttgaaagaaattttccctcaaattttcaaaaaaaaaaattttttttttacaaattgcatctaaaaaacattccgggcagtttaatccaaaaactccaaagtttgtcttgaataattcgattgataaatgttttttttctcatggtaaaatcttatcttcggttataaatattacattttatctaaatatcccgaaaaatgcaaaaaataaaaaaactttttggcacgcccgcacaatcgccgctcggccctcgtcatgggccaaccgtcgcaccgccacctccgtcggaacaccaccatttcgattcggctcttctgtggttgtgcgtcttttggcggtgttcaaatggtcgcagttggcaccgtcgtcataaattgtgccatcaaaaactggtttcccattttttgccgtcgtcggcgccgtcctcgccagctgtgaccaagagtcactgaacgtcacccggccaatgcccgccttggcacagtgccggaccagcgaacggacaaatgcctaataataatattaaaaattatggcaaaaaatttctgaccgaaaattttagttttttcgacggctaaaatgggtgacttttttgtcataataagtgcacactcatcacgaatttgacacccattttgaccaatccctaatccgaactcgaacgaaagccggaaactcgaatgtcaattttttcttcaaatttaacggaaaagtggaagactttcattcattggtatcgcctccgagacctcgcgcacccaaatttctcatttttcaaaatccacaaaaatatcatttttggaatggtcgcacagggcgcccccctccccaattcaaaatcttgngactgactatctctctgcacaaacacacctcgttgatgtaccgtcggtcgtccaaatggaatgcaatgtngtggggcggtagtggcgcggagttcggcttcgtctttatt

SEQ ID NO: 21842 - DNA, 329 bp, Heterodera glycines
catagctcgcttcactccaaatcaaactgaccgaatttgatatctaaaaattgcttttgaatagaagaatcgtttccaagagaatgctaagcaatttatttcatatgaaaaaagttatgagcctttcaaatttttatcacgttataactcaagtcctaaactgctgatttcaaccaaaatgcgaaaacatcatttttctattgattctaaataatcaaagtaattttgtatccttctaacaaaactattagcatttgcgaatttatttatttttatatgttagagacatgaaaatagtacgccaaaaggagagaaaaagaaatgtaaaa

SEQ ID NO: 21843 - DNA, 1501 bp, Heterodera glycines
  misc_feature (1480)..(1480): n is a, c, g, or t
cattttcgcttttattttttattcattttaatacatacaataagtacagaggcatacaaaactatacatataaatatattcattcggcaatgagaacaaatgagcataaaacattacataaacaggtcaaacatcattatgaaaaagccacaatatattggcatatttaaacagaacaacagccatttgtgggataaatacattcagcaagacaagcaagacaatgcaataggatatggccaaaatcgtgaacgttaaatgaaatgggtgacacaattagaagccagaatgatggctaataatcaaaatgagaagaaaaactgggaatgactttttgactcgaagatgcggccatgattgtataccggttgtgcaggtggatgttcatgatcacgagtttgtccgggatggccggactgacactgatcgttgttggcatgcacagccactgcacggaaggcagtcgaagtgagcacagactgaactgatcgaaagtgagcactgacaattgggggaagtgccaagggcaacaaaatggacacaatgccaaattaataaggccaatatggacaaatgaacaaataatatggacaaaatatatatgggtggtcaaatggcaccgatagtgtgaaagttaacgagacgaacggcacactgaattccttcttttctcatttcgataattggcacagataagcaaatgataaaaaagggtcgcaattttgtccaaaaagactcttttggaatgatgaaaatggacatcaacaaatgaaaatgattaaaaaagcacaaagtgatcgatcggagggttagggccaaatcgacaaaagcccccgcccctccctttccccctccgcccttttcagtgccttaggcgtcgtcagcaaatttcttaacccgtaatctttcactgatcacttttccgtttcgtttccaccacaatccatgaagatggccacatgtcgaaaggccgtcatcgccaacgaatgaatggcgaacagctggcggcggtagaacccttcgccggccgacgaagaatgcctttggcctgtctattttccatctccgctgctctttcgctccgtctctttcttctaagcgttcaattcctttcgtttccgctgcaaaggcacaaacaattcgcttttcctccctttttcatttaaccctttcccttcgctttaaccccctcaaataacaaatccaaaatatcactcgttgtttttttcgatttgaacaactgttaatggatgaacaaatcatttatttgcaaacggaatgagaacgaattgcttaactcgcttgtcattttaaaaggctaacaaaaaagcagtgttggcaaagaaatctctgtttatctggcaactctgttgctggatcagttttttgaggagaagcaagtcgatttcgaatattgtaaaatagttagcctgtattagttttcagttctctactcgaaaagtatgggggatacaacccngaaagataattaattaactgt

SEQ ID NO: 21844 - DNA, 1531 bp, Heterodera glycines
  misc_feature (58)..(58): n is a, c, g, or t
  misc_feature (218)..(218): n is a, c, g, or t
ttgatccaccagtgcccgtcatcgatgcctcgcaaaatttctcaatgaccgcacgatntgccttctccttccagctgctctgagttgatgatggcgtcggttatcatccgcgacactgcgccggtgccagcaaaaggcggcggttgaccccattgaaaattgccgtttgtgggggtgggagccgaagtggaggaggtgtgctgggggtcaccaaatcngatgtccatatcgattctcgccctccacgagccgctccaccaacctttccaacttttcgagccgttcgatgattgggttcagtgtgggattccctgaaccttctaacaacttttcaagccggtcaagacgggcgagaatgtcctctccctcactcaaatttggggaattttgccgacgttttttgggcattggggattgaattatttggagaatgaattatttggagaatgaattatttggagaatgaattatttggagaatgaattataatttttatgtatcatttgtcagttattcttttgtctctaccattttttattataatgattaaaacatttagtttatgatttataaattttcttattgctagtcgtaattgaaaaactttttcatagaatttatgctctaaatttttaaattaaattctgaataaaaagctgattagtggtatcaaacgtctccttatcctgattgactgattttttttttgtaaaatttttgctattttggtaaatcaattaagaccttatatttcaaagctaaatacctaatgatttattttttctgtaataattgtcattatcattttagcatttttatttgatttattcaaacgtttgtcgtcctgtccagtgcaagaagaaaatttcattcatgctctttactttttaatattttatttttagttttgatttcaattttctaattaaatcagctaatgataatttttgtccaacttttatttaataagaattttttattactaaatgaatgtaacattattattaagagatgctccaattagtgatgtttctttttattaattgtaaatactttttgctctatatttcgttatcaagcatctcaataatttttgattttcaaaccgatgacccaaacatttcatatttattaaatcaacagatgtatatctatggcctataatattttcctttcaaatttattaaaatttaatgtttaatatttttataatttcgaaattacactaattatttgaaaattattcattatgatattttaaacttctagaaatttttaatttaatttaacattttgactatcaattttaattttgttttcttaatttatttcattttgaatttaatttaatttaatttgctgttgaacttattaaattattgtaattattttcaattgaaattttattttctttattttattatatatcattttgaaatataaataattttttgctaatattcatatctttcgatagccaaagggtttttataatttctgcattaaggtaaaatatatcaaattattaggt

SEQ ID NO: 21845 - DNA, 1478 bp, Heterodera glycines
gcaaaaagcagtcttttaaaaaatgttttttctgtttttcttttttaatgatgacaaaatagattttgtgtgttttattaacataaagaaatagaaattaatgctttctattgcatttgttaagtgaaaagtaatttgtttttgctattaaaaatattcatttggaaatgaatgctcttaacacttttgtaaagaaaaagaattgtttttgtatatgcaaagtcaatggaaatgatcttacacttagttttgatattgtattgaaaaagttttggttcgagaaattgtttgaccttgaaatggagtttttttgttttttttgtaattaaagcggatgtcaattatgcctcttttaatggatacggttttaattggatggatttatcgcacttattgtttgttttgacaaaaataagtttcttttaacgatataaggtcagtttatttgttctttttttgtatgtagatgtttatgtaaaagaaattattaaaatgtaagagaacaagtatttataatgaaaaggattttctacgcaaattgtatttcataatagaaatacgtttttaaaattccaaaattatgctgaacaggtctgaattaagtcccgtgattgacatgccgatgactccgtaaaattgagttcattgtttggaatagtgaaggattgagtcctcggtgattggaatggcggagaactgagtcctcggttattacgatgccgaagaatccgtgaaaagtgaaggattgagtcccagtgattggaatgctggtgggattgagtcccgggaataggaatgatggagaattgagtcccagtgattggaatgctggttagttgagtcccagttattggaatgtcgcagaattgagtcccggtgattggaatatcgcagaattgagtcccagtgattggaatgccgaaggaccaggtgaggttaggtcccagtgattggaatgcaagagaattgagtcccagtgattgaaatgcaagagagttgagtcccagtgattgaaatgctggagggttgagtcccagtgattgaaatgcaggaggatgagtcacggttattggaatgcataaaaactgagtccgggtgattgaaacgcaggagaatagagtcccagtgattgaagtcttggagatttgagtccctgtgattgaaatgcaagagaattgagtcccagtgattggaatgcaggagaattgagtctcggtggttgcgataccgaagaatcaggtgaggttcggtcccagcgattggaatgatggtgagttgagtcccggtgattggaatgctggagaattgagtcccagtgactggaatgtcggagagctgagtcccggtgattggaatgcaggagaacagagtcccagtgactggaatgctggtgggattgagtcccgggaataggaatgatggagaattgagtcccagtgattggaatgctggttagttgagtcccagttattggaatg

SEQ ID NO: 21846 - DNA, 1782 bp, Heterodera glycines
agtcgtacagggccacgaacacactgggcggagtatgcgcttccgctctcttcgcccccttccgcgccttcgcctcctccgctctcttccgtccctccgtctaactgctgatgtgccattgccattgaaaaaggcaatcccccgtcgacggcactattccacggcattttaagcttttatgtctgagacaatttgaatgaattttggctacttattggccattgtttctctggtcgaatcggcaaaaaagaaaatggaaaacagaaatagaaacaaatcttcgccaaccaatttcccctcggggctttctttttgctttgaatggttaaatagattcagtggcttgagcagcagcagagggggaaagaagaggtcactctctctctctcttctctctctcccactctctctctctctctcttctttctctcccactctctctctcccactctatctatttctctctcactctctcttctggctctttctctctctctctctctctatctatctctatctctttctcttgttttttttctgttctccccgttcttccccaatcttttctcatctctttctcactttcactttctccctctgttttttgtctcctgctcccttgtcttttcctttctctctttctctatctccccctctctcctaactccctttcacttttgaatgtttcattttctctgctgttaaaatgggaaaaacgaatgaacagcaataaatatatgcagagcaaggattcgtacttggatgccaagtacgtacttggatttcggcttttgtgcatggaaaattttaactgtacttatttacaagattttatttggaaatcggtatttttgcatttgaattagagttgagcgggaccgggaaatttgacaagaaccgggaccagaaaagtcgggaccgggaccaagtttttcgaccgggaccgcgaaaaaacccgggaccgggaccaaccgggacttttcccaagtgaaaatttttttgaaaaaaattgaaaatttaagtgcactttattacgaaaattggcaatattcaaaaatgtacccataaaattttgtatttatgttttgggggacgagttcgaggaaaatttttaaaaattttgttttcagggggggttcttggaattttctgagtcccaaaattctgtattttttaaataaatttacaatcttttaaattttttgcttttaaatcgctgtttttgtggcaatgttttttcaaaaaacttttttggaacagtgggaggggcggggtccggcagtgccgataggcgccgccggaaaaattttgaaattttgagcgaatttgttaacagaatttgtcaaaaaatgaccaaatatttggttaatttatgggtttttaggctattaaaaatgaaaaaaataataattttaaattaaaatattttttattaattaaattcaattaaaataatggtaaagaaaatataaaaaaattttctgttccatcagggaattgaaccgaagagacaaataatgaaagtaaaaaggtttagccacttgaccacttatgcacatgaaaagatgctataaatgaaaataaataatttaatttatttttatcaaaaatttctgatccctcaccaattcccttctcttttctcacccagacccccattcttaacagtgcttatttagtcccgccgggaccgggactggcaaaatcgggaccgggatttctgtttttccaaaaaccgggaccgggatcgggaccgggacctgaaaaccccgggatttcccg

SEQ ID NO: 21847 - DNA, 2497 bp, Heterodera glycines
tattactctattaaactgtttattgtttttacaggctgcagcgagaaatgtgcgccagggaagcggctgaacagaaacaacatgaatatgaagccaaaatgtacgtacgtttatgtatgggtgtttgagttataataacaatttacaaaaaaaaaatttcttttgattttcctataaatttaagaatttttttttgttgaagtttttttgcatgaaacggcgagggagaattgaacacatcagaatttgaaagcatcctctgatccggaaaacggatgctaattatttgctatattcaaaaagtttataaataatcaaatcagatatgaactttcattgtcagcttcttttttccggcgtacaatgcgagccaaaaatagtatgaaaacaaaattaaggttatccatgaaagaggagatggaaagtgcgcagcgcgagttggaagtagcacaagggcgaattcggcgcctggaagatcaaatttacgagttgaatgaggtggagtcttgcggaaccgcttactattccctcgaatcatttccttttttaaagaatgaggagaggatttttttcgaaatctaaaaacatcttttttgaatggagaaaatgcaccgatagattgagccattactatacaaatacttataatatggtaccaattttgcaggcaaaacgattgttggaagaaaaggagcacgagctacaaacattgaacactgaactggcatcagagagagctgtaaaaaatattttacaattttcaataaaaaaaaatttagttggatacgaaaattaacgtgactcttggaattgggactagattttttgaatcgttatgttttaaaaagaaagaatatattttccgacattgctagcaggcaccgccggtggaattttgaatattttttgggaaatttgtatacaaaagcacggatatatctcgaaaattgagcgagaaaaaacccaggtctcgaaaagattggggtttcctggtcctgttatgtcaagaaaatacaggcccagaccaagatgggtccaggctttttcaaaatctcatgcttataagttcaatttatttaattttttatattatttgtcctcctgacccgattgattccttttttaaattttattaatttgtcaagatgagcgaggaggaacggtcaagactgctcactgaaattgcaatgcaagaatcgcgcgtttccgaaatgcgattcgaagttaaggtgcgttggtgttaattggtcaaatcattaaaatgttaattcaccaaatgttagtccatgatacctatttgcatttcttacaatgagaaaatttaaatattgtataatttggtctgaaactaagcacagtacaactattgtgccaattcttttcgaaaataaatttttcccataaatggacatagaacaaaacggatgagatgaacaaactgaaggcggaggttgaaagtgggaagacaactgcacacatttacaacccgggcaatggtcatttgccgaccgaattcaatgacccggacgatctgacaaacgcccacattggtgggcattttttaaaattaataattgaatttaataaattcgacctggtccttcatctacatctatatttaatattttttgttttttctttaatagaattgagtacattccacgagggagacgtcaacaatgtgatgccacagcgtgaattggatcggaccaacttcactgatcaggacatgtcgttgaagaacaaactcgagggcccgtaattaggggattatactataaaatgatcgctctttcggttacggataggaaggagtcaatttacgaaatttattcattaaattcgaagcatgtgtttatctccgtttgaagcaccgaaaggttcattcgtagaaataaacttagaatctacgaaaacaagaaaaaatttcggaggatgtgataaattaaaaatttcaagaaaaatgggcaaattttttaaaatttggcaccaaattggttgccacaatgatgctaattaaattaattaattatacattattttttaatgttattgtaaaaacacgctcaataaatttcattgttgttttagttgcttacaaaggagttggacaatgcgcgagacgagcgggcgatcactgactttgatgtgctgcacatggaaaacaaggtgttttcctgaacagtgttataatcgctgaattgtttttcatgtgaattttcaaaagtcggtttttcaaattaaaattccaaaaaaattgtagcaaaaattattgattgtttttaaatatggtaataatatatttgttattttgcagaaacaaggccgtgacagatataagactttgcgtcaaattcgcagcggtaggttttattggcattttaaaatttttaaactttcattttatttatcttgaataaatttaaaaaatcaaatctaattttgcaggcaacgaagagagcggagaattgaccaatacgaaaatatgtaatgctca

SEQ ID NO: 21848 - DNA, 2279 bp, Heterodera glycines
aaatgcaatagagccgaaatttcctctcccccccccctctcatccgcccgaaatgcaaaattaaaattttccaagaaaaatgggcaaattttatttctttaaagttttcaaaaaaatttctcctcgctggaccaccattctcccatttgaccatatatatttttttgaaaatttgaaccaaaaatggcaattttggcgaaaaactactaaaaattcctactgctttgccccgggcggtggaaaattttgaaaaataacattggagaaaaaggaaattctaacctgaaggaggacaaaaaattcccgtacttgccaaaatgacccatttgatgctaatcacttttcttattactaatgccaaaaacgcataattttttttgctaataatttttttttattaaaatttctttaaaaaaccatgacaaatttttaaaattttcatttttcttttttgaggaacaaaatcagcaactgattgcctcctcaattgttccatcaacatcgagcagtagcaggaataaaccgccggcattgcagctgaacgaggcggtcagtcactcatttatttatttattttatattttgaaaatttttaattaaaattttactattttttcccatttaagccactactttttgatgatgcacagcaattgttgagcccatatgttcagtgccattttactacacatcagcaaattatgttcaaagtaaaaagtggcaaatgctttggcttggattttcatgccccgggggcatgtcatattattgacgattagagctcgccaattttcaaaaaagccttaggcatggcctgggggattccatgttggccctgctggacctgggttttctgcctggacaaaaacggaggaaaaaaacccaggttttgcatgcctaacctggacctggatttatctttttttaaatatttaacctgcatctggatatcaaaaaggaaaagccaggtccaacaaaatacaggttaccaaaaaaaagagtctgtgtggatccaggaaaaatccaggcctgagctctattgaacaagtgtcacgaaaattgcgatcctatacatcccaacaaaaatttcgaaattttattttttcacttttaatagatctttttatcatttaaaattttacagatgccaaaaatatacacaggttttgtagcggaaaaattttttgaggagacaaatttcacgtatatacctaactcgactttctaaaattggggataaaactgctactaattagtggtagtgggtatgattaattgcctgccatggggacctgaaaattaagaaaaggaagttctaggtactagtgatgctcgagagtctcggtctcgagtctcggtctcgggttttcaagtctcggtctcgattttcgagaccgagacttttttacacccctaatgattgttggcctttggtaaacttctatttttataaattttaggttcttttttgttcaaatttgttaatatatgcgtggtccagcgggttgtgttcttgattttgttccttatttttgcgttggatcagttcccctccaagtattattttttcttctcatttttcaaaattaatgtttttttcgatgggagttcaaacacaattttaacaattaaaatcgtaaaaatgtcatttttggactaaatctattaacaaagtgcactaaaaatttcaaaattttctccggttttgagttttttaaacatttactgactatcaaattatcagtcagacccagtcactttctatcacttatataatgctgtttaggctatcatggattgataaaactatgtttgcacccgattttgggtatagccagcaaatctgttgtgcgccaatatctcataaccaaaattgcatctcccaattttttaaattttaatgccaaaattctgcaaaaaaaaaaaaatactacgcccaaagcaagttcgagtcgggctccacgtgctgcaccatcaccgactttcccccatgggtggtgaaaatggcacagaatcagccgcgcaaattttcgccgaaaatcattcgacaatgcgaggcggtcatcccgctacagtacggcaccaacaaatgcgcatcactgaaggccatgacaccgtatggattgaccagccacattcgaatgtactgattgagaaagaatcgatcagaatgagatcgaagagtgatcgatcagaatgaattgacacaatgataaagctggacagatggatgaaatcgataaatgctaatgaatgattgatattatgtctattaatcc

SEQ ID NO: 21849 - DNA, 993 bp, Heterodera glycines
attaaaaaagaaaatattcgaaaaattgaagcagtccaaaaaatttttacaagaaaagccttcaaaaaatgtgggcttgtccccatgccgtatgaagaaaggctaaatatttgcggaattaagacattggaaattaggcgtaaaattaatgatattacaacaacttttaaaatcataaaaaaacatacacatcttaaaccatctaacttttttgctgttgctaaacgggctattcgcaaaccctttttactacaaaataggatatatattacaaaaacaaaaaataatttttttaatagagttattaattcatggaatttattaccgaaaaatattatggaaataaatgaccccaaaaaattccgagaaatagcaaaaggaataattaagcaataatgcatattttccctattgagaggtgtgattttctttcattgatatttactttttatttaatttgacgtttacctattttgtgattttgacttccgtttatgttttattttgattattcattttattttgtgttttacaccactgttagagtgcgaagcaccttgtggtttgttcgataaataataaatattccggtctacgtcggcggttgggcgggccctcacgtttgggcccccagcatatttttccactataactttataacttttttctttatcacccaaatccaataaatttggtatcattcgaaagcttacatacttagaagctttttctaagctattgcttcgcgattagacaattaccaaaaaagttatacatgaaaattgcaaaaaagttgaaatttttgaaatttttttcttaaaaactttttttaaagccaaaaatctttttgttttttagtaaggctaatagagcatgttaagagctttcgaatgataccaagaatgttggatttggatgccaaagaaaaaagctatcgtggaaaaacatgctggggcccaaacgtgtggggcccaaacgtgagggcctaactga

SEQ ID NO: 21850 - DNA, 2164 bp, Heterodera glycines
tgcccgtacaggtgacttcgtgggatgtgcagttggaggtgccgccctcgcccggacacttatccgactcagtctgaaaccaaatgggaacgattaattgcatggatggcaaatggggcactttctttcactcaccacgtcctccgactctccgagtgtacacggttgaccgttggtgaagaaattggcctttgagacgcatcctccattgcgcacaaagagtttgaagatcaagtcctcctttccgttcttctggaaaccgatgaggggcaggtcagacgtatcagcggtgacagatgaggaatccaagctaaatgggatttgggaagattaattgttgtttcacaaaacaacacaactcacatcagaccgtcgtccacagctttgaagccatcgattcctccgtccttcgtggcacaattgaggctcgacagatgcacaacatttccatccgcacgacagcagccgaagaggaagagaagggcggcaatgaatagaagcggacgagataacatggcgtgattacggtgataaaaaataagatgaaaaatggtcgatggaatgccttttataaagaaaaatgtgtcacaaaatgtcaaaaatttgggagaaaaacaatgagaaaaattgaaattatagcattataaaagaaaggaaatgaatgaagaaaatgcatagactgaaaatcatttattccaattaccatcatttacctattctaagcagaattttttttttctttaatttgaatgaattttcattcagccctcttaattcattctcattatttaatctttgtccatttgtaatttcaaaaaatttattttaagcgttaccgaacacatatacacatattatacaataatccatctctgcaaacacattgtttcaatggcccgcagatcgaatgccaccggcacgaggaagccgcaccgttaccgtccaggtacagtaacactgcactcatcatctgctgaccccaaatgctcactaatcccattctctccccatatttaggcaccgttgcccgtcgcgagattcgccgttaccagagcaccactgaacttctgctgcgcaagttgccgttccagcgtttggtgcgcgaaattgcacaggacaacaacttggagatgcgctttcaggcggtggcctttgcagctctgcaggcagcaaaagcttgttgtttaatcattttactaatttggcatccatttcaggggggttatcgaaggttctttgattcttccggtccccggggttccccagttgaaaagctcaggttccggtcccggtagggcaaccgggaaccgggaaaaacaagcactggtaagaatggtggtcttggtgaaaaattagatatgaaaattagagtaaaagggaaaaatttaaaaatatattaatatattctttaaaagtgacacggacaattgcgcaaatggcctagtggctagtctccctgacctgcccttcttctttcccctggttcaatccctctacagaaagtaaaatatttcgaattttttttttaggctcatggctttcctatcgacaaaatatgattcctcatagttttattttaattgacacatttttatcattttttaaaatgaaaatccgtacaaattgagcctaataatcccaaaaagaagccatttttgttgaaaatctgttaacaaattgcactcaaattttcaaaatttcccccggtgtgatgccagaaggaacgagtgtgggagaaagtgggataaaggacctgagagaaactctaaaagtagcgcccgtagaagttttttggaaaaagcgcgccgaaataaagtgatgtgaaaagcaaatctgaatttctattaatattcgattatttagtccaaaaatggttatttttttaataattgaaataaatttggtttaaaatttttcatttttaatttagctttaactttaggatttattaaataaaaaacaaaataaaaaaaataattttatattattttcactttaaaaaaaattaaaatttgaatttttttaaatttttttgaatttttgaaatttcctcggttggtcccggttcccggtcccgaacaaaaatcgaggtcccggtcccggcttctcaggtcccggcaagtcaccggtcccggttttgcccaaaattcccggtcccggcgca

SEQ ID NO: 21851 - DNA, 1655 bp, Heterodera glycines
  misc_feature (14)..(14): n is a, c, g, or t
  misc_feature (31)..(32): n is a, c, g, or t
  misc_feature (34)..(34): n is a, c, g, or t
tagtttaattcganctgaagctgaatatctnncnaactgtacaatatttctggttgatcagataaagtgccacagagtcaacaggtctgagtcctccttaatcgccttgatactgtgattgggtgggttattgtaagtttgtttgcttttcaagtcatgtttttatttgagatcattaattaccgtcagtttttcatgaaatttcaatttttcgaactgaagctgattaaagaattttaattatttttaatcctttaaaaatttctccaacaaaatgtttctaccaattttcagcaatttacaattgccaattcattcatttttggcttttcttattttatttgccaatattttttccattttttcttttgtcgttattctttcactgctaatgccaaattgtttaatccggtacttttcggttttgtgaccccccccccctgaagttttcaaataaaaagtcatttctatgggaatttggggcgctgatcacgaatatgacatttatttttcaaaattccgaatcccgaacccgaattcgaacacaaattcgaaattaataaattacacggaaatttttaaatcttttcgccataaaatcattaaggcatattatttcttttaaccacttttattaaatattaaaaaaatttatttatcaaatacaaatacaatctttttgaaaatttatataacaaatctattttttagagcgcagataattttttaaataaatttatccaaattttcgtaaatttttccgtttttcaatccttcaaaatttcttccccaaaatgtttcttccattctgaaattctctttctattaattttcaaaattttccaatttccgtgtcactcatttttggattttctttttttatttcccaataaattttcattttttctattttttgttcctccgttattcttttacagcgaattccaaattgtttcttccattttttaattgttacatagcctactccaattttcttacaaatttcgacataatttttgttccattctttgactgaatattttcttttttgtttaaattcatttttcattttaatgaatttttgcacaatttctaatttttcttcatcagtttttgatttatagcatttctttttttggagaccaaattctttaatccatttttgaatatattggcgatttgtccccaatttcttcgctatttttgagttaattttatcccattcttttgttgagtattttcttcctttttgctttattttttcttttattttataaaattttccaattatttctctttttttgagttcatttcgtttttcttcttctttttcttgccatttttctccaaatatttcgccaaatgacttttgttgcaattttttcctttctgatccaattttgtcaattaaaaataaaataattaataatagtagcggaaataatttcatttttgtcgtctggaaattattttattttatttttcttcaattaaatgcaattcattttttgaggcatttaaatgattttttttctgattaaaaaactgaataaatcattatttacttaataaaataaggaaatcctgtttaatttcaaagaaataataataataattttatcttaatgacaaaatgtggggagagagcgagagaa

SEQ ID NO: 21852 - DNA, 898 bp, Heterodera glycines
aaaatttacaaaaaatgtttattttttaaaattgccttgggaaattagccaagacacaaaaaaagtctttccgtcgccccgccggggacaaatgatggcgaaataaacaatgaaaatgccgaccgcggatgggaggaggaaatcctttcgtgttccttttcctttttccttttccctcgtccatcggcggcggagtgacccaattacacaacacatttcacaaacaaacacttggggccctcataaaacacattaaaccaattgtgaagaagcagccacttcttctgtgccggcgggcggcgaaaaattaaatgttttttgcttttgccccattttctgccgaaaaaatcggagttattagtcccaccgaaattgtctgaagacacgaacatttgcaccaaatgttcaatgtttgatggatgccatttttagaaaagcattcacaaaaaatagcaaaagaaaattcaaaaattgtttaaaaaatgcgagcagcaaatgccgtggggccaacgcacgtccgactgacgccggaggggtcgcgacgcattcgcgtgtacagaaacggagacgcgcacttcaagggcattacggtcggtttggtggggggggggactgtgggagtctcgaaattttactgtcatggaccgcgtaaagccgagacccattcaaaagttcacacaatgtgccggattcggccaccaacaaattgactaatgccactctcgtgttaaataatgccgatgccaatagctttccccgtcgtgctcagattgtgctaaatacgcgccaggtacacagcatcgacgcactgttggacatgatcagcgagaaaatcggcttggtgatgggctgcaagcgattgttcacgttggacgggacgccggtgaagtccatggag

SEQ ID NO: 21853 - DNA, 673 bp, Heterodera glycines
gtcggcacaatgtcccttgcccctctcccaaggagtacgtcgctgcctcgggcatgttcacccccgcccgctatggacgcgtgggttccgcagcgctgcaaagcgcttctatgctggcacgctcctcctccaatttctcggccgcttcacgcgaggacccgttggcacagtcaggcgcctccaagcaatcggcgcccgcctcgttggcatttggcacggcacacgcaccgcttcggcactccaggcaatgggggaaaggcaggcaaaatagcgggaatggcacccttgcatcaatcaatcagaatgccaaaggataaaccaacggagaatcgacgaagaaatggaaaaaggacggaatgccaaagaaatcaatggcatttggcagaaatgccaaaaagaaaaacgacgaaaaaatgcaaagaaacttaggcttaggcaatatttgattttaccaacgtcatcataaaaaattgattaaagaaatagacaacggccactgttttaagaagcattgagccgcggcgaacggtcggacgtccgccgcccgcgcaaatgaacggacagaaggacgagaggaggtcactttgagtgggcaaaatttggagtaaaatgtgcaaaaattttgcagtagaaaagtcgacggcaaaaaggcacgcgacggcagcaaaaagcg

SEQ ID NO: 21854 - DNA, 1742 bp, Heterodera glycines
  misc_feature (69)..(69): n is a, c, g, or t
  misc_feature (79)..(79): n is a, c, g, or t
  misc_feature (1685)..(1685): n is a, c, g, or t
tttgcagaaatttacaaaactttttcaattaataattatttgatttttatttaaaaatatttgaataanatatttaccnaattgcagaaattcaaaacaacaaaattgctcattcaaatttgtagcaaattctcacaaagcaaatatgaagaaatgtatggacgaaattggagtgaaatatcctcattctttacataaatagggctgagaatttaagtcacaaaaaatctcttttaattagaattgcaaaaatggtacattcaaaatttgtaaatttgtaacacattgtaaaaggggacaaatggaaagatttcagagccaatattttttcatgaatgaatctgacaaagttgggcgattgtttcaattccctggggtcgtctttctgtcggatttcaattgtttgtttgtttttggcattttatccactgaaattcaatttttgccgtataaaatgaaaaaaccaaaaagtgcaacaaagtcataaaactccaaaaaaagtagaaaaaataaaaagctcaaatcttaaaataaagcgtgcgataattttaaggtaaaaataaatccatttcgagtcagcagaaaaaagttatttgacttaaattcccatccctagtaataaaaaagaataaatgtattttttaacaacttttaattaataatttatctctcgcaagcattttaaaaactttgcaacgattcatttcttttccaagaattaaaaatgtcattttaaatgattttttaaagaaaatataaaaatgcttacattaaatgactttataaatggaatagtgcattgtgtcaaaatggttgaaaacatcagcaaaatggtaaatttgagcgattttttgtgcaaagaaaaagcaaaaaatttgatagaaaaatgggaagaatttaaaattgaaatggacaaatttaaattttagacaggaattaggcgcatactttaaattacgaatactatgtaaatgtctattttcattttgggagtttaaaaaatgattccttcttttaaaccaagcctggcaaatccatttttaagaatttttgtgacgcgaaaatcacaacgatttctcgagtagccctagtggagatcccccaatcccccaatctcctgattatgggtattttagaccagcttctttggcaaaataaccacaaaatttcagcgaacgaaaattcggaaaaggtgtcctgctagaaaaataaaatataaaattaaaacttcacaacgaatttaaaaatatgtaatcaaaaataattgcagtacaagataaattgcagcgaatattttaatttatatttatttttccgtatgtatttttattattgactactgtttttcctggccaagtttaaaagggaatgtattttacagcatttgaacaaattttttttttaataaatttgacgaatttaatgagtttttgacaaattttattaaaattgaattattttaataacataatgccgacctattaactgtgtggttcacaaatctaaatttaaaaaaatgaataatttattcattaactgaatttgttcaataaaagcagtgctgaatccgaaaatccttccgcatcacataaatcaaacccaatctaatcccaaatttccgccccaacaatctcaaagtgatccaattatttaattaatatttgcaattttctttattaaactanaaactacaacattctcacaaagcctttttttcaaaaaatagataactcgagcccgga

SEQ ID NO: 21855 - DNA, 2260 bp, Heterodera glycines
tttttaattttgaaataattatttttgtatgtactttcctcttcattttgacttccaaataaaattcaaaagcataaaatttggtcatttttggacaaatgcaagtaaaaatttcaaaatttccttggccgcgcctttcggcaccgccggtccccaaaaactcctaatttttttcttaaaaaattggcccaaatcaacaaaaaattcaatttttttacagattttgttaacaaattgcaaagatttttctaggcctcgccaccgccggcccgaaaacggcctaaccgaaaaccgagggtgccggtttttcggttttaaaaatgcatccttaaagatgacatctctttaagcgaataggcactaataactagggccccaattttgaggctctattgtgaccgtttaaaagttgcaacaaaaaaaaaatatcgaaaattcaggcatgagtcgcccgagtagaaatttcgaagatttgttaaaattagaaaatctgtgaaaaattggacaacgccatatagaaaaacggatgcagaaaaaatttattatttcttattattttgttctactgattgatgtaggtagaatttttttgtaatgatttaaattatatattttattggtgatgaataatttttttcattaattttgcctactgattgattttccatgaaaatcaagcaaatgaaatattattatttaaatagtttttttaataatttatttttaaatggtcttaaaaagaatagtttttagaaaaatgaaaattaatatattattactattatgcctattcatcatcaaaaatataattgatcagactgtttctgtgaaaataaagtcaccgaaaggatttgacgaaatatttggcgaaggatgggagaaaaatgcgcatgaaaatgaacttgatcaaactgatcaaaacggaataattggacaaaatgtcgatcgaaagaacacaaataatgttgaaaatattgggcaaaaattattatcgaacaatttgatcaaatttttgttgaaaattttgaaatgaaaaatgaagagagtgaagaaatgtccacaaatgatggtgatgaattggaacaaatgtcagcaaatagtggacaaatttccgatcatttttcaagtgaaattgataaaaagaaaagagaaattgtggaaaaatttgataaaattaaagaaaaagttaagcaaattggaaagaaatattcaacaaaagaatgggagaaaattgaaagaaaaattgcaaaaaaattaggtgcaaataaaatgaaaatttacaaatggaagagcgaacttggaatgatgacgaaaaaaaattattcagttgaagaaaaaagaataatgttaaagcaatttgatcaaatatattcaaaattaaaaataaaattaaatgaaaaattggaaggaaaaagagaaaaatgcaaaaaaataatagcaaaacatttgggcacaaatatcagcagtatttatcattggaagaaacaaagtggaaaaactaagaaaaatcaacaaattgatgatgaaaaaagagaaattgttgaaaaatattttaaaacaaaaaatgaatttatgcaaattgggaaacattcacgaaaggaatggaaagaatttcatgcaaaaattaaacaaatatttggtttgagttatatgacaattgaattatgggccaagaaaattaaaaatcaatcaaatgcttcaaaaggttatggtgcatttaaaatcaaaaatctaatcttttttaattaaatttatattttttcattttaaaattatttatttattttacagagcgaaattttatacaaatgccgaaaaaatggaaattatgaaaacatattatcagatgaaagagcaaaacccaaagttcactgatcccgaaattgctgtttgaagatagccgtccccacattacgcaaatacaaatccgatttaaagaaaatggaaagaaattttaaactttgataaacatattgccaaattttcaacattttaaattcattgtttatcgagatgcttcaattatttgttttttttttttgtaaacgaattttacttttgttgatttgacaaaaaaaaaaattctctattcagatttcttagtaaatttattaattttatgtaaaattaaaaaaaaatcgcggccctaatgataattaattgcatcaaatgcaattttttttttgattttcttaaatttaacacattgcgctaaatacggcactctctctttccttatggaaatgcggggccaggacgt

SEQ ID NO: 21856 - DNA, 1688 bp, Heterodera glycines
ctttaggaagaaaatcgtctgttgaatagcggtgtcggaattgtcttctttaaatatgttggtccgtagacgtagcaatgggtccgaagatgggtgcagatcgatgagtagatatgagtatttttgacgtgttgcttgtcgataagcatccaagaaaaagtcaaattgtcgagggaacagttggacgcccaaattccggatggccaatgcggagtttggagcacgtagtaggacgatgtacatcgaattttgacgaaccactttaagcttacgatcgaacaggtcttgcctgatgaacacgaccccgaaattttggtggtgtgcttttttggtaaatagttctgctaggtagcgttcatctatagagtacaaaaggtcgtcgagaatgatcatcgcgggctttgtcaaagaactaatcatttctgcatccggaactccggcatgaagttgcacgttggttatacgatgctgaagatctgttaatgatggactatactccccataacagaacaaaatccatttgggtgcagggtcgattatatgttccgcttgttcgataagtttgcaaatgaaggtgcttttgccgctcgaactaggcccggacacgagacatccgaatgggagacaaaattttagctctttactctcaaaccgctgcgcgtcaatcataacgagtttattgaacaataatgatataattagggtttttatacaaataaaacatgcgtatcgctttaaacatctttttcttccttgatggtgtctagattagaaataaatttatttgttctgaatttaggtgtattttccattgtgtttgcttcgtccattagttgtacttgtgacagatccattttgtctgtccgtatcatcccatctgttgctttctctcccacatttaattcatccgtccgattggtaagttctgctttctcatcttcgccatttttcgtagtaatgtcgcgcaagtctgagtcaaatctcgcttttttccgctcaacattgtcgatgagagggttttcagtcgttgatgtaacagttgacgacattgccttttctagtggagaatccgagaaaatatagggtactttaaatattcggcgcgaccgtacgcgaaacgcacaaaaacgcggcaggtcatacactcggtcgaatggtacaaatttttcggtgccttttagtcggctcgaatgaatgtagacgccatccttactgatcagatagtccaaatccatattatatcggcattgtctgcaaatggtaccatcatcattgaaaaacactacacgcggagtgtccaatcggtcactgtgaacagtcactccctgagttgtgaccaaaaaattgactgtaggaagtagttgacttgtgagagatttgttatccattttttgggtcaatactttagaaatgatccattaaaatgacgagaatctaacattatactgtccctaataatgggcggggcttaaatacataatttacacactcgtagtgtcatcattatttaaatttagtacactcatatacatccgatgcacactgacgaggatctgtctgacgacggcactgaatcatatacatttcgctctctgatttactacgaaaagaaacaatgctccaaatgtaagaagcttcgtaagtggtacatcgtggaatttcacatgccaaatccgatcattacaaat

SEQ ID NO: 21857 - DNA, 3001 bp, Heterodera glycines
ggggggggaggtggcaaacaccggaagtaccaaaaattttatttgcacaaaaacactttgccatggtccatgggttttacaaaaccattccaatttatgtgttgcctcctctacgtcccgccccttccgccgaaaaaaatttttttttaaataaattattttattttaaataactgtttcgctgtttccgttcatttgtctcggttttttagaccattcgtcgtaacccggacacccaatggatcaccaaacccgtgcagaagcatcgcgagcagcgtggactcacctcggccggccgcaaaagccgtggcctcggcaaagggtggggcaatttttacatttgaaaaaattttcagcgattttttttaatttttgaaaaatttctaggttttaaaacctataatattaataggggattgtgcaataattcatggcataattttgattttttggcattccatttttccctaaatgtatttgatttgccccatttttgcagaatgaagcacacgaagaccattggaggctcgcgcaaaaagtgttggaaacgccaaaacaccgtcgaattccatcgcaagcgttgagcaaattcattcattttgtatggtccattggacagaacggagacattttttgcaccattctgctgttacttttttctttttttgttgagaaataaaaaaatattgttttttacggaaagcgaaagcttaaaaatgaaaaaggggcaaaaaatatgtttttggggttcgttcagttcgagagtctcgaagggaaaactttcggtaatattgtgcttatttgttagttgttgtccggtagggattaaaaaattttcctaggtaacaattccgacccaaaaaatgtcggaattccgtgccatccctatttcaagtgcttttttagtcggaacatccagcaaaaaaattcaaaaaacaaaaataaattaataaataaatttatgtattcgaaagaaaaatcaacaaatgaaattgagagaggagagcatttatgatgagggaaaatgagcatcaaatccgtttccaattggtgaaatccgtccatttctcaaatacaattaggtaataattaattccgcgcaatcatcagacgacattttcaaaaataatcactcattcattccgcacaatcagttggcccgagaatcgtccgtcgagaacactttttcgttgctttgacccgcttcttccgctgctggtggcgacaatggcctaaaattaagtgaactttgaatttgggtgattgagaattatgtatcttttacgggtgcacccaaaaatttcgccgaagaaatttttttttttttaatttctgtggaagaacttccacaaatgatttttcgagagtttcgacatttcaaatttcaagaaaaaaaatattagaaaatttttttacatgacaattccaagggaaaatagcgattttggaaaaaatttcgaaaaaattcgccgggacgtaatttcggggaagaaatatttttaaaatttttttttcgaattttcaagaaaaatatggatttttttttttcggcggcgaaattatgtctcgtcccctcttttacactcacccaatgcattgtttgtcaatatccattataaaatggacactgttgaaattggcatccaaagtgccgtcttcccactgaaccgccgtctccccaattgggcatcgtttcatcacccaattgccggggtgccgtggcactttctccagcgtcagcttctcattcgtccgttcgttcaccaatccaaacagcacaattggtgttgaacccttcattgcgaaattcatttggtagctgactgaagtggtggcacggacaaatttctgaacaattgggaattggataaaaaatgcctccaaatatggcaaaattgcgagaaaaaaaaccctcattaaaaagaaaagttagcaaaaaatggccaaaatgatgacgaaaactcacattttcgtactgttggcagtatatattttttaatttcctgaaaagttgatccttagaggtgttttttgcatttttcttgtgaacatttgccaaaaattgccgaaagatggactaaaaaacgcaaaaatggcgaaatgagaatttagatattcccgaaaacacccaaaaaatggatttattcccgacaacaaaatcaccaaatcaattagtacaccacacctctttgaaattggtgatccattcaagatttgctggttgttgtcgatacaatgtcgacgtcaggcatcgcaatttcttgggacggccatccgttctcggcatgtgtaaccatttggacaaaatttggccggcagaatttgttgcatttggcccatcatcgtcgtcgtcatcagcaagcgcttccggaaacagtccaccattgcattggactgaagtgagtttaagatcgatgagaattgtcggcgatgtaagacgaagcaaagtgtccaaatcggcgccatggtcaactcccaaatggtggacatttgttgctgttggcgtaaaaatgggccaaatttgacggacaaaaacatccaaaattggctggacattgttagtgttggctgatatccggcgaaaattcaaacgcaaattggtgcctctgtcccaaatttgctgattgaggcggagaaattggatgacggccacgtcaatgtacctgaaaagggtggacacgtatctcaaaaacgggttaaaactcaatgtaaaattactcaatctgaaggaagtaaaagcgaattttgcgcggcatcgggcattggatgagtggaaatgtttcgtcggtggaccagaaaatggcaacaattggcttttccgtgacttcgtctcttcgaatgacgatacgtcgccaaattgtcaattccgttttgccatcaaaatgcgcgtccactaaaacatcgaaacggtcggaaagcattgccaatttgagaccaagttgaggacggtcaaaaaacggcagaatgtccatccaaacatcgttgcacacccggctgaaaa

SEQ ID NO: 21858 - DNA, 1263 bp, Heterodera glycines
gggtttattttaaaatgaaattttatgataaaccttatatttcaagaagctatttaattgatttgaatgtttttttcgcggataattagaacaaggaaaatttctttaaatctttaattttctaactcacttctcaaaatttttaataaattccaaatatatattccaaaattcttttgacactttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagggtttatttttaattgaaattttatgataaatcttattatctcagaagctatttaattgattcgaatgtttttatcgcggttaattagagcaacgaaaattggtttgaatcgtgaagtttatcatttctaactcacttctcaaaattgttgataaattgcaaatatatttttccaaaagtctgtggacactttctgaaaataaattctatactcatgtattttccacttattagattttgcaggcttattgctgcatgttctttgacacttcttcaaaataacctatgccctttattcgttcaaaacagcatctttgttgtttcgctttggattgacaagcccgatgataaatagctcgagcgcaaaacgcgtgcatgtttggaaagtatcgttcataccaataattgagggtttatttttaaatgaaattttatgataaaccttattatctcagaagctatttaattgatttgaatgtttttatcgcggttaattagagcaacgaaaattggttgaatcgtgaagtttatcatttctaactcacttctcaaaattgttgataaattgcaaatatatttttccaaaagtctgtggacactttctgaaaataaattctatactcatgtattttccacttattagattttgcaggcttattgctgcatgttctttgacacttcttcaaaataacctatgccctttattcgttcaaaacagcatctttgttgtttctctttggattgacaagcccgatgataaatagctcgagcgcaaaacgcgtgcatgtttggaaagtatcgttcataccaataattgagggtttatttttaatgaaaatttatgataaacctattatctc

SEQ ID NO: 21859 - DNA, 993 bp, Heterodera glycines
aaaaagaggagcataaaagattttccatgataaaaagcaaaaaatttaatgtacgcccaaaggtctaatcgagaaactttgaaaagtttgggctatttaagcaagcatatgattagcctatgagttatgatgaacgacgttgcacctgaatgaccaacgtggagtaataagagtcatgttttgaaaagtcattcttaaaactgcttatttaaaattctggcattttttataaacagtatgagaatatcaattacaaatgttaaggtttgccataattatgggcaattgtaactgttcaaaaattctatgcaaaaaaaaagcaaaatattcaattataaaatgctcatcctagaaatcaatgctctgattatgaaaaaatgtgcttataacaactcaatagttggggccgccttttgtatgacatggaaattttggcagctttgcaaaaaagaggagcataaaagattttccatgataaaaagcaaaaaattaaatgtacgcccaaaggtctaatcgagaaactttgaaaagtttgggctatttaagcaagcatatgattagcctatgagttatgatgaacgacgttgcacctgaatgaccaacgtggagtaataagagtcatgttttgaaaagtcattcttaaaactgcttatttaaaattctggcattttttataaacagtatgagaatatcaattacaaatgtgaaggtttgccataattatgggcaattgtaactgttcaaaaattctatgcagaaaaaaagcaaaatattcaattataaaatgctcatcctagaaatcaatgctctgattatgaaaaaatgtgcttataacaactcaatagttggagccgccttttgtatgacatggaaattttggcagctttgcaaaaaagaggagcataaaagattttccatgataaaaagcaaaaaattaaatgtacgccctaaaggtctaatcgagaaacttgaaaagtttgggctattaagcaa

SEQ ID NO: 21860 - DNA, 1062 bp, Heterodera glycines
aactaattccaggacaattagcatcggcgcaatggttatgagaattcggctgtaattcatattactattgagcagaaaaagagatagccaattttccaaatttttcccaaactaacgcgccgagaaacaaattccagaacaattagtatcggcgtaattattctgagaatgcggttggaattcctattactgttgagcagaaaaagagatagccaattttccaaatttctccaaacaaacgcgccgagaaacaaattccagaacgggtacgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttgtaatccctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttctccaaacaaacgcgccgagaaacaaattccagaacaattagtatcggcgtaatgttctgagaatgcggttggaattcctattactgttgag

SEQ ID NO: 21861 - DNA, 2889 bp, Heterodera glycines
ttctttatcagcctgaaaactttaaaaatatttgataacttcctagaaaataatggtcagaagatcataaagctacttttttaacattttttgccttcaccatttttaaactttaaaaatttacatggcatgccaaaaacgaatgtttatcgatattgatatgaacaatgtttaacatggtgttgtttttgagcaggtataagaaattttcattttgatttttttcctaacaaataaattactaatgccgtcgcaattgatttgttattattttattttaagcacaacatttattcttcaatttatatcagctggtccacaaatgggacaatagccaaaataagagactttttaaattgaaaaaataaaaacgagcaaaaatttcattaatagtaatgctaaaaagaaatatgtgttcaaaatcattattcgttattttaatcaaatgccaaaataccgctatcattgtaaattatattctattttatttattttttaactatttaagtaagaaattaaattctaatttacaaaggtaaatattaaaaattcataaaaataaaatttgcttttataaaaagaaaatttaagaaaacataaatcataaaataacagtttgtcaaagtgtaccataaatgcggaataatgaggcataaatccttaatgaggatgatattacaaaaacgaaaataaatcaattaatgattaatcattaagaatatggaaaacccggctaaatgctgactttaaaacttaaagccaaataattaaaaaataaaatcatcgagggaatgtgttacaggaaaatgaatcgttaaaaacatatcaacaaataaaatatattttcaaaaaaaaaatgtcgataaacctggccaattcccgacacgacagtgtcgaccctagtagggacagtacccttgtaaaataactttatttaaatacaaattattaattacattataaacctatattttaaagaaaaaaaatcaactatttgtttcctttttatgaaacgattaaagtatatcgcaaaaatgtttttgtctttttatataaaatttgtaaaacaaaatattctggcaaccgccagtaattgacatccaacagactgcaagaatttttcatataaatttaaaaattgcgataacatgataacttaaacacatttaaattcctttttattcaaatgtgtaattatttatttatttttaataaaaaaactctaaaatattatgccttaaatttctaaataattaccatcgccgaaattaacaaataaatttaattatttaatgcataaaatgaaaaaataaatatcattggacaaaaaagagttacatgatgactgagtttacgaattaattaataaccaaattacaaagtcaggtcgtgagagagcattttcctaacaaaaacccataatatattataaatagaacaaatttaatataattttgttgctatatagaaaatatactttacaaaatttcctgctatttaaaattaaattttttcaccatttacataaacaatgtcaaaagcattaaatgaaaaagtgcaaaaaaataattgaaaaaataattataaacgatggctaaaatgaaagctaaataaaaaaatatataagtaaataaaatgaaataaggttataagatagctaattcgaaaaacaagcaacgaggaattaattgattaatactgtaatgcttaaacacaaaagtttattaaattttttatacatacgataaatattttatcattgtgcaagaattttgatacaaaatttaaatattacaaataattattatttgatatgttaattggctaaaaaaggaatttaaaaaatatcatatacctacttattgctcaaaataattttctgaaaataaaaaaatcttcaaaattgctaatactcaaaataatctctattttttaattatttagctttattgttgtggacccaaaaaaaatattatattttaaacaaggagctaaacgatattaacgacgatttaaaaaaaattaattatacatttctcccaaagaaaaattatattcatcaaaattgtgttcattaccagggatgtattaatatttgcttaaattacgaatttgtatttacatatttattattttaaatattttctaaaaataatctcgcaaaaatcttttttaattattttttgccaaaattgcaattttatgaaaatctgtttataaatagagtcaaattttcccggagtcgactccctaaaaccctattttcttaaaatttgctcaaatcgcaaaatttcatcaatttttggacaaaagctttttaacaatcgcattaaaaattacaaaaattttccccgatggcaccggtctgcaccgccgaaatcccctccgccgtactgttcctcaaaaatttttaaaaaataattcgtaaaaaagtgccatgaaaagccaaaaaaagttattttttatcaatatacgtatttttcaccaagaatattaaaattgactcgtgaacaactgagaaaataaataaataaaaagattaatgtttcttcttttgagattttaaagaaaaaatttagcgaaatccaattcagtgagattttaaaaattgatttacatttcttaattattattttttgaatattatctgaattaaggaaagaatattatttacctcactaaatttaattcaaagaatttgaaattcaactaaatgcacttattaaggaaaaaatcggaacatttttacattttttgcttaaatttgttaacatgatacgctcaaatttccaatttttcctccggcggcgcctatcggcaccgccgtgccccaaaactcctatttcttcatagaaaaatggcccaaaatctcaaaatttgataattttt

SEQ ID NO: 21862 - DNA, 1844 bp, Heterodera glycines
  misc_feature (35)..(35): n is a, c, g, or t
  misc_feature (47)..(47): n is a, c, g, or t
gaaaacatgccaaaagagaaggagaagggaacatnggcagaggcaangacatttcggcgggagcagctctttcctccccccccccccctctcttgtctttcgttttgctcccatgaaattgggtgcacttcatagagaattcttcgggctatcgaatgatatcaagattgttagaaattttgagtggcttaatatatatatttcaatgtgtaatttgatgacgacaactgacatctaactcatcactaacaaatatgatcagctgatttgtgagcaataatcactgaccaaaatcaatggctaataataaacggaatggaaaaacattaaaaatgttaaaataaaaatcaaaaaataaaagaaaataaaaagctaaaaacaaaataatattaatttataatttgaatttttggcacaactttatcttttatgctgaagagcttaaaaatgcattttaatggttatctaaataaaataaattaaaatgtagtttaattttacaaatccaattcaatgaagcgaattaactatatcaatgaaagtttttaaatttaattattttaaataatttttttttacagataatgaatcataacttagctcaaacttgatccaattaatcaatcttggagtttagcgacagctaaaagatctttactatcatatcaacttttaaaaatttagcaaaaatttatcaaacttgttactaaaaaatttcgaaaaaataaactcaataatttgtcccggactttactggatcataaatttttggaatttaaatatcacacttttcttgacataattgaattgctaatcgtcctttttcgaaatttagaaatactgtcaatgcaatccaattaattagatgtttaaaattggttggacgcacaaaaattgaatggacgcattgagaagtgcttattttatgggatttaagagttatggaatctaaatctgacatccatttctacttagattgaaccccgaacccgatcagaaagtcatttcacaaaaaaatgaataaataaatctactaattgggggaaggttttagttcgagatcgaagcgtttgaaaataagggtagaaatctcgggaatttttcattccccattagttcgatttgcctgaaaaaaatgacgttaagtgtcaactttcgctgtcttttgtatgcatagtttttcctcaaaaatcggctcatgaggtgttactttggcgcgactccatttaaagttaagactttttccggcaactttttacctcacttaggagcacaaaacgcacttattttttcaaaaatataaaggaatgctgattttaaatgttattaatttgttttttttattccttcaatttgctcagctattataaatctgtcgaaactgtcttatattggtaagggggtagggtcgggaccgggactttttgggttgaaaaaccgggactttttggctgggaaaaccgggaaaaaacccgggaatttcccggtcccgttcaaaactggtcaaaaccgggacttcggtactcagttgtactcagttatccgtggtttggtcccggtcccgacacaccctatattttgctccaacaaaatgtcagacaaccgaaaagacgcagaggcaaaagcaatgtaaaatgaaaacctcattttcaataaaattttgttttgactccttcaaaaatgctttttacaaaaattttttaaattgaagggatgttggaataatttttcaggccggatagggcttctgcttggggggaagttggtgaagggacggcggtgggtttttgtctttttaaaaaaagaaaaaaatttttttaaaataaaaaaaagaaaccccaaaa

SEQ ID NO: 21863 - DNA, 1162 bp, Heterodera glycines
attcaaagttgcatttttttcaagccctgatagcctaaacagcattaaaattacgaaaaaacagtcttctagtttgttagggtccaccaattctgttatttggaaatttttactatttttcaaaaatttgagcccaattttggacaaaggagcaaatgtcgaggccgtaagtgtcggcgatcgcttagggtctcaggaacttaaaatgttagaagagcaaatactaacattaaaaaaaaaattctgcaatgagaaaacacgaaacacagcttttttcgagggaacgggtcgttttggcgccgccgttttggcgccagcctcagtttttttattataactttttttcttgttgaccaaatctaacaattttggtatcattcgaaagcccttcacaagctctattagccttacaaaaaacaaacaaaaattttagcttctaaaaaagttattaggaaaaaacctcaaaattttcgacttttttgcaatttcatgttataacttttttggtaattgtctaatcgcgaagcaatagcttagaaatatcttctaaacatgttaagctttcgaataataccaagattattggatttggttaacaaataaaaaagttatagtccgaaaacttgggctggcgccaaaacggcggcgccaaaacgatacagacccaatttttagtcccgcatgtccgaatccaatacccattattttcgacatttgtttcgaattagggattaggaattggtcaaaatgaatgcagatattcataatctgcgctttccgaatattttcgcgacttttgaagaaacaaaaattgattaaaaactgaccaaaaattggaccaccaatacaattttgcattccattccagccaaattattcccccacccctttcctaattaatgcattccacatgatattatgtagtattgttatttattttttatccaaaaaagtaaaaaataatcattttcgaaaatttttttgaacttttttccaaatcaaattggtcaatttactttcgaaacatttttaagcaatttttagaactacatctaaaaaacaaattattgcgacacacaaaagttcttcggatttttttataagtaaagacccaacatggtatttacgaaatcaaacttgtgaatcgatagaattactttaa

SEQ ID NO: 21864 - DNA, 1863 bp, Heterodera glycines
taaaatgttaatttgttggtgatgattttgccgtccactcttttgatgggactcagttttctccaccagttttccggaggggatattttttcataaaattttatcaaaatatcacaaatttctcctaatatttttgtgaaatttctttcctataatttttcccctggggcataatagaaataaatatataaaagctaaaaaaacatctaatatttgatgcaatatttcctagaaatttcccctggggcataataggagggactgagttgtcatcggctaaatttgttggccgggcgggcgcggaactgacgaataatgccaatttttcttttcctttttttgttgttgtttctgctgatgtgccgtcccgtcatcctctgctgacgctcagcgagccgtgaaaatgtcagaaagcgtggggagggggcgatgagcgtgccgccaaatgaatggcccctctagggacaaaaaaaggcgggtgccattgtggagaaaaagccgggggcggcgaatcccaaacaacaaaaaaggaaggcattctgcgggtttatcccctcacccagggcactccttaggctttatcccctccctctccgcccccgcctccttggctggggcacaatgtgccaatgtttttctttagcagcagcaattagccctccggcttttccctcggctcccatttgcgctggaaggggtggccgaccggctggcggcatgccaatgcttgtcagtcgactggcacaacaaatgggcacgagtgggggtggcataattagttaaatgcactcagggggaaacgggcggggggggaaagcattggaataattaattaatgctttctctgacattaagtgcgagggaaaatggaaaaaatgtaattttttttattcagagcagattttgagaatttattcaacataaaagaattttaattaaaaaaacaaaggaatttttttaactttaagcggaaaataaaaagaaattttctcattaataaaaaatagctttttaatagataaaattaattaaaaaatgacagaatcataatttaattaaataactacggtaaaaaaaattttttgaaaatgatgtttaaaaaattaatgccataatgcttgatcattgaaaacaaatttaaaaaaaacataaaagaatttgaaaaatcgagccaaaatatgctgaaatggaaaatcataaatttttctaacacatttaccagttgaaaaacttttatggtgtccacaggcggatttaaaatgtgccaccgaatgcgtttcataaaatgccaattttaagatttttcgagaaaaactcgtcataatttttcttaaaaaacagccaaattaaataatcttggtatgctaagatagctctcgaattgctctattagcatgaaaagtttcaaaaaatttcattgcgattcacaaagttgtgagcaaaaacgttcaaaaaattgcaataacattttgaaaaatgaatggaaattttctgtaaggaaacgcccatagtggtatttttttattgaaaattttatctttttagtgtattagaattttattaaaatgttaaattatttgtaaaattaagaattttgccgatttttttcttccctaaaaaatgggtcagagaatcagaaataatttcttgaaaagcgagtcattatatgaaattaaaggtgaatttttgtaaaatggagtggacaaattcagaaaaacattttagacattttttattcaatttagaccattagtaatgttaagacttaatagtacagaacatcttttttagaaataggaattcctgactcactttgtccggacgcatttaacgcgacacacaatcaatttttgttttctcgat

SEQ ID NO: 21865 - DNA, 2341 bp, Heterodera glycines
  misc_feature (2326)..(2326): n is a, c, g, or t
atcattgggccggacaaaggcaaaagagaacgaaaagcagaatagcgaggagaaagcggaggaggtaaagagaaggatttcatcaaccaaagcacaaaacacagaaacaaacaaatgctattcgagactctcgacttgagaaagtctcggctttttgggccttggtatcactttcttggattaacatccgttctcgaatattgtcacagctccctgagaaggaccgagtcgttctgttgcacggcacaacgcgctatggtcgcattggcatcgcgtggtatttcgtgctgctccactcgcacaaaccgccgccggtgctggacggagctccaaggctggaaattgatgagcatgggctgattctgttctgtggctggggccgggagccgcccaacgatgtaatcaaagcgatcaacacgaagtacgggcttcaattcgcgttacgaaaagccaaatgaactatctcggatcacccccaaacgcaacgaagcgaattcggccattccattcattggcattgacattttattgatcagaaaactacaatttttttaccatgcttttcaatgaaataaatgtttgaacttacaaaggaacatatcgaactgttagtgtccaaatcactttaaaaccacttttatcgtgtagagcatagtcgatttgctattgtaaattttcggcttttttggctccggcgccaaatcatgccgataagcaatgagtaaaaaaattttttcttgtttttaaaaagggataaatctgtaaatatctaaaaattactataaagtttggaaatttttcgtaaatagtttaaaaaaactcaaaaatttttaaattaatgtctattaacattaaaacgaagaatttcggggctaaaaaagaaattttcgtgcatttttcatcgaaacactttccttcattttggcccctgttgcttttgctcctacagcactttcagctcctacaggctattctcgatcagccattacaacacccttgtcagaaaataaatgaatttacctaattattttatttaaaaatgaccaacaaaaatatacattttattgaagcaaaaatatttcattataaatcaattaaaattacgcatttaatagcatttcattctgcacattttcgtcaaattcctcagattcatttaacaaatgctttaattgatcaatcctaaaaaatcaaaaaattaatttaaaaattattttaagcacttttttatacattttgtgaagcttttgtgcacttgtaaagaaggaactcattaaaaaatgtttagggcgcggtgaattcgaatgattctgctgataaattggcaccaatccattcaaattttcattctctgtggtaaattctcttttcagtgaaaggccaaggagccaaaaagtgcaaaatgatttttccctaaatttgaaaatttaaaaaaaagaatcgagagttaattaaatttatcactttaatatgtagcaaatggttttttgttcaaattttgggatctgatgataattgtccaattgggcttggactgaattgacccatcccaacaaattttgccgaagtcggcttttctgataggcacagtttgatgagtacgaatcgaagtcgaagccgaccgattgtgagcaaacaatcagcgcaaaatgctcaaatttttcttcataatttatctctttaaaaatcctttcccaattttgaggattctccgccaaaatttcacttgctgaaaagtaattttttataaattaattttaattaaattaaattaaattttcgaccaatttttaattcttcgataattgtcctcattgtgaaaggattgacattaaatgcagcattttgttctggaaaactcggcgtaattattgtcatcgaactttgaagtgattgtcccaaaaaaatggggggccaaaaacgcccgacaattttgttcaatttgttaggagttaattgcttcagcataattggaacatttggccaatcccttgatttaaaaaaacgaattaaaaaaattatgcttaataatatttttaccatttggcataaatttcgaagaattgaaaaagtaaaaatgatacgggtgaatttgggaacaaaacgcaaatttgagttgccattattgacaaagtgatgccattgaaaaagccaaataatcccgaataaattaagcgagctttaaggcaaattataacatgctaaatgaataaatttaattttcaataaaaaaaaattacttttcgcccaaactttcacaattttcagcaatgatgaaagcatgctttcactttgcaccaatgcaatgtgaaatttggccgattgnatagcctaaaaagat

SEQ ID NO: 21866 - DNA, 1976 bp, Heterodera glycines
tttttaattctttaaaatttttacttttttaaattaggaaatttaaaaaaaattaaattgatttctcatttattcttttaaaattttttggcaacatattaatgaaattctatacatttagcattttaggcgggtttttaattttttttttttctaaaaccattatttttcataggattgggccaacaaatgtgagggcgatgcgcccgtgttgccctgtcaggatgtgaatgcgcccgacctgtacattccgttgatggcgttcatcacctatgtgctggtgtctggttttgtcttcggagttcagaaaaggtatatatatatatatatattttttttttttgcaattcggtttcgtttaaatttgttaattttgaaaataaaaaaaaaatttctggtacaattggcgaaatcgcggggatacacccatcactttttgccacaaagatctgtacattgaacatttttaaatcaaaaggttgcgattttcattgaaatcggtgctcaagcgattgcgcaaatttttcattataaaaaattaaaagaaaattacggttttttcaaaaaaaaaaaattcggacatgaaacgataagggggggacaaacgtagtgcacccaggcgttatatcgatagacatggaaaaaaaaaatttttttaaacttaaacaaaaattgataaaatttaaaaaaacgatatattttcatctgcaaacatgtttcatttcatggcgacatatagtaaattattttagattccctaaatttataaagcatatctaaccaattaccacaaccaaaagtttttttttcaaaaaaaattttctctttttttttgcaggttcagccccgaaaagcttggcatgctgaccacaaatgcgttgttctatttgttccttgagaatggcattgtgttcgtgatgaaatacgcgttgaacatttcgcagagtttgaacatttggcacgcactgtcctacagttcctacaaattcaccgggtctgattttttggcatttttaaaataaatttatttttccccactttttaggatggttttgtgccttttgctctatttaattggcggtcgaaaagtgtattattgtgcactaatttacttcatattggcaactgtgtttttcctggtaactggatttgaacctggactcaccagaaatgcaaacccaaagaaattttttatttttatttttttgaaattggaataaaaatagagttaatgccattttgcttgctgtttttgaaaattatttttttttattcaattccgaacgaaacaattttttgatttagcaaatctcttatccagctccttataatttaaatttcaaaatttttcaatccattgatttcatcttcaaaaaaaatctaaaaatttaattttaatggtgccaaattcagttgcgcagtctgaagacgtttatcctggacatgggctggagcccgcacagcgggcgcaagcggaagctgtacctgttgttgtccatcaccgcgttccagtcgctgatcatgtggttgttgaccaggtacgtgttgttgtttttgtgtttgtttctcctcctcccccctcccacagtctaattaaacataaaaattgaaatttaaaggaataaaattttaaaaaattacaagaaaatcagacccaataaaaatgacaaaatttgagtatttataaacgacatttgatttattcgcaaaattcagtaatccacctacaattttttggcatttttttaattttaattttctacccctcctatacgcgaaaaacgggtacaccccaaaatctcgccgggacaaaatctcaccgcagaaatttcaaaaaaaattttttcaaacagaaatttttcaaggaaaaaattcttagaaaattttttataagaaaatttcaaaaaaaaattatttgttaagttttttttttgaaaatttttcgaaaaaacagtaatttatcattaaatttcaaa

SEQ ID NO: 21867 - DNA, 2140 bp, Heterodera glycines
  misc_feature (2040)..(2045): n is a, c, g, or t
tggagaggacagacacaaatacagtaataaaaagtcaccctaaaatttcaaaaaatgtcgaaattcccaccaaaaaaaattttattgttttttttgatatgataaatgaaaatgttacgacacaccagacactattttgctgcaaaagttttgtttgtctaaaattgataaatttcaaataattctcttcgaaattcccttccaaaaaaaattttttttttcagatcgagaaggccgtcgtttcccagcgtctcaccaagtctccgtcagcattggttgcttcttcatggggatggtaatgaattagtgtttcaatttttgactcaattttatccctcaggtctggcaacatggagcgtatcatgaagtcccaagcgtatgccaaagcgcgcgacccgtcccaggaattctatgccaagatgaagaagacgtttgaagtgaacccacgccatccggtggtccgggaactgctccgccgggtccaggaagatgcggaaggtgaaattttggcaaatattttttcaattttgtaacattaccacaatttttcttggtacacagatccgattgctgtctccaccgcccacttgttgttcgagaccgcaacactgcgttccggctactcgctggacgaccaagttggcttcgcggagcgcattgagggcgtaagttttttgggaactgtgcaatagcaatcaaatagacagacggacggtaccaaggggacgagggtccccacagggaggtaaatttaggagaaaaaaaacgaaaaacctataggcctatccaaattttttttctcttttgtgaacccaaaagccaaaaaaacccgtacgccgtcagggaacttgataatttgagcgaaaaatccaattttcatccattcatttattcagattttgcgcaagacaatggacctgagcgaaaccgccgaagtggaggaagaaattgagccgctggaagaggaagagcccgaaaagaaggaggaggaaggaaaggaagaagacggaggagaggaagatcaacagaaggaggaggaggatgaggaaaagaaaattgttgtggagggagaggaggaggaggaagcggcggcgcgagacgaactctgaagagagggagaggccgcaaaatgacgagcttttttttggagggggtattatgccttagggcgcgaaagaaatgatgatctgttgttgtttgtttttttctttttgactgattgttgcatttgatggatgttgtgatttatttgtggggtttagccggccgttattcgttcgttgattattatttattatttggacaaatttgacacacccaccacacactttgtttcccattttgagcaaaaaccgagaaaagagctttatcattggacaatgttcatgtttctgtattttatgcctgtgggcaatttgtgtggccagtggatttccacgaatttaaaaatttgcataattttatgaaaggtcttggcaaatacctttcccagtagagctgcaacctggacccaggcctgggtttttcccgggtccaggtccatgccatttttcgtcaacctggatttttgttctgaaaatataggctatgacacgcctgggtttttttgtccagcaggaaatccagttttttcgaaatgtcgagctcttaaaaaaatttccatcggtaggattaaagacaataaaagctctcatactgtgcattctttgctctatttggtgtaatttttggcccatttgctatttttgttgttgacaagcgtttttgtttttccataaaaatgcttttcctaattcccttaattgtctcttcctttctgtccctgcatttctttttgtcataaattatttttggctgcaataaatttcgctgacttctctaataggtatgttgttcgggaccaaaagttttccgaatttcgaccccgattttctcgctgtcgagtccgaatctcggacgacaaattaattctttgattaggtgaatcgaccgttaaaagaatgggggatgcgcgaaagcgtcgagccgtgaatttccccnnnnnnccctgtcgggggcaagggtcattttcattgcaaaatttctcgcataatataggcatactgtatttgttcatttttacccccatgaaaaaaatggg

SEQ ID NO: 21868 - DNA, 958 bp, Heterodera glycines
  misc_feature (16)..(16): n is a, c, g, or t
tagtttcgggaaacanccagtgagaaaattgataatgttttcgggattcacattggcattggcataattgtgatcattttgggggaggtgaatgttattgatgtcgttatagagtgcgccgtcatgttctaacttaactttgtttcgttttgttttaattttttctgctggtccatattatataatttaaatagccttaatttagtttataaactcattaaattataaaataaaaattcgttagaaaaaagagtgaaacaaattttggtaaaatataatgtgagttatgaattcttttttatatgcaaccacgcgaaaacggccacgcgaaaacgtacctcacgcgaaaacggccacgcgaaaacgtcctggcccgttcggatgataccaaatttatcaggattcgatcgttttaaaaaaaagttagaagtgtcaaatctttgaatttttcgaattttgaaccgagccgagccaaaaataggtttaaaccaaattccgcaacttccgggaaacccaaaaccgggctcaaaatcccggagctttagggacttcgggttcttacacacagcgtccgggaaatgagctcctgtgccagaaaagatttgcatgtgtggctcagtggtttttgtaagatagtaaagggacaaagggtggtggttcgagtccgttgtgcaacatgaatattttcatttatttttgtccaaaatattaaaaaatcacgatatttgggaattatttttgaggtttttgccaaccaaattggataatcttggtatctttcgaaagctcttgataatgagaagctttttctaagcaaatgctaagcgatttggtgtaccagagaaaagttatgaggctttaaaattttgtttttttataacttttgaaatagagcattaacaaaaataaatgcagcattaatcgatgcagaatttttttctctaatgatatgcaaaat

SEQ ID NO: 21869 - DNA, 1650 bp, Heterodera glycines
caaatgataatgataaactacaaccgcttctttgtttccgattcaaagcttaattttttcacttgtgtatataaaaatgcataatgcataataatgccaccataaaaatggacttcttatacactacaggacatcgccagattaaagccacagatacaattactaagatttgaaacaaaagcgttcattctaacctcctcgtgcgacttctattgcttgcccactatctcattgcttttcccgttttccttttatgctggtattctttgataaattttcttaagagaagaggacatatttctcagcgtgatgccaatgagatgatggatgatttgcgaaattatcaattaccaaaaaattcatcaattatttttccaagtttatcaataaagaaatgattaacgcacaaatattcaatttttttcacatgatcccctttcagccttgatgaagatcaaaactaaatttaggagtgcttttcgttcttttgaaaaattaaggttacgtgacaaacgcatatgggccaagcttttccaacaacgttaattggattgttatgaggagagttgacgatccaccactcggatagagccaactgcaaatctctctgtgctcattacgaaaaattgtcaacgtgcaatcctgtctcatggtgaattcacgaagaaaaaacaaaattgcaatcacatcaagaccattttggagtttgtgtctcatcatcttcaacaataaaatgcatttttaatggatttaaaaaaaagtaaaggacatgctcaatctttttttttaaagctcacaacaaatgaatcatttttctctctctctctctctatcaatttttcttggccttcttggttgcaatctcatcaacatcatttttttcttttggcacatcactgtcatcattccctgggcacttcttgaaaaggttgacaatccaatcaaatccagtgtacgtctgattgttcgcctagggcgtggtttgtcaaatacataataaatatcaacaaaaaaccttaatgttaacttttgcgatcagcttcacagcaatcaaatcgtccaagtgtttcgcaaggctttccggctccttctccttggcgagcaattcagcagctttcattcccaaaaactcttcggcaacactcgaaaacatggtgacacgttgagcaatgtctgcttgttcaacatcctgcagcagaagacggacaaacaccgtgtggatgggggcaatcgctttttggccgcaagcctcacacatgttatcatcggacaattttcggcggcaaatgagccccttggaacggaatgggcatgcctaaaaacagaaaaattaataatttaattaattaatttaatttggactttgtaaacacggtactgcatatttgtcacttttcccaaaacataaaaaacgccggccgaattgaagttgaccacatcgctgatgtgtttcggttcaactgaatccaactcctcttgctgtcgtgtcccttgctccgggagttgaaagcgtttaagagaattcattgcaggaagatcggaaaaaacgaaggaggatggaattttttaaaaaatggaacacaaatgatttttatttaaaaaaactgtggttaaatagcaaaaaaaattgaggcggaaaaaagaaactaa

SEQ ID NO: 21870 - DNA, 1554 bp, Heterodera glycines
agttcgaaaaccgagaccgaatattttctcgagtgacccttggctcccgaaaatagagacccgagattttagaaaatgatcccgagatcgagaccccccaaaaaacagattttctcgaatgggaaaatggctcccgaaaatagagacccgagattttagaaaatgatcccgagatcgagaccccccaaaaaacagattttctcgaatgggaaaatggctcccgaaaatagagacccgagattttagaaaatgatcccgagatcgagaccccccaaaaaacagattttctcgaatgggaaaatggctcccgaaaatagagacccgagattttagaaaatgatcccgagatcgagacccccccaaaaagccgagaattttttttttaattgaaaattgactcgctcatctctccctaaatagtataatggcaaaaatggtagtcgggcatgggagttgatcttcttctgtgcactttttgatcaccggcgcaattccccgattccgttccccgcaaaaaaggcacgacggcgaaaataccccgccaaactcacaacaaaatattgagggtaaacaatcaactgccgagaatcgaaaatgatactgatgatgatgattaatgtttgggatgttacaacgcaaaaatttatttatttatttatttgggcatttcaaaagtgtgaaaattaacggggcaatcgcgtccctccctataaaaacggcacggagggcggcactttgcaccaaaaaaaaaaatttttttttttttttattacaaatatttatgattaattgtaggtactacacctaaatatatttttgtttttaatctttgtttttgttgggtatgtgtttattattttgtacgcttaacggaccaaaaaaaaaaaaaaattgtattttcttcataactttttctttacagtaatgttgcaaccaaatttgacaaagtggcaaattttaataaaaaaaaaaaaatttcactaaaatttccaaaatttttccacgcctagccgtccaatagattattttatgctttttgccaaattttccaaaaaatacatagtagtcatttttgggccaaattcaattaataaatgtgctaaatgctattatgtatttatttcatccgaggttcaccgaatttttgaaaaaataaaattttgcaaaaaaaattttggggctaaaagcagaaaaaacttttttggattttcttccaccttcgaaatttaatgataccaagttttgttggatttggttgacaaaaagtgatttgccaaaatcctctacgatttggccttcccagattttgttttaaaagagaaaaaaacggaaattaatttaaaaatggccaaattaattaacggcaatgaaattgcgcaacaatttttggacgaagtggcccagggaatcagccgaattcgagaacagaacagcgacttcaacgttggcttggccattgttcaggtcagtcagtgtggctatgagtttggcacgtcccccgcaactcatgccaatgatcactattcactcatttttcctgaataattcattgat

SEQ ID NO: 21871 - DNA, 2768 bp, Heterodera glycines
ctgtattgttggcagttttttttaaacgagatgcaatttttattttaagatcaaaatctagctaaatcaattttaaacagtacctttcattcaaaaaactgtacttcattttggcccattttttctcacaattttcatctgataatggctcttctgaaaaaatttgaatcaaagagtgcacgagttaaaggtgtgttaatcagttaaaaacacaattcataatttttatacaaatttttgtccaggcatttccttccatcccacgcgtccgtgggtgttggcctctctgcacagcggagtcatccaactttgggactaccgactgtgtgtgctcattgacaaggtttttcaatggaaagctaacaaattctgggcatttacgacccttttataatggagggggagggtgatggaaaagccaaaagtggtgctaaatagggtaattaatttgttttgttcttttctaaaagaagcaaaacccctttgggttcttcgaaattccacgcttccccctcatttataaaagtgccatttaacttctcgtggttggagaataagtactcgcatcaataaatgtctaattcattcgcattcagtttgacgaacatgatggacctgtccggggctgtgacttccattcgcagcagcccattttcgtgtcgggtggcgacgactataaaatcaaggttaatacttttactctctgcacattaattagtcaacctcataacagttaatcctgggattttttcaattctattgaaacaatgtaattcagaggcttacaattactttattttcttgaaaatcctaaaaaaaattgacgggttcgtttcaaagcaattttggtgccaaaaagtatgggaatgaatgtaaatgcccattttaattgtaacactgactaaattatccatttcggagtttctcagtccgttccatgtccaatgttcaggtgtggaactacaggcagcgcaagtgcattttcaccctgctcggccacttggactacattcggaccaccttcttccacaagcagcacccgtggattatcagcgcatccgacgaccaaacggtgcgcatttggaattggcagtcgcgcaattccatcgccattctcacaggttttttgagaggaggggacattttttgtatttgaaaagggccattccaatcttttggtacttttctagtttaccggagcaattccacatacattttcaaatgcctataaatgtgtttttgaaattaatgaaaataaatccatacaaatttcgaattctatgcttcctgtaccaagggtaccctcattggcaagatgcccatgaggatatcatccatataaattttataatttaattttgttcgagttcgggtcaggggttcgaaattggcaaaaatgggtgctatattcgtgatcagcgacctcaaaaaccccttaaagcttattttcattaatttttattaagtattaacagcataattatggcgaataaaagtatattcacgattttttgtcaaaaaatttaataagaaatgggcaaaatgttcaacctcgggtgggaatcgaacccactcatgcaccctttccgtgggcagatttttttgaaaaacaaaagggtcccaaaaaaattactcaaaaaaagtgaaaaaattttcaaaattgttctccttgcaagtagcgccgaagattgcatttaccatttttactctcttttaaattggatttatggatttatcccctaattgaattgttgcaattaaattttcctgcccccgccccggggctaacatcgaacacattagcggggttgggggcggcggcgatgggcggcacccatttaccgccaccactcattttcctagactttggtataagtcttaaaaaaagtgcatgatgtgcctgggcaaagtgagcaccatgacgcgtgtgaccatgggctgtgtgcacgaatttcattgcaggtggcgaaggggctaattccgatcaatttagaacccatggtccccgatttcgaacaagtctaaaagtcgattttactggtctaaatcccggaagttttgcgcttgctgatcatcgaattcgaaatccgttccgatcaattttgaacacctgcgaatccccaaaattggagcatttaaattacagtttacgcgtctattcaatgtgtagattttcagcaatttttttttgatgaaaaaatgggaatttttttgtccctttttcctgtaggtgttatttagaggtaattgtggagcccggatttgttgtcaaaatcaggttagctttgatcagtgtcgtccctcagtctgtttctctctctctctagctaggtaatctggacaggaaaagcggttatgtgcaattttttcgaaaataatgagaattaggtatataccgtatttaatcgattagaacccccctctcgaatagagccccccccccccttcagagaggggttgaacaattgagccccctccaaaaaaaattttccaaaaagaattcaaattttctgcccattggtattataggtagggccataacttttttaaaccttaacgaaatttttcaaaattttgcagcctaatagaggacacagggcttgccaatgataccatgattgttggattttgttgacaaagaaaaaaacttttttatgctgactctaaatcagaaatcggatctcaaatgatagaatattgatgatatatgatacagacatatcaacgaaatacatatatgacaattcaaatgatcaatcggataaatg

SEQ ID NO: 21872 - DNA, 2492 bp, Heterodera glycines
aaatctgatttttttgagcccggtgttcttttgaataatttttgatggccgtcatagccttaatttcaaaatggacgtattcacatgccatgtgaatgtagattagcaaaaagacattcgtcttgatatgtgaaattaattcagccaaagctcctaattagaatatgaaaatggtgatgaatttattaagcctttttacattaaatattttgccaaattgtttaataattgctcattttgattttgctcactatcacagaagtgccttactgaattaatttcgtattttatgatttcattttctttagcttcacttttctcctctatgtatgaagagattgcgatcatatttatagtcaaaaatttaatcaatttattttgtattaaattcggttaaaattacacaaatcttttatttttcttatttcttttaaaaaagactccatccaaacaatcttaaacatttttcgtaagccgaatcaaatttaagaaactcatgtaaacttttcactcatattaattctcttattaatcttgcaaaaaatgtgcaattttagcaaaaaatcagctaataaacaagccaaattttacataattcccggctgtgtgttatcgctggatactaatagtcaaggttaggctttatttttttatatgctattatgtgaaaatgttttggcataataagctttttttcattcagagaatatataacgcgcaagatttagttgcacaatagtcggctaaccacaattatcattacaagcgcttggaattatatgtaataaaaattgcaaaattggatataaatatttttaaaaatgccgaaatatgctaaatatattcaaaaactcaaaaatatgtacctaatgtaaataaatgatttttgattttttagaaaaaaatatattagaaaagcatgaaatagggcaagcgcaaaatgccacgaagttaccgaagatcttcgaataacattttgtgtgttttaaaaaatttgtttttatacgactttttgaaaatgccattttatgggtacattttccaattttttgtattttttcttaaggaatttctaaaaattcataaaacttcaaaatataaaaaataaaaatatttaataaaaattgcaaaattggggtattgttttgatcatttaagaaaaatttccataaataatcttcaaaaatagccatattatttgaaataaatttggttttaattgaaataattataattatcttaatttattatatattaaattaaatttttactttaacatttgcctatataaatgaaaaacaaaagaaaagtattatttataatattttcagttgaaaaaatacccttactaatcaaaaaagcattcaactaaatgaattgaaaatgggacatcaattataaaagctttaaataaaatttttgaaatcattcaattttttgtgcatttcatttagtgatttttccttcatttctgttcccaaatcccactctcaaagcaattcgttttactctcaaccgtctaacatggacaagtgggctgcacttgtgtaagttaattgggtgggggaggggttaattgcccctagaatgaggcaatcaaagcaaaacccgaaaaatactgatcaccaaaacggtttaaatgcgtttaattgatctaaattaaaacaaaaaaaaacacgaaaatgagggtttttaatcggtgttaaatgggaaaccgaactagtcctaaacgaatcgagaaacacaggccaaatatagactatctgtccactttcagtctgttgatcgccctgatcaacgcgctggacagcgctgttgttcgacaacagcgcgccgccaacgcggacgcatcgaaaccggaaccgaacaacgaaaagccaggtaaattaaaatgaatttaataaaaaaaatttaatttattaatttgatttaggaaatgtggactgggacaaaggaaattcggacaaaagccagggagcgggtacggaaggaaagaacccggatgagccaacggaaagccagaaagtggaagaggatggaccaaatccgaagaatccaaaggaaagccaggaagtggaagaggatgaaccaaatccgaagaagccaaaggaaagccaggaagtggaagaggatggaccaaatccggaggagccaaagaagccgggaacgcgggaagcggaaggaacctggaggaaaaaaggccaaggcggaggcggaaagaaaacgggtggaaagggagggaagaacgcgaaaaaaaggggaaagagagcgcccgatgagccggcaccaaagtcgccgaaaatgccggataaatttgacctaaaactgccaagtatgcataaaacactgatcgtcctggggtcagatccaatcttctgacatggcatgttcggttacatttgttgtctgcatttttttgtagtttttaaatgaaaggtgcaaaaatatttaattttgtataatataagcaaaaagccaaattatttctctat

SEQ ID NO: 21873 - DNA, 1257 bp, Heterodera glycines
ctgaaaagcattagtaatagccagtagagaccggcgcgggacgggatcccgcgcgggattttgccggatcccagtccgcaatctcgcattttttggaaaatgcaagattttcgggattaatcccgcgggatcccgtcccgcaaatgtttgtttcgacagtaagtttgtttttaaaaaagatgattctatatggtataaatatcgttaaatttttacaattaaatgataagcacaggctcttatacattgtgcgattttcaaattttgctagagcctgcggatttgcatcttggcactcaaaccctgcattagtatgcagattttcccagattcgagaatcttaaataagaaatttttgtattcttgactacaatccagcaagagaagtctgggtaatacagaaaaatagggatgaaaaaatccgagggtttcacccccggtcaccgtaccgcgcccctggcgccaaccctactgtaccgacctgtcaccgccacgccgaccaaatacatcagtgtgggactcgagcagaaaacggcgccgctcaaactaatatccgatttccaaatgccaaatctaagaaaagtcggaaattttcgcatttgtatgggattggaatgtttccaaaatgcaatcttcattgctcaacacaccttataagcccagagtaaaacgcaaaatcactaaaatctggcttttttccttttttgggaccaatcatcaccaccattaccgcatttagcagaaaatgatgagtaataatttttaaaaactcgctgaatttcgttaaaatattcaaaaaaaattttacaagtactaatcccagcttcacacgtccctggttttctgcaggcgatgcctgttggattcagaaatggattttattagaattttttcttttttggttatttattgggaactgccagatttgcgcctcaacatttgcgcctcaacatttgcgcttccaacatttgcgcctggaacatttgcgcctccacttttgcgccccccacattagcgcctccacttttgcgcctccatttttgcgcctcccacatttgcgcctccacttttgcgcccccacattagcgcctccacttttgcgcctccatttttgcgcctcccacatttgcgcctccacttttgcgcctccatttttgcgccctcccaatttgcgcctccacttttgcgctccatttttgcgctcccacatttgcgcctccacttttgcgcctccatttttgcgcctcccaaatttgc

SEQ ID NO: 21874 - DNA, 1295 bp, Heterodera glycines
ccggcgctgttgaagacagcgtggcgagtgggcccggtgctgagcagtccgatcagcagaaatgccaacgacacggccaccatggcacaggcagacaccaaaaacagcaaatggacctgacgggggcgaatttgattttgatgagtcgtattttgtgaaatttttgtttaaaaaaatggggtatgtattcactgggaaagttaggggccaaaggctccacagcccatgctattttatgcggccgaaccgcaattccaaaagagaattagcacattttttgcatttttttcaattttaaacatcataaacaatttaatttttttttggttattttttgccaaaaaacaggatatttagaaaaataaaaaatagaaattttgtaaaaaaaaaatatgatgaataattaagtgttttcagaaaattttccttcttttttgatgatttgtttaaataaatttttctgggggagggggaacctagcgcacccaacacatgcacacacacacacagaccttgtccaaccacggcaaattgctgacgcgcagtgcgcgacgcgcctgctcaacagaggcagtgaatgcccatgccatcattgtggcgaacaacagcacgccgaacaggcagcagaggaaggcgcacaacgaagtgaacggcgtgcgggccaagcaaccgccgccactgtcgccgggcaaccgaagcggaggcggcggcggatgccgcggtggcgagtggttgagcggatggggcggcagggaagggaaatgcggtggcggttgcccatgctgagccaattcgggcctaaatttttgtgtcattttgtccccagttttttttttttttgctaaaaacctaaactcatagttttcggaaaaaaatcgtcaaatttttgtaaaagtcgaccaaataaacaatctttgtatcatttattatccacactcataaattacgaaggttttcatcgtgttacaaaaaaaaattattacaaaaattgtaataaaatttttatagtccataacttttttctaatatgatcaaatttttgaaattttgcaagtaaatggaaaatcatattggctatcgaatgatgccaaaaatgttgaatttggttgtttattaaaacttcttttaccaaaaatttgttatttcaaagatccataaaatttggcaagcctttcaacaatttctttgtaagcactttttgatcggtcgagcatttctgtccacttttgaaaacctataaaaaaatgggcactggtaaagaattgtggtccctaatttaacttttttttattttg

SEQ ID NO: 21875 - DNA, 1231 bp, Heterodera glycines
  misc_feature (51)..(51): n is a, c, g, or t
  misc_feature (65)..(65): n is a, c, g, or t
  misc_feature (70)..(70): n is a, c, g, or t
  misc_feature (95)..(96): n is a, c, g, or t
  misc_feature (102)..(102): n is a, c, g, or t
  misc_feature (119)..(119): n is a, c, g, or t
  misc_feature (124)..(124): n is a, c, g, or t
  misc_feature (142)..(143): n is a, c, g, or t
  misc_feature (145)..(145): n is a, c, g, or t
  misc_feature (149)..(149): n is a, c, g, or t
  misc_feature (152)..(152): n is a, c, g, or t
  misc_feature (170)..(170): n is a, c, g, or t
  misc_feature (175)..(175): n is a, c, g, or t
  misc_feature (177)..(179): n is a, c, g, or t
  misc_feature (191)..(191): n is a, c, g, or t
  misc_feature (199)..(199): n is a, c, g, or t
  misc_feature (203)..(205): n is a, c, g, or t
  misc_feature (210)..(210): n is a, c, g, or t
  misc_feature (212)..(212): n is a, c, g, or t
  misc_feature (227)..(227): n is a, c, g, or t
  misc_feature (250)..(251): n is a, c, g, or t
  misc_feature (263)..(264): n is a, c, g, or t
  misc_feature (266)..(267): n is a, c, g, or t
  misc_feature (274)..(275): n is a, c, g, or t
  misc_feature (279)..(279): n is a, c, g, or t
ctttttcaaaatttctttcctattttttcaaaaatttttaaaaattcaatntatataaaatttanttctnatcataacaataccataaaattttnnaaatcnttctcttattataaaanttatnccatccaaacactttttnnantttnctnattcaacaatttataatnactcntnnnaatttttttaanaaaatctnaatnnnccatnanataaataacaaatancccttacaaaatatacataattnnttttttaatttnncnnattctcnnaaanaaaattcatttaaaaaattttgaaaaaatgcattttggaggtgaatttaaaaaatcataaaagttcacaaactcaaaataaaaatcataaataatgcttattaaaaagcccagagttttctccttagaataacatatccaaattaataataatttgtttgaccgatttttaaaaaatccgtaaacaaatcaattcacagctatgcaaagacttattttttacaccccaataaatgccttttataacttttagagactaaattcactccgtcaaatttatcagtagagaccggatttttatgtgctaaaaatcctgaaatatgtaataaaatatgtgctaaaaaatgctgaaatatgtgctaaaaacccccaaaaatgccaaaatatgtgctaaaatatgttttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaaattttttaatttgaaaattatgttaataattatgaaaaaagtcgatttttaggggtgtatttttcaattttcttgtatttttattgcaatttttctcaaaaatgccaaaatatgtgcaaaatatgtgccaaaccccaaaatatgtgctaacatattttatgtgacaaaacgccaaaatatgtgtttttatgtttttataagtcgctctaaatcaaaaattgttcggagataatgctatttttgggcttctctcgccataactaagccgcaaaaaaaatatgtaaaaacataaaaatccggtctctagttattattaacat

SEQ ID NO: 21876 - DNA, 1397 bp, Heterodera glycines
aactgaactagtaccgatgttgagtatttggtttgacggaattcgactgacaaaggaaggtccccaggtgtccgtgggatttccaaatgaaatttggtgggtggatagagcacccatgggttcttaagaaaagtgtttttattttctgcgaaatgagtctgagtgccgagttatgacgtgccaaactttttttatcgcaataaattaaataaatatttgcactgttttgtgttattcggtggtgcggaggttgtgctcctgccttccctttttgccctcgctggttcgaatccctcatatgttaatttattttccccgttttatttttgattttatgcaaattaatggccattgaaatcaattccatcgggtcaaaaatttttattcctcctttttcattcaattttattcattttcacacaaatggtaatcattaaaaaaatggttaaagcataaatataattcacaataagcacaccgtaataaaataaaacattcacaatttaatttctgacacatgtcattttttggcacttcaaagcagtatttaacgggatggcaaaaatttggcagaggctcgtccccgtaataacccgattttctccaggcaaaattaatccatccatgaaaacgttctgcttgaaactgattatggattaacgattgtaatttaacaatgttatccctgtcgtgcaaatttattttcacatcataaatcattacaaattccgttatttttctcgtaaattgcttccaaattctaaaactattttttattttatttttggcaacaaaactaccggaaaatgtaaacatctaatggttggcatattccagttgcatgttttgggatttgcttcacttttaatttaacattatccgggagtcgaaaatcattccaaccattccaactatccaccaacaataatgattgttctccagggcgtaaaactgggaccaaaacattgtgaacccaatcgatcattaaatttttggtcataatatggcttgtatttggaacagcaaaaacatttttggccttaatttttagcaaattaaaaattaataaaataatttaaacctgaaaaattcctttttgaggaaattttccttgtctttcagcaataacaatatatagtggtgacaaaagcatgccatcagctgtaatgattggcatgatcgtatagctatgtgttgtgcttgaaaccgactgcacaacacattccacaagcttggttccaattggagccaacgaccttttttgatgcagctcgagctcgaagcccgattgatcggcatttaaaacatctcgaacaaaaacattttcagacacaaattctctgacatcatccacaaatttgatcagattctgatttgatttttttcagggttaaaaa

SEQ ID NO: 21877 - DNA, 1768 bp, Heterodera glycines
atcattgctgatgagcgtggcaaccgtcagagttttgggtagagtaaaaaattagagtccgttggttatttatctaagtcattaattttagtcattgtgagtctgtttcggaaccgatcacaattggaaactgttgcaacgaaatgcacagctatgaacacattcagcgcatttttgcggccatgtgggacaaggataagttccaggcccattacaacaactgccgacattggagtgacggattttggtggaaagtgtaagaaaattaattgtaaaaaataataataaattttattgatacggaaaataatttaaaaagacgttttctctaaaactaattaattctcagttttttgtgaaaattaattaaataacattttcagtggttttttaaaaagcaaaaaaattcactgatttttaaattgatatatgctaattttctaaaaatttaactgagtttgggttggaaaatctaagttttaatatgaatttttaatgtcttaattaaccttaattgcttaaagacaccctgatgagtaccaaaagaaaaaggcagccgaagaaaaaatgggcgcgagaccgttggatgtgaagagttaaatggcaaaattaatcatgtgttttgagagaataatgaaatctttcgattttattcaaaatttattttggtatttgtcacaaataatcatatttacacagaaaaaatattgaaagatatcaaaataaaatattatttattaatttaatttatattccaaatgaatgggttaaataaataatcaaaaatttattatttttcaatcaaattttcgcataaataaaaaaaatggaaaaaataaaaaattatgttatttaaacagctattaatggacttttccccataaccatcttaacaaaaataaaataaattaaaatttgaaaattaagggagcgaatcaaatgcactttcgtttttgcaataaattcatataaacaatgtctatgtgcttaaaaatacgatttatttgaatacgtaaattccattttgatgaaacgatgaaattcatgagttttttcgctatttaagcaggtcatacaataaaagcatgcaatgaaaaaactctgtttattgattacatttaaactttaataattgttttcctcattttatttattaatgacaagaaagcacaaagaaagggaatttaatgtgttaatgtaattttttttcttaaattaatattgaatacaaattatttttttaatgtttaattaataataatttgaaattaaattttttgaaatcttttttagatttttaacttttctacaatgggaaaatgctcttcaaaattagtcaaatttttattttgctttttacgattaatactaattgggtcattggagcattacctgattcaactcaatgtgtagcaagcacaacaatcagcaaacaatttacgaacatttagacatttttcatttgaaattattttaatggagaattggtgtcggacatagacaccattgatggtttatatccgggtgtcaatttactcgcataacttgtatcaagaacgccaaaacaggtaacataattaaattaaatgaataaaaacataaattttgatttttcaatgtttgcaggtggtatcattcaacttcatgatgcgtatcatattccgcaattcacaactgctagacagtttgattaccctttggtctatcgacaccgacaaacatctatgcccaagtatggcaattcattaattgaaaaattaacaaagaa

SEQ ID NO: 21878 - DNA, 2130 bp, Heterodera glycines
  misc_feature (2093)..(2093): n is a, c, g, or t
ttctgtaaaatgaaaaaaagtcaaacattgcaacaaaaaaaaaaaaaacacatgcctcagaaattacgagtgaacagttggtggtgttggcaaaagtgaatgtgaatgaagcaggttgcttttatatacactttaggcgcgcagttaaaatccaaaaatcgcatccctactaataaatgaaaaattttctcaaaaatttgtctccaaaatttattaattttcttggcaaattttgatattaaaaaataatataactacgatttggcataagtttgttcattttataattttgtcattttacacccctaaatttgatgtttatttgtgcctattttgcatttttttagtgtctatttttgggttttttttagaacctaaagcctgttttccagaaaactcattcttgcatttgaccgagagactcgaatgataataacatttttagggtttgataaggcacatctattcattaatttacagattttgacaaataatctcgcaacactaacattttcagtttgactcttaaaagttgcttttattacctatatttttgtaatttatttcaacacacaaatttttgttacagattcgtgtacaattatttaaagaaaacagcgctttctgttcttttctcgcttcaaaatgtctctttttcttcttcgtgctttgcctcttttcttccttttctctctgtgcttcgctgcctctcccttcaattttcgcgcaaatcattcgcttggtgccgaaaccactcaacagattgtgcccaccgtggcgactgaaacgaccgacggaccgaagcctacggaaaatgttccccttatgttggagaatgacaatgtcaccgaagttgccaaagttgaaggacggaatgccagtgacagcgaaattgaaatgagggaggaccaaggtttgcaaaaggaatgtaaaaaatgggttttcattttcaacggattcggaatggatttccttaggtttttaatttgggatggatttaatcgattatttcaaagtgtgattcgctttaaatatgtgtcatttgtttagcctttgccaacatcactgctcattcctccgacaatgcttcgcttactgagagttgtggcttcttttgccgaaacggtactgccaacaaagcccgaaaaacccaattattttctgcgtttagctaaatattccatacaaaaccatttttggcctaaaaaataatgcattccggacagtgtcctctaaaattctgtcagatttgctccggttctgccaccaaaaattccttcgtttttcagtgcctttattcgtcggcttcatcttgaccctcgtctgcgtttctctgctcctcattctttccattgttttgtaccgttattttacgcggcgcacttacgccgacgagtgaaaagacagcgaatggacgcaaagaaacgatgattcttcttaaaatgtcatttcattttgttgagccatcaatcaatttgttgcttttcccttttgttggcctcctttttgaggcctttggatttattttttgatcattttttgctgaattacaatacaacactatgatttgaataacgtttctccttttgatgaataaaattattgtcttgcaaaagatggttccctaacagcggaatttgaaaggtccaattcaggaaaaggctcgaaagtcaatagataattccttaaagtcatttggtgattagtggtttggtccccccccccccccctctaaatttgtctgtttatttccccgtcgttttggttccgctattgtgtcattggtggagatgattctgcgcaatttgatcaatatgatcgtctgtcattaaccacattaatatttattgctatgatccccataaaaagaaatttcttttatttagtaaaaaatggcttttttgatttggattcagttttgatctgacagtaacataatttaaaaaccatttaccaatggagcaaatccaacaataatttaataattttcgagggtgaaattttccgagaatcggaactaagtttaacctcgagcggacttggtaccgaaactcaagataaaaacgggggcacgagattagctcgagtcccanaaacggaaacttttctcgagccaagactcgagaaccc

SEQ ID NO: 21879 - DNA, 1521 bp, Heterodera glycines
accatccaagcacttcaatgcatttgttctgttcagtaatccagccatcaattttgtagtttttaatacacttttctcttccgttgcctgcgtgttggattgtcaacccctcattcttggctctccaatccaaatatttgatcgccttaatcaaaataagaaagttttttggtaacatttaccatatttaccagtatactcgctctgtcgtttctctcatacccagcctcaggcacatagccaactgattttccttcatgaacattgcgcgaaaaatgttcatacaggcgctaatatttgggaaagactttaattttttttaaactgtcagcctcacctagctattgtgcagctgataggcaaaacgtcatatccgttagtcacgtcccgcaataaggttttacgaaatttgagaatggatttgattagaatttcagtgtcgttttcacaatagttgcgcagttcttcgggaagaaagaatggcttttgtcgattcgcttcatacctatttttgtttcaaatattttttcaagctatttaaataccattgatcgaatttttctaattttgactgcttcattgatccaggaaaatagtcgtctcttggaggaagctgcggcaatcgaatggtataattttctcttaaaaatatagctgattaactacaattggtagaaccaaagcccgacctccgattgaagccataaggaaagaagggtttgtccgggcagtcaaggtcaaatgtgcctttcagtccatcaagccgtattggtaggagcaggcatgagtcacgccaaataagaagcgaattcccacgcgaatgttggaggcgaaattcaaaaatttttagcccattcattacaacatcaggtctccttctggtctctccgagataacgaagaacgaaatggccatcaaatctggacgcgttgtgtgccttaaatggaaatacattggtgcctgttgctctattattacccaaatatatgtgttaaattcttcactccacgccctcattatccattctacaaagttggcaaccggatcatcgccttcagcttcgctcctttacaagcagtgtccaggataaaataaatcgcaacaaaaagaaaactgaccaatatttgctccgttccattaatccatcctcattcatacatatttcacattgctcaattgcacattgaacagaatcagcacaatcggagcaggtcacacgtgcggacaggaagttgactttatggatttgttgaccaccagccgtcatcggctctaggcgcgtttccgtgtcccaacagacgatacggtagcgctgtttttccaacggtataagtatttttttaatgtaacaaccggtatctttgccatgatacacctagaaaaggagggatggtttgcgcagttagtgttcatgtgacgccgaccttgcaacgtgtacaatacttggtgaaacatttgtgcggcctttttggatccagctgatagacacgccagcaacagttgcaccgctttagtagtgag

SEQ ID NO: 21880 - DNA, 2880 bp, Heterodera glycines
agatttttttcttgaaaaatttctaagttagcaatttttttttttaaattttctcgggggggaaacgattcggggggcgtattattcagataaaaaatgaataataattaattttattattattatgaatattattcagataaaagtgtggttatctctcaaattaaattcaaattaaaattgaaatatgtttttttttgtaatacttttattatataggaattttgaaattttcactttcataaaattctttttttattatttgtatatataaattaatcactgaccttatttatccacgattttgttggtgcgttaatggttgatgctgcaatttattgttgttgctcacttggagagcagccgctgcaattttttttggcgcaagtgtcacaaagccaacaattggaacggggattttgaccgggggcggtgtgggaagaataaccacgaactgcttgttattgttgtcgttggttgttttgagcatgacatttttgttggagctgctcccattgttgtttctgatcggcgcagtgatcaaacgcttttgcgtgtgttgcggacgatgacggttgattctggtgttaaaaaagtgaaaccgatggcctaattaatgcacaattaattagtctaatttacgcgtacaatcaatgaccatcctcatttgtcagtttctttggccataactttttttgttcctcggacaataccgacattcttggtatcaaacgaaagtgtgaagtctcgggaaaaaagttatcacgaacttatttcattgagataagaaaaagaaaaactagtgcatatttttgtctcccatttttgatttggtacttaaaatttaaatgaaataaggttcattaattctggcttgagaatcaatcaagttatgaaatataaaaaattttccataattttttttatttttgtttcccataataatttatttgtaatttgcctttccatacacattatgtcggcgtgtgttcaattttctttccgctttttgtgttgcaaatgttgttagcttctcgcagtaaaagcaatttagcataaaaataaataaaaatgccataaatagtttgaaaatcatttctaatattgttttataatttaacgtaagtgaatttttgcttgcaaattttctctgtcgaaaaatgaattgggtcatttcccgggaacaaaaaaaaaacttttgcgccgccattttattaaaaaaacacaatgacctctttaatgacccagtggtaatttattatccttcgctaagaaagtgttgaaaacaggggaaaacaattggtattacttacaaagttccccttttttaatttattaaaataccaggagggacccttttggtttgcaagaattttttgtgataataaattgtgaaaattgttaaagagaacattcagggtcgctaattacaaacctgaatcaatttttgactaattactaattacaaacaggaactcgaacaaaaattcaattttttgtatcgaaaaaaacatccggtacactttttatgactaagattaagaataaataacattggttagtgatcaaaaagtcaattgcaccaccatgatcgtatcactccttcagggtgatccgaaaaccaaaaaatggattgaaatcgggaaaactttgaaaaaatattatttttcaatgtacttacaaccgctaacctcaccaccacagcctcctaaatagataaaaataaaataaaatttgaattttaaaatttaaataggcacctccgccacttccgccacaattaatgataattgggccgccccacctctcccgccaccggatctcaaatcctcattttgaaataataaattcaaaatttggatttgtaaaatgtatttttttcgccaaattttgaaatattaaaaaaattttttattggcattagttttgttatctaattacatttttctgtgctctcatttttgttaattgtccccgttaatttcccttccagttattttttaatagagattagttaattatgttcgtctgttctgctggtgttttaattgctttttgctgttttttcaattttttgattttgctaatggaattgtgaattatttgattttgggtactaatttaaaaaaatattattttataatgttatttaaatgtaattcataaaatgaaaataaatatttaagcttaatataattttatatttcaataaaattaatatatgaaaaggaaattaataacagaactaagaaaagataatgcaaataacgaaaattataatgggaaaataatcaaatataacaaacaataacatcctccaaaattacatctacgaaactgaagcaaatttctttttccactttcttagcgtttcatagccaattttcaattgctttgcaattattccatcgctgactttggatttctttctttgattaaaatattgcttcaacttttttaatttctcctcatcagaatgtcttttgcatgcttaaaaataataattaataaaaatctaattatttcccttacttttataatattttggcaccaattcttttttccatcttcgaaatgctttttctgaaattcccaattccttcgtaaattctttttgtttgcctttacataaccttttaaagtcatcaaatctttcaaagaattctttctttttctcattataaaaactatctttcattcttttaaattcaattttatttaaattcattttttttttccatttatatattttttcgcgatatgtgcctaataattttccaattttcctctcaattttggtgccagttttccattggtattttcctttttgcttcaacttttcaaaagttgcttcaaatttttgaatcttttctctttttt

SEQ ID NO: 21881 - DNA, 2231 bp, Heterodera glycines
aatcgcaaccatcagtaaaatgagtcaataaatcaatcacaaaatcgaaaaagcataatatttgaaattaaaatgattaaaaaaataataatgatttaaaatttgaaaatcgaattcgaacaatttataaaacccttaattattatggctaatttgtcagagtatggatgaggagaaattctggcaaagtcgggcgccggaaccaatccaattcgaagtgcaagttaaaaattgcgtgtgctcacaatgaatgattttctatgataattcttggcgccaagcaggaataacttttattcaggcttctgaccttgttctatcaaattttttagccataacgtgttttacgtgaaattttcttggacacgagaaaattaatcaaactgatactaaataatttggtttttaaattttatgttttcatataaaattaacttaattagaattattttatttgtgtgtccgtttcaactatgaaactttgcaagtgtctaacaaaaatgcgacacaaaagtgaagcaagtgtgtgaaaatgagataataaaataattaataataaaatttaaaaaaatgaaaataatttcataaaaataatcacaaatatttttcgcattttttgtgtcgttttaacattcttttggatttttcgcccctaaaacagggtgtccctatttggcactttgcccttattttcgccactctttcggcatttttgaaaaatttcttaccgaaaatggaattaaaaaatgcaccaataaggaccgaccccttgaaaatgtttcaataagttggaaaaagtacaaaaattttcaacctatgaaaaaataagccgaaaaatcgaattttctataaaaaatttttttttttttggtttttattcaaaaaatgatggaattaatgatttgttcaattttagctgaaaattatgtcactattttggactttttgtcactatttcgtcatttccctcactattctagttaatttcgaggttttttgtaactaaaaaacgcggccctagtgatcaatgaagacccagaaaaatgccaaaatagggacgcccctattttaggggcgaaaagtccaaaagaatgttaaaacgaagaattttcgcgttaaaaatgtgtttttcgtacttttctcactgaattaaaaccgcagaaaaaataaataaaaatttaaaaatccgctcccttttcattattgttacgtaaaaatatttttgattatttttatgaaattattctgttatctcttttttcgcatctgtttcgttttcgcttcttcttccgtcgccatttccgagagaagcgtttgaaaaagccattgctattcagcagtaggaggttaaagaaaacaaaaaatcataaggattttttagaggcctgcggtgctccgataggcgccagattttaatgaatttgttaataaaatttgaaatttttaaaggctaaaaataaagcaaattattctcgacttcaaatgcgtcatctccccacctcctttttagtcatttcttcattaattcacaacgaggaaattacgaattaattaacaaattaaattccgaataaatactttcttcaatttcgctgcgattataaaacggaggcggacggagaggagaaatcagaggaaatgccattgatggttttctctttttattgctttatttatttagcaaaattttttagaaaatttaaataagttttggcaaaatgtcccccttttcctctttctcctttccatcgtcgctttggtgcttctccttgccgcttctcccgccgcttccttcgctttctatcccgtaccttggcctttgacgacgacgccgtcggcagaagatgacgaagcgttttacgataattatgacgacgaatgaggagaaaagcaaaaaggaaccaaaaagcatggataattagttaattacaataattgatggcgaattaattaaagcgtaataaaaaagtttaacaaattttgactgaaaaaccccgcggtcgcggattcaaattgcgtagatcgctcgtcagcgccccacccgtgggtccactgcgtttcggcgctggcgtttcggcgccagcatgttttggctataactttcttctatctaatccaaatccaacattgttgatatcattcgaaagcttaacatgtttagaagcttgttctaagcgaatgcttcgattagacaattaacaaaaaagttatacatgaaaatttcgaaaagt

SEQ ID NO: 21882 - DNA, 1722 bp, Heterodera glycines
  misc_feature (64)..(64): n is a, c, g, or t
tccgccgttgcattttgtgacgctaatacatttctcggcgtggacttttctgatcaaacaattncttggattttgtccaggcccctggggccttattcccgtcttgcggttaatttcttaaccgcggttaaaataagtaaaccatggttaagaaattaaaccgcgattctcgtcttcccttttttaaccatggttaacgcttaaccacggtttatttaaccgcggttaaggggccgcttaaccgcggttaataaaaaactatgaaataaataccaattacggaacaaaattatggaaaaacttttaggtaattaaaaatggtatacataattaaagaattcataaatacgctcccaaccctggtgcattggctcttaaataaatgtaaatatttcagtatttttataacaattttgtaaaattttccacatttttaaaaaccttccttataaaaatgctgtaaaacgaacaatacatctcatggacaaaactaaattttccaaaaatataccttcctaaaatggaaaattaaaaaaaaattatccactaaaatatatttcaaaattttcggtatcgaaaaattaactttgtattttaaatgatcatgagtaatgaatgatggaatgaatgtgtgatatgatatttgatgtttaaaataattaatatttgctatatttcaatgtttttttagaaagtcctgattttaggtcccaaaatctgttttttttttaaaccaaatgtccggatttgaaaattttaagttgagggcctgtaaaaaatacccttgttttttatgtgctaaaaacctctctaattttgggtattgcttagagaaatatgtgatttttatgcatctcatataataactagggttttttaggcacaaaaaatcacgaaataaaatttgcaaaataggtattaaataggcaaataatcacaaaaataggcaaataaaatttaacactttttaggtagcaaaacactaaaaacataatcaaaaattccacaagaaataacaaataatattttagggatcaatttttgggagttttttttaaaatttttaatacaaaaataataattattattttttaataggatattttacgaaatgacttatcgcactcagcacgagttgatgactatctatgataatggttgaaatgacctattttcggacaataaatctggaaaagtgccgagttgggaggtcaacaatggtcagtgtgcagcacagcaatgctgtcttaggtgctaggtcatttcgcgacaagtgcaagaataaaaatcaataaaattgggcacttcgcgacagtgcaaaaatggtgtaaaaatggggcacttcgcgacagtgcaaaaatggtgtaaaaatggggcacttcgcgacagtgcaaaaatggtgtaaaaatggggcacttcgcgacagtgcaaaaatgggcacttcgcgaaacgtgcaaatttaaccgaaagagaccgggcctcatcagtacggtgtctctttgggttaatttatttaaattaattattatttgtgtttcggccctaaaccgtatacacacaaagccacagcaatcaagcaaagcaaaataaattttattaagcaaactaaatattttatattgggttttaatttaatcttttaactaattatatttgaatatgattaatcaacgtaatttgttagaagcatactttaaatttattttgagtttgcaaggctcc

SEQ ID NO: 21883 - DNA, 1229 bp, Heterodera glycines
  misc_feature (113)..(113): n is a, c, g, or t
  misc_feature (182)..(182): n is a, c, g, or t
ctttaccctggtgtaaattaataaagtatttgcaatttccggtttccctcttcaaaacgttgaacaaaaaatgtttatgactctaggcgggagaatatcttcacctgataatnaattcagcgattcagtataattcgatccggtgactggcttattaaaattagtcaaaacctgtccctgangcatatcgattccaaattagtccggattttttccaataatatttcataatttttgaaaaatttttctgacttaattttacgtcttgggaacgtattggcgcactactgctacattctgtagccgaagaataatctgccgatgattcaaacacgttttcacttttctttttacgtgatgctcttattaatcgtaactgctgacgcttattctcttgttctacggctgtttctatttttggtattttatgaattcccatatatggagcaacgtttggtattgcagaactcgggtttccttctatgatcactttctgtggtttattttccatcagctctttgagttgacgtctccgtttgtatagccaagagtgtcgtttcattttaatatcagctccgattgttttatcattcaaatttttatgtatatttgagtctaatgatgttttttcatcttgtataggatcgcctcggctacccatactcttcactatgttcataagcgcaatgtattcggtttccggaaccatgaccattttctttgtgtgcttcattatgctgttattttttcaagcaagtgttgagctaaaacgctgagaacaggcacaagaatagcaccaagggcaattccgctcccttgttgaagtttttgccgagctgagttctcactgcgagcgcgtgctatggccctgtaatagtccgcgtattgtgacaacctcgcttctggcttggatttaaacaaaaattaaattttaaaatatttgcgcaaatttccacaagggcaagtatttgttctgctgatgctccctgtagtagctcgttttttcgtttatcagacctagtgtccgcaagctttttaaaaaaatctatattttccctaacgtaaggactaaattgatacattttggattttttctacattcatgtatttatatagacaatgcggttattgtaatacgttattcgctcggtaaatagatttctctgcgttcgtccgggaatattttgctagtaagacgttcattttcctgtgcattaggatgcatattt

SEQ ID NO: 21884 - DNA, 1224 bp, Heterodera glycines
attatttcaaaccattagttttaaaaataagtttatttccctatattatttttaattaaattatcttttaccgaaccaaggctttgttaaaatgctctgataattagtgagcgcttttttgtgtgtccggtggtgcccataggcgccgcctggggatttttggaagttctagtcaaggattaaatggcacgcgatgaattttgagtgctacagtcaggaaagaattgatttaccataatttagagcccaacaaaattcaaagagcgctgattcattggatttttggcgtattgacacattgatacttcttacttacaataattaattgtgccaaatttctggctcctctcgcgaactatcagtctcggccagcactaatgtgggcaaatttttggaatttaaactttcgagagtcagcagaaaaacaatcatttttagggtttataagttttttttaaattttattttattttcgcgcgctgctgaaagagtaacagaaagaaaataaaacaaactttgataacaaaaaaaaaatttcgcaaacaattttttggcttttattttatgctcatcatttccaaattttgcacaattttttgcattatttttgcgaaattcggccgattcatctcacttttgttcagcacccaattgttgtacaaaattcgccattccttcagcaatttttccatttgtttccatttttgggtttgccccatcttggcaaggtcaattctgagcagattccattcgattgtgtgcatacagtcaaaagtcgcataatcccaatccttgtttcggaacatttttttgatttcattttttaaaatgggcacaatttgattcatttctgttttgtagaaaatggaaaattttggtaaaatgaattccataaatacggtgtgaaacattaggcacaacattaacacataataaggcattttaagcgaagtgaaaaattcgaaattcattttaaaggaattttaactcgaaaaaaaaagttatgcccaaaaatgttcgaaaacccggttccttgggtactttaggccataactttgctcaaccttgaccaaattttttggaatttagttgaactaatagagaaagttagggctatcgaatgatactaagaatgtttaatttggttgactatgacaaaagttatgggcagctttttgttgaaaatttccatttgatggtttttatataacgactcagcaccgt

SEQ ID NO: 21885 - DNA, 819 bp, Heterodera glycines
actgacaacagaggaatacggtagtgtttttgtttatctatctatacagtatctaaggaaaaaagttcaaaatttgattattagcttaaagttgaaaatgaaaatagccaatagtgaatttttttgcaatgaaagagggcgacaaattgggaggacttttatagcagagtcaaacaaatgccacacattcctcacataccaaatgccacaccaaaagtttagactttccgtaatattgtataataacagtaaatacattaataaataaataaataaataaattaattaattaatacttcaaaacacctcagcaaactaaattatgacagaaaaagaatacataaattcataaaacatatgttttgtcacaagtgctttgtcaaaagaaaatatttaatttcaatgatttacattcgcaaaatggcgaataatgggcacgaatttagtgaaaggtaataaagatatttaaaatgattaatctcattatcattactccaaagataatttgggtgggggggcaatatatctaattccagcacattttttttgaaattattggtcacaaaaaaattaaaaaccttttttccacctattttggtgttatttccataatttagggttgcgaccccgacgtcggggttggaaaagtcggggttcggggtcggggttgacaaatcgttcggggtcggggtcggggtttttcaatttttgacttatgccatatagtcaaaaaactttatatatttttgctccttaaatatttattattcattaataattttatgtgcttttttatttcataattatttttatatagaa

SEQ ID NO: 21886 - DNA, 1409 bp, Heterodera glycines
ggggggggcgtccatatcagcccatcccaaccatcccaaccatagcatggaacacacaataaaacagtggccgagggaaacaaaaaacaaaacagtaaatgggggaccgcccaaatgcgggaaaattgggggacaatcggcggaaatttccattttcactcccccaacacagcagcaccattcattgttgccagccttcggctaattatttttggaaattctccgacaattaatgggcccaccgtaaagcaatgaatacggtagcaaagtcagaaatagcaggaacattaattccttgaaaatgatcacttttaaatattttaaaggcacaaaattatgccaacaatggccgttggttattacggtaggctttgcccggggcgccatttaagggaaaacatttgtttgtcactgatgaatgcccgcaaatgcgccaattgaaacaaatgcgcgcatttgatgggtacggtaatgaattgcccgagggcaccactcaaatgcccgcggacgaatcagtccgaaaggtgtctcaatttggggatgtttttcctcactttcactaccaccatcacacatcatcctccatattcatatgctacatcatctccattcttcaatcttcatcttcatcttcatcatattcgtccaatttgtccgttgtcccccgcggtgattcccccccccccttctctgatggagggcatggaaaaggaaaggttgcttcgggcaaaatgtcttatttttgccatttatgtaagtgcacttccacgacatcgcgcgaaatttggacatttggggaaaggggaggaagaggagggcacaggggtgcaatggcaaaatacaaagcaaaaatacattaaaaaagcaaaaaactgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgagggagaaaagtgacgcagaaaagtgagggagaagtgattcccctcaaggaccaaatgaattccctctgctaatttttatttttatttgacc

SEQ ID NO: 21887 - DNA, 1427 bp, Heterodera glycines
atactttaatcataaaatttaatacatttaaaataggatcaaaaatagtttttttatttcttttattcgttcggttcaactccataaaaacattttggtataaatttgcatgtatcggtgacatcaattggatgtttcaacacttttggaggccaattcttcaactaaaccaaagaaaatttttagaaatatttaagagaattttcctttttcgataaaatccgaataaccaatattatatatacgataaaaaaaatgttctgacctatttatgccaataaattcgaggtttttaggtcatatttagaggaatgaaccctcctactctgtccaggcatttgcgcccctgaaattttacgcctatgtccaaaacagattctaacaaaaaaattttcaagcccaaattgcctaaacgatcttaaaattaagaaaagagagttttcttgtttattaggagaattaattctctattaaataatgctttttcaaaaatttactaacaatcaaattatcataaacaatcattttctatcacttatataatgatgttaggctatcagggactgaaaaaacttaaaatttgaacccgattttggacatggagctaatttctggacagcaaatgtccgtgtcgcatttgtggggtaaccaaacctacgtattttgccagattttatgtcacttataaatccatcacttgccttagccagccgctcttctcctataagttttgcggcgaaagttctcacaaaatgaatgcaattgtttttgatcacatcatatttgaacatgccgaatttggcttccgtataatctccgttttccatgtaaaaatcactcaattgatcaaaaattttttgaacttcccatatgcttttcttggtagtcccaatttcaattaattttctaattaaacaaaaaaaattttgagtgccaaatttgtttaaaaacgaacattcctctctcggggtcactacgcctacgaattttgtctgaaattaatgcgccatcctgattgccaaaatgaaattctaaatattattgaattaatttaatttttctgtttaaatgaaataatttttaattgaatttaattgtgtattatataattaccgatgccataaaccttcagggcatgatgttgaattcccattgcctcggcaattgcgccaatttttaggcgaattggaaacttaaagaatccattccttagtgatttaatctgaaaaacttaaaaaacgaattactcttgggttttgggtcagactcttggcttttttttgggggggggggttgaagtcaaaaattcgatttttaggggttttttttttttgaaatcccaattatgggtgtagatgcggtggtgtcacagtcctaataattatgcttcacattatcgcataaaacttcatttttcttattaaatt

SEQ ID NO: 21888 - DNA, 1844 bp, Heterodera glycines
  misc_feature (1721)..(1721): n is a, c, g, or t
tttttgaatttagtttatgggcagaactgatgagcaaggaaatttggtatacggcgactttgctaattggcgaacaattgaagtaattaaaataatttgtatttttaattgggtaattaactaattggttgtttattaggggaacccaaacattcgccgaggggtcggaagagatggaaaaggattcaccgaagacgagtcggaaaaagcctaaaaattaacaataataaaaatttaaaaatttaattttagaattaattggttccttagccaacagcaaattgatcaaattttggccttctctgctccgcaacctggcgtaattacttgattactttaattgaaattttgaaatggatttgaatgtaaaacgcataaattggcgttagcgaataaaattacattctttggctactttttaaaacaataaaagaaaattttttttatgaaaacaaatagaatttttccagttttataaatttttatttccggttaaaatttaattttatttttatgggcaaaagttaaattgatatattttgctcataaaccaaacgattttaacttttaaaattacccaaatcaaaatctcagttgacacatttcgtttcggcacatattagtgccagaatttattataaaccggattttaaaaagaacgacgtttaaaagaggatgtcattttcccaatcggtacagaatttcttcatagactctttcgggttggcgcctcgtttttttaacctcaaatttttcaggtttgcccaatcagaatcgaattccgctggatggaggtgtacaaattggcattttttacataaaaattttcatatttatttaaaatatttattttttaaatcaattttttccatttttaggtcacccatggcaacgtgcatctgtttgtcggcggcgccacgcagttgccgaacggcaccgatgaagcggacggggacatgtcggagcagacacgggccgcaaatgacccaatatttttcaatctccattcattcgttgattatgtaaaaaaatgggaaaaatttatttaataaattttttaaattttgaaggaattaagttttctaaaatttttggtccattaaaattggaggcactctctttttttcagatctgggagatgtggcgtcaatccagacaaacgcgcgaaagtcgagaaagggactacccaatggacaattcggtaaattatttatttattaaaaataatttaaatttaatatcatttaattaaatgaaaaaaaaaatttaaatttttttattaatattattccatttaaccctatcataattttttttctttttgtattgttattaatatttttatattaaaatagaatttttaaaataaatttggataattatttattatagattttaaaatattactttgttaaaaatttttctaattttaattatttctcatcattggtttttccatttaaaaagaaattaataaacagtttgatctttttcacatttttctttgcctttaagcaatgctcgagccctcaacattttggctcagcaccgatgcgaccatttcaggtaattaggcccaaatgtacaaaaaattacccaaatttacctaaatatttttaaaatttgaaaatttcttaagccgtggcaaaaccgtgacggcctgaacaacaaatacacggacaacatgtatgaatatgcgccacggccgagctgtcagatgngccctaattgtggatccaagtcactaaaaatattattattttttttaaatccctaaaaataactataaaaaaaaaatttcgaaaatccgtaaattaaaaaaaaaatcacattttgattattga

SEQ ID NO: 21889 - DNA, 1569 bp, Heterodera glycines
  misc_feature (13)..(13): n is a, c, g, or t
attttgattatgnattagatatttgttttgtgaccgctctcatggccagcaaccccattgtgcggccaaagttcggcctggtggaaattgcacaggatttgttaatggttgtcaataataatttgcttatttacgaattaattaattcattatacctttttaatgactaaattttcaggtaatttaactttgtaggatttgaaattttgcaagaaaatatacaattacctaattaattatgaacattctgagccattcttacaaattccaattaatgaataaatatattttagtaattaaaagtctttcccaaataatacgatgaatatttattaaattaattatacccatagttatcgatattataattattatgtcgttgttaataggcatttaaaattcaaaatatattaatgataattttcaggtgaagatgtttgtcataatggcatctgccaaaataaccgatgtgttcagacgactgacactgtaaaatatttcattaaatatttattcatttcagtttttattattatttatttcagtcaagcacgccatggccaatgccaccgacggatgtgacaacaccaaatccaattcggccagtacaagtgggtcattttactattttttaataattagtatttaaaaatattaaattttataaaatttagtcctgttacaatgagcacgaatgctgttctgtatggtcacaaaagggtgaatgtcaacgcaatccgggcttcatgaattcctggtgtaaggccagctgtcagcaagtaaaaatcgaaattcaaatatttaatttaaaaaattaattataaaaattagaattgcaaaatataattttataaaattaaataatatttaaatttccttacgcttttatttcaaatacttaagttgcttaattcagtgtcaacctgactatgatctttaccaaggtaattttttactgtttaatttatgtatgataattaagggtttggttttttcttaatactctacccattaaatcgctaattattgtgctgctgctgctgctgcttaattaattaatatctttcatttttgtaagaatgtgatgatcgtcatccgaattgccaaagttggaccagccaagggcaatgccaacagaacaaattttggatggtaaatatttaagcaaataattataattgtttattaaatttacaaaaaattttaattgtcagtttaaattttaaaggcagaaaattgtcgtcaatcatgtggaaaatgccgcgtttcacgtcaacaggtgtgcagcggagggcacgacagtcagcaaaatcagggtaaattcaaaatctcaaaaaagaaacataatgccaaaaaaattaatatacttaaatataatcatagaattaaaaatatttttttaaatatttcaattccgtaaaatagaaaagcataaaaaatataataaaaaaataaataaatgtaaatgaataacataacaaatttatttaaattgcataaaatagaaaggcattaaaatatgatagaattaagaggtgtaaataaataatatactaattttttataaac

SEQ ID NO: 21890 - DNA, 2666 bp, Heterodera glycines
tgttttttcgctgtcttctccccattatttggcttttctttttcgctctctccgcccctcggcggatgccttttttttcctttgcaaattcgcataaaaaatggccaactgacagacatttgggagagaaccgaaaaattaagaaaataattcagccaaaatctgtggaaattctaaaatatatgataaataaatatagtgaaaagaattaaatcattccaatttatagtaaaaaaaatgttaaaattatttttaaatgtttttttgttgtgttttgcctcaaatgaattttaacgcgggaaaaaacgaagtcactaaaaaggacgaaggacgaaaagccaaccaaagacagaagaaaaggggaaaatcaaagcaaaaagtgtaaattataggaaaaaaggtaaaataaaaattggcaaataaaaaacggatgtactgatcagaagagtaattgcttattaattgttcgtttttctcttcattttgcgctctttcaatccattagaaaatgaccgttttaataggctaattaaattcggaattaaggaattaacttcatactgcgagatgaacagaatccgacttccggttttttgggacacgaattccatccctccaataaatacctttaaatgtcttctttcagttcaaatcaaaactatcgaaatgtttacgttttttgcgccagttcaattttttaatttaatgataatttacaaaaaatttttaaatatttaattaattttttcttttgttcagcaattttttaaaattttctttggcatttgcgctaatttatttttaatattaaatcgttgccatggcgcggaatgaatcgtcggatggccgtgaaacttttctcccttctcttttccttttgccatccattaaagtcaatctaaattttgattatttgacttaatgaatttcaatttatgcgaaaggttcctgcaaattgtgtccaaaaaggtataaaaaattgaactaaatgaatggaatttcgtacaaatttaaaattgaaatgccaataacagaatgaaaacattggcatttctccttaattactccttaattgtccccttccccagggacttctcctcctcctcctcctctccctgcttcttctgctcatcctctgtttggtcgttctgttcggcttcttcctcttctgtcgcttttccttttcgttctgttccgtctcctctttctcttctgcctccttttcccccatttttgtgcttattttcgctcttttcgccttttacactttttttgccattggaacggcactttttgaggtgcttaagcactgttcagcaaaaaaacagcagaaccgtcgtttgccacaagctcatcgtctgcgccctctgctcttcgtgacggtcagtgctaatttgagcaattagttaatcaattaataattaattaattagtttatcaccccctcccttttagtgtgccgtttcccttctcggctttcccccacttttgctgctctcccttttgtgccgtcacttttccctttcccccttttgctcctcttcgtcccttccctcttccttttcctcccctttttctctcctttcctcttgtttttcctcctcttcctcttctcctttcttccctgtctttctctctcttctgatcacttcttttgttccgcttcgccctctcctccagcgtcaattgcacaaaatgagaaaggacgccgtttggactcagtttatgtgccaaaatggttggtccgaaattgtttattaaaaaatactcatttaaattaccgtaagaaataataattcggctgttttatacccaaatgcaattttccttctcaaaaagtgtctcttttaatttaaaccagggatgggatccgtccttgaatggcaaggacgtccttgaaattgggccctctttcttgaaaataaaaaatgtccttgtatgcaaggacgtccttgaaaatgagcatttggaaaagtttaaaaaaaatcaaagaaatttgaaaaatctttgtaattttcaacaatattttgattaaattatggcattatgtcatttaaaaatgtaatttttgagaatttttgaaattttatggcattaagtcactagtcactatttttcttaaaaaattagccaaaaatcgcaaattttggtcatttttggacaaaaatctgtaaacaactcgcattaaaaattacaaatttttccggacccccctatcctcaaaaaattttttaaaaagcgcgccgtaaaaaaaacccattttataaacaaaaaaagtcgtcgcatggcttaaaatcgcaaaaattaggcagtttttggtgaaaatctgttaacaaattgcattcaaattttaaaaatttttccccggcggcgcctgtcggcaccgccggaccccccccccccccctgtcccacaaaatttttggaaaaagcgcgccacaaaaaaagcgtttttaaagcagaaaaaagtcgtcgtaaatgaagaaaatgataagtgaaaacaaaaaaatgttggaaaaaaacaattccggtgaaaaatacaagccatttgaataaatattaaccatttttcattgcatataataaaaattttaaatgtccttgaatttcatgaattttccccactatgtccttgcaaatcggcatacccgtccttggaagccgacc

SEQ ID NO: 21891 - DNA, 2164 bp, Heterodera glycines
tatgagtaattttctaaatttaccttgtaacatgtgttgtccatatgtttccaaagactaattaagcatggcaaatacaaaatctataattataattgtttaaatctttttatttatttgttttttaatttacctcactaataatgccaaaaaccatgtataaagcgccgaccaaaaaatgtttacgttgttccaacggaatctgatcagtgtcatagctggcacagttgtacaaacgattgtacagttcgggtttgaagaagaacatttccattttaatagttttttattcaatgcgaaaatcaaaaagaaatttataaccttttaaaattataggcacagaaaaaaggttcctaaagactaaaattttctatctactaactctaaatgatttcttatccatttgacttcggaaaatgcatttaatgaaatttcatcaagtcaggccaatgtttctaggctttgacaatggctaaaataattacagttcaaaattgaaattcagaaattactaaacattaattttcagtacatttaatgagtataatcagcggacagatgttttagatggtgttgccatagggaatcattttaaagcctaataaaattcagtttgaaagtgtcaattatcagttatgccaatgtctctaggcatttcacaatggctaaaataattacagttcatttgaaaattaatttaattgctttattagcggtaatcagcggactataataaattgaatttgtcgaaaaatgttttttcgctcaaataacaaataaaatgaaaaaaaaaaatttttttgaacagaatgtctgctttgatctgatgaatgaaagatggaagaaaagccaatctgatgatcccacaattaacttactcatttgaatctaatcatttagaaattttagcagattttataatgaaaatagaaatttaatttatccactggttttatgtgtttatacagctgacaagggatgtgatatcgaaattacaaaattttggctccgaggcttaaaataggggcacaaagaacccagaattcgaacaaattaagaatattaaaatccaaaaaattcaataaacatgtatgaaatagaaaaaaattattgaaataaatttttatttaaaatattcaagaaaaaataaacggttcattttaaaaagcaagaagtcgttcaaaatcggaatgaaccttctacaatggtctccgaaaatgcgatgtagggcttttgtaataccattcgaatcggggataccgggcgttgtaaaatttaaaagttatttcaaccaaatatttaaattttaccttaacaccatgccaaaataaacattttttcttagcaaactcacttccaaattggtcaaaaatcataatctggtataaataattttttgatcagggtttccgacccccgacaatttaacctcccccaccgacccgacccccgaaatcttgttgttgattaatcaaaaaaaaaaaacagttttgcaaatgtttttgtaaaacaacataataaattgagccaaaattttctaatttaaaattaaatgtatgccttaaattagagaccggacggaccggggcctctccgggattttgccgggactcccggccctggtcccgttttttggacaaaccaccgcgaccgggagtcttggaaaaacgtgtcccggccccgggccgctgttcccgaatccggcatccatttcgaccaattttgaatccggacccaaattcgaagaaaaagtcgaaaattcaaattttttcggttcgtatttttagtctaaaaataatttaaatgttcttttttgttgaagcaatgacgactttcagtttttccgtgtatttaaataaagtgtgagccaaaatgtgcaagttgagtttccaaaaccgctttttagggaaaaaaggcttcattatgaatctgatcatgattaggtccgatctctttcaattgaactgaatccccttttaccaactaaaaaatatgcataaatttcattgattttattgtacgtatagttttgtatatcaatgatttaaatttttgatgatgataattttgataacaaataaaattgatttgaatatataaattataatttgaatttcatcgaggagctgtaagtgaaaaaacgtcctcatggattttgcgatga

SEQ ID NO: 21892 - DNA, 901 bp, Heterodera glycines
atgttttaggttgcatagcttttaaatttttaacactttcggagtccccagtcccccgaattagtggcggggttcggggggcaaaaagtcgggggccggggacctcggggggcgacgtgtcgggggtcgggtcggggaatagtcccaaaaatgtcgggggtcggggtcggggtcggggggctcggggtcggggcttaaccctagtttaaatttgcatttatataaaattcatttcttattttttaatattaacggggctgcaatttttaggtgctaaaaatcgagaaatcggggtacctaaatagttgcttaaaaactgcttaaatagttgctgagttgctaaaaaattggaaaaaatgtcaataaatgtataaatttttcgaaatcgattcattctttatccctttcggtagaacaattgtaaatcaaacacatttcaagattttcaggcaaaaagttttcatttgtccgccaaatcatgcccaggattttttctttttgaaaagtttattcttagggggtgtattttttgaagaaaaaaaattttagtttgtttcttaggaatgcatttttattttttttaatacacttttctacaacaattttttgttcataagcaaaaatagttaaaaaaatagtttttaaaaaattttatgactcaaaccagttggcaattgacaaaaataccaaaatagttgaaaaaatcgctctaattcgaaaactattcggagaaaatgtgattttcgtgcttctcggatcaagaactatccgcaaaaaataggtgaaaggcgaaaaacggaatcccggatttcgtgaattttaatttttttaaaataaatttattaatttttatattcatttaaatattttaccctttctttttggttttttggcaccgttt

SEQ ID NO: 21893 - DNA, 1497 bp, Heterodera glycines
tttattttgtatttttcagtcccgtcatttgagtcctaatggtataagaaatttcagttccgtctcgaagattgacttatttttcggaattttgatcacaaaatgtcaaattttaccttaaaaagtgtaaaaagtcatgaaaaaagtcaaaaaaacgcaaaaaagtcataaaaatcccaaaaagtgtaaaaaagtcaaaaaaaaagtcacaaaaaaatgcatgttagaagcttcaaacaaagtgtagaacacttttgaagtcattttaaggtcatttagtgtcagcaaaaaaaaagtcatttgacttaaattcccatccctattcatagcatatgcgcagaaaaatatatgcaaaatcatacaatttagagcctttgtaattatgtttatggaaaattagaaactttttataaattctttgttcatgaaattgaaatatttgtttttgtgtgaatactgaatgaaattcaaaagcataaatttggtcttttttgaacaaaacttttaacaaaaaagaggaagagacagaggaagagaaggaggaacagaaagaggaagagagagagagagggggagaaaagggaagaggaacaggagaagaagatgaagataacggggaaaagaaaggggaagaagaacaggagtggaagaggaagagaatgggaaagtgaatgaagaaaatgggaagaggaaaagaatagagcaagataaagggaagagaaaggggaaaagaggaagtggaagaggaacaagaaatggaagggaagatgaacaaaagaggaagatgatgaataaaaggcgaacacaaagaggaagacgaacagaaggcgaagagaagggaagaggaactggagaaaaaggaaggggaagaggaacagaagggaagatgaagtggaagaggaacagaagggaagaagaaacgaaaggggagaggaatggaagaggaagaggaacaaaaggcgaagacaaagaggaagataaacagaaggtgaagaggaacaaatgagaagaggaatagaagaggaacaaaaggcgaagagaaagagaaggggaagaggaacagaataggaagagcaataaaaggtgaagagtatgaggaagaggaaaaggaggggaggaggaaggggaaaaggaagagaaggcgaagaggaactgaacaaatggcgaagaggaagaagaagagaaaggggaagaggatcaggaggagaagaggaacaaaaggcaaagagaaagagaacaggaggtgaatagaagggaaaaagaggaagggaaagggaagaggaacaggaggagaagagggaaagaaaagggaagagaaagggggagaggaacaggaggagaagagaaacagaagacgaagaggaatagaaggcgaagaggaagagaaaggggaagacggacaggataagaagaggaagagaattgaagagaagcagaagtggaacaaaatgcaaagagaaaaagaacatgagggggatagaagggaaaaagaggaag

SEQ ID NO: 21894 - DNA, 1135 bp, Heterodera glycines
tattatttttgaccctaaaatcttattttcggccttggtgtttatattttgaaaaattaccgatcggaaccatggttttgaggggccggcgggtgccgataggcgccgccggaaagtttttcgtaatttttaatgaattttattaagaaaatttgttcaaaatctcaaaaattttcaatatttcccgccttcatggatgaatttttttaaacgctcggaatccacaatcccccgaattagtgtcggggggtcggggagcaaaaagtcgggggtcggggacctcgggggacgacatgtcggggtcgggtcggggaataggtccaaaaaacgtctcgggtcgggtcgggggctcggggtcgaggcttaaccctacttcaattcattaattattttccctcccccccccccccctctcattttgccattctcaacagtgatgattaattttatccgcacaggcgatttctcaaaaatgtctttatcttccctctgtgatcactcatctctcccttcctcctactctctccaaaatgcacagtctttcctccccgtcgatcgggtttcgcgtcgccgtcggccccacgacggagatgaccgtctgcaccggcaccgtcgcggggaaatggggcccgacttgtgccagcgaaaaattgaccaattcattcgtttccaaatgcgacaaaatttgttggcactgacggagcaattgaaattggccaaaaagtaaagtggcattaatgggacactgctaattgatgttagcataatccaacgcacaatttgtcaggaactgaagaggatagcgcccgcgttggctgaaaatccgctgaatttgcccaattttggcgttccgtattcattgaatcggcaaaagcggtggaatttgactaaactcagcgcggcacaactgaacacgcccgaggcaaaaaagcacaatttagaagaatttgtttggatttattttcagagtcaagagaacgattcgcgggtttaaattgtttggcaaaaagcgaatccaatgagaaaagggacagtcaatggccgttttgagcgcttttggcccggaccgattggccgatttggggaggaaaatgtggccaagttgagcacttttgatgcggaaaatgaaatcaac

SEQ ID NO: 21895 - DNA, 967 bp, Heterodera glycines
gattggccgatttgggagaaaaatgtgcccaagttgagcacttttgatgcggaaaatgaaatcaacagagtgtccaagtcggcacgaggagcgaacagcacggcacagctgatgcagtaagggaaacagcagacaaaatgccaaaccgacgcaaataaacaatttttatttcaggaaagggataaagcctaaaaagcgatcaaatcgacggaccaaaagtgtggcggatgagcagcaggtggagcggtggttggacttgttccagcacccgcgactattccgtggttaatccctccccgacggtttccgacggtacgcgtcccccgccggtgcacaattattacgcattcaaaacacaaagtgccagcagacatcagctgaacagcggctggcaggacaagcggattttcaaagggatgacgaaagaggattacgagaagggggacgatgggcgaaggattggcaggacaatgccaaatgggaggcactgagcagacgacagattgggtgggcacaatggagggtggcacaaaggaattggggacggacaactgattaatgggaatagacagttgatcaatggggatggacaattgatcaatggggatgtacaactaattaatgagaatggataactgattaaattcgggttacggattttcgtaattgaatccattacgtccagccgtggtgggaatatggtgcttatttggacgaattgcagtgaataattgactaattggaaatgatagaatttggaaatatcagtgaacttttttgggtggcgccgctgagccagcaattataattaaaatttttaaatcaaatcattttgtcattaaagactgtgcttgcaaaatgggccgtcccccgttgtgcaaaaggaggcgaaagatttgcgattgaggcggacattgaagaacataacgaattgcctgaaagaattgacgaggacgaaaatgaaaat

SEQ ID NO: 21896 - DNA, 1777 bp, Heterodera glycines
ctatgggggatggccaccatccccataccgtttgctagagtgatggccaccatccccataccgtttgctagagggatgaccaccatccccataccgtttgctagagggatggccaccatccccataccgtttgctagagggattgccaccatccccataccgtttgctagagggatggccaccatccccataccgtttgctagagggatggccaaacaatccacataatactgtttaggtggatggtacccataaccaatcccatccccatagacactcttatggggatggatcacatccccttaaacactcttatggggatgggatcgtccccttagacactcttatggggatggatcccatccctttaaacactcttatggggatggctcccatcactttaaacactcttatggggatggctcccatcccgttaaacactcttatggggatggagctgatagtcaatacagtcatctttatgtatgtatagatatagagtatattttatatagtaaaattacattttttcaagagtatctgcatggatgtccatgtcatgggcattctttgtgcaataacagccacattcatatagtccataaccaatcttctttttacagcttttacattttataaatgcattttttttacatctttggttgtgacatcgcttgtaatgtccatcagaagccctgaaattaattaaaacgtatggtaaattttattgcttttttaaaaatttatttgttgcccaattttccgaattaatcgatttgttttaattttgaatatttaaattaatttaccattttgcatattctccttcccaatgacacttgtgaccacaatcaatgatggcgtatcccatttcttcgagcacattgtttttgcattttggcgcaaagaaacataaatcattcgtttcaaattgccctttcttgcgcttttgttttgaaaggccttaaatacagtaagaaatttatgaattaattattgcttcgattttcactttattataaatttacgtattttttaatattgttatttaagcaattttattaccctttatagatatgtctaattctatagcacgatcttgtgtcatttcatcaaatgcattttgttcggtaggatcctcagcaccagtctcagatgacatttcatcataaattgttgagatagcatcacttataaatataggttcaatataaaaatattgtcaacaaattacagtataaatcttctgaagcaatggagcatcggttcgcaatgatccgtcctattgaagatcttgggttttagctatcagatgaacttggaggtagtataatttctaattgattttcaaaattaattgttccaacacttcctgcagcattgcatcatggatgatcctctaactaaatttaaccaccatatattcaatttgaatcggtccgcgacagtaataccatattgttttttagtagcaatcatagcagatgccttgtcatttgggttagcttcgtatttgtgcaaaaaatacagatatagagattcatcatttattatcaactttgaattattggcaattgattgtaattctaccacctctcccctcggttggttgctgtaattttgagattatttggtataatatgaatatgtttaaattaaataatacattattttggtaattaataataaacaagtcctaatcgattttgagtcaattatttattgtcacttaaaaggctgtatacatatacattttgtagttcgaggctgactttag

SEQ ID NO: 21897 - DNA, 554 bp, Heterodera glycines
gtggtcgaacagctgaaaaaattattgaaacattaactttgaaaaaattctgaatcatcctcaaaactcacctccgtgccggtgccttgctgaacactgtcgggcatgctgtagattttgttgtgcatcgtagaacggcagccgccctccaaagtgatgcgcaggacacgaaaattggttccgccgaggtccagtgccaggaattcgcccttttcttcgccaacagcaatcgcgcggatgtacgtcggaagcattttgacgcaagctgtcggagctgaaaatgggagagggaggggaaggaaggggtaaaaatggtcaaaattctccaccggtcactggatcaaggcctttttggtagtccatctcgatctttgccataatgtcgcgcagctgattgtcgtccagcgccaggcacttgcacagctccttcacctggttaaaaaaaattgactgtgttgaaaaaaacatggacaaaaatggacacctcgggcgtgggattatgctgatgggtggtcgccattagcagcaaaatatgattaaggtaggtaggcaat

SEQ ID NO: 21898 - DNA, 997 bp, Heterodera glycines
gtgccggtgtgtgaaagatggtcggcatcagacagcacgagggcatcgacgagtaaaacagcggactcttcgcccgtttgcttggcttctgaagggcgatggtctctctcccgtccaatcattggtcattcattcgttcattgtcacctgttggtcccgccgctccagcagaaagcgtcccgaggcaccgctccaccgactttgcactttccaaatgttttcctccggctccaacactcggaagttggcctgctgctgtggtttcatcgctccgccggtgcctttctccgttcggtttggctccgtcctttgctgccccacaacgatttcttccaccagcgcgtattcgtccaagtccacttcgtaacattgagtttttgcaaatatctgttcattaggagcggggggggggtagggtgagattttggcttcgacggtcgcttttccttcgcttggccacctgtttgatgatatcccgcgcggtgttgttgatgcttgtcctcaaaatggcgtacgggtggttgtcggaaatgttgtggacacacaccaaaaaggtttcgcccatcgatttggcgcgcggatgcattccttggggaaagaaagacgcatggccaagcggttaaaccctctgctgcttttgtttgaattattcactcgcctggctccaaacgttctcctccgccgcccgtgctcgtccccgacggttcgaccacgtcgatggatcttccgtgcagttggctgctcgactgcgatttgttcggctgttgttgatctccgccggcgctttgcccgaccgatttgcgcggaggcgccgttccgccgaaagacattgtcgagacggacggagcaccgctcagtccgccgctactgctcggctgagaacccttaatgatagaggagaaaaggccgggacgaccgcaagcatcctaaaaaagaaagaaagacattgaatggggttgggtggtgggtggagggagtaaactttggcatttaatgc

SEQ ID NO: 21899 - DNA, 2447 bp, Heterodera glycines
  misc_feature (79)..(79): n is a, c, g, or t
  misc_feature (2419)..(2419): n is a, c, g, or t
tatatacactcaaatttgaatacttttcaaagcctacacaaaatccccttaaaattttactttccatttggatgatttntaaggcagtaaatttttaaaattttctcggggggtgtaaatactgctgttacatgtacaacatcactaattattattccctaactgttatgcattttccttaaatgatgtgatggatgtcgaatgtatcaggtgttcgtctgccactgaagcggacgcttggttcgaggccatccattcgtgtgccgacactctgctcactcaggcgttggcacaagtcaatttgatcctcggacaaagtccgcaagtgctccgcatgggttggatggcggagcaggtcgtgccaaatggccagtgaatgaatgtgtctgctttatgcttggcttttcctaccgtcttcctttattttaggacgccgccattggttggagggccgtttttgtggcattgactgtcaacgaccttctcctctacgagtccgtccctgcggtcaaacaagtcagcacaaaaacaaattgcacactttatacacattaattgttgtgccaattccaccgctttttaggaatgggccaacccatcgttcactcggccgctcatcgccacgcgagtggtgaaaaccctcccgttctgaactgtttttataccaatttcaggtgcagaccactgcccgcagtttccctgtcatcatgggtctctccgacattatctctttctcgacccgaaccggcacccaagagggcgtacggacgcatttgttccgtttagaaacgcaccgggaattggcctcgtgggtcaaagtaatgccaatgccgttgacacttcgtgtcgaaattacggcgagttaaacgctctgatttaggccatcatccaaaacacttacgtcgcttgcgaagcgattcagcaggtgagtgcgccgtgcgtttggaatgaccagcagtgcgagctgagcatccaactcgaccggggcatcaaactgagcaccaccggcgacggccaaatgctgtggcagtaccctttcgaggccattcgcgcgaccggcgacgatgggcagcaatttttgtggatggattttggggaaccaattggtgaacaggtgagcgaacgaacggaacagcacgagaccctaaccaaaacgaagaaattgaaaattgtttttatggaatgatcatcctcaaaaactattaactaacaaaaaaaaatttttttttttttttgcttttccttggcaattttcgtactgctgaacaattgaaattcaaaataatgagttgaggggaatgaaatgcattcatttaatccttaaggaggtcgatttgctttgttcccccaaggcggtggtgttcatccttcacagttttcttgccacaaaagtctaccaattgtgtctgtacgcatgagaaattaatggacgaatctctcctgcttgtctttcttttttattgttctgttcgtctagtcacacaatacacagcttttttaaacctttattttccgaaataaatgaaaaaacaacaaaataataattgtaaattgtttcaacccaacttcggggctccgtatgcatctggcattcgttctattgtgtaccgatggtcacgaacatactgaaaatggttgtcccggttaatgggacaaaaatagtttgggacttaccattatcggaacgccgggtattttgcgaatcctttgacgcaaatccttgtcgcaagtggccacaatgtaacacttgtgctgaaaatatatgagtataatttaacgacagtcaaaacaatgaaactcattgtcagatgattacctgtgttacgcgttgaacgatgcaatcgtcggcataaatgcccttgtgggtgcattggagtcgctggaagcggttgtcctttatgatttttagcgcaagtttgaaccgtcgtcccattttctccaattcgcccagcacacagtccgaaatatacggcaccactttagcatacagacagtccatgaacccctacaaaaatgtttcttttaaacgtgtgaatcgaaagtaaaaaaaattatgaccgtcataatgtcgattcggttttttatagaaaaattgacaaaatttgtgtcgataatgacgtggaaggggggcccgagttgtgtgttgtatttgagaaacatcgctgccgaaatcttagggctatcatttcgctttttttggtcactaatcccaccccataactcacgcttccttgattttaactgcattttcatcttctttgggaggttttttcacgcggatttcatcttttctgaattattaccagcattaattagcaatcattaagaaaaattcaaatcctaacattctgtcatcggttggcttaatcagtttctgaagcttattgcggaatttctgagtcagaaggtgtcgcccctnataaatttgaattctttaaaaatgaatt

SEQ ID NO: 21900 - DNA, 2357 bp, Heterodera glycines
aattaatcaacaataacaacaagatatccatcaacaaactttgaaatttttatgataactaatgttaatattttaaagacggaaaaactatcgaaaaaaatccaaaaaaatatttttatatttttaattcaataattttatacatttcattaagaaaaaacctttttaaatataataaatcggacaaatataatattttctgactttttaattattagaattcatgaaaactgggtaatcataaaaatattactctccgttttaaattcacagagtcattaaaaaaggaaaaattttaatcaaaattttgaggaaaatcacttgacttcttagacagcaatttaattaaatcttcctaatttttgttatatggcaattggtttagatctttgacgtgtcgaccaatttttttaaatttgcttccaattaaggctgctccttaattaattgggtataaaattatgtatttaaatattaaaaattaatttagaaaaatataaatttacctaagttaataacaaatttctccaaggttttacacataacttaggctaaaaaaaattattacatgaaggaccaaataaatttttatggttttttccgtttcatttttacatatccgtggatttttgaatgaaattcttattttgagctatttttgtttctataaatcgcatcccatttataaaaaaatgcatttttcaaggacttcccttttcaaggacaaatccattttttagcccaacctgaaagattttttcgttccttcgggctctccttggatttcggacgttgttctttcggtggacacagaaaattaaagcacgaattctcgacactgatcacgcaaattagcagaaacagaagaaacaaaaaaatatttttgagaaaattcatatttaaggaaaaaataaataattaaaaaaaaattttttttcaatattttattaatttttatttgaaataaatcatgcgaggctttttatttagtcgtttgtttggctagccattaatgtggcaaaaaattgtttttgcacgaatttcctgcacatttatggggttggcaaaagcttacaaataatttttattattattattaataaaattgtaaatatgctgcgacaagtgattgactttaaccatatttttttatactctttgtcaaatttaattttatacaatataattagaaaagtaaagttaaattaaatcaaattaatataaaatatataaatttaaaaaaaccaaattattaaaaagagatatttctaaaaattaactttgttttggtttatgatttttttcccattctttcttaaagaaataaataaataaatttttataatttaaaaaatcatataaaatcgaatcattgaatcaaaataattggaggtatcatagttttgactttttttttctccacatattcttaattaataaattattttataattttgtcggctttaatacgtttttaataaaaaaaattttaaaaaatgtcattaaaattattatttttaaatttgtttattaaaattcaaaaattctttaaaatgatatccacttttttctagttgcatataattgaaccttctaacaaattcttttttaccgcaaaacctccattgttaagtgggaattaaatttgattacaaattgcacagtttttaagtggtggcggcggcaccaacaaaatgcaattttggattttcaccaacaaaaagtggtcatccaatccaaaagcaataaaaaaccagcatttctggttgaaaacggatgagatgacctctgacattgagtacatccatagaaaatgaaatgaaacacgtataaatatgatggctatttgctcatttgaattacatttaatacaaaactatctttttttatattctacattattttttaaaaaatatttatggaaattttgcttaaaatccttaaaattaattgttcaaacatgcgtaaattactttttaatgtgtgttataagtgaaagttcaacaatttttaaaatatattttttattttgcagaaaatatatcgtaaacatcatggatatttgctcattttaattacgtttattaaaaaaaaatcattttttatttatttttcattttattaaaaaaatatttgtggaaatttggtctttaaaattaattgttaaaacttcaataaaatggcaattaaattttttattagtcaaaattgaataatttttaatatgttttttcattgtttaatgatttatttttttttaaaaattcaaaaatatgatgactattaagctcattttaattacataaatataaaaaaaaagaaaaataatacttttaacaatcattttttatcctaat

SEQ ID NO: 21901 - DNA, 2363 bp, Heterodera glycines
  misc_feature (1206)..(1206): n is a, c, g, or t
atatattaattattattttttatttttccctttgactcctattttcttcactaatttttcactcagaccccattcttaccagtgcttgtttttcccggttcccggttgccctaccgggaccgggaccgggacctgagattttcaaaacccgggaccgggaaccgggacctcggaggaccgggaattcccggcccggtcccggtcccgctctagtctagtttaaactcgttgcgcttcctccacggcataggcggaccggaccaggggcggagggactggcttgcattgttatgaatttatggatagatttttcttggattttcttgacgaatgttgagagacccttcatatactataagtgtgttcttgtttatcggtcgttattataagcgttcagtgaggaaactccttgtgtatataataaagagagtaactagggtgctcaattggctatggtgtgtatgcgagggttggtcatatatgtcgctcaatcgatactttagaacaggagttgtattactgagatgttttatggcgctatcggccaggggtagtaatgcaccttgtactcacatcctcatgttgagagttgtataataacgagataggccgttttctgagaagatctattcttagccatggagccttttgcgaaccgaccgttgggctgtctcgaacgtgaatattaatggtttctcggggaaaacgctcatgacggaaatctgtttgcaatggagagaaatgtttttccgatatctagtattcttatatctcagtccaagatttaagcggacattcgcaccggtcacccgatattcttctgaggtttcccctataaactcaggaagaaggctggattaatgagcttagtaattttctgagaatactattttaagatatgaaactttttccacgcccgttttgaacgacttcgtatttcacttttttttccccccccccccccctttttttttttttttttttttttttttttcttttttttttccccccccccccccccccccccccccccccaaaaaaaaaaaatccgtggtggttttccccccgaaaaaccgaaaaatcccaaatcccaatccattcggaattttcgtcggggggtcccgtccgtctccttcgccaatcacctccccctcaattttgctttctttatttgggatcgccatttttttattccactccccccanttcactctcattcatttgcccttcttttttttgtttgctttttgatgggatttcgcgcagtgaaaagggcaaaaagggaaaatgaaaagggaaaaaaggaggggggaaatgaagaaagtgaagagagagggcgaaggaagggccaatttataatggcaaattgacactggcaaagcaaaggggggacagataaaagcacaaaagaccctaggactgggccaacaaatgcaaatgagaatataacccctacaaataaatacaaatcgaacaattaaacaataagttttaaataacttttttgctggtcaaacctaacaacaatcatagaatcattagaaagttttttgcaagttttattaacctcttctaattattaatttcaaaaactagaaataaacatcgactttctgagtttttgcggttttcataacgttaactttttttgagcttcttattacaatatttaactttcgatgatacaattttgttagtttttttatgaaaaggaaaaaaatttatggcttcttaaatttggcagggacggagttggcccctttcattcgtccttgggctgaaaatgaaagtgtttttatttcaagaagtacttggaaattggtaatatgccgatgggtgtaaaacatacttcagttgtttttatatactttaatatttactaataaattatgaataatttcttcacttttcaaaatgttttccgtcggcacaaccgaaggcaatgcttaataaatgttttccttttctgtccttgcaaatccatggcagcttaattcagaagagttcatcttgttttattgtgcttatttatgtattaattctgtgctttatcacctcccattattcttttgcacttttcgccgctggcgaagtgcgggcgaaaaaacggacatgtcccgccccggggcggcggcggaagcgaaattcggcagaaaattctttcccttttccctttcttccgaacaattgaactcatttcaacgcccaagggcagcaaaaggggagaagcagcagcagaaaatatagggaaaagcataagcaaatcaccaaaagaaagcattgtttaaattttggccaaatattcgtccatttgtcctcccttatgcactgtgcgtaattggacaattggacgacacgtgtcg

SEQ ID NO: 21902 - DNA, 689 bp, Heterodera glycines
ttttctcatctttcttttccatcaatcatttccacaaatgtttacaaattgtgccaactttcagaatgggtgtttgatacatgccgaaatgttaaactgatcattagcctcttcttcttgctgctcctgcttaactggaggaggcagaatgccgacagcgactaagaattcataattgggatgttttgccgacggtcaaacgcattgctcccatttagtctgattttcgtacgaccctgaaacttttttctttccctacacaaagattttcccttagattgatatatgataattaaaagctatttcgtcactatttttctacaatatttcgacataacactgacctgaaaagaagataaccttttcctgaaattgtattattgaataaatgataccatattattttatttttttaacaagttcattattataaaagatgaaaactggtccttactgcaatacttttttaaaacattaaactattaattttcaatttaacacaaatgacagatagatagcctcactttatacatttaataaaccaatttccatttttttttgtctcttataattttctaggaaatatttccaatcacaatttttttttatcaatttcatcacttgtgtgtcaactattttcaactaaaattatctcatattagtatctaattgagaattgtcgggctctg

SEQ ID NO: 21903 - DNA, 1265 bp, Heterodera glycines
ttccatttcacatatttttatttttttcatattgcatttttattttattttcaaaactttatttgcttttatcagcaatgattgtccgaaaatgccaaacataactgttttataaaatgacttaggcaccgatagcttcataaaacatacactggcaaggagaagagataagtaaatgcctacagaaattattatgaaaattgataaataaaaaaattatgataacttttggataaaggaaaatccaatgaatgccactttatatgctcaataagttgttctccgctctctcactctctgcaatgaaggaagcatttttgaaaagaaaatttctcccaacggaattaattgtcgaattaattaattttctgccaccaaaaatgcgttggacaaccaccagagtttcggcaaaattcgacacattcgtcttacagaagcaagccaactggcacataacgtttttattcattgtatgagtgattaataaattaaaatattttattcaaaacatgatttctgactgaatcttcacgggacagcagggctggacgtaattgcggattacggaaattacagcatttttttgtagtttagggttacgagtttccgtaattgaaaacaagttatgtccagccctgctagacaggtatctcgaccggagctgatcaagtatttttggtcccaccggcattgtggtgtttctcggtctcccttttttggtcccgtaattccccgtcccgaattttgcctaaaattccggtatccttcagcagctcgtatttaggctgtcttatttgatgaagccgttgaacgtttgcagaaatgtactggcaatttatccggcgcgagtcttttccatctgatgcactgtaatttttacaataaaaactataatttcattaaaataaatattttaatgaattatttcacaaaatttagtaaatttccaattaatttttattacagtgcttttgcttggattcaaactctatcgaccgtgctttgtggcctcgaataatggaactgatcccggcacatttaaaaatgattttatccgctctgactttgccgttcttcacaatgcgcccactgcttataatatcgaatttttccgcattgacatggccattgctcgcgaagagcttcttgcttctagtgacatctacttttttcagagttgtccggaaagtgtgtgagctattaattgggggataggtccgagctgatcgagagtgtcggccgagagttctcgactcgagcaaagt

SEQ ID NO: 21904 - DNA, 2304 bp, Heterodera glycines
tgatatactgtttgattgagtgattgattgattgcctttggattaatgatttgattgcttgataattgattgatttattaattgattaattaattaagtgattgttttattgattaaatgattgttttattgattgattgattgattggaatacccgcgcgcatcaacgcggaccgattcagcctcatataaacggccaccacatgaaatgcactcgcggtcagcagcggttgctgctgcggccagctgttgcgatggaagcggatgaacaaccagcgaacccatcagaaaatcgccgccaccttcaattcagacaactttttacatgtttataaaaaagatattttgaaaaataatttttaaaaaatcttaaaaaactttttaaaaaagccaaaacaataaaaaaaattgtggaataaaacttattaaattgaattaattaattagggtagagggaggacccagacgcctaccccgaaaatttaggctattttttgaaatataccgtggcccctatcctcgaaaacttattatccgacccctacactcaaaaatgtagccatttttcagggtataccccgacccgggcgctccgcatctggacaaaccctgactcccccgacttttttttacccccgaaagttcgggcgggggcccaccccgaatttaatcataaaatttttttttgaattttaccgccaagtgctgcggactgatgatggtggccaaccatgtgatgatgatgttgctgatggtattgcatcggtgctgctgcttcaatgccgccagtgataaacgctgaaaatgctgttgaaaaattagcagaatactcaatttcttaaattatataaatgaattgatttaaatgatttaaaaatggataattataataattaattcaccctgttgtccagcaaaaagtgggccaaaatggccataggcattgagcgaatcgagcgaagctgagcccccaagcattgacgaaggctgaccaaaataggatgaactgcaaaaaatatgatttaatataaagaaaatttttttatttatattgaaaattaaaaaaggacgtaaaaattaataattttttaaaaatataatatacaaaacatagataaataaataaatacgaatttcaaaaacatattttctatttcttaaatttttttaataatttcaaaaaaatattttaatttcttagattatttaaaagtgcattaaaatataaaaaaatgaaaataacatgaatttaaaacatatttcaaactttgtaaaaaattaaaatttgcaaaaaaataaataaataaataaatgatttttactcagaaaaatacgaatgcaacggttcaatgtaatattgtggtgtttgactgttccatgagttgctgctgttgtgcagctgctgctgtgcatagaacgtgccggtgttgttgttcattgtgttgttgttggcggggttcgccatgtacacattcattggcggagggttggttgacggaggtggcgaaaaattcactaaaatttaagaaaaaaaattttgggtttttttctaaactataaaatattttttacagcccccccccccccgtaagtaagaaattgcaaatttctatatattttattaatatatttttaattggagtgaaatgggcgaaagtttgatctcgaaaagtgagtattttgtcccatgctgtacaaattaattaattttatctaaattttacatgtcccaattgaattggtgttgttgttgctgttactgctcgtgctgaccacggacaattgggtagtggtgtttgtgttactgttatggttgttgttgttgttgttcaacagttgccgtgtgtactcctcgtaaaggcgcactgtgttcagctccatctgcgggtgtccgccaagtgatgaaattccgcttgaaatgcctccggcgttgggcacttcaaatattttagagaaattggtgacaattacagtatataatgagggagggatttgaaaacttggtaattacccaaaagtatcacttttaaaataaagattttttaaaaataaaaaatgtctcggggatcctaacccaaatttgtataccctaataaaaaagtggattttactaattaataataatattaaaaaaaaataacccagaaatcacaaaaacctaatgtactttgctgaaagagatttgtggaccctgatgatgctgtcgatgttgttgctgaacatgaggaatccatctgctgactgaccggtggaccgttcgcaattaagatctaaaacaaaaattttcagaaaattataaattca

SEQ ID NO: 21905 - DNA, 1944 bp, Heterodera glycines
caaaacagcacaaaccaacagcagtagtagagaagccactcacaaatcgagagacggggaatttgttgagggagaggggggagggaaagggacaaggggaaaagctcattgtcaaaagaatggaagcggacgccgccgcctgaggaaagggcccagcagcgccaccaatacgggacgggccaacaaattgagagtggtcacgaaaagtggacaaaaaacaagaattcattgtgataccgcttgagtatcaatcaaatgattaatcagcagggggtcatttctcacagcccaattaaaaaaaaaattttgctgctaattgattgcgatatccgccgctttttgtcactctcggattgtcaattaattgagtgccattgctgctgcccaccttgtctgccaacaatttcggccacatgctcactggacggcacttccactgactcggtgttgtgccgtgggccgaaccgggccaacagctgctggtgtgccaacgagccgggcggcggactgagtgcaattggcggaagcgatggcatggctgacgacaatgcggcggcgccgctgctgttggtgtcggatgccatgccgagaacagaggacgcatcagtgccatcgatggtcggcgattgttggaagaacctagcggaggaagcagcgaatgaggggggaccaattaatttcgaaaatggcacagatgccgagaccgaaagtgccaaaacccaccatgccccgggcgttgtggtggtcattgtctgctgctgcggatgctgttgttgcggttggcatgtgccgaattcgatgccgttttttgttattgtctgtttggtcgccgctgtcgccattgtagttggaaaaagtggatgccgcttgcgcagcagaggctgcggcatgccaatgtccaacagatctgcgcaaccgccgccggcaccggcggcaccactgcccatcgctgttgaacagaacaagcgtgccggaggctgaatggggcagctcatcatcattgtgatctcaagaggaggtgagaggtgctgctgagaaagggatggaagaattttaaaacattttactgtgacaacgattgaaatttgataaaacaaaaacacataaaatacatataaacattttggtcatgcgattgaaaaacaacaaataacgggaatgaatatgtaattgatttgaaaaattgggacaaacaaattaaaggggaaccaatttcttcagttaatggcgcgacgattttgggggtgggagaggcgaggggagggggggggggtcaagttgaaattttcgagaattaaggtatttatacataataatggggggtaggtgggatatttgggacacagattttgggtgtacagtgtacaattaattatctgtgtatctttcatcctacaactcttctgctgctgtgggcattcccccccccctttcagtagcccaattttgttgtttccccgcgggcaaataaataattcatttgtgtgtgtgtgtgccaatggcattcgccttccttccccagggggttgtttggctgagtgagtgagagggggggggggggggtgggagcccttacggcttcgttggcttctctattttcctccatcaacggcaaaagcataaggcaaaatttttaaccaaatttgggattctcaatgcgaactgctgtgtgtgaacatcattgtcttctcacagcagagcaacccaattttctagctggtaaataaatgtatggggaagggaggggaggggagggagtgaatttcttcctcctttctggaaggagggagggatgaatgtgatgttggtggatgaataattgcggttggaagaggatgatgagtccctttttgggcaccaccagcaatgggagggagggatgaccccgacgaagggggagggatgagcaattaagcactggggtggtgggggaaggtaggggga

SEQ ID NO: 21906 - DNA, 1842 bp, Heterodera glycines
tgtggagttctaaccctttcactaccccatttgcatcgtctccttaaaatttgaattgaaaattttttgggaaaacttagtacaccataaaattttgaaaaattgctagaaaattccctatttttttcttgtaaatttttccgcggggccgggaaatgaagatatccaaatgtacacataacaaattataaaaaaaaacaataataataattcaggtgagtttcgcattcgcgctgatgttgacgcgttcattcgaactgctagcaaatacgatgacagcaggttgaattttctttaaaaacattttttgagaaatttcattataatttggttttctgtttttttcgattgttgcatttgccccgcctgcactgcaccattcggctggactgggcctgtcttggtgaccaacatgaccaccattcggtgcagccgtgtgcacctgataaactgcctgagtactccagcaacattgtgagttattttacacctaaaactttttttttttgtcaaaatggctagaatttttaaaattttactatgggaaggcccctgaaaaaaaattgcgggcttcaaaattggcgatattttttttccttaaatgctttatttcttgggccaacaaataaacggatgtaatcaaaccgatgaccgattgtgcgcagattggttagcacgtcttttgaaaaattttgaattttttttttaagagattgccctaattttcgcaaaaaatttcccatttttcaagggccacgactccttccgtgccttccgctccgcttacgtcaattcggaggtgcgctttgagaccaactcgtgggaacagctgaaccggcagtgtccacaaattttgctgtacgccaacacgttcaaatgcctggactttctgatgcgcactctgatgacggtcaatcggccggtgaagcggggcccactgttcaaaagtacacaggccaaacgctatcagctgagcagacacttcaggttgggagcagttcttttctagcaattttttcaaatttgatgggaaaatccaagggtgggatttaagcaaaaatttaaatttccgaaactccgagtaaataagcggacgagccgactttaaacttatttattttatctcaattacaaccaaacatttaattttgacaccaaaatggcaaaaaacaatgatgttttttgggctaaaaacggctataaatttttactttttttagacgaaaattttaaggcgccccaacttcggatttcccctccgattttttttttttgcgggcctggatgcaataatctgcaattgttctgcttcgttctcgctgtcactacaatttaagaaaacttgagaattttttgtttaagaattctcaaattgaaattttttttttccattaattttttttgttagaattagcaacttttattttcagacgttaattaataatccatacttttgtttttcaggaatgtccaattgatggcgtcgatgccccgctttctgatctcttattggatgtcattttcctcctcccatggctttcgtgtgatcagtgactcgttgcaattcgcttgcgactttttgctacaaatccatcccgatcagtcaaatgttagacgagggttgggaaaaacctaaattttaaataaattttttaaattttaggacggcctcatccgcagggtcaggacagcgtggaaaattctgcacacgtcggccgagttggacaatgcccaaattcacctgtacggggaccagcgaccgccgggcgtggaggaggacctgatgaacagctccacctcgacgggcagcgcgaattcgtcctttttcgtcggactgtcccg

SEQ ID NO: 21907 - DNA, 1117 bp, Heterodera glycines
attagcccagaaaagtggctctcttttttgagagaaatttgcatcgacaaatgctctgcagcatgagcagagggcggagagcatggccattttaatgttcagagatttttaaattcacgattagcccagaaaagtggctcctcttttttgagagaaattttgcatcgaacaaatgctctgcagcatgagtagaggggcggagagcaatggccattttattgttccgagaatttttaaatttcaagattaggccagaaaagtggctcctcttttttgagagaaattttgcatcgaacaaatgctctgcagcatgagtagaggggcggagagcaatggccattttattgttccgagaatttttaaatttcaagattaggccagaaaagtggctcctcttttttgagagaaattttgcatcgaacaaatgctctgcagcatgagtagaggggcggagagcaatggccattttattgttccgagaatttttaaatttcaagattaggccagaaaagtggctcctcttttttgagagaaattttgcatcgaacaaatgctctgcagcatgagcagaggggcggagagcaatggccattttattgttccgagaatttttaaatttcaagattaggccagaaaagtggctcctcttttttgagagaaattttgcatcgaacaaatgctctgcagcatgagtagaggggcggagagcaatggccattttattgttccgagaatttttaaatttcaagattaggccagaaaagtggctcctcttttttgagagaaattttgcatcgaacaaatgctctgcagcatgagtagaggggcggagagcaatggccattttattgttccgagaatttttaaatttcacgattaggccagaaaagtggctcctcttttttgagagaaattttgcatcgaacaaatgctctgcagcatgagtagaggggcggagagcaatggccattttattgttccgagaatttttaaatttcaagattaggccagaaaagtggctcctcttttttgagagaattttgcatcgaacaatgctctgcagcatgagtagaggggcggagagcaatgggcattttattgttccgagaatttttaa

SEQ ID NO: 21908 - DNA, 2002 bp, Heterodera glycines
gtggcacggtcattttggttttattgtggatatcaagtggaaatcgaactgaggcaaataatgaggaagaaggaaatgaaggcgatggtttttcgaccgagaaagtgggacaaaaatacaattggcacagaaatcgaaattggcacgattacacaatgcatagtgatttggagagaaacgatggacgctgaactgttggcagttctaacaaaagttgaagaaatatgttatgaactgctttgtatttgggttgtccccaaaggagtgccaattcacgttatgaagaaaaggtttccggccattgttcgagtgccagaagaagaaaatattgacaatttattgacaaaattggaacaaattggaatgccaattgagaaaaagggcgaacaaagatggcacgagacagcttcaacaaacgcacctagagtgaattggaaccaattgggagacggtcacagagtgcaggccgcgggaagccattcatacaattcgtttgtggcgccacatttttcatcatatttgccaacaacaacaactaaaatgttcttcccaactccggaaatgccaaaaaaaggtgaaaattttggaaaaatccaatcagaaaaatttgatccctttgtggtattgggagtaaaacgaaagtctcaatctccagaatcaaattatgaagaagaagacatttttgaaggccctttgtgcacaaaacgaaccaaattttgggtaaattcgaaatgtgaaactacaaacacggagccgttgggggtcaaaacatttttcaaaaatgaaaataaggaaatttatcagccacattggaaaccaattgttttaagttcaccttcaggcaaaaaaggagctttctttttcgggaaaaattttgttttttccaattttcatccgtcttcttttatgatggatggctttaaatgggataatgtggaacaaaaatattgctttgaaaaggcctcgtattttggttattttaatttggcaaaaatgatcaaattcaaaaatgggatcacagaacccagtgaattcaaaaaatttacagacaaagacatggaccaatataagtcgcttgaagaaaatcccaaatcttttgatcagtatgaatggaatagagttcgagaaggtgtcattcgccctattttatgggcaaaattcacacaaaacgaaaaatttggtcaaatgttgtgggaaactggaaagtttccattatatgaagcctcagtcaatcttagctggggcatcggaattgacattagagaaagacagctaattttttcaaacatggaccaaggatttaaaggcaaaaatatgtgcggtcgtctgttagaagacattcgccaaaaacttaacccaatgggtacggtaaaccaaaaaaggcccacaaatcaaataaatgaaaaagatttagaccaaattttgaaaaagattgaaaacgacaggaaaatctctgttttcaaaactgaaaatattttgagacaatgtactcggattaaagaagttgtcaaagaaaattgggacatgaatgtatttatccaagggagcatatacaatggccttggaagaaaagaaagtgatttggatttagttatgataaactcaaaaggaataccgaatgattggacaaaaaacgacagttgccaattttttgacaaattgcggaaaaagttaagagaatcgggaatggcattaacccggactctgataatcccttcccgaaatgtctccattttggaaatcacaattaattctgatgaccaagaaataaatgctcaaattagttgcaataatttgattggattgattaattcgaaatggttggcatgttgtgtgcagttggatgtacgatttaaaactttatattttgccattttggaatgggctgacttttttgaaattcaccaaagtgctaatggaggcggcactttaaattcttatggttggacatcacttttaattttttatttgatgaaaattcctaaccccgttttaccaaatt

SEQ ID NO: 21909 - DNA, 1742 bp, Heterodera glycines
ttaaaaatttcccccctgtttttagcccatcaaagcgctgaaggagatgggcctgcgcaccgttttggtcaacccaaatgttgtcactgtgcaaacaacgaaaggttttgcggaccgtgtctatttcttgcccatcatcaaggaatatgtgaccgaagtatcggacaggacaaatgggcccatcctttgaaatttgattgaattgtaggtgatcaaaaaggaacgtcccaccggaattttgtgcacttttggaggccaaacggcgctgaactgtgccgtcgatttgcacaacactggcgtactgtcggaatacggtacttttacaattaattggctttacagtattcaaatatttcgtcatagtaatccccatattggcaattcattaccatacttcatattaaatgttccaaaaaaaaaattttgggtgccaaaatctttttttttattttattaattttttttcttgaggtgtcactgttctcggcacgtcgattgagacgattatgcgcacggaggacagagaattgttcaaggcatgtccaaaagacttttgaaaaattaaaattaaaaaatataaaaccatttttaaaaattttgttttttaaggaatttgtgctgaaaattggcgaaaaagtagccgattgtcgtgcagcgaacacaattgaggaggctgaaaaggcagctgaacaggcgaggaaccaaaaacaaattcatccccctccctcgagaaatattttcgaaagaaaaaaataaataaattttctaaaaaaattttctatttgtttgtaagcaaagaaattaaaaaccgaagaaaaattcttttaaatataaatttttttttgaaaattcttaaaaaataacgaaattgatgggggtttaaaaatcgtataaaaaatgttaagaaaattttagtttttatagcttcttacgatagtctgcaaataggaaaaaaatctttgaaaaaatctgatttcctgtcattgtttttttttaaatcccattttttgttatatgtcctcattttttccaacagattggctatcccgtgttggtccgtgccgcgtacgccctcggtggacttggttccggttttgccgagacgcgtgacgaacttatggcaattgcacgccaagcacttgcccattcaaaacaagtgctgatcgacaaaagttttcaaggctggaaagaggtgagaggaggcgattgaattattatatttttaatgggaggccaaaaaaaaaggttttttttttgccaaattcactcaaaaaaacttaataattcactatctagttttaaaaatcgccaaaaaattgcaaaatataatgactcatttacctttccattttcattttcagattgaatatgaagtggtccgggatgcctatgacaattgcattacggtgtgtaacatggaaaatgttgacccgctgggcattcatacgggcggtaataaaataacaaaattaaaaataaaattttaatatttttttcaattttgattcagatagtgtggtggttgccccatcccaaacgctgaacaacgaggagtattttcgaatgcgacagacggcactgaaagtgatccgtggactcggcatcatcggcgagtgcaacattcaatacgcgttgaaccccaacaaaatggaggttggcttttcatgctcacaatcagccaaatccaatgggtctctctctctttttttgttgattatactgaaaatagtgcaaaaaaaatt

SEQ ID NO: 21910 - DNA, 1118 bp, Heterodera glycines
aacgatggcaaaagcggagacggtaaaacacagagaactttagacggattattcgtcttggtaaataaatgactaattgtaaattaaattaagatgtgccaaatcccaccaaacagtgccaaaagcaacgcgaagggacgtcgccgttgacgaaggaagcgagtccgacgagttcggcccggtcggggagcgtttcgctgaacattccgtcctcaattccgacgcgtaacaccgcattggctgagaacacgaatggcaaagtgggttaaggcttcatgcgctttttgggcttgcttttttcaattgctggatgattttttgagtctaacgcggggaaggaaaacaaaatgtgtggttctgtgggtaaatttgtatgctttttgttaattaggttccacttttttaaacaattttacaaccaaggaacaaatctttttatttcattcaaaaataaatctaaataaatttgagttttgattgtcacaattttggtttgccaggaatttgaagaaacaaactttcgagtatttccaagattttttaattttttcatgcaagtttatcattttgttgttgtttttgagttctcttcgtctcataatacggagggttcgcccacgagagagtcgaacaattccaacccttcccaagcgttgagtgacgtcaccatccatttggactacgcacgactcaaagcggagcaccgaaagctgaagaaatattttgaggtatcattaactaattgataagcatcgtcgtataaaattttcagtgactaattaacatttcattttgaatcccattttaaaattaatttttgttttttatttttagagtgcgtgtgaaagtcgctacaaaacgccgccggtgcgcgagacggtcaggcgactaaaccgtgctgagcccgtcgcgctggacctgtacaggttgcacagcgagaagatggaattgttgcgggaagcgcttgaggaatgcgactgggacggaataataacggttggttggactggaggaggggggggggctggttcatatttaggtagtaaaaatagcatttcatcctattttcattattgtcacatttttgactaaatgatatacaatcagaattcatgaac

SEQ ID NO: 21911 - DNA, 1481 bp, Heterodera glycines
cgcttgaggatgggacggggacggaataataacggttggttggaccggaggagggggggggctgttcaatattttaggtagtaaaaaatagcattttcatccctatttttcatttattgctcacattttttgactaaaatggttatacaaatcagaaattcaatgaaacgatgggttagaaaagcttttggcatacaaaaaatatggtacaccccgaaatttggccgtcgaaacgtcgccggggcataatgccgcagcaaaaaatttttttttttttaaattcagagaaacaaaaaaatttcaagtttttttgttttgtttttgaaaatttttgtttttagtaatacttagtttttcaaaaaaaaaatttcttaaatctttaaaatttttattttattattttttgcggcgactgcaataaaataattttacatttttctctcttccggtgggatggataccgaacgactgtattcatttttttcgtgtttattattgctaatccataacctttgccaggtgctgctgttcttcaaacgcacactgtccaatgcgttgttccgccagtgcctaatggagcatccgaaagcggcacgccattacgtcacttatctgcgcgagtgcggtgacagtgccgaattggcggacaccctttttggtagcgtatcgcaatttttggggcacttctcccttttcctccacttttattagaattcccaaaaaatattgaaaaaattttcagcgatttcaactaggatgatttactaaaaaaaatttcaacaaaaatttccagaaaatagctgaaaaattttccaattttttttccttgaaactaaaaatttctgtttgaaaataaatttaatttttcctagggggaactacgggatggaaaatgaaattttgacccctccctccccctcctctactcaaaaatttgtgcctttgcggcatttcgtcattcaaacattggcacttttttgttttcggtcttggccaaacggcggatgcggcgatggtcgaatttgtgtccgcctgcaaatggacggacccgaaacggaagttggaggcgttgcgcaactgtttgctcagcggcttctcccacccgcagttggccaacgagaggcgcagtttggaggaatggatcgcactgcttgaaacccacctgaaaagaccatcataagcttttgaccccctattattccccaaaagtgttgcgtttgctctcattttttgtattttttttttttgatttttggagggtagctatcagtgatggcacggaattccgatttccgatatttttagggtccgaattcgggtttccgaaaaatttttggtcctcggaatgctatccatggtggctatcataaaagaaaacattttaaattctaaattaataatattttaattttcttagaatttaaacgaaaaagaattgaattcgcaaacccaatttcagccttattccctcattttcgctt

SEQ ID NO: 21912 - DNA, 1112 bp, Heterodera glycines
  misc_feature (1076)..(1076): n is a, c, g, or t
aaaaaaatttattaatataattttgaccaaaatataggatacaaaccaaattagtaccactctaagaccgatttcctacttttgggccttggaataccaaatttcgtcatttttgcttggtcaaaatctcccaatttctgaaacattttaaagactcgaatttcgatttgaattcgatggcctccgcacctcagcgagtgctgtgaatcgtcgccgtccgtcgttgagaaagggtccaatgagataagaatggccaaaacaggttgaggacgattttcgtctttcttcgatggttttgttgtaccaccattactgggaaaaaaacatttagacaaaagtttggttgacattttacaactttggcgagttttccgaaattttcaaggcctccatttcatcacattttgaactgttttctgttgttgttgatgatgttttcttgttgctcaatgcattccattggaaaacattttttccctgactggccaaacgacttttgagcacttcaacacacgaaacgcatcgctcgcaaccatcgccaatgccgtgaaagagcaattgccgaactccgctctctgtgccatctttctgtttaaaaaaaaattttttttttttgatttttaattagaaatcaaaatttttcgagtggacggataaagtaatgggttgggcacattggaacggactcattgactagtaaaccgtatttaatatttgtatattttggtagattttcacagtaaatgctcctacttgaagctcgacatcaatccttttgagaatcctctcaattttggtgtgctttcgaaatgcgaaatgaagtgcatttttggccgcaagttcaggaaaagaaaaattataggttttaggatcatccattgtgaattaatcgacttaaaaaaacaaatttgcaaaaaaaataaaaataaacaaaaccacaccagcgaaaaaagcgcttgtaagtgtggttcagtggtttttgtaagaagtaaagggaaaaaggtggaggttcgaatccgctccacggcagtaacattcttacttattttttgtcaatcaattaaaaaataaataanaaaatgacgttttttgaaaatttttttgaagttttt

SEQ ID NO: 21913 - DNA, 2124 bp, Heterodera glycines
  misc_feature (2104)..(2104): n is a, c, g, or t
attggtgtcagattcttggtcagcgacttcaaaaaccttttgaacaagttttcgtaatgaagaagtacatcatattatcttttaaaaaataatcaatcataaatttcactcattttttgtgtaatggcgggttttattttttcagaaaatttggactgattaatggtgccattggcgcgctgctcaaccgatcggtcagcgaatcgaaggcccttaaccaacagcatcaaaatgggggcggacactacggaaagctgaaggcccaccaacaatttcctttttcccaatcatttcccgtgaaagaaaactcgaaaaagcaacagcaagcaccaattgctcagtcggagccatcggacacggactttgacgattcactatcagccacatcagcagtggagacgggatcaacaccaatgggaagtggcgcgacgaggacaccgatcggacaaggctcggcggagggcgacacttcgcaacacgaaaaacgaccatttgttgcaatgtataaccaaacacaaaaacaccaaacaaattacgaagcgacaacaatggcaaacagttcaattagaggttcagtgtttgcagttaaaaccaaagctgtccagaatttcgagttaaaaacgccgaaagtgctaatagtcactttagtctttaatttaatgtgatcaattaagatcgtgcacagagctttgggtcgaccactccaaacgcaatgacaaaaagaccaaattcacgtgggaaaagtcattcgaagggaccgacctcacgagaaaacggcgaactgcctacggatgagaagcaaagaacgaatccaaaacccagcgaccgccttcgcattttctctacactcagaccatcaaagcctagtgtaaatatggacaattaggaagacttttaattagcaaatacaaattgcacatattagaacaattaatcattaaaaattgaaaggatacaaaaattataaatgtcgttgagcacattacatgccgacaatgactagctaacaaagtttggacagcccggtttcagaactgacttacgatgatgcacaaacaaaaatgaataaatattttgcggttcaaaatagagttaagcctgactcaatgtttcgttgaaaatttaccccgaagagagtattacccccgacatttttgtttaaatttctccgccatcctcgacaaattctgtcgaggaatttcccccgagtatcgggggacttaactctaatcaaaataagaagcttattaaaagaaccaaaaattgtgtcgaagtgagaaatagcaatacgatctccaaaattccattcggttctgcccttcgacgcactcactcttccttcaaagtcggtggtcttggcgtgtgcggaaggggcactttcgaccttaattcggcctgtcgctgtttttctgcttccgattcgtccgctgagtttgccatttggcctccgtcctttgcgagcagtcctccgcctccccccttttcacacggagtgataacaatggacgggcgtcgttggtgttcgtcgccttcgaacaattcgaatttttcgtccacagttagcgacgcgaggcgcgccattaaatcgaaatcgcaaacgacgggtgccatttcagcgtgttgaatctgaaacaacagaaaaggcattggaaatgctcttgcttttgtgtaccattttcccagaaaaaattgtgaaaattattaggcagcttttgaattaatgggttctcatcaaattggacgacccaaaaaaacgcaaaagcaaacatttcaccacataacagaataattctgggttcttttacatcaggcgtcatgatactaaattctggttgagaaaacgcatttgaccctaacattttggaaatagcaatttttcttacccatccgacgggcggtgagctgggcggtgagatgagaaattgtttctccaacggcggcaacgtcaaatggccggcctcgtcttggtgcgccttccttgtcaatttgatgttcttggcaaagaatgccttcatttttgtcccgttgaaagaatgatgttccaccaacaatttggctgctaaatttgaatacatttggactttgggttttttgataagaaatngtgtgcccaattgaaaggaa

SEQ ID NO: 21914 - DNA, 1485 bp, Heterodera glycines
ccctgggttgatacccctaatcaaaatcaaaataaaaatttattagggaaaagtataaattttttaaattatagaaaggctttaattaatttttagtgaatacgaaaattttttgaaaaaaaaatttcaaaattattttcgagataacaccattctaggggttgccagggtcggggaaaccgaatccgacatctatttcagcctatttcgaatcccgaacccgaattcgaacaaaaagttcaaaattaaaattttttataagtcatgaaaatacatttccaaaggttttcgggtacgctgatcacgaatccgcggcatccatttcgtccaaatccgaaccccagacccgaattcgaacaaaaatttaaattttaaaaattcacatttatgcaaccaaatttcaaatgcacgaaataaataaaaaaacatgcttattggcatggataaaattgcgaaacatgatagttcaaaaacttgcttagtcgacaattttgaaccttataatagaaccaatacacgcaatgtgtatcttttgatcgaaaaagttaagaccttcaaaaaaagtcccaaccaagaggggggaccggtaaattggacaccagaaaattggacactggaaaactggacaccaaattcctcttttaaaaaataaacacaggaattagcttgaaaaataattggtgtggataaatggattaaggtatttagagtcgatcaaacattaaataggcacgatgattgatcaaatgtggcaaaaagaagaaataattaaattattaaagtatcctgtcaactattaagaaataattaaattattaaagtagcctgtcaactattaagaaataattaaattattaaagtagcctgtcaactattaagaaataattaaattattaaagtatccttggtttctttcatataaaaaaatagtttagaaaaattagaataatataaaaccaaaaaaacaaaattaaattattaaagtagcctgtcaagcaaacgagtcacaagaccaaagaattatgcgcttagaacagatgagaaatagaaataatagtcaaagatctgaagaaagtgtgttagagcgacagctacgcttagaacagatgatttgaaagcctgagaattgagtctcagagattgaaatgctggtgggttgagtcccagagattggaatgccggagatttgagtcccacagattgaaatgctggtgggttgagtccccgtgtttggaatgccggagatttgagtcccacagattgaaatgctggtgggttgagtcccagtgattggaaagcctgagaattgagtctcagagattgaaatgctggtggattgagtcccagagattggaatgtcattgaaagttggtgggttgagtcccagtgtttggaatgcgggaaatttgagtcccattgtttggaatgccggagaattgagccccagagattgaattgctggtgggttgagtcccagagattgga

SEQ ID NO: 21915 - DNA, 1782 bp, Heterodera glycines
  misc_feature (1729)..(1729): n is a, c, g, or t
gacccgttttttttgaaaatccaacacacggtaacaaattacattcaattttcaggaaaaaaaggtcgtcgaccagggcggtggtaccccctccaaggcaaaactataagaccgccctgacctttggaaatattttctttagtttttatagtagaaggcacgtcggtaagattatggggtgtaaaagcataaaattttatataaaaaataacaaaattaagccaattcagcttttgagataaataattttttaaatcacacttgttaagaaatgaataaattggaattgttgtgaaggacttggtaatcgatgaaatcgatgagaaagcgcaataattcattgtagtatgaatagttaaaaattaattggtctttcgataaaatttatataaaattttattgttcttttgagttttattcttttgaatataaaaattaaataggtttgattaagtgaagcatatatatttattttatttctctgcttgatattatagaattaataattcagctaaattttttatattttaaaatttttaactttattaaagaataaattatcaatgtattgatttttattttctggtttttaaatattgtacaattttaacgtaagttggagtcaaataaacatcgaactagagattgtcaattctccgcgtatattttccatctcatttgtcagtcgaatctttcaaaaaagttttgcttgattatattgaaataaattttaaaaattattgttttattttttttttgttaacgtcttttttacaaatattgattctaaaaactaagtaaaattgcaattaaagaaaaaccgaagaaattttattttcgttttttaaagaaaaatgtccttaaataaggctcagtttaggaaaacaattacctttttctattaaagagtattatgaatattcaaactatttacagtatttaaaagacaattttttcatttaaaagaatcgtaaaagtataaccctatagtgtgtatgcttaaattcactccatgaataaaatgaaataaagaaatatgaaattcaagtgccggaagcaataaaggtcgatttaaatcattgtctaagagaataattattgaataagtaatttaataataattattacatcaattaaatataaaattgcaatatgttacctaattcaacactttaaaaaaattggccttttaaattaattccaaacttaacctatagaactgttaaaccgaaatgtttaatctactaaaagatacataaaacctaataaaattacaaaatattacaaacaaacaaaaaattacgactgtcgtgaaattaacatgtttaatttttttttagaaaaattaagggtcttaaaataaaattatattctaaaagagaatgcaatattataaaaaaaaattgcttttggaatcaattagaaaatttaaccaatattaaatttaactttgtttaagaaattgaaatgaatctacataatattttaacttaagtaaaaagttagataatatctaacaaatacttttttaaataaaaaaagctaaatttaccgaaaagtgctcaggcaccccatttaataaatagatgagatagaacattgggggcaacaaaaaacgtgatcacatttcaagatgcgtaatttaaactttagtaaaaaaaattgcggacgtgattgttttaatctaattatttattaatttgtattttccttaatatagataaataanaaatgttatttaattaatccgctttttaaatcgcaaaaaatataaatgcaata

SEQ ID NO: 21916 - DNA, 1824 bp, Heterodera glycines
aaaaatgaccgatgaaatgaccggtggacataacgacccaattggtcgcgtttgcttagagccgcttcgatcacttcgtattgcaaagggcgaaagcgcgaataaccgaaatatttcttcagcaattctaaacttcgttcagagggaacggcgggcgacgaggaattttcatcattgccggggattgccgacgaaagtgccacggcactgtgttcattcgccaaagtcttaattttgaaggaaatcactattttgatggacattttcaatgtaataaaggaaagggtcaaaataaatggcactcgcctgttcacagttagtcggatttgcattgtcattggtcaaatataaatagtctgttgtttcatcataaaaatcatcgtcagaaggcactggaaaactcatctaggaaaagagattcagaaaaagatttgtaaaacagataatattaaacttaattcaagtgttccagccaattcctaccgccaattccctaccggccaattccctaccggccgattccctaccgccaattccctactaaggcatttgggccatttccataccaaaagtgttgaatattgataaacattgagattaaaacacacaagaaaatttattcactgctttttagacagctcgtcaagagctttcggatgataccaaatttatcaagattcgatcgttttaaaaaagttagaagtgtcaaatctctcaatttttcgagttttgaaccctcctaaaaataggttctaaacccatttccgcaactcccggggaacccgaaaccgggctcaaaatcccggagctttagggacttcagattcgtaaagtacctgcttgtatgaaatttgaataattaaaccccggccttacctcctaattttcgggcccctggaagtcctacaaagcgatttgaaatcaattgtaaattcgaaaaaaaattcacgatccaatttaagaatccggagactggataaagctgctaaaatagacaaaacactattttaaaatttttacttcgatttgtgaaaaagtatgaatggtcattgttttaaagctttgtacggttctttttttgttagaagtattttcattttcttctctgcaacattaaacaaaaaatttattgtcttataattcacgagaaacatcaaaatgttgaaaatcccctttctgtttttgaaatttttccgaaaattttcgaaaaattttttggtacggagatggcccaaatgccttagtagggaattggcggtagggaatcggccggtagggaattggcggtagggaattgaccccaaccccgtggaagggtagacagtaaacagccgtgtgctcgctgtgcagcagcattgtgtgtgggaaaagggaagaggtgagaaaaataaagaaggaaatagtgcactgtctgactgtctggttacgcttttgaaaaatttgaccgaaaaccgggacccaaatctgaattactacccaaaatcattgacagaatcaatgactacaaaatctgagctcacaatcagattcataataaatttccttcctactttggcacttattcatacataagccaaggtaattttaacatcaatggcgaatggatgcaagttgattcattcgacgaaaacgatactgttggatgtggcattaattgggccacccgacaggttttttacaccaaaaatggacgacttcacggtttgtaaaaaataataccaacaaattttgttgcataaaagaacactatttttaaagacaatttctcaacatcatcaaatacataatgcccaatatttttttttttccaataccataaaatcc

SEQ ID NO: 21917 - DNA, 1461 bp, Heterodera glycines
cttatttccatctgccgctgctcacctctcttccggccctttattatgcattatttattcacccaccactgctggtgccttccatccatgccaattgtgccgtgccatgaccattcaatgtttggtccgacccgtcccattttcactgctcctcccaatgcttatccaccacagagcatttgtctgtcactgaccaaatttatccaatgccataagcttcccgtcatttccatgcataaaacaaatgccaatttcgtattattttaggaacatttgcatttttatgctgctgtaattctgcaaatgtccgaggaagttgacagacacatcgtggagcgttacaaaattcaaaagagactcgggaaggatgaggagtaatggacgttttttgtgggtggtgaattggtccctttcaggagcgtatggcattgtttggaaggcgattgaccgaaaaacgaacgatacaattgctctgaagaaaatcttcgacgctttccgaaatgctacggacgcacaacatacatttaggtgaacagaaggcgcggaaggacagccattaaataaataaatggaacatgaaaatggaattaactaactacggttttcagagaaataatgtttctgcaggagttcggacggcacccaaacatcatcaaactgttcaacattctcagagcggacaatgacaagtgagtgtttacaataagtgcaccttttgctgattcacccacatttaaaactcaaattgtttttcttttttagggacatttatttggtcttcgagtatatgcaggctgatcttcacaatgtcattaaaaaagttgttccattattagaattgtcatttctttcaatcttttctttgttttattcagatgaccattttgaaagacatacacaaacaatgtttgtccttttgttttgtttttttttctgcatttaatgatctgatcctacaacagatattatgtgccaacttttccgtgccgtcaaatttctgcacagtgggaatgtgttgcatcgagacttgaagccttcaaatgtgcttttggatgccgattgccgagtcaaggtaaagctgtgtccgtttctttcccaccttttgttttagctaacaaattcaattgtcatttagttggccgattttggactcgcgcgttcattcagccaggtcaaattgcaaaatgcgtttctttcgtttgtttgacattttttttcagatggatgattatttggatggcacaaatgtgccggaactgacagtaatttctaaattttttgttgttctcgccgttaaatgtttttttccccaaggaatatgtggccacgcgatggtatcggtctccggaaatccttttgggtgctttttcattttttaattgcaattgcccgtttttttagccgccaaaagatataccaaaggcgtggacatgtggagtttgggctgtattctggcggaaa

SEQ ID NO: 21918 - DNA, 1107 bp, Heterodera glycines
ccccccccccccccacctccctggcctccccgtgctgctttttcctctatgcttcttcacttctattcctccacaaaacgttgccgcctcccgccccccccccccttggcccgcctaaagattctcgaatttcaggaccgccttaatgaaaaattccccctcgcctcccctcccctctcccgtggcgccggggggcctttgttggcgaaaaaatgggggaatagcgggggacacccacccattcattcattcactgtgtcaattttttttgttgttgttccatttgcgctctctgatggactcttccggatctgtgacaagagcatctcggatgtaaaatggagagcttttgggctctatgtgatttttgagtgttgattttcgagaagtgcaaaaatcccgaaaatcttttgaaattgaatggcgcaaattttttaatttttcaaagcaaatgttgcctgggatcatcaacaaaacaatgtacacatatcagccaagcaaagttcattcacaatttttaaattttaaaaaagttttcaaaacttaaaaattttgtctgaatatcgcattaattctgtcgggaattttgaatttgctatttcatctaaacaaaatcaaatcgaatttaaatttttcaatcatttttccattctgtatgaatggcggatagcagtggtcggtggaatcaaaatcttttttcgagattttcaccaccaaaatccctatgtataaagcgttcagaatttgtcactgatcccgggtttttgaaaatgcccggcgctattaatccgccttaataaaccgctgatcaattccaattaattttattttaattacttaataacataattttaaacattgccatttcatttagtgttattttatttgtctattcatttttcgatcaattttgttttttgaaatttgcacattttccactggtaaattcatgttctcctccctcctcctccttctcaaagtgatcaatcattctcaactgattgatcattgtcctttttattccaattaactcatgtgatcatgatcagctgctggtaattcctaactcattactagctagggcttttattttcgggtttttgtcta

SEQ ID NO: 21919 - DNA, 1903 bp, Heterodera glycines
actttgtatgttgtgcacttttctctaccctcgctcgcttcaaggatcgtttttcctctgaaagcgacatactttttgcgcgcgtttcacgttttttgaaggacgaagcagcagatggaagtgaattttggaaaatttggaggaggaagtgaattcgactcgaatttcgccaccagccaaacgggcttgttcgattctggagattatgcagaacataacctgttgtagcaaaaaaggtggtgtgaaatttcagcattggtacaaactttttagctacatcagctcaaaatatgggcatgtcggaagaaattctcacatacaaagacgacatttgtgtttccatgggtgttgatccattgcagtggtggaacaacaatgaaaaaaaatttcctaaactttcaatgattgcgcgtcgttatttgtcacccccatgcacaagcatcaaactgcagctgcgcaccagcaggcgacggtgccgatgcacgaaaatgtgccacattttcatgtgcatgcagatgcacgaaaatgtgccacattttcatgtgcacttgctggtaatgcctaaagtcttggggttggtctcgctcgatgagtcaagaaaagtctcgtttttaaaaagacaaaaaacgaatcgcgtaaaaacgaattggcccaaaaacaaattgggcgtcgtctgtaagcatatctctacaggcaatgaatagaaaagtcgaaattatcggaacatattaagaaataacggaacatattaagaaataataattatctatcgtaaaccactttagaaacacatacattcataaagattacattaaatcaaaacttttggaagtctctaagacatttgactttgagatatctaaatttgataagaatcgtgaaaagaaaagcttgtgaaccttggatacaacagtttttggttttttttaatttaatcaattattattattgattttcttaactgtatcggatcagtgacgtccttcacattgtgtagttcctaatggatgaggtccattctgcaatggaatcactgatttcagatttgaaattcgattgaacacaaatggaaacaccgtttggaatgcttgccgatattccgtactaaagttgaaaattatttttttttaattttaaatattttaaaccttgtaaaatataaaattggtccggttgacgatgcgccaatgttcaaaggaattacactaattgcatgtaaaaaccacgcagtgatcggagacgaaattttgggaattaaaagaatgtaacaaattaatgaaaagaaatagccgccaatattaacagaaatgatgcaaaaaagtgcgcgaaaagtgcgacgattgaacgaatcagcggacggcaaacctattaaaagagttaattagttaaattaatagctcagaaggaagaatttttgtatgctttactattgaaattctttcgagttatgtggttgtgctttcattttttagaaaattttttattaaaacctatatgatacaaaaaacagattagggaatattttcgaagaaaggcggtgatgttcaggtttttctttgttcctagtagctttaacattttatcaccataaatttttatattatggcacgcacgatttaaggacgaattttctaacttttgcatggtttcagttggtgaaaccactggcaaaatgggcctggtgatggcacaatttaattatacacaacagggatggcattccgcggcaccaaaaattttatgaaatcggaattctgagggtaaaaaattttttggaaatcggaaaccgagaattccgacccctaaaatttcggaaatcggaattccgtgccacccctggtacgcaatcttgacggaaccaaatggcatggtccacccgaaattccatcatccctggcaatga

SEQ ID NO: 21920 - DNA, 2316 bp, Heterodera glycines
caatcattttcgccatgccaatcatttggtgggccgttcactgcccgagaatcaaattcgggacattgtggcgatgatggagcaggagccaattgtcaggtggggaaggaaaggaactaattgatcatcgaattttactactaatgaataaatgaattaaaaaaaaattctattaacaaattagccaagttatgtggtaactccccgaatcactaatttcctttgtttttttataatgccctcattaacaaatattaatgctaaaatgcattttttttttctcggctgtgcttatttttgggaaatattacttgaaaatttgctcaagagcaaaaaatattcggcggattcttctgtctaaaataatgtgcctagcacagatgaaaaccgtcgaattactatttttttatcaaactgctaattaattttgaatatgattgatattttttacaattttactataggaaagtgcacgacgtcaaggccacttatgttggtgagaaaagtgcaattacctaatgctattttaatgattcattttcaactatttatcaccgatttcaattatttttgttgaccatttctcaggtgtctccgactcggtgttcaaagccgaaattgaatacgacgggcgggaaataaccaaggcgtatttgcaggagaaatgcaatttgacacaaatgctaaaagtgatcataaaagggtgtgattaaaagtcaaattgcatctttaaggaggtcaatgccttcaaaactgagaaagaattggcagagttcatgatgaaccatggcgaaaaactcgtcgatagagtacgccttttgagcaaaattccgacaatatttgtgtaatttttctttacttcttgccacagatgggcgacgatgttgacctgcttgaggaacgggtacaggaaaagcatccatcggttcggcatttggacttggagcccatgtgattgatcggctaatggccaggcgatggaccatttgcagacgaacctttcgcaaataacggacaaatgtcaaaaaattgcatcaaaattttaattaattaaatatttattttttaaaattctttttggccaatgttcttttcatttgaaggttgtgttggatattcgcataaatttttgagggaaaatgccaaaaatgcctttgctgatgcgtttaactcattgaatcatcggttgtaattcatattatgcttaaaattgtgctgctctaaacgaaaattccacaagaaaatgtcatttttaatttatttttttttaaaaacgtcaaaattcctttttaaatttccaaatcccattcctcaaagaatgtgttgtaaaaagttctcgagaacccgagactgttttatccggcccaagctctcgagcagcacaaatgaaaaagcatttttcgtctgttactatgatttctctgtataaaaatattcgaataaatcacaaaacgcgcgattaatggtcatttttgaaatgcaaatttctgtagatggacgataagaatatttaatctcattgaattatccgtcatttggtcccttacaatttttcattggcattaaatattaaagttgccataataaattggcggtctccccattttccccatggcttcccattagagatcgacttggacctggatttcctgaacttattattttaagtgaccgaaaatgattaaaccaataaatcctggtccagtccaacctggaaatccagacccatgttttttcaaaatgttgctctctacttcccattaaaaaaagaaaaatgcaaaaacgaaaattaatttaatcaatgaatttcattattggctacatttcatcacacaacaatgccgaatcctccgatcagactgattgatcatgctttgccctccgtggccaccgccggcacggcgacggcggagtacgacttgacgaaggcgacgacgtcggcactgttgttcagattcagctccttcttcgtgttgtccgacattttggctgtcagctcctccgtccgcttcaccttctcgtccaaagtcgtctttttgtcttcaattatcaaagtcaactgaaaagggcaaaaaaataaaataaatttacatttaaaatcaaattactgacaattgctttttccaataaataatttcattgctttttcacctctgcgctggcctttttgctgtcctcagaaagtgttgccgttttcgttttcacttcgctttccaattccgcgtcgtttttcgcttttgcctccaaaattttgttgacagccgtcttaattggggtaattaattaataattaattgtttcgatgcttttgttttg

SEQ ID NO: 21921 - DNA, 2971 bp, Heterodera glycines
  misc_feature (14)..(14): n is a, c, g, or t
ttttaataaaattntcttgtaaaagcaaaatattcttagattctaatgcatttattatgcttttcaaagttcttactctttttgtaatccattttaggaatgttttaattttaccgattcatttttaaacatattttaataaatgatttacatacaaaataaatgcttacggtcgtatgaataaccacaaattgctgaccaattcgttggcatcttcttcctccgcttcttcttcctcggcttcttcctccgcttctttttcctcctcttcttccacggcccctcctcccccttcgtctcccctctcttttggtccctccccctccggcgccaactttctctttgacgatggcccgccaatttatggcgactcttccgccgctgcttcgtccactcctcctccaacatttgccgattctgctgaactgcttgaacaactccgtcaaatgtccccctccttgtgccgtcagggattgctcaatcgctttgagcaattggccgatttgttggccgccgggtggaagtaccacgtggccaacacggacggggtcaaggaggcgtggacacgctttgaggacttctacgaggacgtgtgctcgtacacggaaggtactcgcgaaaaggaacccctttgggcatattaataatgaatttacaattttgtgcttttttaaaataattcaattatagcaaattgtctggctttctaatagttcatattttattaatctttattgtttttaatccacattttttaatttttcctctctttcccaaacattaattaaaaatcatttttttcacctttttcctcatttatgaattttatataattatttaaattattatataaaataaaattttcctcccaaaatattcacaggttctcctcttcctcttctctttgtgtttctccgttttccccctttttgacacttatgaaaaagtacctttctcactttttggttgttccctcaccaccaaaaacgtttctttctttctcaccattcttaccaaaccctccccccccctaaggggcttttatggaaatttggagggatgcttaaagcaaatatggccttatgcctgcctatccgagtgctcacatgtgagttgggtgagtgagttttggccgggatggcaatgaatggcggcaaacaccggcaaaagggggggcaacgggtgggggggggaagggagggcgaaccccggggcacaaagggacagacaggcacagatagacaatgaatgcttcttttcattgccacggcattgatcccgtctttgtactggcgagaatgaatttgtgcgttctcgtgccatttcgcttatttcgaacaaataaaaagaaacatgtcaaagtctacctaattaaggaaaatgaacgcacattaatgttccataataatcgaataaaaataaaaccaaaatgtaaattggatttcacacctttcctctttcaaattcatgactatgccaaaacgcattttcgttcctttttcaaaagaaatatgttcgatattttttcgtataatttttttgataactatcaaatttatccgaaacttcatcggcaaaattggcactttgaatgccattccttttattgccatattttcctttatatctgcactaatttgcatatcattcacaataatttgtccattagattttggtttcattctcatagaaatttcatttaattattgtttaaatgtcaacaaatctcataccgatgcttccctttttgtttttatttggacttctttcctggttttgctttgctttttttattggcattgtgaccttccctcacttttcattttcttggcactccccggagaagacccccgcccacccccgccgaatggacaaatgcggggaggggagacaaaatgaatttattccgcttcttgtccaacttatcgctctgcacacacacacacagagccattctgatgcttctgctcggaagaaggcttttttgccctcgggggacggattcatttctcagcagaaaagacaatcaaaaaaagggaggggggaaacatttttgggttgttgtgttttttttttcgtacaaaacttcagcaaaatttgaatgtaaaagtttattttatttattttgcttaaacacattccgattccaattgattcatctttattttggcacttaattttacataaattttcattttttgacttctgtaacaaattttctcatcattttgaagtctaatttcatgctaatcggctaacaatttttgcaaatgcgcccatttttgcgaaatgaatgagggaagtaagcactttaaaaagactttgatcagtcgcggtcgcaccgctgggcatcgccattctccacaaaacgacgatggggacgatgaccaacaacaacggcaacaacagaaccaatttgatgcttatctgaatccacaacaaatggacaattttgaaatgggggcagaaaaagaagaggaagaagaaggggaggaagaggaggaggaagaggacttttacgcacttttgcaacggtttgggggccacggaagagagggcggcaaaacggcggaggagtgcggttgtggaaggcggcgcaacggcattggcactgccggaaagagtgccgccgatggtccgggaagggagtacgacgcgccacggcactctctggggcaatttttcaacagcgaacaaagactccgagacagaggtccctctcggcttttacttttgattggaaatgccgagcggcataacaattaattggccatgtgccttttttgcggtgaccagcggacttttaccggtccttctcggctttaatgttcaccccggccaatcccccaaaaggtcctaattatctaattgcttttatcgctttaattgggattaagttttatttttgtcctttttttgttccgattttccgttcttttgccattttcgtccgtccctccgttgttgccat

SEQ ID NO: 21922 - DNA, 3172 bp, Heterodera glycines
gtcgctgggcaccgtacaaaaagcccctcagggggacgggggacacttgactttattacaaattgggggacggatgggttgtgtggggtatccattcgtcatcatccaactgtgaattgattacattagtggcggtgtgttattggggagaggggggagcggcctatatgtatggccactttactatgcaaataggggaacggatggagacgcaaggcttaaaccgatccgagtgtggacggcacaaatgggccaagtggcgaaaattggcggggggcgagggtttgaaattgccttcaaaacggcaaaatgaaatttgcctggaatgataattacactaaaaaagtggattaaaatggttatagaaaaagataaaaaagtaaatttggtgttatatcagggcagggatttgtatgaatctaaaaccaaaatatggacacaaaaatggaatgacaaaaattaaaaatggacatgaattgatcaaggcgaataaattacccaaaaaataaataaatttaaattaattgatgatttatcttttcctacaaaaaaatcttttttttttggagtggcttgggttaattaggacttattaaaaataaatgcctttgattaattaatttccttgaataaattatcgtcatatatccctcatattttcggcacttggattgtacgcaggcaaaagaacggcacacaaataaaatataatgctgcctttgcgcactctggacggttagatgctgtgcgtctcacatttggcccatccaatgccctcaattatgccgccgtcgcacaaatccattagtaatgctaattaatatgaccccgataaacaaatggagggagagaaaaggcacagtctgaaaaaaatatatgtaaaaacagatttgcagcttaatgctcatttgcgcattggcgcctgaataattacaattttggatttttggcattttgccaaattgggaaaggaaaagaattttaattaaaaaatgcagctatagaaaaagcagctcaaattttatactgttttttaaatttaattttatttcttgaaagaaattttatttaagtgtattattattaaaattaaaataaatgaatattataagaatttaaaaaaatatatttccaagctcaaaacaaacaaaaaaaatttaatttacgaaatataaatttaattcaaaaagaaaataaatttagtaaatatttgtaaataaattaaaatttataaatattgctaaaatatcaaaatcgaaataaaatacaaatactaaaaattattttttatgcaaaaaatggcctgctggcggattgctgcatatttaagcattgtcttttttttggcttggcccaattatccccggcccaatggccagaagaatggctcttggcccgccacgtttatcttttccaacaattttgaccaatgccattgttttgaagcgaaaactgcacaattttatgttggtcacaattaagaaagtgcattagcaaatcaccaactgagttaagtggggatgcttttggaaaaataatttttagagaatttttacaagccttaaatggggagcgagcggataagcaaaaaacaaacttaaaaagtcgaattagccatcaaaagccattactcatagcaggtgtcattaacaagaaaaaaatgaataaattagtctctcagggcatggggaaaataaaaataaaaaaaattaagggaagtaaaacaattcaaaaaagaaaaataatccaaaatcaaatttcaggtttataatgacaaattttgattcaaaaaacaacaaaattaaacaaaaccagtaattagacacctaatttttaaaatcaaaaattttcgtctaaaaaaaataaatattttggagatgaatttttgaggacatttttatttaacaggggtatgtattcttaaaaaaaggaagtaaaacaatataaaaaaggataattgatgaaagaaaaaatgaacattttggttttgtaaaataatataaatttttacgtattcgaaaaaaatgttttaataattcaataattaaggacattttcagtttttatttataatcctattcgattttttcaaattgatggcttttaatatttattgtatttttcttattttacgaaattaaatccggcaaaatccgacaaaattttgacgaaatatttggcgacggatgggacaaaaatgaaagtgaagaaaatgtgataaaaattgaacaaaaagaactaaatgaaaactgggaatttactcattcttctgtccgtcaaaatagtgatgaaaatattgcaacagacccaaatgatcaacaaaaaaaagaaatgattcagaaatttgaagcaataaaagacaaattaagagaaaaagagaaatttcaaagaatatatcgaaataaaattgagaggaaaattggaaaattattaggcgcaaaatcgccatacgatattcaaatggaaaaataaattaaatttataaattgaaaatgaatttatatgcgcagaaaaagaaagaattcattgaccgatttgataatttaattgtttatatggccaaggcaaacaaaaagaatttgtgaagaaatttagtgaaattttataattttttaattaatttttattttaagcacaaaataaatgttccaatgatgacaaattgggaaagataaagcaatatttcgaaattaaagaagaaaatccaattagtgacaaactaattgctaagcaattggaaattggaagtcgctaaaaacctggagaaagaaatttgccttaattttgaattgatgattttttgaaagtgtaaaaatttggtttaaaaaaaataaaataaatgaattgtaatgaaaaaaataataatttaaaattactatattgaatatttattaagaatcaaatttaaaaaattttcataatatttaaattaatagaattttgagtggtaaaattaatgagaaaaaagaacgaaaatcttaacatgtaaattatactttgtattaattttaaaaaagatcaaaaaaatgtttaataattttataattaaggagattttcaatttttatttataatcctatccggacaaattaggacaatcaggacattttcgattatttcaaattgattttcaaaaattaaaagaaattttaaaaaaatatttgcgtaaaaa

SEQ ID NO: 21923 - DNA, 1827 bp, Heterodera glycines
aattggtaaaatagatgctgtgttcgtgatcagcgactacacaagccccttaacacttattttcattaatctctaaaacatatttataggcatttgaaaatgtatgttacatagaagtagcctgtaaactagaagagtaccaacaattggaaaagagacgaccaaatgcatacagtcaaaccataatttactaacgaaaatgtgtgagtgataaacgaatgaatgagaaaattgaaatgaaaagacaataatttgtgtgtttcgtccgctatttgaccggaacattgcgcagtgtcggcgcggtcaccagcgaagaagcgccgtcttcggcgtccactcgcagcggagtgcccttgaaaacgcactcgccagtgccagaaacaagcatatcctacaaaaaattttaaaatgaaatgctttgggttagaatttttaccaaagcaatttcttcccacacactctttttcaacactttgtccggctgacgagcaaaattgggacaaatgatcaaagagccgggaggggacgactgatcagacaattccaacggttcaacctgattagaccaaatatcacacaaaaaatggctgtctttttttcactttttgttcggtcgatgcgcacaaaatcatcgcatgcgaatcgatgccacgttttttcgacggtctcaaattgcaaaggcaaacgacgagccggttttgaagctgtacatccatttataaaacaaatgttatggaccatttcaatatcttgggattgcccaatgtttggcacctcttccaatccgacgaatttgacgagtccggcaatgactgtgcgcggctgcaactcgcccagctccacgtgggccacatacagtgagtccgcgttcgggtgcttccgaaccgcaaccacgcgaccgacacgaacatccaatcggccgaaatcgaccgatttttcaccaaaaaagcggaagaatttgtaaaaagggaagcaatgctcactcactctcttcgatggcatcggcacgtttcctaccgaaaagggatgcgccaacattgaaaaagcgaagattggtcgaaaaattggagcatgacggctaaaaggcaaatgtaattaaaacccaaatttggaccgaacgtttgccagacgacgggagagaagtgcaaaattggaagaccaaaacatcggaatgttgaaaagaatttttaattcactcacgttccaaaaataaatcaacatctcaattaatattaggagttttttttgtaacggagtaaaaaaagtatttttttaaaattaggaattttatgctcgaattgaaaaggaagaacacaaacaaagccaacaacaaaagaaaaacctaactaacagaatggaagaatgtcaaacaaaaattggatggtcgtcattggtcatcgattcgaaagcagaggcctttcactgcacaaatttgcctctttccatcattcgtaaacccacgcattctgcgcactttcccagtcgacgagttcttccggcttgaaccaatgggcaatttcacggtcggcagaaggcacctaaaaagcattcaattcttcgtcggctttaaggtcggagggactcaccgaatcggagccgtggcaaatgttacgtcccatctcaatgcaaaaattgccacgaatagtccctggggcactggccaacggattcgtagcgccgagcaaaacgcgaccctgtttaaccacatccaaacctaaaatgtgagattaaattcgtcggcaatcctttaaatcagacgaacaatctccaccctctattcgcattttcaatttttccatttgctggttctagtgcagaatacgcgtc

SEQ ID NO: 21924 - DNA, 2231 bp, Heterodera glycines
ttttttataatttacaaatgaataaagaaattaaaaaaagtaagtttgatgaagcattgattaatttttaaatataagaaatttaaaaaaaagataatgtttggtgaggcattgatcaattttttaaacataaagaaattaaaaatgatacttttggtgaagcattgatcaattttttaaaacattaattaaataaataaatttttataatattaagaaataaaatacatatgaaaagtaaagtaaaacagttaatttaaacattgtgggaagcattgctgaaaataataaatcaaataaaaaagtgaattattgaccgatagattttgtatatgttaaagatgcgaattaaaagaaaagcgaaatattgaaggaaagatgattagttggacttaaatgagtagaataaatacttatttaattgaatcaaattctccaattgaaataattcccaaacatattaattcatttgttcagattcccttgcttatttatcctctaattttccctctgagaatggccaacccttcggctgccattatatttgccctgttctcggctttttggtcaattatttttgaagcaacggtaatttattttttaataaaaaaattaatttttttttgccatgactttttctttaataaaaataaaaaataaaatttgctttaggctaggcctaggcttaggctttcttgggcttaggcgtaaacttaagcttaggctatgttttttaaatatgaattgctttgaacaagttgcctttgtataacattgtacgagttgccattaatccgaaaatataatccaatccaaattcgatacctaataaattctccctgattatttaaattttcagtgcaatgattccttttctgacacattcgcaacattcatcatttctcgtacggaagctgttgatgataatgccgctccaatggaaaatccttcctttgaacagcagcaaaatttggtggcattggacttgggaagagtgcgcgagttgcagcaaatgatcggacaaaatgccatcgatcacattgttgttgaggatggcattttctcaggcgtttactcatgccaatccaacattgagtttcaatttgatggactcagtctgggagatggcaaaatgcatcggatgctgttctcattcggagcaatattaagtgccgaaattgacggaccaaaacaaacggccagtgaaaatagcaactatttgcgttcacttttgaaggcttacgaatgcgtgggagggtcattaaaacaagacgaaggaaggtagtattgaaaaatttgcttagggttaattgttaggtcataaaagggcgtgttatttaataaatattatatatcgcaaaatatatgcattaaaaacttgcaaaatatctacacctatttttttgaaaatgtaccataaaaattaaaaaaaaaccaatttttaaatacttaaaacattattattctaaattctaagcctaattagcagggctgggaaatttaggcaagaaaaaatcacgaaataggtatttaaacaaaaaatgctcaaaatagttattaaatagttacaaaaaacccgaaataagtagaaaaataggtaaataaaaattttggcactacttaaaagcaggtaatttctgaaattttttgcactttttttttggtcgaattttttttttttaatttattttaataataatgaatattaaacattaacagcacaattatggcgagtaaaagtatattcacgaattttttttctcaaaaattttgcaaaacaaaagggtccccctttggttttttataaaattcaaaatttgtcactttttaattagcgtcaaatttcttttaaaaattatttatgcgtaccatatattaaaaaaacaaattctatattaaaataaatttaaaaaaaaaattcgaccaaaaaagtgcaaaaaatttcaaaaatttatttttaatattttcttagaagatattgacattttactaattaaaaaatttggaggataaattttttttaaaattttccaattcttaagggtatatattttttttaatttggtcgattcttaggggtatattttttgattttattgcatttttgttatgaattttttgaaaatccttaaaatagggaacaaaaatgcctatgtaagtaggtaaaaaataggtacctaggtaataggtagaaaaattcccaaataggtaagaataggtattataaaagt

SEQ ID NO: 21925 - DNA, 2011 bp, Heterodera glycines
gcactctttgccattggcactccccacgcccactccgccgtttttcggcctcattcccataaatcacttctcttccgcctcccctttttcaattgtggcatcaataaaatcgatgaattttttggttccgaaaactttttaaatgctttttattaaattgattttaaactctttaataattaatgtgttatttttaattattattaaacttaccatttttaattatttcgaatttcctttcgtcccctttttgagttttgtcatttgattacctttttcctttgctaaattcctcctccccataaagtcaatttccaaattagcactttttggtgtccttttgtcctccctttttctctttttgtgcttctcatttattcgcgtccattcgtttttttatttgcgctaatttccaaccgaatttcgcaaatggcccatttgcggccattctccgccgccaaaacggaagcgcaattagaaagagagcattgccaaaagtgggaggggggcggacggcatttggcttcacattggcccttggaattgccaatttggccaacaaaaacttggaatttttggcctttctttccttcactgtttccgctcccaaaaacggaatttcgcttccgttgagttttgccattttcgaattgttttgccattccttcaaaaatcccggcacttttgaaggtcgaattcggtcgatttgaactcgtaaagcgcgcgttgagccaaattcggccgagtttttattgtcctccgaatataaatggatgattgtgagcaattaagcttgcttttaagagaaatgaaatgaaagttcactttgaatttaattttttgtggtgtttctgatttttaacgttaaaatgttaatttattcttattattattttttactttaattttcattttacatatttataatttttaattacctaattaattaattcactcattaatttccccctctttatttcagtttcccttttcctcggcgtcctttcctttgggcgttcgttcgtttctttttcaccgttccgtctttctttcgtccgttgctccgttcttcattttgtcctccattatttttcatcacactttttgctggccattccttttggcacctccaacaattttggccatttatggtaataaaaattaaattaaaactgaatatgaagccattttcgtttgattttccaattgattgtccgtccattctccgatttggttcttgaaaatcgatttaaatccgataatcaaaagtgaatatcttaaacgctgagatttgaggccaatactctcgggcattctaaatatcctttgaaaatccaatccacaaatgctgctttactttcaaggcacgcttttcgatacccggacaaaccccaactaattagtcgtcatccttttgcttattaccccaactaattagtcgtcatcctttggcttactttcccttatcagatttatgccctccccatgtttaggtggatgtcacccccaattgactgtcggagagtgccgttttcgccgccaccgtcgtcgtcgccgttttgccgcttcctccgccaccgtctcagcctttgttccgctgccgtttttccgcgccctccgccgtcctttttccgttctttctgctgccataatcaccaacaaaatcgcctcttcctccgctgctattgtcccccgtttcgtcgtactccgccgtcaaaagccgacgattttccattgtttggcgcacctccaatccaatcgaataatcccccgctaattgttgccgctgagctcgccgagactgttcctcgttctgctgcggttgcgggtcgtccacaccgcgtcgagtctggctgggccatcgctgggcccacggccgccgaatgccgtgggtttttcttttggaagaaaatttaaaattggcccaaaattaaaattattaattaatttgccatttgtttgttcatcaatttataaattaaattggtataattaattactttaattaatg

SEQ ID NO: 21926 - DNA, 1697 bp, Heterodera glycines
  misc_feature (929)..(929): n is a, c, g, or t
ggaaaatggaggtgtagggggcccggagtagcacattaaaccaatttgtcaacttatttaccatttttatttattgttttagcatcgttaacaaattaaatcatgcgaagaaaatcatgtaagaaaaaaaaataataattcagaatttcccatcatctttgtattgtttcatcaatttgttctcaactttcgctcttcattttctctcaacttcattctctcaattattccccgctctgcgctcattcagtcgatgctgtgccatttgctgaagaacattgacgatttcggcgggtgtgttgaaaatgccatgctaaacaaaattaatcaaaaaatgaaaaaattaatttgttgtgacaaattacccgcgcgccctgttcccgaacaaagtcaaaaacggcatttagtccagggtcctggcgaatttgttgatcaaattgaatgactggctgaccattggtattgttactggagtcatcacgtggtgccattttgggtaaacaatagaatgggttggaaaatttttggaagaaaagtatggaacaaatgtagcaattacaatgaattccattttggaaaccttaaatattcacaaattgacctattttataagtgacaaacaatttaatttcggtcgaaacattgcgcgaaatcgtcaacaaattgcaaatttacaccttcataacaagtttgataaagtccaaatgcaaaacaaattatttcacttcatttgaataatttaataatatcaaaaactgtcatatgttgatcaatcaaaattccgatcctcccccccccatcagaaatttgaatttcccctcatctgtcatttttacaattaatcaaaaaatttcccgccctcatctgtcactttttatcagagatttgaattttccctcatctgtcactttatgaccaatcaaattccncctcccctcggctgtcactttatgaccaatcaaattccccctcccctcggctgtcactttttaaatcaatcaaattttatgtcaaaaaaaagtacatgaaaattttacacacccttctcataggtctaggtttccctaattaattgacaccacccatcccctacggctgaccaattagtgcccgttgaccgctgaccaattagcgcaccccccaattagtgactaattgacacccctcccccgccacctgtcacttctaattagcgtcaagcggcgacggaatggcaggggttactactataaaatatttttattatattttttgagttaaaaaaaattttaaactaataattatcctattaaattattaataattataataaatgaaaacaaaatttttaataaagcgaggaaagttagtccaaaaaattaaatgcatttttacaaggattaataaaaatgaataattaagcaacaaacaacattaataaagaatacaaaatttgaacaaagaaaaattttatacaaaacgcacaatgaaaaaatataaccgttgttttctctgtttttaaatgcagttttataagtaattaattttaaaaaataccatttatttcatacaatcaatcactaatttatttctaactttgatttaattaacgacaatgttttcaatggattacatacattgtttaaaagtttaacaatatatcaaggaatataataaataaatcaaagaaatacaacacattcaataaaaagataaaa

SEQ ID NO: 21927 - DNA, 1191 bp, Heterodera glycines
aaaggagaaggatgtgccaatgagtgatttgaagtgatttgagacgtgccacacctcgtgctgcgcctccttccagtgtaatttgatcagcgtattcttcgatgagctcggccccggactcggctcccgcccgtacattccgccgggcacgcaaaggccgccggggggcggcggaggcggcgcgccgccgccgttcattagcggagggggcgggggcggaatcggacctgccaaggtgggtggggatagttggtgacttggggtgccaatttcatcaggatgtactgacctggtggcggtgggggtggcggtgcgccgcccgcgcccgaaccgcccagcagaatgcctttgtcctgcgcaatctgagccatgcgggccaacacgagcgggtcctgctcgaactcgaggaattcggagaagtcgaagtcgttgatgatcatctgaagttttttatcaaattgttgcgaaatcaattagtgatggttttatcttttcctctcatggcttttcctccccattttcccttctcatggcttttccttcccttggctttttctccgcttcttttcctctcaccggtttgtctttgagccgttccgccgcctctttccatttggcctccgactcggaccccctctgttccgttagccctttgcgcagcgtcgacccgctctccattttcttcgcccttcgctgtaacatcgccgcgaatccgccgcctccgcctccgccgtcgtcgtcgtccgccaaaatcacctgaaagcgttttgacgtttaaaagtgatcggagaggggaataaacgcaacaacaaagtcactcgcccttttcggtttctcgggctccgccggcggtggcgtcggttcctttggcttctccggctcgggaaatgccatcgttttcttgtcgattggcgaagaaatgttcgttgggatggacgggggaggggccttcatcggtttgggcgtttcctgcaacggttgttcatcctccgcctgaatttaaagggggggggggggacggaaaaatatttataaaaaatcccgggggaggggaaagagtgaaatgttctaaatgaaattctctggcgttgacctcaattagcactaaaaggcgacatcagcatagctccctaatgaaaaaatatttcccccaatttcgattcggtgatttcatttgactgaccgttcgtt

SEQ ID NO: 21928 - DNA, 1324 bp, Heterodera glycines
  misc_feature (31)..(31): n is a, c, g, or t
  misc_feature (59)..(60): n is a, c, g, or t
  misc_feature (1317)..(1318): n is a, c, g, or t
tgcattcgcaagttcgagtccaattttttcnccatttattcttgactccacactttttnntctagagtcataaaagtcgggagataaaatgccacggttggcggggagttcgatgatggtaaatgtggaggtcgaggacggagaacaagcacaattcaaattcacagctgaggatttacctttcccaaagtgccattgtgtgggcaaagaaaatgccgactccgttcacttgattgaggacatttagccggtcaaattaatccaagcgaataaaatgagcaaatttcggcatttttaatctgcgagaagggcacaaattggcattatcagagaatgcagaaaaaagaatggcacataaaagacagcagaagcagtgccaaaatcattctgaaaaaatccaacggtcagagccaaatttattcatttcgttcccttatagccataattaattaattattttcccacaattatttaatatttctttcaattctaatttcttcttcttctccaccgtttggaccagcacatttctcattgtgaatgtgaaaatgatcaaattcattcacatgatgaaaatgcgctgatcttaaccgatggaatttcataattagtgtcttcattagctcggccactcgaatttggctctaaaagttcatttgccttttgaatttccattttttggcatttttaattgttccatcaaattaattcgtttggcaattattaattttgattctccttatccgtcgttttgatcagcgcatttctcattgtgaatgttaaaaatgattgtaaatgcgctgatttgaccgatggaattttgggccctaattacctaatttgaattttccttaatttggcaccagttgaaaacagtactttgagttcgcataaaagaaacaaaaaagggattactaatgattgcttcatcgaaatgataaaattcaaaaacaattcgacacgcgtcaaaaacattttcactacaaaataatgcctaatttgcatttcaaattccgagaattgtcacacgccgtttaaatgtttaataatgggcactccgtgccatcatttgtttgagcaatttgtgccatcatttttgtcactggcttaattctctcccgtgcgttaatctttgatgatacaaaattacatgccaccaaaacatcattcattcattatcttatcacagtcgccagagatgaagttgctgctgctcgctctacgcatgccgtgccgctctgttcgccgttgttcggctatttggaatagcctttgcgcgctcaatcttaatttgaatttgcttcctcgacctgcagnngcatgc

SEQ ID NO: 21929 - DNA, 2281 bp, Heterodera glycines
tttagctgttaatttttaaataaattaaatgttcccctttctttgcttaaagttcgctacttccatcctcgtgtgactgcgctaacgtcctcataaaacccagccatcatcgccacatggcccggcctggactcagttggcacatgactttccaaattgccccaggcagcctcaaaaattgatttttttttattaattaatttttttttgacaacttttccatcacgaataagcccatgcaaaaaaggagaaagatgcgggtgttggtagaatgttcttgctcgaagtccatcttgagaaagtttggctttcatttttaatttgttttttttaatttttattttcgctttaaatgtgtccaattctcaaagtttcatttgttttaaaattacctttaagtaaattttactggtaaatgtctcaaatttgtttgacctgccgagaaaaaaacgatgcgatcggcgggcgtaaaactctccgaatttttggcgattataaaaggccgcgccccgcgcacaattggagaagaaaaataaatgtcaaagacggcgtagagcaaaagcaaatggacggagaagccgacgaaacaaagcaaaagccgaaaaatggcaaagggagcgatggaacgcataaaaaaggcaatggaaaagccaaaaaaggcaatggcacagccaatcggtgaaagatggctgggatgatgaataaatattttatcagaattttaaacaaaatttactcgatattttatttttattttatagagaattaaaaaatattggatgagaaaacaaaagaaatattttcatttgcgttgtgttttctaagcttttaaaacgaaattcaaaaccccggcggcgccaagaaatgaaattaataatccctttaaaaaatgaattttttattataataataataataataataattaaaattggtacattttaagaacacgagcccggcttttctggacccggcagtacccggacccggtttttgctcaaatgcctagacccatgtaaccctattgaaatctctacgattcaactttttctcatttctattcaaacaaccaccattttttgttataaaacaaaagcttcttttttaattcaaaatttagaaaatcatattaaaataaacattcttggcattcttcttctctatctatgatatttctaaaaaagttatgacaaaaaattgcaaaaaaaaaaaaattttccctttaaaaaattcattttgattttaatgtttaattctttttcaaaaaatctttactgaataaaataaaatcatttaatgaatgtcgaatgtttgcctgatcacagttttgtgtcttcttttcatatgcaaatgcgtgggtgattggtctagtggtatgattctcgcttcgggtgcgagaggtcctgggttcaattcccagatcaccccagtttatttttacactcagaagagaatttgttgaaaaagtttaaaattttatgatatccatctttaattggtattttcatttaattttttgctgtttatttaatcgaaaggaaagtattttatttcatttaattaacaaattgttggatttctttaaaatgattaaacaattaaaaagcacagaacagagaatgcatttcgaaaatcactcattatttagacactgaacttcgccctccgttatttttgccaaccattcgcagtagatataaacgcaggagaagaagcctaaaataggaaaaggcaattcgaaaataaaaataaacacagtgagtaattaatgaatgctaatgggtaattaaaaattgattaaatcagttaattgattgttaattggctgccctcaccgttcgattcgcatacgaaattgcctcggctggtcactccgatctgttcccagcgctgaccgtcgtaacttttgaccaacaacggaccaccactgtcgccctgtgattcagaagggtaataacagttaagcagcttttcactgttaaatgtattcttacaaagcaaacattagctccgtcttcgccaaatgcgcaaacttccgactccataatgccgtcgcaacgcgcctcatcctttggccaaatcagcacattggcaccttgcagagtgaccggagaactccagtctaagcagaaatttaaataaatcctgcttttgttttgatttaccggtgatacgtccccatccggcaatgaatgccaggtcagtctttgtaaaattggacctccgggacaaagtgatcggatgagtggcattgtcggagaaatcaatcgaatcttcagct

SEQ ID NO: 21930 - DNA, 2732 bp, Heterodera glycines
tgagagagagaggatgggaaaggacagaatcaaaagcacaaaaatgggtcgaatggacaaattttgaacattttcgagtggaaaaatgccaaaggaatggcaagttggcattgtcaatttagcagatggcatcaatggacagagaactgggcaaaaaaaaccagcaactttttagctagtaattttacaccaaaattgtcaatttttagtttttaaaaaaataaatacaatgcaaaatagtgccacggcatggatgccaaaaaccggcaaatgctgagttttccagtcaatttcaggaaaggattaaaagtggcgtcttaacacagattttgatatctttttgcacctttttcttcgtagacacattgtccttgcgcacatccatcgggtcgacgacgcttttgaagttattccccgtgacgaacgaacgccgccgggggacggcggacagagcgaagagggaaagggcggcagcggaagaggaggggggaacaacaacaacaaatctgagggggaggaaaaggatggcaaaaacggcattttataggaggggggggggggagtcaatgacaaaaaagtcttttaatttgaaaaaattgaagcctaagccagccaaatttgtaagctaacgcaatgtttattttgtaaataaaaatttttgtcggaatgggcaataatttgtttgtttttttcaactgaccacaagttagcatcaccagagccccattaaattcgcaaaatgggtcaattaaaacagtaaatcgtgaaatcattagagttcggcctggacctggatccaggcctggatttttcctggatccaggtccaggtccaggtcatttttcggcaacctggattttcctggatttttgtccaggaaatcaaggtccaggtccaatgtgaaaaaaaatccaggtccaggtccaggcaaaacaggaaaaaacctggattttcctggacgaaattttagaatttattttttcaagtgaccgatgttttttcaagttttcaaaaacagattaaataaatttaaaaacacattattattattaattagatatttttagatgcttctagcaaataattgattttttcaagcatttgtttgctttttaaaacaaatttcaaaaaatccaggtccaggcctggatccaggtcccgaggagcctggatttttcctggacctggattttcctggatttttgtccaggaaatccaggtccaggtccaacatggaatccaggtccaggtccaggccatttttcaaaataccgagctctaataacgttaataatcactttttgtacgtccaccgctttgtggaaaagcgcgcgagggaatggcgacggaaacagcgaatagggcgcaaagctaaaggttcagactgatctaaaaagcatcgatcacaaaacaaccgcccgcgctgaatcagtccgttggccaacgcccattttttggcctcgtcaatttggcccatcactttgctgggcatcctcttctaataattttcatgcttttatcaatttaacaaatatttcatgttaaatattctcataattttttcgtgtccaatttacgaaaataaatttttaactttttttgaataagggaaaaacaaatcacccgcttcattgtttgtgctaccggaaggaatgtcctccaaattttttgtaccttctgccaacggcggaaggaaaacgaatcgcaaacaaaaataaaatattcattgtctaaactaaagtggttgaaaatagtggtatttaaaaatggatgaaaactaataaattatataattaatgaaatcattgtttatatacatacaaaataaaaataatatggttgtttgatcatttaaatcaagataaaatctggagaaagactacggcttacaaattagcttagctacctggctttaagaaaagaatagattaaattatttattgctccaacaataattttgccctgtcatcccttctttccagtgtatttttaggttcggttgggcccggaacaaaaccgggtcaagtccaggtctggaaagagccgttgctggacccggtcgaaaaaggtaaatgacatgccgagtctcgaacccacggcatttaaacattaggatgatctaaccgacttaattgggtccggcgtcccgtcattttgggaaaccgagtaaaacgggcggcgtttttttgggaaaaatataaataaatcttattttaatgataattatgagtgaattgcgtggtgtcttttaaactttatataaatacttgtttatatatcagttggcatatttatttgccaacattattattttaaaaaccgaattgaaaatataaaaatttaaaaaatgcaaacgaaaattgaccattccttttagagattttaaaaattaattatttaaaaattttgtatcaatggtttattttttacaaatttgcaatggaattctgttaattttcgcaagagtttctcaaatgttgttttcttgaaaattttccaattttgagaagacaaaatagccggacatttcaatgcgcaagaaaatggccgaagaaaaccgtcttatggaaaagcaagtcaaagtaaaagatagttttaaataatgccaaaatatttattcatttaatattttaaaatcaaaattttattcatattaacgggggggggggggcggaaggacaggaaaactgaagaaggagaagcagcgaaagagactggggaaaataagagaa

SEQ ID NO: 21931 - DNA, 1439 bp, Heterodera glycines
cgctgctgctccggaaagtgtccgcatattgtcccacctgttcccaccacacattatgcagggtgcacccgtcatagcaatgaatgccgtccgccccgttttggccaatgatcaaatttttgatcactgcattcttttcggcacggatcagtgctttttggccctccgactgatcaccggtgcccaatgccgaagaggcggtcaaccgtttgaagccaaaatctttgacgcctcctgacactttaattgttgccttaacagtttcttcactagtcgcttttggccattgttgcccaaaagcatttgttgccaaattggcaaaaagaatggtcagtacaagaaaggaatgcattgatgaattaatttttattcaatttattaattgatgttattttagtgtgaaaatgtctaaaaagttaatcgcttttaaacaaatttttttttgcacttaggcggaccaaattttgttgaaatttcaaatttgtttagctgctctttctttagccaaccattaaattgatgccaatttatatcgattcaaattatttaaaatttattttaaataattttgttgcacttgacagttgactaaactaaacttttgtttcgagttgacggaaaaccaaaaaatttaaacaaaaatttgtttagctgaaatatttttgtcatttggccaatttcttttgttaatttggccgagataaattttcatcaattaaatttgtttgcttctcattattgggctcagacgccacctttagtagtttggtcgttttcattaaatttaattgactttttgaatgatcactcgggaaataaaagctaaacagataaaattaaaaaattctatccataattataagctaaaagaaagcgtgctgacaaaggaaggtccccaggtgtccgtgggatttccaaatgaaatttggtgggtggatagagcacccatgggtattttatttttgcttttttatacaaaagtcaattataaaaaattttttataaaacacatcttttattttttattttatttcattaacaaaaaatttattaaagataataatgtaataaatatcttttcagttcataaaatctaatttttgtctaatactttttgagtaacttatgtgtcaaaatgggttaaaaataagaattttagatcaaaacattttttggataattgactttggtataaaaagcaaaaaaaaaaaaatgaatttgcatgtaggggattccgaacctagggtttaaaaatcaatgacaagcgcactaccgctacaccactggacactcgattggtgcaaataaatgtttaatttgtttattcattaaaaaagtttggcacgtcataattaggcactcagactcattttgcagaaaataaaaacatttttaaactctcaaatgaataaaatcaattaataaagaattattttaaa

SEQ ID NO: 21932 - DNA, 1719 bp, Heterodera glycines
ggtttttatacaataactttgtttatgttccaacaaaccctgtctttttggtatcattcgaaaatacaaagtctaaataatgtaataatacgagaaaacaagaaaattctaacatttcaataaagttacaaacgaaaataatcaccaagtgtttaattaatcaaatcttttttggtaattgtctaaacactgcaattttatatattttagcttcgttagactgtactttcgaatgataccaaaaaaatacggtttgttcgaacatgaacaaagttattgtataaaaacccgggattgtcaattgattggacgcataaaaaaccattggacgcataaaagtccattggacgcataaactgtactagagccgattttattctcagccttttaaaataaataaaatagtcccgttttctatcaccacaaattatttcttttattcattttatcaattttaggaggattttgacagttgttttgaaggtgatcgatggtcttgcgtttcgttttggcttccttttgtttaaccgttcttttttccccaaggctcaaaagttatcctgctcattcggtgtgcttgtgaaactcttttacgagaaatttccccatccgatgttggtggattattcaaatagaaatattttcgtgagcaggtgaggagtaaaattcacgcacattcgcgtaaagaaaatctgtttcatcagtggagcgaatactagggatcacaaactgttcagcaaggaggattcacgatcattcaccgccatcttagagttccacgagaaaaccttaaaacagggcattgagttgcccaagatgtgagagtttgtttactaattccaactttagtgattcaaaacatcttcagattcaaagacagagtcagtggtccttctgaagccccaaaagtgctcgttgagttggctaaaaagtataatgtgaagggtgggcattggattatgttcttcaacaaattggccacccacaaatgggaaaaagtcttcgacgaattgctctccggtcagtgatttctttaaatgcacagattagtttttaattttcagaagcattgaaacactgggggattctgaacagattcaacgcaaggatttcgtcggataatttaatcatttgttttgtcagttttccgattactgtacgatgcctcgtgattcatttccattttagggcaatgaaaaaacactggccgcgtcggatcccacgattttggactcatcggaccaactccaacggaacaatgtgaagaatgacccgggaccatacactgttctgcgaatcattgacgaaatttataaaccaaacagtaatttttcactttattcgtccattattctaaattattaagcatttggcaacatgggcgtcaaatgtattgtttgattttttttcctttatttctttttcattttagacaaattggacattgtcaggttaattttctcaaattttatactgatttattttttttctcagcgcctgttgcatccaacgggacaatttcattcggccaacaggtcaaatttgggagaattcctcaaattaatagttggtcgaaccctcgaataagatcgccattttcagtttaccaggctaactacggcgaatactctcaacgctttgtcccgtcgaatttgcctttgtcacgcggcggcgcattggagggaatgccaatgccaacggggcgtgtgccggggacaa

SEQ ID NO: 21933 - DNA, 2374 bp, Heterodera glycines
agtgcaaagaaggccgtaagccgtgtgttttctcgaacccttcaccgtccttcctcttcatgcccttcttccacgacaatcgtttggccaagttcgtcgtgcacgctgagtgtgtagatttggtgcgacatacccacgattttgtacgagttcaggcgcaggtatgcttccatggccgtcatgtagcgcactttgaaggtggctgcaatctcgtcgtagtcgtacacttcgtccgcacccgcagtttcgttgcttctgccctgttgcgccgatcttcgtggctgtgcgacacggacataggccttttcaaaccctgaatgttctggaattattgaaaaacccaaaattaataaaataacaaccttttaacaggtatttgaagatatacttgcaggccttctgtccgaacacgtactccacattgatgtggcatccgtatttgagcagaagaaacgggttgtatggaatgactcggctgtcgtccatcagaattgcgctccggaccccccttttcttcttgtaatgcgtctggccttgttcgcccttaataattatattttgaattgacaatataagaaaaattagtacatgctgcctcgccggaactcttccttggtgaggaaagcgctggtaccgcacttcggcccagtctcgttccgggtcagcagctgggtcgtgatggtcgtcgtcatgttggttgtcctggccaccggctcttccaaaaaacgtgtcactttcgtcggggggtatgcgcacataattcgtgtaacggacctctttaaatttttacaaaatatttatcagatatatatgacaacatgatttacccgatagttcagtccggtcagagtacggcttgggaaaatgcttgcggcatcgcgagccttccagacatgccgcgttgcagtcgtgcaacatcattgaagtgacgtagtgccagaggcgacgctgctgatgtccttcgggcgattgatccgatgacggtggaagcgtcgggatgcgcgcggaaacatattcgtccacctgctgtgcagtttcgatgcggaccccccgttcaaggatcagaagcatgtggatgtgtggcatgccttaacaattttataatttaattatgctattaattttaatgaattaccgcgcttttgatgttccacactgtagcaccaaccggcaactttgccgagcacaccacgctccgtcacatccctgatgaattctgccgccttatccatgaagattcggcacacaatgtcgggccggtgagcatagttttgacgcacccgcaatgcttcgtcgatctctggccatttcgggtttccagtaaatgtcacaaaccttaacatttattataatactcataaatcattacaattaatttgtgactcttttaccaagtcggagcccccaggtgtcgaaccatcgtcatcaagtcggcgtacttcccttggtaatactgccgcgacccggcgaaggtctgtggcatgaggaaaacacggccgagcttggcatttggtccttgctgtcggacccccttctccatggcggcgatatattcacgggctagaagctgccggtagttcttcttcacttgaatggctttcaagtggttgagctcgttccgctcgatccggttgagcacagagatggtgaagtactcggcaagtcgtcgagcgaaccacaaccaatggaaggtgttcttgccggacccccgaagtgccatgcggtagcggtagaactgtcgctcagagatgttggtccggcctccacgagtctccacttcatggtcaaagatgacgtcctcattttcattgcgtccgggatttggctgtgcagtagacgtacccaccgcatccatttcagggtcctcctgttcctcgacaacatcgttgtccaatgccagttcgagctccggcatttcgtcaatttcctcatcattctgctgtgtacccacaatgtcatcgattggaacttcgtcgcccaattcgtcgtcggaaatttggtccaaatccggttcctcttgttgctgcatttcatgatgggcgttctttagaattttaatcatttttgattttgttaggctttctcgttataacctcggacccacgcttcttcataaaccaccgccatccaagtgtgccaagtgggtggagtagtgggaagcagcacgggtcgatttgcggcatgccactcttcagctcgcgcatcttcccggctttgtcggacacccagaacgcttaattattttatgatgagactgtttttggatcgtttgttattaccgctgatctgaggtggtagcccatcctcttctacccaaattacagccacttgtttgacagtcggtgcatccgctcgttcaataacagtaatatca

SEQ ID NO: 21934 - DNA, 2178 bp, Heterodera glycines
  misc_feature (917)..(917): n is a, c, g, or t
gggtggcttttcactggggcgggggatggtgggggtcagagtcgcgggggcggggacgggggcacgataattccgcccccgcgggggcgggggcggggtttgatttgaattaactccaaaaaattttacaaaaaattaattttttatgaatgatgtgatggctccacattcctttagtcaatgtatcgcctcaattcaattccttttggcataaattacacagattttgtctaaagaattaccaaattttagagatttttggctaattttttaagaaaaaataggttttttgggggggggggcggtgccgataggccgcccggcgaattttgaaatttaagctcgatttctaacagacgtttacaaaaaaataagatttttacgataaatttttcattttttaatcatattaaattatcatcgatttactcaagcaaaatcggaactcagatttgtaacatattttcttcgaggcacatttttccaaaaaaaaaaaaaaacttcggtgaacgtgcgagcgtagaggtccggcggtgcagataggcgccgccgggaacgttaatagattttcgtccaaaaaatcgataggtttttcgcaatttttagagaaattttttttaataagatttacgaatttttgggccccgcgacgccgataggcagcgccaggcgaattttaaaattaaaaaagaaaaccgtcaacctgaatcgaactcacgacagaaaagtaacgtcaaggttgatttcactaaaccactaacaccacactaacatattcaacgaccaataataaaattaactttaatttcataaaaaatttggtcaaaaagggttaaaaaaaaatcaaaatcggtataaattttttcgccttttcttccatcgaaaacctcattttttaagggggtggtattttcaanccccggccccccgcgggggggtgaaaaagtctcgcgggggcgcagaatttttggcgggttttcaagagtcacgggggggcgggagaacggggggtgaggcccaaaaaacctgtcccgcccccggcgggggcgggggtgacgggggcggggtccgaaccctaatattaactaataaattagttaaaacattaccacaaataaaatatgagcgaatatttactaaataataagacgacaatgaataagcgtttactaaacaattggactacaagagaaaagagaaaattatagattatattgtgatagcgagaaaatgactccgtcacaattgaaacataattaaattaaatcaatctcagcagtaatattttgcattattttttataataatcattttactagagcagaaatatattgaatgaatgaagttatttgactctagcaagtcaaaaaataatacaaataaaatttcattcaaatttgaaaaaaatcataaaaattttactcatattctatgcaaaccgaaaaaaaagaatacatacaatagtttttcttaattctacataaaatctatattttttgcttaaaatcaaaaattacaattttaaaatgaatttctaattgaaaggaaaattttctttgttaaaaaatgttttattttgaagctaataataaacacatattaaacagtaacaaaattaaacttaatgatttaaatgaagaaaataaaatagcatttatatactatgcaaattaaaagggaattaattattataaattcaaataaaaacaaactgaatacgaacaaaaaatttttgttatttatttcgtaaaaaaaagagtcaatatcaataagataaataagagaataatgtaaacctaaaaattttattcgaaaataatgataaacaatttgctaattaataaaataaattatttattcaacaattgaaatagaaaatacagcagaagcactggaaaattaaaaacaaatttattgtatgaagttgaatgtgaagtaaactaaatgcgctaattttgataagtaatacaaaaacacgaaaagagatgtgcggttatgagcaggtaaatgatagaatttgcagtaaatcaaataacactaaaaaacaacttaaagaaataaaatatataaatgaaatttttattattaaataataaatagatctatttcttaattgtaaatatatttttagattgaaaaaatagtaaaaattctaatgcaaattataaaactgaaaat

SEQ ID NO: 21935 - DNA, 950 bp, Heterodera glycines
acccgacttattaactaatttttaacatatggcgtaaaggcctttgaaagcccaattatatttggcggtttaacgaggcaaccctcccaaacaatctgagaattcccttaaattgaaaaaaacaattgcccacttcaaagcgaacccctcctcttcagttggctcagagccaacggaattgtctaagtccgtgtcgaacaaagggaagacattggccattgaattgtcagcgaagggttggcaattagccagcaaaaaatggtcgtattccgattcagaaaagcgcaatgtctcctccaaaaggcgtgaaatttgcaagtaaaaggacgaatgattcatttgtagcgaagaagaagagcagggaagaaatatgggcaaatcctggccaaaatatcaactttttaccgttgctattaattaaatgtgtttgccctgtgcttctctctctttctctcacctccttcgtttgttgtacgtcgttttcccgactttccccctcattctcttctgtcactttttgtgccgccgtttcaaaatcgccgaagtcatcgctgtcactttcgctttcgtctaaaaagtgaaatttcattaggtttttaccaaatatattttaatgaaataacctttttcgcttttgtttttgtatgacagcagtgaaactgaacggatggagccgtggtcaacagtttgatcagcgaaagtgtcagtgttagtgttatttgacgttgaagcgatcattcctttgatcatttggcaatcatgaagaatgggggtcccatatttttcaaaaaaaagttttaaaaagatgtaaaacaactttttatgaggttttcaggggcgctaatcacgaatatgatatttatttcaaacccggacccgaactcgaacaaaagtcgaaaactcgtttttcacaaaaaatccaacttttgtctaaaccggttcaaatgcat

SEQ ID NO: 21936 - DNA, 912 bp, Heterodera glycines
  misc_feature (15)..(16): n is a, c, g, or t
  misc_feature (55)..(55): n is a, c, g, or t
ttttaaatcgtgtcnnggttcttctggcaatcagtccaaacttgtttttcacttnaaaaatgagttcccgagaaaaatggcaccttacactcaagttctttattttaactcaaacgtaacttataaaaataataataaaatccaagtgattttccactgttttagattatatacgtttgcgcggaagaaaagtccgatttatccgtgttcagaattttttcgttggatggaacaaatgaacatgaacatattattgacgggaaagttcaaagtgtggcgatcagtcagaatggcgacttgtacatgacgaaacagccgacccacgggacggaagagtccgccatttggaggtaattgcgtgggttttgttttcactgttctattactcttaattcagatcacacatcgatcatccaatagtctaagaatttgcaaatattatataataaaaacattggtttttaggcatgggaggaattttgctcgacattcgacgaatgtttccaatcactttgtgtttacggtaagcttattcttctcataataattcacacatttttaacattccttttgtttgctactaattaagaaaatttaattaaatgaataaaattctattaaatttgctttttgttagataatgaaacccttgcagtcgccgttgtttcatcgcctgttaatttatattcaaagtgcatcgaataacttcatccttttttatattaattttccagacagtgcattaaatgggttgctacaaaagactgtcgaatcattgggtcattttccgctgccggcaaagacaatgggcaaatatttttcccgcgatgtttgcaaaagtttttcctgaaaaccttaatctgacaaaaagttcttttataggcatggtgactcattgctcatttggacaaa

SEQ ID NO: 21937 - DNA, 1385 bp, Heterodera glycines
gcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatga

SEQ ID NO: 21938 - DNA, 2470 bp, Heterodera glycines
aataatttgatcatcagtctcgctcctggagatgcaacatcatcaccagcagcagcaaagaagcaaattatttgcccattttggccccccgggggaaaaaggccttgagaatggcgcgaaagaccttggggcatagcagcagcagcagggggcataggccagaggagcaaagaccgatcagagaatctgatcagcgccgcgcatcagtggcgagcgacagggcggaaacaccggggggggggggggcgatgatcaaccccgacgacgacgagtgagagaattgaattatgtgaattttgtggtccaaattttggaggggggggggccgattttttttttgagggggatgggggggttaggtgggagaagagcacgttttgtagtaataacggagtggggataggggggatggtgacgaaggcaacagcaaaaaaaaaagaaaagggggggggaagaacaccatcatctcattagcagcagcagcagcagcgggacttaatgagtgttgaatggaggacaaaaattgaaaaatttggggccatttataattggccgaagggaatttgcaaaaaaaaagggactaatgagagggaaatcgggggaaaaaaaattgcgaaaaacattcatgaattgaaatgcgcgatgacataagagaaggactgggtaaaaaagaaattttgggttaatgagtcgagaatgtgggctagaaaacccgagaatttttgaattaagctccgataattgaaagaattttcggcaaaaaataatttgctaaaataatagcaacattagcgggtgttaaatggaaaattgaacaatttggggccattttaattggccgaagtgaatttgcaaaaaaaaagggactaatgagaggaaaatcataaaaaatcgaaaatttcgcgatgacataagaggagactgggtaaaaagaaaataatttatttgcgcttgagatttattggttcatgagccgtaaatggggctagaaaataagaaaatttttgaattaagggagaaaaaattaatgcgatttcccgagattttaaagaattttcggcaaaaatcttacgtcagggtcaggtaaattcagttccacatccaagatcgggttaaaaagccatagaaattttacaaaaacaaaaatttccttttgttcatgaatgggttcgaaaatatatttaatgagccagtgctgagaatgagaatgaaaaattcataattttttatcattaaatttaaaaagcggagaatttctcgagattaaaacccaataaaccggacaaaaaatttgaaaattctcagattcaattaaagacaaaaaaattttaaaaaattccgggaaagttttattcatcgaagcatcgcagcattaggaagaagcacatatttatttttacagcaaaataaaaaacggctatttttgaattattgggataaaggggagacggggcgaaagattgacagagattggggggggggggacattttagttaattgttcgtcgggcggtcattaaatccgtaaatcctttgccggcggacggcgtccaaaatcctcccaaaaattaatggattcggtggccttcggcggcgggggcaccaaaaatgtgtgatttggggcattggcccccgctcggtcggacggacggacggacggacatcctccaattggtcagccgccggcgggcggccgttgctgccagccgccgccgccgctgggtgggccaaatcagctggcactaaccgagcattccgccgccggcgatcagttcgaccacttgctgatccatccatccggggcctggccgtttgagtcccatctcgtctttttgccccaggcgccgcacatttgtgagagattatgaatgaggagggttcggaaaaaatggatataaaatcactaaatatggacataaaatagagactaaaaattctaaacatggccataaaattgcacaaaaattatggggataaaattttagcatgacgactcaaaaaactgagaattttattgctcggtgattagataatgaaaatttattacaattattgtttgattccccgaataggaagtttttttaaatactcgttggcctcacttaaaaatgtcggcatggaaaaaattttgccgcgaagaatggaaaaaaacgggaattttccgtttcttgttcataaaatttacggttcgattggaacccgaatccaacattcattttgggcaatttcgaatctcggacccgaatttggacaaaaagcgaaaataaaaattttcaaattatgtattacctttgttcctaaattgatcaaaaaaagttaaatttagcggaacccgtcagttgggccctcacggttgggccatagagcatgtttttccactatagtttttttcttttgcatccaaatccaacaatcttggtatcattcgaaagctcttaacattctctattaggcttagaaaaagccaaaag

SEQ ID NO: 21939 - DNA, 1030 bp, Heterodera glycines
tctagagtcattttttaattggctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggatagcttcctatagcctgtactttaattctgcgttggattttgctcccataaatgtttgagtacccaaacggacacttgaaaaatcgatttttttggtttcgggcagtcccc

SEQ ID NO: 21940 - DNA, 2209 bp, Heterodera glycines
cgttagtttcatttgactgtttgttctatggaaatcttttgttttatgtttcagtacgcaacaaattctttttcattaaatttaaatttgtagccaaaattatcttttgaaaatttaaaaaaatttatttttagccaaactaatttttcgttttcttttttgtttgtctttccatttttaatttatttccaaacaggggtccgtcctacggcgtttcctaaatccaccagcagcaagggggggggggggcgctgaaaatgaaaaaattaataatccactttatttatcaaccaaatttaaatattaatagtattcgctaataagttgactccaaaaattgtttattgtattaaaaaaagttttattttaaatattttacaatttattttaaatttcttttaagtttttattacagttttgtttgaaatttatgactttatcagctttttagagaatatacatatatatttttaatttgtttgttttcgaccaaaaacattatgataattttatgaattttgtttccataattataccaaacattttaaatttcaaatgcttttttttgtcttctttaaaatccgaatttatcagcttttgccagctctcctcccactcccaaattttggttcatcaaattatgacaaaattagagttttacaaatatttattttaaaatcggattgtgtcggcggtgaaacaaattcatctgctgctttccctcctccactttcttctctctcatttccgcaaccaacaaaaagccgcccccaccttcagatgcttcatcttctgctctgatggtcgccctcccattttatgttcaattttaggtcgtatttatttatttttttgctcatttttttcttaaaattccccctcatttatttgtatttgacggaatgccacaatgtttttggcgaaaataaaaaattggaagcggaaaaagcataaaagaacaaagaaagtgaggggcataacaaattatgtgtttcggctacttctaatagctttacattggaacgtcataattgtcacttttgaataaaagtaatatttttaaatgatttaaaaaataataaaatttggccacctaataattaaatttctgttcgattaattttaccattttcatcaataaagaagacatattaacacaataaaacggaaacatttttaaatggcattgttataaagcaaatagccgattattatttattcaaaagcgttcctaaggaaatttagcagcatttaaattcaatgaaaaatttaatgtatataaattattttagctggcacacctgttgctgatgaatagggaccgaattttgaagcatttgcttaattttttgctagctttgggcgagctaagaagcattaaaaactcatttctaaacggttttgggctttttacatttagagaaaaatttaaaaacttttattttatttagaaagaaatttcggcttttttatttgattctcatcaaaaaagacaataaaatgcaaaattttatgcttatttcttgattttatgtacttaattcgctatttttgagcttatttcgtgcttaattcattaaggagtttttgttgcttaattaaatgtttaattatcttttttttgcttaaaagtccgatccctactaatgaatgccaaatgataattaaatgacaacctttgcacataatcactaattttttccaaatgttgtattactatttaaggctctaatttatgagatgttcccttcaaaataataatttttctacaattttcccattatattaattttttcgagcgattacgtaaattttaatttgattattaaatttttaataaatcatttatgattcaaactacgaaccaaaaatttgtagtttcttttcttttcgcagcgtcattttccattttaagaattgagcaaataaatgaacgcaccacagagaattttaattgaccttggaaattgtaattaatatagagagaatctttgatttggctgggggttagggatggcaccaccgccactctttgcctgagaggcggataattaggtaattaatttgatgaccaaaaatttaaatgaccgatagactgctgattactgtaagtgataataaaatatgtgattctgaactgcaataggcttcgctgttttttcttaatgttttagtaaaaaatttttcctttttgaagcttttgcaaatt

SEQ ID NO: 21941 - DNA, 1648 bp, Heterodera glycines
atttagtccaaaaatgattaattgtttgaaatagagtcgatcgggactggtcccggtcaaaaccgggacctcggtactcagttgtactcagttgtccgtgttttggtcccggtcccgctctactctagtttgaaataattgaagaaaatttgtttgaaaattttcattaatttaatttattaaataaaaaaccaaataattttgtattattttcacttaatataaattaaaatttgaattttttttaaatttttaaaaattttttgaatttttaaaatttcccggttggtcccggttcccggtttttcttgcggtcccggtcccggtcccgaaaaaaaatcgaggtcccggtcccggtcccggcttctcaggtcccggcaagtcccggtcccggttttggcaaaaattcccggtcccgtggcactctaatttctagtgaacgataacgacatcagaatcgaaaatttttaatgcagaaatgcgttttttgagctcctttcttcaaaacaatttagcagaaaatttagttaaaacctaaaaatcacagccctagtgatgagtcgttatattaaaatcacgattcggccccagcatgttttttcaatataataacttttttcattgtcaacaaaatccaacattgttggtatcattcgaaagcgtaatctgtttagaatgggtttgaccttggctaaaaactagagatcggaccggtggcttttaaaatcagttggccattttttaacaaaattcattaaaatttcttaaaattttccccctgcggcgcctatcggcaccgccggccccaatgttatggttagagctcgcaaagaaaggcaccaaaaagtgcgaaaaggcactaaaataggcagaaaaaaattgaaaaaggcatgaaaaggcacaaaaatcccgaaaaaggcattaaaaaatttttttattaaggatttttagggagcaaaacacgaaaaacttaaacaaaaaacttgattttggtcatttaaatgaatattaatattttatagtttttcaataaggaaatttttaaacctaaaattttttatcaagaaaaaaaatgaaattttgtgtaacaacttttgagaaaatttttcaattcttaatggtatattttctgaaatttttttagatcatttcttagggtttattttcccgattttattgaatttaattgaatttttcggaaaaaaacgctaaaaaggcaccaattcgctaaaactaatctttggggttttttgaatgaaggcaacacacgttttttggctgcctttttcgatcattttcccaacctatagtacaccgttcaatagaggtttcaatagccctacaattttactcagaagagattttcgtttttttctattaatagaaatagtttattacttttttggaaaaaataaacaaattcaaaaaaatcgaaataacccgaaaatttttcttcagttttttcgggttttaaccgaaaccgttcgaccgaccctcttttccggtctctactaaaactcatattgactgtacaacaaacaaatttataaatagaggattttatagcatgtagtttaaatggctctattccagtttatgcgtccaatgagtgaccaccctcacttttttaggtcataacttttttctt

SEQ ID NO: 21942 - DNA, 2161 bp, Heterodera glycines
tgtcggattgtccctgtcggattgtccacttctgtcggattgtccacttctgtcggattgtcctcactgtcggattgtccaactgtcggattgtccactgtcggattgtccactgtcggattgtccagtcacgctctcatttaattgcatttttactcgatttggttacgaaacagcgcgacagcctcctctcttttcttgttagatgcattaagggccaattctcgtagcctaatcgccctcatttcgtcttgcaaattttgcatgtcagcaatgctattttcttttcttttctgagcaactggcatagctactattggtctgctgctccttgtggccaattcttcgccaatggcaccgccgtccctccattttgacaattctcgatcggtcatcatcgttctcgattttgaaaagcttctcctccctgatgattgtcgtgtatcgctcgtcattgtcaataatcttgacaactcttgggcttcgatcatccctcctgatcgtctgctacttttttggcgccttaattttcgtaagctctctatcgcagttgaactgcttgttcttgccgcatgagagtctttcgattcatcctccacatagttgcttttccttggagcttctctctgtttctgcttttcttttgcgtgacttttccttggtcgatgctctcgcaaactctcttccttagaataccgactctttcttggcttttcatatttcatttgctcatcaaagttgcttctccttgctgatgatcttcgatggtttctttgtccactgctctcctcacgaatttgcctgcttttgcttcttgcttcgtatttttctagtgcaagcatttcactcattgagttgctttttcttgctggttgttgctcgtactgttccggctcttcgtaagcgcttttatccatgctttgcttttgctgcttttcttccaatggcacaattttacttgaagtgctttcacgtggttgctgctgcttcggttcgcgtacttttttctcacgctctcggtccggtttttcttcagccaaatttcttctaacattttcccatgggaattttgttcctattgtcagctgcttgtcctccccattattttgtgaaagagttctggcaacattggtgttaacgcatttcgatgtactattgctagcgttagtccgagttttgattctaaaaatttatttgtttaaattttttaaatttaattttacgtctcattccgttttgaatcggtaactggtggtgtttgttgcacttctgaggaagaagtggcttgaaacgggttttcaatagcatctacatatttgccaagctttttcttcatttgatgagtagccaggtctaatttcatcttacgctcaacttcatcatccgtgcttgcgactgaacgagtacttgcagatgaaatgcggtttggacaaagtgccaatattacaaataataagatgttgccatcaaagaacattttcatttgaatttctgatacgattttaaatttcaaatgattttacaaaaattaatttatgttttaccagtgtaatattaatgtttatatttattactaatataaaaaatatttaatatttaataatgaatgtaaattttataaaattataagaaattgagatagataaatatatataattattgatttattatttgacgatgcagatttaaaataagaaacaatagaaagaaattttataacttattgacagaaaaaaatgataaaattattactgaattataaaattaaatttttattttagcataaaatattatagtttttgtaaaaaagttttcattagtattcatacacctagttttatatggggacttctaatgtataattttattaaattatattatgttttgaaaataacatcattttcttgggaaatttatttatgctcgaataaatgattgaaaatttacggcattattaattacgcctgaaagttcatcttttaaaatttgccattttttgcatttttaagttattatatttgaatcttggcaatatttaaatttaaaaaccaaattctgataaacttaacctgactgaccttaagtaaatttaaattttgaatcgcggttatgattcacgggatagctttaagggttttccgtgataaatttaccctgtaat

SEQ ID NO: 21943 - DNA, 2027 bp, Heterodera glycines
ttaaaacaatgtttgttctccatacagatttgctttacgattggcaaaagtgccaaataaattaataaattaattttaggctaaaaattaattaaaaagtcaaaaaaacagactgttgatttttatacttttcggttgatcatttgttttaccattttaaattcaatttatcaaaaaaatcggtcgtatcgctggtgatccttcatctaatcaatttgttaaaatattttttattaagcaaatttttttaaataattttcaaacacaaaaaatatttaggtaactctaaataaaaatatatttttatatttaaataaatcgcaatcaaaatatttaataaatttattatacaattctcgcgcattaattctgaccgcttctttcagttgcttcaaccaggcacaatgatgaccaagaaaagttcggggggattttatttatttttggggagagaagtcaaaaaaggagaagtggtttgatcaaaagaccaattttttcttttagacgcattcatttattcaattcttattaatttttaaaagccaatctccattaataataaaatttaataacagtgaaaacatgaagattctcttgaaaactgttaaatattttttatgtgtttttctcattacacaaaaatccatttttaatgaaatcatttttttgtttttaaatatttattttaattttcaaatattaattaagcctttcctaaataccaacaaatttgctaaattcgtaaagaaatggagaaacaacaacaacagcagcagccaaaaagtgatgaaaaggagaaaagtgatcagaagcagaaaaaatcgctgtagtactgccgcgcgtcgtgcggaagggaaacggtgggaaattttagtaatggtatcattttggcattttctaagacaaatttattcttaaattgggttgacggtgattgatgatggtgggatatcgaatgagaatggcatcaaaatccggactttttctctctgattattaaaatattaatctccaaaaccgaacgttgtcaacaaatggtgtcgcagatttttttgaaattttgtatgattttcgttatctattaaatatctattctcggtctttttctcgactctcaagttccttggtattggttctgaagtttctaaagattttggcgcactggcattgctaatagagtcttaaatattcaaaatttaaaatttatttgttttcaattttcgcgcaaagaaaagacataaaacacaattttgcccaaaatttaataaaataattaatgtttttctttttttcgtaggttttaccgcaaattaaccgacagaatttaaaatttgaatattcaaacgccttttagtattgctttaattgacattattcgtttttgtttaaataatgctttttccattattaataggcttaggcttttcgaagtaaaaccacttaatatattcagaagtatacacaaatgttttaaattattgcgatttcatttctgcgaattcgcgctacgaaggaggctgtaatatggcacgcaattcaaattgtggcgttttaaaagcgcgggaaaatttaacggtcggagacggtgcacttgaaataagtgatgaatctgatgaacgctgagatttattaatgaatccattcgagtcaataagaaaaaataacattctaatttataaatattaaaaaaacaatttatataaagcttaaactatcaacatgaaagtattgtttaaaaaattaagaaattttctctttgcgtttcgatccctactctatacatataagcgccaattttgatgcttctaggctttaagtttttatgcttaattttgcttaaaatcgggtgtttaattttgtggcccttttcaatgcccaaccgataggcggtggtgtcgtggtcgacatcggcaacatcaaagcaatgcctttgtgccattgtgcagttattgccgacgatggcactgtcaatgcacttgaacgtgctcatcggcattgcaacactacctccaacatcgccactgctg

SEQ ID NO: 21944 - DNA, 1670 bp, Heterodera glycines
ttgacaaaatttcgaaaatctatgattttcaaaatccctgtttagtgcaaatctgatatcatattcatgatcataagcccctaaccccccccccccccccccggttaatctttttatgacagaaaaaaaaaaatttgggtggagcccagattctccagtattactcatgcgcctaataagacaataacagtagtagttacaagggggccagggtcccacttttggcgctaaatttgaattcaaaaatttgaattcaaatttgggcttgctttttttctctgcctatagggctatttcgtttattggctcgtgcctattgagcggttttgggaggtcagaaggtgtgggacgtgtttggcgccaagtttagaatttaaaattttctttttttctctgtcagaaagactgtttcgtttttcgtcgtacacctattgaatggttttgggtgatgtcagtggaaatgaggcgctttggcgccaaatttaaattcaaaattcctgaaagtgttgaaaattgaataatttatgttttaaaccaggccagcgaccgagttgcggcgccggtcgtggcgctaaatttgaattcaaaaattcgaattcaaatttgggcttgctttttctctgcctatagggctatttcgtttattgtctcgtgcctattgagcgattttgggaggtcagaatgtctaacaaatgaaaagacggaaaatttggcggtgtggaaattttatgaatgtataacaaatgacaaaatggaaaattttatgaattttaacaaataaaaaatggaaaatttgatgatgtgtcatgaatttaaaaggtgttaaaatttatgggtaatttctgtgtatgaattcggtcacactcagggcacccatttccgtcgtcacaacggtaattgtgtttttgaatttttgctatttttctgaaatccgtttctattgtgggtggacgctttcgcccggaatttgacgaggatgatgaggaggacaccattgacatagtacttgaacaccgattgttgttgctgctgctttcaccgtcagcatttgattggtgaagggcagtgtgcaactgtcttacgtgcttggtatcgcaggtgaggcgaggaaagcagggttgaaaggcgctctgtgaaaatcattttcgtattattatgttattcataaaacggtatttcacatttagaattattatttatattatttaaaacgcttttcactggttgggggatgttggacagaaggagagaaattgggggcaaagattgacggacgggttgtgggttgaacaatggggatgtatcgattgatgatgtttgaacggtttccattgcgccaatttcagtgtcaacagtgtgtccattgtgttccaccattccgttttttgtcctaagtgtgaatgaacgttccattgtttgagcagagtgaatggcggcttcctaaaatttatcgaaaaagccaattgggtgattttttcccataaattccaagagcgaatccgaactgtaatatgataatttatattactttttacatgattcataagttgcctatacagggttcttctattacctaactactcagtccccattttgtaacgatcgtatttggcatgtgcaattccactatgtaccacttactaagcttcttacacttacagcattgtttc

SEQ ID NO: 21945 - DNA, 2451 bp, Heterodera glycines
  misc_feature (124)..(124): n is a, c, g, or t
  misc_feature (141)..(141): n is a, c, g, or t
  misc_feature (2320)..(2320): n is a, c, g, or t
  misc_feature (2341)..(2341): n is a, c, g, or t
gtcgatagagctcgaaaaactatgttttggaagtggtctccgtttctctgggaaaaatcgttaaaaatcctaaaaattcaaaaaacccgaaaacctacttttaggcctaactcgaaaaatttgnaaaattttcgaaatttnaaaatttggaaaaatcgagctcattaaactctacaataagttcgctggcaccccctccctcagaccaaaccctgacgtggtattcacctggtactgaagtgggaaaaaaaaattaactgagtctccgtgtctgtacgggtccgggatttggtctgatcaaaaaataaaaaatactggattatagaggacacttctgcggagtgccctcacagcgggaattttttgatccgagtttcagaaaaaaagttaggggccctcaaatgcacgaaaaaatgagaaatcagccgctgggactcagtcgtccgcgctgaatttttttctatagttttcccggattctcctcaaaaagttgtaagacccttccaccactttcagacccgtcccattagccgttaagctcaaattagtttttgaaacgaaactccttgtcaatataacgtatatattaactagcgggtgcgtgaaccgtcggctatttagctgggaaaaagcgcttcgcgctttcggagcttcgctacctaggctgtaaagcgattcaaattgattgaattggttggagattttttttgaatttttaaaaaattattataggtttttagtcaacatcgaggctcaagacgggcgcttcgcgcccgtttttaaatttgttggccttggacgggcgcttcgcgcccgttattcaaattttgttggctttacagagattagaagaggtacaaaagtgattagaagaggtgcaacagagattaaagaggtacaaatttgataagaggtacaaaaatgataaaagaggtacaaaagtgattagaagaggtacaagattagaagaggtgtaacagtgattgaagaggtacaaatttgatgaagaggtacaaaagtgataaaagaggtacaaaagtgattagaagaggtgcaacagagattgaagaggtacaaatttgatgaagaggtacaaaaatgataaaagaggtacaaaagtgattagaagaggtgcaacagtgattagaagaggtacaacagagattgaagaggtacaaatttgataagaggtacaaaagtgataaaagaggtacaaaagtgattagaagaggtgcaaccgcgattaaaataaaagtcataaaatgcgccgtatttttcctcattttttaattatttgattgtgaaaattcaccctccctaacccgagttacgaatttttgaaaattacaccaaatataatttttttgacaatttataatttaaaaaacattaaattctttaatttaaaaaaataattatttttaaataaaattttcaccaaaaaataatttaattcaaatgaaaattttttatttattattaataaaataaaaatattttaaataaataaaaattaaaaataactcaaaaataaatagaaaaataatgttacaccgtccggattcgaacctgcccccccccccctcagaacatgtcccagaatccccaatcacacagggattctgaggtcttgacgatgtcaaaagtaaaatctgatcacgtattcgtgatcagcggcccaaataacccctaaagacatatttttggaagatttttgtgagaaaaatttttccactcaaaaatcctggtcacccccctttggtctcgaatctcaaaatcacttttatttttataaaaattcttaaaaaagtgataaaaatgccaaataaaatttataaaatagagctaaaaattgcggatttttgtagtattttacttttcccgaatagcttttcagaaccgagttatgaatttttttctgaaaatttgaatttttccagaaattctggaataacttttttcctttttaagatagaaattccaaataaagtccataaaattctcctgatttttctctatttttaaggctttattcctgtaaaattgatcaacccttcgatttgttatgaattttcaaatattaggccaaaatcccaagggccaaaaaattgccaaaaaataaagaatttttaaaatattccaaaaattctgaaacgtaaaacaaacatcatattcgtgctcagcacctcaaaataccccagaaaaaaaattttcacccccattttggcccacaaaaaaaattttgaaaatttctagggggcctagctcgaaaatttttgaaaattttacatcatgtagtacaccgttcgatagagcttanaaaactttacaattttgcccntaaggcgttttttcgataaaaccaacccctaacgagttatgggcccgggactcaaatgtcccgctcaggccaaaattttttctatttccgggaaaaatcgaaattttcta

SEQ ID NO: 21946 - DNA, 1372 bp, Heterodera glycines
atcaaaatcatcaccaaacgcagcgggcaacaaagcaccggaatagattgaattcaattggttgagatcggtgaaaattgttggcgaagtgcgacgaagcaaattgtccaaatgataaccatcgtaaaagcccaagtggcgaatgttttcagaaaaaattggccaaatttcacgaacaaaaatgtcccaaatttgttggccattcgtggtatgtgaagaaggaagccacaaatgtaaattggtgcctcttttgtcgaaaatttggtgatttgaacgaagaaaagcgatgacggagtgatcgatgtacctaaaaatgggatgaatgcttttattgcgatagctctgatttttaagtactcaatccgaagatgcttaaaacggattttgctgggcaacggacggtcgggcaatggaaatggcacaaatttgtcatcgattcgtacagacagcttcggttcaggtcctttgtccttgcgacgaatttcgattgatctccaaattgtcaattcgcttttgccatcgaaatgtttgtccaccaacgcattgaaacgtggcgaaagaagtgccattttgaggccgagttgagcacggtcaaaagaggggaaaatgtccatccaaacgtcgttgcaaatccaactgaaatgggaaaaagtttagttaaataaatgatgaatttgtgtgacttttcaaattgcttaccgtcggttcatttttgtggcaattagcacaattttggccgagttccgaatgatatcacacaacaaagagcagaataattaattgcgttagaaatttttatttttttttcaaatgcaagacaaagcgaaaaaacaaacatttttatagccatgaaaagggattgatgaatgtttttgtatctttttgtttatgtgtcatgattagggaacggattttggctctattgcagtttatgagtccaatcgacttttatgagtccaatcaattgacaatcccgggtttttatacaataactttgttcatgttcgaacaaaccctatctttttggtatcattcgaaagtataaactgaataatgtaacagtaagagaaaccaagagaaatctaacatttaaagaaagttataaacaaaaataaacaacaattaattaaattaatcaaatcttttttggtaattgcctgaacgctgcgattttatatattttagcttcgttagaatttgtgctttcgaatgataccaaaaagatagggtttgttcgaacatgaacaaagttattgtacatataaaaacccgggattgtcaattgattggactcataaaggtcgattggactcataaactgcactagagcccggatttcttggtttttaccttttttttgcggattagtact

SEQ ID NO: 21947 - DNA, 2570 bp, Heterodera glycines
tggccacaatctgtgaacggattaacggaaaccaaagccattgatgagcagaccaggcaagtctcacggccaattgcccgtttaatggcgccgatattcacttggcctttgctgttggtgccgacgcggaccaaacgcattctggaaaaaaacataaacaaaaattgaagtcttttcatttaccccaatagtttcgctgctttaaaaaatccgacatgggcgttgaggggcacaataatttccggtcttcgaatgccatttttgtgggcagagttccgataagctgtaaaagacggataaattaaatgggaaatttaaatgtgaaaccgaggcatgccaaaatgatcgactcggacccgctggtggtaaccactccacaacttttggcacctccgtgaaaaagactgcacaaaatccggatacattcggcctaaaagtgccgttttaccctaaatccaatgatggcacacaaaagaggaccgacctccattttcctaatggaagggcacgcttcggggaaagcggcatttgtatgagagtacagctcgaaaacctgttcaaacacaagttttccaaataatccttcgcccccccccctcctccctcgacctgtttgatcatccgctggtaattgctgtcttcgtcctccaccgcgtacagcgacccgcacagtcggcccctctcgaagagaatgtcgctcatcgttttgtaggcggtcgcctcgcgaatgatgtcgtcggggggcagtccacggtcgggcaaatatttgtaaaattccctcagccgatcggcgcgatgcatccgatctgaaatttaaaatatttccgaatgcacctcatctccgtcagttggccaccctccaattctttgtacgcgttttctttgttctcttcccatttgtgtttgtacgtggaaaaactgagcaacgaatcattccactgaaaatgaaaataaaaacaaaaaacagacagtcgacaccaattggcgaaatgagacgaactcttcgaatttcaacactttgcgaacccattgaacaaaaaggacgaacgacagagtgtaaaggacaatttgccactgttccaaatgatcaaaacgacgatttctgaagaaaacaaaagtagcggaaataaaatatagcaaaaaagggaaataaagaaatttaaatgcaactcactaactcacaaatgaatccgaaagtcgtcgatgacgtaaaggacgactcgccacggcgtatggtccatcagagtcacaaaacacaaacaaatattttcaatagtaaaaatgaaacattaaattggaaaaacgaccataattaactttattaaagtcgtatgggaaataatttatcaataaattaggcaagtttaaaaataataaagtttaagtctcttcgtcaggatgaccgttttcgaattgcagtgaaaatatccaaatattggctcaaagtgtcgattgccatataattgtccagctgttcactgtgccgtttgaacacctccggctccggcactttcgactgtccaaaaaagaattcaacaatctcttcgagaagggccttgcattgatggagaatgttggaggcggcatattcaatttcaacgacaacgccctgaaattgacaaatttagggagaaattcagagagtaaaagccgcggtaatagtttagatggtgccacacctttttgacaaaaattttcttgtaagtttttaaaagtcgtgaaaacacgttttatggggtttttagggtcgcagataacgaatctaacattcattttgatcaaattcgaatcccggacccgaattcgaacaaagttgaaattcaaaactttcgaaattctcacttctattcaaaaatcgattaaaaacaatctaagtttattcgcaaacattgcaacatcaaagaatggtcattgtaatgatacgaacataaaaatgaattttgaattttcaaatttttgttcgaatccaagtccgggggtcggaattggccaaaacgggtgtcattttcaggatcagcatcaccgaaaaccccacataactgtttgcacaacttttaaaaagttcaagaaatttttgtcaaaaaggtgtggcaccatctaaactattaccgtttaggtatgtatatgactagattgtggtataaatagaccattttttaatttgaaaaagcgaatcataaacgctgggcttgacccatagtgaaccggtgtcatgccagatttgtagtggtttttgtggaccaatggcatagaaaaggcaatgcccaaaaaaacaatctaaggaatatgttaaaaagtggtgacagaccaaagccatcgaagaggaggacgaagtcatgccaaacatttccacaattctgacccaccaacaaaacttgtgtatatgtataggtaaataaattagtgaaaatcggactaattgtaagctaaaatagttgaagacggacaaattgcgacgtatgccaaggagaaaaatggtcacaaaaatgcgtaaaagcaataaaattttattaaaatgaaaatgtgaatagaaatccaaattcagagagatactgacaaaaagagagagc

SEQ ID NO: 21948 - DNA, 642 bp, Heterodera glycines
  misc_feature (516)..(516): n is a, c, g, or t
ttttaatgtctctaacacatgaaaaacatcaaattcgctaattctaacaattttggtttataggctacaaaatcactttgaacacttagaatcaatagaaaatgattagttttcgcattttggttgaaatcagcagtttaggacttgagttataacgtgataaaaatttgaaactctcacaacttttttcatatgacttaaattgcttagcattcgcttagaaaaagatttctcttttcaaattttgttcactttagttgggaatgaagcgagttatggctgatcaaaataaaaaatacaaaaaaggcaaatgaaacgtaacccagaaaagagaaagggacaaaattcacttatgaaaatgattttatttcggtgtgacggaaagattaaaagatactcacaacttgggcccactttctgagctctctatggtctgaaacgcacgaaaaacatgttttttcggctgttgttaggctccagcactgtcatttccgccacccgtttagatgtttttanattgacttggaaaaaacagacggcttttcgtacaaagtgaaatcaccgacacatcttcgccaaaagcgataagtatgtcacgacaaacagagacgaacaccaacacgactgagttcaccactcttc

SEQ ID NO: 21949 - DNA, 1423 bp, Heterodera glycines
tctcacattcatacccgccttagaaaaaatctctttgagaagagagtaatatgactgaatttcttcagccctttctaaaccaagtattatgttgtccacataaatgtctctctctatttctctcacctttttgtcagtatatttggacaaatgaagtttgatagtcaaggagagatgcgccggtgaacagatgactccaaacgttactctagtaaaccgatactccacgaggggagaatcgtccacgtatgggtctctaacccacaagaatcgcatcgcattcctatccttaggatgtatcaaaatctggtgaaatgccttggctatgtcacatgtcaagagaattggtttaattcgacttcgaattaaaatgcctgctaaatcattatagtcattttctcccttttctaacacttggttgagggtgagacctcctctgcatctagcggacgcattatacacaattcgaaccttagtatgttcactcgtttcctttaccactgggtgatgtggtaaataatgaaccttacttccaaccaaatacctttcttcaataggtaatggctcacattcttcaataaacccggtttcgacttgttccattatgatttcatggatttgtcgaagcaaatccggtgtttttctaagtctgcccaaatttgacattaactgtctaaatgccatatcataatttgttggcaattgagcagccaattcttcatcccataacaattctgtttgatacctatccccattgaatgatattttatcaatcattctttgtctcacgttttgcttatctgaattgagatcagacataccgacatgttctagaccattccagtccataatcattttattgaaataattccgactcagttggtcgctattcagttcccattctactgaaccttcgttactgttgaccaataatccattgaatatcattaccacacttttggtttacagtatggtgaatgactgatgatgatatgtcggattgagatccgtttaatgacttaaagaattgaacctttccttgtccactcaaaaattgaccaatatttgagtcattgatatacagtcccgattgtaattcctctaagacactaatgttcaaacgattataataatcgtttccaataattaaatcaggctcaccatatacctctggtgaacagaaattaaagcactgattaattctggatgagaccagattaatcagacttccccttgggaaaaaaattgaacccgcctgtgcacaaaaggtcgccagttgtccggcgcgcgtcttggtaaatggggatggcctgcgcgctgagacgtgcaccaagacagtgcactcaattggttctcgattcgtcaattgaccgatgcgtccaatgtccaattcgctgcgtcaaatgtccaaactgttcagtgc

SEQ ID NO: 21950 - DNA, 1196 bp, Heterodera glycines
aaaaaagacttacaaaataaacccctggagaagggagtggaaacatgatttcaaaatttcaattttttctagtctatctactcaaaacggttcagaatcaataaaaataacatcacggtgcgaaaaatggggtttgacaagtttattgggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcgataaaaataacattcacggtgcgaaaaatggggtttgaaaagtttattggggaaaaaaagactacaaaataatacccctgggagaagggagtgggaaacatgatttcaaaattttcaattttttctagtctaatctactcaaaccggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttatttgggaaaaaaagactttacaaaataatacccctgggagaagggagtgggaaacatgatttaaaaattttcaattttttatagtctaatctactcaaaacggttcaaaaattcaataaaaataacattcacggtgcgaaaaatggggtttgacaagtttattggggaaaaaaagactttacaaaataatacccctgggagaaaggaggggggaaacatgatttcaaaatttttcaattttttttagtcttatcta

SEQ ID NO: 21951 - DNA, 1580 bp, Heterodera glycines
  misc_feature (1437)..(1437): n is a, c, g, or t
atgtctcgtaagacgtcctgtagtagtaactgctttgcttcgtacattcaatatattttttattaaaaaaatatttatagtttttttcgcagtttttttctaagctaaaatttaatataattggttttgtttttgttttttcttaaaatttaggttattttgattataatttaaccgcaacggtattaaatttgctattttaataattaaaaagattaaatattcatattatatattttttagacttttttcattaaaaatatatctcatgaaaatggaatttatccagaaattgaatagagccgttatttagtcattgttagacaattatatttcaacaaatttatgactaattcccagatttattggaattattggttattaaattttaaaaatccattaaaaaagaaaaaattattttatattataattttttcgttgcaataaagaatggtaaatattaaatatacttttaacaatgatttttttaaatttatttgtttttaaattgatccttaatatttttttataatttatttccttgatgaagttttcggctttagatttctgtggagtcgcaaaaatatatattttttaaatttatatattcttatgatttgttttttttaatagttgcgcaattttaaaatcattttagattgaaattataatttttatgaattaatattttcgtcacgcaaaagattttgtttggtattatttaatcaattaagctattctttcgttttttaatatgtttgcattcaagtcttttggcttagcccagaatttctttaaaaaatttaatcatgaaacaattatttggtcaatgttgggccttgaaaaaataataatattttattttattactattagtcaattaatcgtcgtaaaaagattttgaaatttaatcctttggataattaaaatagaataagatttattatttaaataaattagtttagtaatattttattttaaaagaattaaaaaagtttatcattttgaaagtttttgcagtgtataaattttattctatttattaattaatatctttttagctattcttgttctatttgttattttacttttttatttctttatttttattttttgttgtttatcttatcactcatgtaaatgaccttttcagcctattaaaatttgtaagattaaattaatgttaatttcaacaaccatttttttaatattttgagttcttttccaataataatttaattttcattagcttttagctttttagtatttttatgtttttctatttgaattatttactattagacctatattactaatttttaataattgtaaaatgcacattcattttttttgtttattttgatcgtttactgctgtcctttattgcaaatgaagcgtcgtcatagttggcataaaaatgtatgccgactatgttanattatattatgcccataaaatgatgaccattcaaatcagttgattacagcaatggaagcttttgaaaaatggtcaaaaataaatgttttaaaaatttcaattgaaaaatgttttgttttatactaagggtgcgaccccgaccc

SEQ ID NO: 21952 - DNA, 1020 bp, Heterodera glycines
  misc_feature (17)..(17): n is a, c, g, or t
taaatggttatgggtantttttgaaaaatatataattattcttaaaaaatttggttatctttttataaaacaatgtttaaaaaaattttcttcgatcaattttttgagtttttttcttttaaattacatagtttattttagatttaatttctggtatatttataatattctattcaaaatttttatttcataaatcaaaaattgataatcaacaagatacactttacatttttagtttttttaattgcaaaaatgtcaagggatattatcattaaattctgccagattcaattattaattatatttacaacagttaaaaggatatgacattcatgttttcattcaaaataaaaattttttaaaattaaacaaataataaattatgtttaaattaatatttttgaaaaaattattttttcattatcttattcaaaatagaaataaatttactatatttataattaataattatttttgtaatgtttttttatcaaaaagtgtggttgttttttattcaaaatatttgtgttttctttaattctttgtatattttattatttaaacttctcaattaattctcgtaatttgggtgttatacgccaaaagctcctcgcctatatgcttttttgtattttatattttaattaaatttatgttttatgatattacataattttaattaaataatctcttcgttccacgggtacaataaaacactttccactgccgcgttcaatagaaaatttctggtttttaattttcatttgttttttttatggtattttttaagccttaatttgaatttttttattttattattaatttttttttgatgtatttatttttttacctaaatttacaatttttctcattctctcggcatagtcgaacaacaatttgtgatcgacttttaaaaattttaaaatgattttttcattattttcatttatcttaatataattaaagtcaattaattttttgattttcttttttttatttttgtcccaaaatcattaaacg

SEQ ID NO: 21953 - DNA, 941 bp, Heterodera glycines
ttagtcatcatgtcgtggggattccatttctctggtctccttaattcggaacgttgtaatttgatttaatttctcaaaacatattcaaatatattttcgtaaaactttattattaatatattatatttacatttataattaatttttagaattaattgtcattatttttttgtatattataaaataaatgctattataaagttttaatcaaaaaataatcatttttacactgcaatttaattattattgtttttatttttttcaattatatttaaggcaagattttttgattagatttattgaataaaataactttattaactttcaataattttacaatttatctttgttccgtagagcaaatatttattaattttaaatattcatttattaaattaaataacatttttaactttcaaaaatttacaatttctcatacctatgtcgttacagtattcacaaacttgatcattaattcttaactcaatcataaatcagggtttaatttttttaaaatttagatttaatgaccaagttttttttgattaaataaacaataaatttttaattcttttcactgttttgatcagttttgaccgagaccgggaaattctttgttttcccagccaaaaactctcgggttttcaacccaaacccggtcccggtttacctcaaaattcccggtcccgtgacactctacttcggaccggctcagttcgaccccagcatgtttttgcactataacttttttctttgtcaaccaaatttaataatcttgatatcattcgaaagctcttcacgtgctctattagcttacaaaaaacaaaaaaaaattttagcatgtaaaaatgtaattaagaaaaaacctcaaaatttttaacttttttgcaatttcatgttataacttttttgctatttgtctaatcgcgaatcaatagctt

SEQ ID NO: 21954 - DNA, 1898 bp, Heterodera glycines
tccgtacgcgaatacgttttgtatgcgtctggtatccctttaagagtgagtgtgttcggaactggtggcggtgcatcgatttcacgacggacacgcctgattatctaaatatacaaatatttgaggaaacataaaaaactatcacttgttttgtcgcctgtttggttgggagttgcgcaaggactgtcgtggtcacattctgcagtgccaaagagcaaattggcactggaggatccatggattgatccgccctgcgcttgattgccgagatcgctcgaaagagattccattcaaactgcacttgttgcacactgcaaagtgaccaagccgatctgatcgattcggagatgcagacggagacagaagagaagaccaaaatgaccaacgagcttgccagcacagagacgcagactgaaccagaagagaagcccaaaacatttgcttttggattgcaaactgatcaaaccggtttgatcgattcggagatgcaaacagtttcagaagagaagccgaaaacggtcacttttgcaatgcaaactgttcaaaccgatctggtcaattcggagatgcaaacactgtctgaagaggaaccgaagattaccaacaagttaatcactacagaggcgcagactgaacctgaagagaagcccaaaacatttgcttttggattgcaaactgatcaaaccggtttgatcgattcggagatgcaaacagtttcagaagagaagccgaaaacggtcacttttgcaatgcaaactgttcaaaccgatctggtcaattcggagatgcaaatactgtctgaagagaaaccgaagatgaccaacgacgaggttcttgaactcaatgtctcggttagtttattttaaaaatgtttatttggtcttcatatattttcttgttgtcattttattctttgagactaattttatttttcgatgttgcagaaattgcctatggatgctgattcgtcatttctcagtaatcaaggacggagttcccctttgttggacgaatcattgcgccgtaaatacaatgaaaagtgtgaagaaatggcagaattacgttatgtaatttatctttttcttaaaatcttttctaaacattttctacaggcatatgagtttcaacagtcaatcatttctaatcaactggacgaaattgcgcggctaaagcaacaacaacaactacgaaatggcgttcaaaaaaatgggtgagcgaagaaatagattcttacactgacaatgagtacgtttaaaagcgtgttacttttttgaattaaatgatgcttaccgattacaatacaagtcattgttcagaagtccgtcctcgactcgtcactcagccattactgctgctgcttcgccgtcgtccgttttccccagcggtgctctgcccaccatttcgggtcgaccacgcgctgcaaggcgaacttattgcgaacattgcgaaatgtttgacgcacacgactcgtcagagtgtccaaaagaagaggcaaaaagagcagaacgacgcgaccatgaggcactttcaccgcagaagtgggacgaacgggaacgcaccttctggcattaatattgacgatgcatttagacccaccctttttctctttatttttgtccattcgtttgtatgatcttttgactttaaacccgtgtgcctttttctcttttttttgtctcattgagtttaattattttcatcagctgcctttcatattcttggttcggtttcctctttgacttttctttttacattaaaaatcgtaaaaactaaataaaattcaatcattgcttttttccccctaaagttcaatcaatggcttttttgtgcccaaattaccgttcgtttatattgaaaatgggctaccagacaactctgtttgttgtcaatttaaatgt

SEQ ID NO: 21955 - DNA, 1522 bp, Heterodera glycines
  misc_feature (1404)..(1404): n is a, c, g, or t
ctacagtagacttttttccaattattattttaaagtgcctttccccaaggaccaacgggaacagaatcccgtcaaggacatcaaaaaagttccagccgactttgctgtctaacacgaaaatgccgaggtcatcttttcggtttcttatctttcggtgactttgttcggtgctttaagtgaatttttaacgaatgaattttttgtggctgacctgcaaagcagatctcttccactggtcgccctatttcggtatttattgttacaaagatatatgcagggttgtagtgatcaacattcacactgaattcataagaattcagagtgagcacaaatgggaaaaagtcctttaagatctgtttgtgttgggcaaagtgagataatgatatctgatgaaaaaataaagagttaatagcgtgttattggggtaaaggggtaaaggagggatggagagggagacaaagatttagagacatatagagacatgctgagaatgatagacagagagaaaagagagaaaggggagggggaagagagaaagaggaatgagaagagagagagagagaaagagaggggggagggggtaaaggggtaaaggagagatggagagggagacatagcgtgataggtaaagagggagagaaagagggggagacaaacccgagagacagggagaagcagaaaaaaagcagagtatgattaaaaggagagagaagagaaagatagacagagagagaaaaagagagcgggataaaaaagagggagagacagagagaggcagagaacgactaaaggagagagtgagagagaaccagagaatggagaaaaagatagacagaaagagtgagagagggggggggggtgtaaatgagggacggagagggagacatagagtgataggtaaagagggagagacaataatcggtctagagatattatgaaagacggggaaacagagaaagaggcagagaaagagtgagaaggggaaggaagaagataaaggggactgagaatagcgagcgagagagaggaggataaaggagggatgaagagggagacaaagatttatagacgtataaagacatgctgagaatgatatacacagagaaaacaaatacaggataggtggtgccggaaatgtatccagggacggagacatcagcattcgcactgaattcataagaattcagagtgagcacaaatgggaaaaagtcctttaagatctgtttctcttcgcaagctaaaataattatatcttttcaaaaaataaagatttttaaccttttatttcttgtattagcaaataaatgttgagggaaactgagcccattttcatcaaaattgtcgaggcggtaatgtacgggtgggctttaatgtaggtgcctatacgtgataaagccactgtcnaacgagctaaagccgaaactgccctttgtttccgatgtcttgttgttcgaactatgagtatttggtagccacagaattattatttgtcaaaaaagaaatttttttctttttctagaaa

SEQ ID NO: 21956 - DNA, 858 bp, Heterodera glycines
attcatacctgtgcaagggggggggggtcagccaagaggtcttacgatcgactttggccctcccatgggagggtcagagcccatttccattacgatcgaccatttcttgcctgctgaagacctttttgttgctcttcgggtcaaaaaattgttttctccagtgttattaaaaaattttgaacgcctattcctttcaagattccgtttggggctggggttcccacccgggcaacgacttttttgcggcgcttttttcaaaaaaactttaggaaaaggggggtccgcggtgtcgataggcgccgccgggaaaaatttttccatttttaatgcgatttgttaacgatttttgccaaaaaatgcctaagttttgcatatttctagcaaattttcaccaaaaagttaacaattttatgcttttaagcctaattttaaagaaaattatagacgaaagggaaaaaaattgattttagttgatcgtaaaaatttgcatttttttttttgaaaaaccggcaaaatttttcgatttttctactcctctcctcttacgatcgacaattttcctcacaaatcggtattagtcgatcgtaaaaattttgaatttttaatgaaatttgttaagaaataaggcaattttccgaattgccaatgagaaaattttataaagtttctgtttttatattaacgatcgactttttcgctgactttttttctctccctcatttttcttttctccttcttcctcccttcaccccccccccccacctcgtacgatcgactgtctcgaacccttacgatcgactaagagacccccctcctgaccccccctgtgcacaggtatggtgttgtgttggaattatt

SEQ ID NO: 21957 - DNA, 456 bp, Heterodera glycines
tcaatctctctacagaaattaaaatattttgaattttcccggacccccttcttcctcaaaagttttttgaaaaaagcacgcagaaaaaagtgatttgaaatgtaaatctgaatttctaataatattcgaccatttagtccaaaattgattattgtttgaaatatttgaaataaatttggtttgaaatattgattaaatatattataatttaattttgcgttaaattattaatttttatagttttacttgaaaataacaaattcccggtccctgtacaagaactaattaatgattagggaaaacatcggtcatatgggccgaagcccaaaatggctaaataaaaaccaatcgactcctgtttgtatgaacgaagccaatagatttttgcggggctacccgacttttgggggatttgcaacttggggacccgccatttggggacccgacttttgggga

SEQ ID NO: 21958 - DNA, 1081 bp, Heterodera glycines
  misc_feature (26)..(26): n is a, c, g, or t
gtcgggtcctcaaatgtcgggatccncaaatgtcgggttcccaaatgtcgggtccacaagttgcaatcccccaaatgtcgtcgcaccacgtttttgcggcacccaatccctgatggaaattgtttttagttttttggcttttgtgcgttttaggctttggagggttaagtggcatttggccatttcagtcccgggtctgtaactcttcaaacaaaaaaatctttcagattcgttcattacagaccgagaggagtcgataatatttattttagccatttgggctcctgctagccatatgaccgataaactttaaattttgagtgagatttattaacagaattgtcaaaaattacaaaatgttttgttaattagttggtttttagactgtttaaaatgaaagaaaactaaaaccatgctccgaaattttttcatttaaaattaaaaagcccataaacccgaatatttacaaatttacgttcaaaataattaagccaaaaatcccaaaaatgggtattttacttggatattttactgcaaaatatatttaatcatgccaaaattcaaaattttcaggcagagcgtgtaggcgccgctgcctgccccccccccccaatagcagaaaaataaagataaattaatttttttttaactagaaaattaattatttttgattttcccggaaaactcccggttgtttccgagccccaagttccgtttgaaaatccggctaccgatcctggcctttctgctccggatgtcccggcccagttttgctcaaaattaaacacattgtgtgccagtcggattgccttcgtaagacaaaatcgtcgaattttgccgaaacccttgttgttgcccaacgccttttgggtggtagaaaattaattaattcgaaaattaattccgccgggagaaattttcttttttttctatttcgcatttttagtacttattttttgatattttaacaaattcatttctaaagaagtaataaaaagaaaaaccggtcgtcggaaaatttttagaagaacaaatccataaaatgtgaaatctcttcaaaaaacttttaatgtaaaaagcg

SEQ ID NO: 21959 - DNA, 1127 bp, Heterodera glycines
  misc_feature (104)..(105): n is a, c, g, or t
  misc_feature (111)..(111): n is a, c, g, or t
ttttgagcgtaatacgattttacttacaccatttttgctaggctagatcacatgcgatttcggcactctgatattttagcgctcatatgggatgttaagcgatnngtaganggaatgggagcgctaaattgttgaagagctttttgagcgtattacgattttcttagcccattttttctaggcttagatcacatgcgatttcggcactctgataatttagcgctcataatgggatgtataaaggcgattgtagaaggaattggaagcgctaaaatggttgaggagctttttgagcgtaattacgattttacttacaccatttttttctaggcttagatcacatgcgattttctgcactctgataattttagcgctcataatgggatgtataaaggcgattgtagaaggaattggaagcgctaaaattgtttgaggagctttttgagcgtaattacgatttttacttacaccattttttgctaggcttagatcacatgcgattttcggcactctgataattttagcgttcataatgggatgtataaaggcgattgtagaaggaattggaagcgctaaaattgtttgagaagctttttgagcgtaattacgatttttacttagaccattttttctaggcttagatcacatgcgattttcggcactctgataattttagcgctcataatgggatgtataaaggcgattgtagaaggaattggaagcgctaaaattgtttgagaagctttttgagcgtaattacgatttttacttagaccatttttttctaggcttagatcacatgcgattttcggcactctgataattttagcgctcataatgggatgtataaaggcgattgtagaaggaattggaagcgctaaaattgtttgagaagctttttgagcgtaattacgatttttacttacaccattttttgctaggcttagatcacatgcgattttcggcactctgataattttagcgctcataatgggatgtataaaggcgattgtagaaggaattggaagcgctaaaattgtttgcaaagctttttgagcgtaattacgatttttacttacaccattttttgctacggcttagatcacatgcgatttttcggcactctg

SEQ ID NO: 21960 - DNA, 1839 bp, Heterodera glycines
atatagttttcttgagtcgtctattgtatattcgcataaagaaaagtgctaacgagtttaaattgtatattagattggttaattttcttgttaacgtcagctccttcgttaaatgagcaaattgttgctatttcgcgtgaattaaaagataatataatatccagttattcttcaatttccgtttattattcgttgttagtaaaattaggtttcatattgtcacgtaattctgggtttgatgccgcgttctgtctttctgtattagaagtttctcaggtttttaatcagaacaattttataacagaaacctagaataatcttttttatcatatttgttattcatgtaatttttgttcattgtttaaattttgtttttttttcttgatgcgatcttaacgaggtgtttgttttcttggttaaggccttcttgcattacttcttttagagttttacaattactaagatacacatcttttgctaatttaagtatttttacactcggttgttttttaaaagtttgataatcaaagcggtttttaccttaatttttattgggttttcagttacttgactttaatgaattttattctctcctcataactaagccgcataaaaaatatgtaaaatataaaaattcccagcttctaatgataattaatgtaaggcaaaacaaagttaaaaacaatgaattagtatatgcaaattataacattttaaatttcagttagtcttgctgcgattgttttccatttaatttgttgtttttttggtaacatgtgatttcgtcagtagtgatttcgtcagtgataataattatttctttacaaaatttttaatatttcataaaataaataatttaattattagtaacttaaatatgtagactcaaaacaaaattctttgctcgattaccaacctataattcggccggtcacttacatatattaattattgtatttgtgcctagtctttttcgttggtggacttgtcaggttttctgcctacaaaccgaagccacattaaaagcataaatcataatgagttcgacagaacaataatttgagaatgctttcattttgcaaattgggacccattagaatttcatgagccattcttatcactatttttttaaatttttaaaaatttatattgaatatcattggatttacaccaaattttggatttgaaaaaaggtaaaatcaactgtctgtggatttagttatttcaggaaaaatattgaagtatgattaaaaattaaattttttaatgggaaaaaataaaaattattaaagaggcagaccatttagtatcgaattgaaattatataaaaatagaaaaataatgtcaaactttttcaataaatataaaatatattattatagaaaatattataaaattaaaatacagtatattattctactttcattaaaagtcaaaatatttttctaaaaataaaaaaacaaggtcgcacattttcaattataaccaactctgtgcgaatttaaaatactgttactaaatttattgacaaattatggaataagggttttcgattttttatttgcaaatctaattttaatagaaaataaattttaatcattttcatataaattacaactgtccaaatacaagaaggttaatcacttaatcgcgatttaaaaaacaaatcaggtaaaaataaaaataaaattaacaggaaaaatttttatcctataaaaaccattttaaacggccgatgggcacttcttttttttaaataattcatttgaaaaaacatcaaaatctgcaaaaaaaaattgaatggaaaactaaattggaacgtcagaaaattatagtaat

SEQ ID NO: 21961 - DNA, 1104 bp, Heterodera glycines
cgaaataattaaaaaaccgaaacaatcgaccgcttttttgacaaatcagttggccatttttttaacaaaattcattaaaaattcttaaaattttcctccggcggcgcctatcggcaccgccgcataaaggtatattctctgaattttaagacttttttgttctggaactttttcgtttatcttttttccgactttttatgaaaatttcgcccccgacaaaggtgtctgccccgacatttttaaaatttctctagccaaccccgacaaatttagtcgaccccgaaccccgacttttccaaccccgacgtcgggggcccaaccctaattttaagcaaaaaacaaatactgtaaacagagatttcgtgtttggctttgtgccaaatatgttccttttttcgaatcccctggattttgtttgaaccgggttcaaaaatcttagatggcattgttcagtctccgttgtctgccatattttctccatttctccaaatttgctttgcccaaccttttgatgccaattatgtctttaatgtttgcgttaatccgtgccaataggcaatttttggcgcaagaaccttatagggtttttctagcgccagaattccgaataaagcaatatttgcgccaggatccacattccacgcaatagatctcttggggctaatggaagtgccaagtatcgcgtgaaataaatgtgccggggtcatgaaatgcccaaaaagtcggggactcagtgaaaagtatcgaatgtcgagatagttgaggtgatatcgtccgcccaccactatctgggattggggaaaggcttaaaacatgtttggaattcgtcggcgggaatcgagggtgggccactgaaagccgccaccacgtatcgcacgaattcgtaaaatgccacaaaaagctggggatttagggtcaaatccgggtcctcccttctgatcagcttttatcatcgccctgatcaccacagatgccgcttctctgttgctgctgatcgcattgctgtgctgtaccgtgcccgcaccggtggccgcaatccgtggcgcatttttccgttccgggcattcgtcggccgctttgtcttgtctaccgatgccagtaagc

SEQ ID NO: 21962 - DNA, 893 bp, Heterodera glycines
  misc_feature (779)..(779): n is a, c, g, or t
tttttgctttggtgaaggtttttagttgcatatacatccagattttgggggtttttgggaatagatccatattatcaccatttgttgagcatatttcggcaatttttatgatttttcatacgaaaagtgcaaaaaaacgaaaatatacccctaagaatcgactttttgggaataaaaaaacacacccttaaaaaattttgaacttttgtgagaacttttgaataaaatttatttaattttgttttagcatataataaaaattcgaaattgcatataaaaattttaaaatcacgtttttttttgcaatagtctaaaagttattgttttggtgtttttaaagtaaattctgaatttttacaccatttttggcatattttttttttgttgattcaaagtcgtttttgccagtttttaaggcatattttaatgcatatttggtcatttttcgggtttttagggcatattttaggcatttttagtgcatattttatgtgcataattgcatttttttagtgcatacaacttataagcttagacataacattaaattttttgtcattttatttcatttttatatttgtttattttctttttaaatggtaaattttaaaattttatttaaagatcgatcaaacaaattattattttttctagcgctttatctttaaaaagacagggatttactaacgaaagtgataataattagggcacaaaaataataggacataaagtcgcgaattatgtccacaaagagggcaaaatttctcaaaatctcttanaatcttaattaaaaatctttaaagggtaaaaatagataaaatgagtttaaaaaaaataaattagtaatttttcaaaaaaacggcataaatcgcaaattccccatttttttaatt

SEQ ID NO: 21963 - DNA, 887 bp, Heterodera glycines
gcttaatcaattattgatagaataatattagtgagaaaaaatattttagcaaaatgaaaatgatttttaatccaaatttagcttattaaaaaatttaaagataaattaagaaatcaaataaaagaaaatataggtgttaaagtacttaaaacatttaatgtaataaaaatcagaacatttgttattttaaattggtattttcatgcttaatgctgaacatgtaaattctgtgctgaatttagcattttcgtgcttatttttgtgcttaattggcattttttgtaaaattttgaataaacaccgtctcccaggaataaaaacgaaaaaatacacgcctaggaatcgacttataaaaattcaaaaaaatatccctaagaattgacttaaaaaatttcaaaaaaatacacccctaagaaatgaaaaattttcaaaaattcaacccttaaattttttgttttttgacaaaattttcgattttaaaaatgacagtttttgctaagaaaaaattagaattgtcagtgcgaaaagagaaattgaggatttattgttaactaataaaagtttttacataaattcaccaaatttttatgctttttttaccattttcatgcttattttgtgcttaattatcattttttggtgctgaaaaatccggtctctaattatgatttggttgctttgcttttttgcagtggtagtgtctacggtaagggccggaacatgcattttaaataattattttaacacaaacagacaccgtactgatttggcccggtctcttttgttaaataattgcggttacgcaaaatgacacggcacctttcaaaagggcgaaatttcaattatatattttttatcaatttattttcgagagaaatttcatttat

SEQ ID NO: 21964 - DNA, 1721 bp, Heterodera glycines
atttaacaaatgatcaaagctactcaaattatttttaatatttaaattataaggaaaccacaattaatcaaatacagtttggcgatccgttttccattaatgtaattttccccagttgtatcattcatttatactgcatattgttattttatatgtactttcttaaattttccataaataaatgtcggcttattttaaattgatttcttcattaatccaaaatcccgaaaacatactaaaatatttcttaattcattagtttgtttctcctcttttcgcatatatatatatatgcattaaagtaaatttccctttgttggtgaaaattgactcatggttgtcgaaactcgtaaaatcaaaatttgattagcattaaaataatgcaaaaggggcgataggggaatggtgtgactgctcattttctctcccgttgtttgtttgtttttaatcccttctccgcccgttccacatcctgttcctccccaaaaactcacatgtttccctccgccgcaaattcgcaccaccttttttatcccgcgatcgcaactgtgcgaaattgtccgtccattctctcccctcataaaaatcatttgttcgccaaatttaccctctcataaaatgtggtttaattacctaagtttgaggtccccgtataaatcattatttaattgtgtgtgtgtgttcgcccatttgaccccgacccaccgatcgagcccagctgcccccgatcggacccgttgacactaccttgtgcaaattttgtgaaggctcctccacatggtactagcaaaaaatgaattgttaataaaaaaaataaaggataattttataaaatattttcgcattaaaaactttaaaaatctattctaacaataaatattatttaaaaatttaattaatttaattgcgaataattagctggatgaaattttctttaacaatttaagttccacaaaaaggcagatgtctggcggggcgatggtttgctactcacttcgttttttcgctggacatatgaagacaaagagaatagccaaaaaacatttttattttcataatattttatttaaattaatattaattcatattttaatgacattttcgcattttaatgaatttgaaatttatggcttagtttaaaaagcttccaaatatgtgttaacattggtcaaataacatagaaagatcacctttccatattttttgtattttgtgctaatatttttgtccacttatactgatcaccttattattatgcatttttcctctcccactattcgcccatatttgccctatcaagtctgactgattcatttttccaatgtatgccctctggctctgtctattataattgtacacgcatagcttattcaatttaaccattttgtttattttttctgggttaatcgaaggtttaatcacccaagtttgtgtttgagatattttgaacggggagaaaaagccaagtccggggctcagatgcgtaattgaatggcttcgatccgaacaatttcgatgcaaaaattcttggaccatagtgccaaattgtatatttcaatgtattcgtatttcctttgcaaattatttaggccgagtttttttagaataaactggagaattttttccaatccgaaattttatgtttaaactaataacaagttttgacaaaattactgatccaatgtttgtaaatataggttaaatcaataaatctattttgg

SEQ ID NO: 21965 - DNA, 2497 bp, Heterodera glycines
ttgttcttcctcatcaactttgacctccgcatatatttgttatttcttcactgcataaaataaattggctgttggtcggacacaacagttcactggcgcagtcagcagtgcaaaacaaagcgacgaggcacaatcggagttaaataaaatacgcaaagtaaagcgttcaactgccgatttcaaaaacgcaaagtaaagcgtacttcttctgccgacttcatccaacgaaaagctcaaaaagctaatttaaaaacgtgaaagtaaacacgaattcgttttgtcagctcagtaaagtaattctgtctacaaagctgaagtttcacaaaagggtaaagtaattcccacgtcaaatcatcagcgtcaaaattcgtcaacattcacaaaggatggccgagccaaaagcaaaagctggaaaagggccgggaccctacacagcggagatggcatggaaaatctgggaggagcgcttcgaattcttcatcaaactccgagcagtcactgatgccgacacaaaaaagctgctgttcttcacagaaattgggccgatctacgaggaattacgacagatggcactaccggatgatgtcagagatatgcccttggataaaatcaaggcattgatgagagatcaatatggagagacaaagactgtggccgcgaaacgacacgaattgtttgctgcgaaacaaacgcaaggacaaaccatccgcgactatgcgattaaattgcgcactctgatcgccaacgcagaatggcacagagattcggtggacatgtgcctgacagcgttgttcatcaatggactcgcagatgattcaattcgagcggaactgatcaaaaaaggcgacaatgctctgaagttcaaagacgcaatagaaactgcggtgcttttggaacaatcatcattggacgcacagcgaatcggtggacatgggccaagagaaatagtggccaaggtttcatctcaatgaaaagagaagaaagccggcggcaacagcacaccagggaaatgtcatcgatgcggacggaacggtcattgggcgagtgaatgccccagcaaaaacaccgaatgccgaaaatgtggaaggattggacattgggcagtggcctgcaaagcaaagcagagcacggtatcaaatgccgcaaaaggaaggcaaggctcttcctactacaaaggaaagcctgtgcatcaaatcagcgcacaaaagcgtgattcttccgcggatgttgcgagcgtcgtcaagtcaaaacaagttaaatcactcacagctccaccagcattcgttcaattacaattgcaaaaagaggaagcagactttgaattggacagtggcgccgacgtttcgctggtctccgaagatgattggattgcaaatggcgagccaaaattttcaacatgttcgggattacacgcgtacggaggaaagccaatcaatgtccttggattcttcgagtcaaaagtaaagtacttggggagagaaaccacgacggacttgtatgtggtcaaggacaatgtgaagaatctgtgtggacgtgatttgatcaaaaagctgcagatcgacttgaacaaagcgtttggaattggaatggtgcaacaaattcgggacaccaaattcggcagtaaattggacgaagtgctccaaaattacgccgaagtctttagtgaaggacttggccgctgcacaaggcacatcgcgttaaaatttaaaacggatgtacagccgaaaagatgcaagcctcgtcccgtgccattcgcgttgcgttccgaggtggagaaggttataaaccaatgggaaaaggaaggagtcctcgagcctgtggcgacatctgaatgggcaactccgcttgtcattgtgccaaagcccggcaacaaaattcgtttgtgctgcgactataaggtcacagtcaatccgtgcctggacatccatcagtacccgctccctcgaccggaagaattgttcagcgctctcaataacggcgacaaattctcaaaattggacctgaaagaggcctatttgcagcttccgttggacgatcaggcgaaggaatgcctcacaatctgcacccataaagggctgtaccgattctcacgcatgccctacggagtggcatcggcaccagcgatattccagcaggtgatggaagaaattctctgcggaattgacggagtggcagtatatttggacgacatcgtcgtcactgctacaaacaatgccgaacatttgaagagattggatgcagttctccaaagacttcaaaaggcaggactacgagtaaaaaaggaaaaatgctcgttcatgcaagaaagcattgtctatctgggacacattatcgaccatcaaggaattcgaacttcgccagagaaggtggaagcgattcgaaaaatgccggcgccggaaaacttgaaagaattgcagtcgttttctcgggatggttggctattacgggaaaatcatcccttcattggcgacggcctcggaacctttgaatgaacttc

SEQ ID NO: 21966 - DNA, 2178 bp, Heterodera glycines
gggcatcgttccgcttgccactgacaatggcactgctgatcagcacagtttgttcacattgcccaacaatgtgcacctttacccggcaaatcattcgcttctgccggcatttcagtgaacggtgctgaccgtccggaaattgttattttggatgtgcaatcggttctttgcacggaaaagcatgacgatgctgccacgaattgagcagaatgaaaacagattgggatcgaagagaaaatatcatatgacaacatcgaacaatttgtgctataactagagagtccaattatatggaaatccatatttttttcctggactgtgggaggcctgaaacgcatgaaaaacatgtttttagctttgtttgaagcttctaggatggatttctatatccatatttttccaaatttcgcgatttatgtccatattttggcatttaagtccatatgttatgtccatattttggtatttttccaaaaaccccctattagaacggcccccatcgggtaaattggcctttttgaacccttaagaccgaagaaatttccgaaaaagacactttttcaaaatttgtcgaaaatattgattaaatttaaattttcttaaaaattggttaatttatgtcaaaaataagcaaaaaagggaaaatttcgcttttcaggttgattttccgctgaaattagtaaattttaagctgcatcgtgtttttttcttctaaaatgattttaatacaatattttgccatttttgaagggtttactttgcgtttacgaatttgaaaaaatttagagaaattataccctctatttgaaaaaaattatgtccatattttaccattttatggccatatttcgcgattttatatccatatttttggactccctagataaaacaaataaattcgcataataattttgccatttgtgaatttattaatcaacaacaaatctaactttcaacaatttaataattttagaggtcggaatggtgctgagtcgctatataaaaactaatgctgtccgagacctaaaatttcccgagaccgagactcgagagcgagacccaaagccccgagaccaaaaaaccccgagactttttcgaaaaaattttcttatgaagcggaactgatctaaagcaaaaatgaagaacataaccaggagcataacccactagcccacggatatgaattaaaaaagttaagcaaaaagttaacaaaaaattaattttagatttacaaaaaagccaagcattaggggtgtgaaaaagtctcggtctcgagtcacgaaaatcgagaccaagaccaaaaaaacccgatacttttctcgagtcgagactcgagactctcggacagcactaataaaaaccatcaataagggcgttatataaaaaagcatcaaatgaaaattttcaacaaaaaactgcccataacttttctcgaagtcaactaaattaaacattcttggtattattagatagccctgagttctctattagctcaccaaatttcaaaaaattgatcaagcttgaacaaagttatgacgcagtggagttgacccatagagttcattagttttattaaaagcataagtaaggaatttattattttcattaatttttagatagtaaaacattgattttggctccctgatgtttcgtcactgaaataaatttttaaaaattaaacactatgccatacactttataaatttttttagccaaaacccattaaatttgtgctaattggtatgaaatttcacttaacacaccattcagaaaatgagcttctgaaaggttttgacaaccaaattggaaaatcttggtatagtagcgcggccctgcgcggtggacgtgctggcgttgggactgggcaatttgggagggcagatggggaacattgggaaggaactcataaactcccgaaggaagggccccatgggatgatcaagcccagggatcccatcccgcctttgatggacacactgggataagtggctttattccggagagactgaagatacttcgcttgaaatggcgattctcagctgaatgttcccaattttgtctattttctgaattagagggaccagcaaaatctcgaggacaataccaacattcattttgaatggtgccctggtcgattggcaaattcgcagaagagccgagtctccctactcgtataat

SEQ ID NO: 21967 - DNA, 2222 bp, Heterodera glycines
gtccttctatcaatttgcaatattttagcagtttcttgtcactcatttttgggttttctctttttattttccaatattttttcattttttccattttttctttctccgttattctacagcgaatgccaaattgtttcttccatttaccaattgcgaattggcttactccaattttcttgccaatttcttcataattttgctcccattcctttgatgaatattttcttttttgcttatattcatttgtcatttcaataaatttctgtacaatttcaattttttgttcatcagtttttgatttgtaagaattcttttgattaagtcctaattccttaatacatttataaattttcattggatttgtctccaattttttcgctattttctgatcaattttgttccattcttttcttggatattttcttcctttttcctttattttctcttttattttgttgaatgttctaattatttctctttttttctgctcatttcgttgtttttcttctttttcttgccatttttctccaaatatttcatcaaatgacttttgttgcagctttttctcttctgatccaacttttgcaatttcaacaattaaaaacataaataaaaataaaaatagacacaatttcatatttcaatgataatgcttgacaaaattataaattcacaaaaaaaaattactaatttaataatttaacgaaataaattttatagaattaatattttttcgattaataggaaatgttttccaacgctaataattacgtattaaaaaattaaaagccttggatttattaccaaatctgcaggacaaaaatatgtaaaataggacaatttatgattaaatattacaaagattttcatttccttaggacaaacataaaaaacacaacacacatttaaaaaaaattagttatctttttaatatgttaatttttttacaaaatttaatcgaataaaaatatttcgtcatcagtgccgtctgatcattgctgatccggcagctgaaatcaatgccaatttgacgtgccaaatttcgcggcacttttaaatattttttgcgtaaaaaacaaactcgatgtttatctggcatatggcaacagcaaatttgtcgtagtgatctgtgtcaattaaaaaggtgtgtaatttaacttcattatgtaatttgggaacaattaattaattgcatgctaattgttacaaaatgccaaactcggccctgtatgtacccgagtatttgggcaaaaccgggtccaaaaagctgggttctctgcaaaaatttctcaaaatcgaatttgaaaattgtaatttgttcataattaaaaaataataatattttccgtcaaaaaaagatcaaaataaaacaaaaatatttagctaaaaaagatcaattatgaagcaaataatgttaaattttttattaaaaaataatcaatcaaaaatggagctctcattaatcacgaaatatggcaaattataggaatattagttataatatatattttttatttatattttatatgtcataaataaaaatattttaataaaataaatatcatcgtttttacataatatttttatttttatttcagatttagaagataatccatgaaattgactcataataataataataattttaggcaaagtatcattacaagaatgaaattgtgccaaataatggagctctcattaatcgcgaaatatggcaaattataggaatattagttataatatatattttttatttatattttatatgtcataaataaaaatattgtaataaaataaatatcatcgtttttacataatatttttatttttatttctgatttagaagataatccatgaaattgactcataataataataataataattttaggcaaagtatcattacaagaatgaaattgtgccaaatattcattttaattatatttttggtcgtcctaattaatattaattatattggatcagaaaagaaaaaattgcgacaaaaaacatttgatgaaatattcggagaaaaatgggaggaaagagaagaaaaacaacaaaatgaactcaaaaaacgagaaataattagaacattcaacaaaataaaagagaaaataaaggaaaaaggaagaaaatattcggcaaaagaatgggataaaattgaacagaaaatcgcgaaaaaattgggcacaaatcgccattatatttataaatggatcaaa

SEQ ID NO: 21968 - DNA, 1317 bp, Heterodera glycines
aaaaaattattttaatttaatttttttttgataaataatttttataagtttaaaattatttattttttttaattaatagaatttcatgtattttttttattaaaattgttagaaattttttcattttaattaatgaatttctaatcactgtgtatcaattatatttaaagattggtgtaaattaataataaaagaatttatgtaaaaaaataataattatcttttaataaagaatttcatattttttttaattgtttataaaaattaatttcatattaatttaaatattcaattattgtacatttcaaaattctctttttaattaataaaaggaataattaatttattttttaaaatttataataaattgcattcaatttttgtacctcttctaatcaatcacagttgtacctcttctaaacacttttgtacctcttctaacaattttgtacctcttctgatcacagtcaatttaagtgaattaaagctctaaaaatagagaaaaatcaggagaattttatgggttttatttagattttctttcatgaaactaaaaaaagttattccagaagttctggaaaaattcgaattttcagtaaaaaattcataactcggttctgaaaagatattttggaaaagtaaaataatataaaaatccgcaattttttgctctattttataaattttattttacatttttatcacttttttgaaaaaagttatagaaataaaagtgattttggggttcgggaccaaagggggtggacaggatttttgagtgaaaaaattttttcaaaaaaatattccaaaaatatgattttaggggttatttgggccgctgatcacgaatacgtgatcagatttcaattatgacatcgttaagccctcagaatccccgtgtgattggggattctgaggcatcattttgagggggggggggcgaagttcgaagccgggcggtgtacattatttttctaccatttttttcgtgtttttcaatttttattcatttaaaatattttttgagttaataaataaaaaattatatttaaattaatttttttttaatgaataaattttataagtttaaatgaattatttttttaattgatagaatttcatgtatgttttaaattaaatttgttaaaaaatattttcattttaatttaatgaatttactaattactgttgtacctcttccaatcactgttgtacctcttctaatcattgttgtacctcttttaatcgacttttgtacctcaaaatttaaataacgggcgctaagcgacggtccaaggccgcgaagcggcctaacaa

SEQ ID NO: 21969 - DNA, 629 bp, Heterodera glycines
tgcaattgagggggaaacgtgtggagtgttgggacggcttcagttcgaagtgcatggtcggctttgaaccttcgaaatgaattcgaattccctttggctttgctttttgcagcaatcgttggcttcgcccgactttgtgccggcgatgtgttcgaagtttcggtaaggcacggccaccagcgatggcgcagcagaggcaaaacgttggcggacaaaagccagcggtgggaacagcgcatgtcgacgatggacgtgctgtggaacgagccggtggtggtgaaggtgccgcgggtgcccccctattgtttaaatcgaagagaaaaagatattatgtttctcttcctgcttatggaaacgtacattggaaatgacatcatgttcgtgaatctgatgttaggttatttgcatttattaggtggagttccgtcaatattacgcatgaaagaatcaggcaataaaaaaagtgacgaatctacacattttgctacttacggccaccgatttgagtgccgttaatgttgaaattcgggtgaaccacccaggtaaaattatgaatgtaaaacaaatcaaatgagttgaattagaaaatttgatgacttgcccaataaatctatatttgccacaaaatc

SEQ ID NO: 21970 - DNA, 997 bp, Heterodera glycines
cccccccccccccccactttgccttttcctttgtcagtgcgtcgcatgttccttctcacccgcttcatcttctcacgcttcgcctgctttgataaattcgcaagaattgcgagttaaaaacacgcaaaatgagcagcaaaacgcactgcggacggcggaagcacttctgtcgcgggtcgagcgaattcggacggcgttggcacaattgagaagctcatcagaattcacagaattggtcactttcgaagcggcgatgctcaattgggaggcttttctgaaggtgaagtctttgcatgtcccaaaaacgaaggaatgaaatgccttcagttgaatcgcgcggctgtgatttgccaaatcgaatcggaagccaatggcacggcgcattcattcggcggcccattccgtcgtcagaacagcgcgtcggctgcttcaaggcaatgggagacagcaaccatctcgaaatatcaccgagacatttgatcaatgtttagaaatgaattgtcgaataaccaccgaacttcactttaccaactccaaaatggcacaatcgctggacccaaaagtccgtcgacggcgtccgatgggaccgatgaaagtgccggcaattggcagcagaatcggtcgttggccgaccaaatgtgtgaactttcattgtttcggtgcttaaattgcctttcaccgcttcagctctgaaattgacagtggcattgactctcttcgccaatatcattcgccgtttcatttcgccgcgactaatggcccacaaaagcatttttcggtgtttttcttgcaacggattaaaccttaaaccaattcaaaggatcggcgaaagtctttgggcgccgtcgtggaaatggcggcggtccctttgaccgatgggacgacggccagcggaaactcggaagttgacaaatgtttggcaattcatttggacagggcgcagcaggcgattagggtgaatcgttgcgaattgcgtgaaaacactcaaatgatatgg

SEQ ID NO: 21971 - DNA, 1900 bp, Heterodera glycines
  misc_feature (794)..(794): n is a, c, g, or t
tgattatttcaacattttttttttaatttccagaaacaatccaagtcaaagccatgacaagcattggatttttgtccaggaaatcaaggtccagatctatttccagtctttttcaaaatgtcgagttccaatctctttacttttatcgtcagcaattcgttgcaactgttcagcaacagatggttgttgaacaggttgctgtggtgcagacgcatctgcggcgaccggcggctttgacactgagacaattgctggaacaacatacatgattagtattttaattgcccaataaagaggtgaaaaattctgggaatttttttttttttactttttttgcattaatttttaccaggatcataagtgatgtcaacaacacttggctctttcggtggtgtctcttcacaaactgaaaagtgttcaatttggtccatttttaagacatacatttaagagacgggaccagaaaatctcggctttttttcgtgttcctggcaatggtaactaattgtggttcctaattaatttaataattgggcaacaatgtgcagcgccattgtcgggtctcccatttgattaactaaattttttttttggcacattcaaagattaggcaattattgaaaatttaggttaaacattcggaattggttgaaataaatgtcaaatttgcaaaaccatcgaacattttgaagcaaaacaacacaacccaagtaacaaaccgatcaaatccttgatgtcgctggccttgaagatgatgaaatcatacacttcagcgcgtgcctggcattttttanacggaaattcgtttaaattttcaagcccattaaaaaaaaaaattaatttttaccggcacgggcacaggcgcgggtctgtcctctgtgccaaatgaacgaactgaaacaaaagaaatgttggcaagagaatggcacataattaaaggcaattcattgtaaaccggcatatttgggcccaagtgggctaataggcctaaggacgcttcaattgcattttgtgagtctaattgacttttatgagtccaatcaattagccatcctcactcatccttgactttatgcaccataattttattgaacaagatcctggacagacgaggaacatatacatgattatcccaaggtccggaggacggacaaacttggactcgttttttttttggccaaatcgtatttcgcaattgcactttatgagtccagaaacatttttaagtccaatgaactgcaacagcagcaaccggaatcctacaactgtgcaagctcggaaagttgaaaaagtctgggacggctattggcaccatgccggaagaggattatcggaatccttccactttgagacaaatcattaagaatcaggttctattgcactttatgagtccaatcaactcaacccctgagtatctcattgtttggataattaccaaaaaagaatgactaattacacaattgtttgattatttctcgttttaatgattttaaaaatatcaattttttttggacatgaacaaagttattgtaaaaaaagtatgattaaattgattggactcataaaaaaaattgaatcgacatataaaatgccattattggactcataaagtgccattatggacttaaaaatgctattattgaacccataaagtgccatttgattttgtttttgttttaccttgtgataatgaaattgtcgattccaatgggtcaacttaaatttgatttaataaaaaaatgccattttcatatttattcatgcatttttgacagaaccttgataaagtgtgccttcatagcgaatgtcgagacgtgaaatcaaactgattttactgcctatgtaaaggcgtgacatttcaagaattatagggcaatttgacgattttttgacaacgata

SEQ ID NO: 21972 - DNA, 2161 bp, Heterodera glycines
ataattctaataacctaattccatagacttaaaatttaaaagaccgtatgtcgtttttttaatattacaatgccccaggtcaaggccaaacttaattgatgactcattttatgaatgaattaattgtctaattaattatccatttcaatcaaatttcagttccaactggtgtgttaacaattgaagaagtgaacagcgtgtatcagcattattcccatcaaaatttaagtgatgccactgggcttttcccattgaaatttccaacgcaccgacggaacaaaaacaaaggcacaattgagatggaaattgaaaaagtgtctgaatttgtgctggagcctgtgggaagtggccgatttagcgatgccatggacattgggggatttccatggaaaataatggcacaaatcagaacgaaaaacgaaagcaatgagaaatggttgggcttttgcctttccaacgatggccttgaaaatggtaaaaaaaagtctttttcataatctgtccgaatttaaattcaccaaaactaaatatgtataataaacgattatgcagacaaattagacaaagtgtaaacaataaaagaatgcaaaaataagggaaattgaaaatgtaggtgaaaagtacccaccctttcaacttaaataagtatcgtatttaaataaaatggtaattttattaaatatttatttattgtgcagaaaattggtcttgtaaaagttcggcaacacttcgaattgtttcacaaaagaatggcacggaggatttaattggaacattcaatgaccgcatttttaataaggaatggagcatttatggaaaatatttcattagttttgcggtgagtgggattcaaataaatttaataaacttcatattttgaaattaaaatttttaaaattttaaaaaagaaagtgacaaaaaattgaatagaattttttgaaattttttggttataactctttgtaaatttttttctagattttaaaaaattaaataaatataggatttgataggatatgtaatgcatcgcttaataccaatttttattaatttaactaaatttaagctaagttatggtttcttattagcaataaaattgaactaataataaatttaaatgtttctatcattgacacttttgtaactttggctcaccatgattttatattacataattgatttaaaattaaagttataatcggaaacattgctgattttcatgttaaaaaaattaattacaatatttgtcaaatttttgcatctccaaattcaaaattaaggaattgttggatccgggcaaaggattttacgacaaaagcgaggacaaagtaaaattggccattgatgtcattgtggatgagccaaaaacggagaaaagcatttccgatccgaacaaatccaacggcacactttcgacggaaattgaaaaactatcggaatttgctcgagaaatcgaaggaagtgaacgtaaaagtgaaactgctgtgtacataaagggaatgccatggaaaatattggcatatatcaaaatgaaaaatgaaagcactgagaaatggttgggctttttgcttttgtgcgatgcttctaaaaaaggtttgcttatcaaattatataatagaaataataattattttttgtataaaattggtgtaattaattattgaaaagactcatgtaaacattttaacataaaattagaagtgattttttaaaggaaatgagttaaaatataaatttgattattatttaatttgctttaaggtggaaattggagccgcaaatgttcgacaacacttcgaattgtatctcaaaaaaacggtgtggaggattttaagagagaatccagtgaaaaaagaatttttaacaatgcaaagccgagttggggttggaactatttcatttcttttgcggtgagtggaaattaattagttaatttacattttaatattgtaatggcaaattaaggaattaatggacccaagcaaagggttgtacaacaaagacgaggacagcgtcaccttggcaattgattttacatgtgaatagcgtaaacatttcgagatggattgaaaagtgaaaagaaggaaatcagcaggatgagaagagagtcttggagggcacagaaattttcttggtgcttaaattttatatttttttatgt

SEQ ID NO: 21973 - DNA, 1052 bp, Heterodera glycines
acgcgaaaaaagggaaaattaaaattaagaataaaattctatataattttttacttggcttttcactttattaaaaaaaattcgcccaggggaaaatgaaaagagcgaaacgcagcagcaacagcagaacattgcgcaatccatgcgaaggcttaagccagtgacgtggaaatgcaaagtcatttcgggaaggatttacgaacgaattgggcggggcgagggaacgtaaagccaaccggaaggattaagccgagggcattggcaaaatgaatttttgacaaattataaaaacgatatttgagttaaaaaagaatgcaaatcattaccgtaatggtacgcgttgttggagagcattaccagcgacgttggcatacggtagcgaagaaagaagccccgagccacaaaaaatgctgcttatgtatatcgtgtgccatcagagaaacagtgccaaagtgcgtgttggagagcagagaaagacacacagagagagagagagagagagagaagagagagagcgagagagagagagagaggaaaagagagagagagagagagcgagagagagagagaaaagaaatcatgaaaaagaaattgaagagtaagtcggagagagagaaatagagacttgaaaattgcagaggtatagaaagagaaagagaggcagagcgagagctagagattaattaaaatttgcaagattaagcacctccagtggtcggacaattccggaaaaagttgacgaagctgttcagggctcaattccggttcggtcagcgaaaactttggacgatttttctcctcaacgaccaatgcctgaattcaaaattggacaattacattcgacgttaacattttgagtatttttctgatcgctgatcattttcaaaaaaggcttcaaatctccgattttttgttttgttttttagttttataattgatgattgatcaattgtctgatcacttatgttcatttgtcagcaattgatttattgatcagtgattgttagcgatcagtttttcgcgatcggtgatttaccatcagtcagcaaact

SEQ ID NO: 21974 - DNA, 946 bp, Heterodera glycines
tgatatcgatcgatccattctgacaaataagtgatcatttgcgggactgacttttgcaacgctgaaacagcgatgctgccggaagtggtggtcaaatggcggcggagacaaaagcatcggctggtgcgaaggtgacaaaaggcaacagctggcgcaatggcgctgaatcggcgccgaagcgccggaggggtcgagcagttggacactgtctgaacaccaaacacgagactttggcgatgtgtcgcccgccaaatttttacgttttaacacaatttcgccgtttgccgctgcgcgtgccgtcgtcgtccgtcggccgccaccgctgtgaatgccttgcgcaacggcggagggccgaatttgcaaactctgcgcgaacgttgcggaccaagtggcggcggtcggcctctgctccgccaccaccgaggaggacgatttgctgaagccggcgcccaacaattcgtcctgcgaggaaatgccaaagcgatggggcggccaatgggcggaggaagagcacagcgaggaggtggaagggcctaaaattcgaaagctttttgaattgttgaaattcaaaatttgcctccgccttgcactgccagcgcgccgccgcgatgcttttccgcgtcggacgatgaatcatcgccggaggcgacagacgaggagcgcgaggcggagcggggcgataagcggcgccgcgggctgacgccgccgccgccggcggcggtgggcggcgagcgggcggaaccagtgctgaacgagctccgcggggaagggcctgtgaaaatgaaggaaagaatgaacgaaaaacattcatggattaccaattaaaattcattaccctaattagaattatacattaattaattaccctaattttatttgagtaccataattataattaagaaataagcatttcttcatcaccctaaatagaattaggaataaacat

SEQ ID NO: 21975 - DNA, 2430 bp, Heterodera glycines
  misc_feature (2417)..(2418): n is a, c, g, or t
accaatatatcgaaatcgttgtttagggtctaaaccacattttaataaaagaaaattaaacatgtatcggatcgggcagggcccggtaccggttttttaccggccccggaaaccggccctgcgatttttgaaaaaaaatccggtttaaccggtttataattttgccacaaattttccatttgctcattttcctttgaaaatgtctttttatggcataaagttcttatttttttgttacaatctgttgtgaaaacttgggcaaagtcaaagtcgaacgtaagaccccttcactgtctcctcccgtgcatacgtattattaaacgaaaagaaaaaacccgaaaatttttaactcatttcattcataattaaaaactgattttttgtaattttatttacctattttggaaaaatgtattcaaaaatttcgaatatagtaaaagaaattgcctaaagaagatttaaatttattcatttttatgcaaattttcatgctcacaaatcagatgaaaatgccaacaaaataaagaaggcaaatccggataactgtgtggatcggatgatagtgttgctgagcacggccaaaggcgccgatgcgcattttttggttggcaaaagtgacaaaaaagaggtgagcgagtgacattaattagtcaattaattattaaaagggaatatttttaggctctacaaacagccaaaataggctataaaatggaaaataagcgctaaaaacctcatttttaggggtgcaaaatgacataatgtattcaaaaaagtaaaaaaattaggcaaaatcaatattgaaataaataatttttaaatctaaaattctttcaagaaaaaataaaatttggaaatgaattttaataaatttttcatctttaggggttcttttttgaaaaaatttgggtcgattcttaggggtgaatttttcgtttttttattgcatttttattaataattttgggtaaaaggccaaaataggtcaaaatatgtttttctctaaattttgtagtttaacaatccaccaaaaaaaaaaacaagttttcgttgcatttcagtccatgatgaactcaagaataaataagcaaaacataaaaatatcatccctaatatggcacaattaaagaagcaattggttttggtaatgaattttttcagcttgttcatgctcataaaggcattcttatgatttcatccaatgtttttgaggcaatgtttcaaaaggaagcagaaaattcgaataaccgcacaacagacggaaagggtgggcaaaaaaaaaaagattttttttttttagaaattttgcctcaatgttttgcatgaatactaccgagtttttataaaaatattagtgattcaatgtgaaaactgctcttaattaatgcaaataaattggcttaaaaacttaatttttttttcatttattgaaaataaaattgaaatttaaattttcattttatcatcagttgtaaaggatggccctttgttgatttctgatgctgatgcagaagctttcaaagtgatgttgcgcttcatttattcggacgatttgagcgaattaaatggacaaaacgcagtcgaaattatttaaattttcatttcaattaaagttttaaaattggccctaaaattcaatgtttataaaatattaaatggaaattatctgcaaaaaaaagagaatacaatggccaattaattcatgttaattgttttttatgattattgaaagtgccaaatttctttttagattaaaccaaaaaggcgctacgaaagtaatttcggcaaaaaaggcgccgaaacaaaaagcagtcaatggcattggcaaattgcaattgtcgtggaaaggacactggcgagtgccaatcggtttggagcagagccaatcgacacggattgaattaattaaccattaaaaacaattaaacatagttagttgcccaatatttaatttttaaagtcgggcacctggtagagaaaaatgaacatcatgcaagcggatgtcatcttgcaaaagccacggacctcgagccgaattaggacaaaaagtcgaaaggcaacattttcgaattagcgtttttcgttcaaaaccggtttaaaaaatacactgaaacttctattgatgcattttccgggagcccatgaaattgataaaaaaaatgagtcacttaattttgtctccgtcagttaaagagtgaagaaattacaggccaaagacatttagacggaacaaaaagcaattaatatcagcaaagtatcaaataataacaaataataataatttaaatttaaacacaaattaaaattgcattaagttaatagggaaaaacgaacgaaaatgcaaaattttatttcgcttttgcttcactttttattgttttgctgctaattttgtgtacattctctctcatggaaanntgtggtagagaa

SEQ ID NO: 21976 - DNA, 1911 bp, Heterodera glycines
  misc_feature (1847)..(1847): n is a, c, g, or t
tccaatcatgggcgacgacacggccacagccgacaaaaggctgggcaccagtggacggcgtgttcctcttgtcaaaatggagcatgaccgaaacatgcaccgggatcgatcgtcatgcaaactgcagtccggttatggcgtcctatttgagcgacggcctagctcaaatctacataccaacgctgctccaccttcttctggcccaaatcctgctggaatacagcgaacgatgggatgcgatatcagacgccatctacacgctgacgacctccggcctgagccctgcggatctcatccaagcagccatcgcccaaaaaccactcatcggctacggctactccatgggcaaaaaatggacaagaggaatacctaatccagcaaagtggcatgcccacctcgaatggcacaacatacggcaacgtggctcgagtacgaagatgggttctgctccctggccttggcaaaaggcggaaagggcaaagtcctagtcatgccattcgcggaatccgatgtctcggaccagggatttctcacggaatccggagtgtccaaaacagtggacgaattggagcgcatacttcgaggcaaaaaagaagaagcgtccagcagccttgacatccgactacagcgatttgtcgaagcaaggacccaccaagcagatgaggtaaacacaaacatgctcgatgtcgacacgtcaaagccaatggtggtgttagcagcatgcacatcggcagcgcaacatccgattgaacaccaggaagaagtccatatcgcaatgcctcaagcggaagaagtcccttggacttggggaacgaagcactattttgtgaacgacgtcaaaatcagcgcaacaaaaatgcgggagctggacgaagcactggaagcactgattctgtcccaagtgccaccacctgaagaaagggagctaaagcagctgaccttcgaggccgtcaaacgcattctgcgcagggacacatgggaagacttcgaaatgcgcatcgccggttctacaagggcaaacacggccctcagaaatggagacttggacatcatcctgatgcccaagtccggcgagccattgagccatgagcgaaagctccgcgagctcaaattcttggtaagggaattccgcctgatgaagcgccaatacccttaccgccactgtgtcgccatcaccaaaacgaaggcaccattgatcaaaatcagaacttcggaggacgtcgacattgacatcacaatggacaacaccgaagctttgagaaacagcaattggctagccgagcagacgaacgacagcaaattgtggcggctctatatgaccgtaaagatctttgccaaacataacggcattggcgatgcgagttgcggcggcctcaactccttggcatgggcagttctgacaacgcatttcgccgcctcacggggacaggagcgttgtgaaacgccactgctcgacttcttgcagatggcggagtacttctccgagttccccttcgagggctacaccatcaccaccacgggatggcgggagcggaaatcgtcgtctgtgcccatctacgtcgaggacccgcacaatagagaggacaattgcgccaggaaccgacaagcgcaagacgtctgccgggtcaaaaacaagctgacgcaggcatggagtcagttcatccgaaagaaggacaaatgccgactcgccgacctcggctttccatgtccgagggacgaagacgtcggctggccatcagcgaggggtcagacatctggccaagagcagatggacttcggcgaaaaggagtcggaccactcggacttcgactcggacgaattggtcttcgaagggccaaaggaagaanaatcaaacagcgaaagaacccagggaggctggcccgaaaacttcccacggcaacatcacgacag

SEQ ID NO: 21977 - DNA, 1604 bp, Heterodera glycines
aaatttggctattttttggaaaaactctgtgcactgcactcaaaatttttttgcttcggcgtatatgggcgcccctatggaccaggtctgtacgcaataacggattacggattgcggattacggaaattacggggttttgggagttacggattacggattacgggttacggatttttgggatttttccgtaattttgatccgtaatttgacttttggattattttttcgagacgatttcttgtaagattatttttataaaaaacaaatttttctatttttttatttaaagggctacccgtatttcgatttatttaagaattaaaatagatttataattttttatttgttgttgttaaggctatttgggtagttcgcctagaaaattttgggatctgtcaaaagactcccaccgtattgggcgtatagctacagaatggcacaactttttaattataaaaaaattttactaattgggaattacaaacatattaatttgatttcagcagagtcattcctataagataatggaatttgtttaattcgtttttcctttttgttgaaaggaatgaatttaatgatgcttttcagaaaattactatagttaatttctaaaaattcacacttaaacagtttagaattgcttaaatataataatataaacgcagtttctcattataggtctttaattcatcatcaaaatataccgcccgaatttctagagagaagcttcagagttttccaaaaaatatgctggtacccaaccacaggcactaaaagaatctttttacaacggcatttcatttttcccacgaataattggcaataagaaagaatttccaatgttttttggcacaccttggcaaataataaatatgcaaaggttttataattttcttattaaaataattaattatataatggaatttgtttaattcgttttcctttttgttgaaaggaatgaatttaatgatgatttcagaaaattaatagggtttatttctaaaaattcacacttaaacagttttgaatcgcttaaatataataatataaacgcagtttctcatgagactcaaatctccggcattctaaacactgggactcaacccaccaacatttcaatcaccaggactcaacccaccagcattccaatcactgggactcaacccaccagcatttcaatcactggcactcaattctcctgcatttcaatcactgggacaacccaccaacatttcaatcactgggactcaacccaccaacatttcaatcaccaggactcaacccaccagcatttcaatcacttgcactcaacccaccagcatttcaatcactggcactcaattctcctgcatttcaattactgggactcaacccaccagcatttcaatcaccaggactcaacccaccagcatttcaatcacttgcactcaacccaccagcatttcaatcactggcactcaattctcctgcatttcaatcactggaacaacccaccaacatttcaatcaccaggactcaacccaccagcatttcaatcacttgcactcaacccaccagcatttcaatcactggcactcaattctcctgcatttcaatcactggg

SEQ ID NO: 21978 - DNA, 964 bp, Heterodera glycines
  misc_feature (859)..(860): n is a, c, g, or t
  misc_feature (945)..(945): n is a, c, g, or t
tcagggcttgaaacaaaaaaacaattattaacccgatttttgacataggcgcaaatgatgggaccacaaaagtcgggcaagttacggactgaccctggcggaatgcgcagaaggagaaacctcaaaatttgatatgcttttcaatggatattttaataattattttgttttctcgtttgtattttattttttccatgaataaattcttttgtttatttgaaaacatgtatcaatcaggaatattgggtgggctgggatccccattctaatcctgaattttggcatgagacattgagaaaaattgtcgaaaataatttttgaaaattttttaactggtgtgaggatttttagttttctaattattttttctttgattttgattcgataagaaattcactaaaaaaacatttttgagcggaaattcctttaaagcgtgccgcaaaaagcgattcttggaattaaaaaaacatcgaattacatggctgaccacattcacaaatttggaaatatggccgctgacccaatcaataatgggaagtgaaaaacacggtatttacatttttcattttaagcaatttggaaaaaattaattcctggtggtaaatctggtttttgccattgcagttcagaattagaaaattttttggtgtcatcctgttttatagtaacaaaatcttaaaggaatgttattgatcactttgactgcagaattaatattaattatagtaacaagaaatatattgtaattatttttccgttgattactgaataataaatacttgaaaaaaggcatatgtatgtcgggaccatttcgtcactcccactcattcaatcgccttcacgcacaccattctcctannatggcgatgttcaacatctttaaaccttttaacgaagaacaaagttttaatggcactgattaacccaaataatgataatatattncaataaattaaataatttt

SEQ ID NO: 21979 - DNA, 811 bp, Heterodera glycines
ggcttgaattatatggaaatccatatttttttcctgtactatgggaggcctgaaacgcacgaaaaaacatgtttttaacttagtttgaagcctctaggacttatttctataaccgttttttccatatttcgcgatttatctccacatttccaatttttccatattttggcatttttatccatattttatgcccatattttggcatttttacccatactttatgcccatattttggaatttttcaaagaaacctctaatagaacggccccaacaaaattggcctttttgacctcaaaaactggaaaattaattttcctaaaaaaatcattttttcgaaaaaatttcctcgagaaaattgaataaattaaaattatctttgaaattgataatatatttcaaaaataaacaaaaaagctaaaatttcgcgatgcgctgatgggggaaattgaggaaagggctgggggaagggagagaaagatcgaatgccgagggaaggtggccactaccgctcggttggtgagttcgaaaacctatgtcccaccccccaaaaccaattcctgactccaaactttatttccttcgatggataaaggtataaaatggaataaaaaatggagaaaagataaatgagtggaaatgaatgaataaaaagtgtaaaatgttgatcgttaaatatccgtttgaattggcggagccaagtgagagagagagatataattaagtctataaatggagagaatagagaaaaggagtaattgcgatttaaatagaatgataaatggataattgacgtaaatgaatatgccttaca

SEQ ID NO: 21980 - DNA, 955 bp, Heterodera glycines
acctaaaataaacaaaaaatgccaaaaccatcacagagagtttcaatttggaaaattctcgctgaccaaatgcctcttttattcaatttgatcaaatgtcccttttttattcactttgatcaaatgtccctattactttgatcaaatatcccttgttttattttcactttgatcaaatgtcccttttttattcactttgatcaaatgtccctattactttgatcaaatatcccttgttttattttcactttgatcaaatgtcccttgttttattttcactttgatcaaatgtcccttttttattcactttgatcaaatgtcccttttttattcactttgatcaaatgtcccttttttattcactttgatcaactatcccttgttttattttcactttgatcaaatgtcccttttttattaactttgatcaaatgtcccttttttattcactttgatcaaatgtccatattactttgatcaatatccattgttttatattcactttgatcaaatgtccctattactttgatcaaatatcccttgttttattttcactttgatcaaatgtcccttttttagtaactttgatcaaatgtcccttttttattcactttgatcaaatgtccctattactttgatcaaatatccattgttttattttcactttgatcaaatgtccctttattattcactttgatcaaatgtcccttttttattcactttgatcaaatgtccctattactttgatcaaatatccattgttttattttcactttgatcaaatgtccctttattattcactttgatcaaatgtcccttttttattcactttgatcaaatgtccctattactttgatcaaatatccattgttttattttcactttgatcaaatgtcccttttttagtaactttgatcaagggtccctttttttattcactttgatcaaatgtccc

SEQ ID NO: 21981 - DNA, 912 bp, Heterodera glycines
gggcggattgatgcgtagcacctgcgaggggagtcgtcagtcccccgaccgtcggtcgtatagcaactctccgctttacctgggtcctcctcccacacgactttgtccaccgtctcgtggagttcgggcgcttcaaatcggatccatcgctccgtgtacattggcaaaatgtctttgcgtcgcaccacctcttttccctcacggcgccggtcgttcagtccgatctccaggaaggaagtgccgctgagaaaggccaaacagaacagacggacgcgggcgcgctgattgctcacattgccctctttgtccaccgaagcctcgtactcgtcgtagcaatgaatctgcatgcaaatgtacgacattcaaagtgccattcccgtactaaatgtccattgccgactaattactctctgtccctcccttttcaaagtgtcaatttttcccgtcgtaaactcttgaccagcgtgtctattctcgactattgctcattcactctcgctttgtcctccgttcttttttttcacctgcacttcgtcctgtttgtaagtcggcgccgtctcgcgctttgccggacaatggaacagcacattttccaatgcgtcagtgaaactggcgatggtccgttcgttcaatgacccgaacttggccagcactgtgcactgggccgcgtgctcaagaggaaggccatatttggtcagatggccttcgacgaggcgcgaaatttggccggggcgaatgccaatgcgttctttgtacagaatgtgttgcaattttacggtgtgaattttggtgaaaacgtcgtacggttgcagcacaatgtccgacagcgaataattggcctgaatttggcacaacggaagtgatcggtgaacaaacatagcatataaattcattggtcgtgaacccaattag

SEQ ID NO: 21982 - DNA, 1995 bp, Heterodera glycines
atgcgatggggcgagacagagcgtatgcgctgagacccgaaagatggtgactatttcctgagcaggatgaagccagaggaaactctggtggaagtccgaagcgattctgacgtgcaaatcgatcgtctgacttgggtataggggcgaaagactaatcgaaccatctagtagctggtccctccgaagtttcccccaggatagctggagctcgttaagcagttatactcggtaaagcgaatgattagaggacttggggacgaaatgtccttaacctattctcaaactctaaatgggtatgaagccagggttgcttgactctgaacccaggcgttgaatgtttgagctccaagtgggccatttttggtaagcagaactggcgatgtgggatgaaccaaacgtggagttaaggtgccaaagtgcccgctcattagaccccataaaaggtgttggttgatatagacagcaggacggtggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtggtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtgggtcagccgatcctaaggcaccggctaacgccgtaacacactacggatgacgacttttctgtgcttgcgcagttggtccatccggttgccgaaagggaagtgggttaacattcccacgccaggctagggaaatgacggttcgcaagagctgttttgcgcggtaacgcaaatgaactcgcagacgtcgtgtggagtccgagccagagttctcttttctggtttagggtgtgcgtgcctggaagtggctcagcctgagatagggatgttgcgcccgtaaagcaccgcggttccctgtgtgtctcgtgcgctccacacggcccttgaaaatgcgagggaagctatttgaatctcctgcctgatcgtaccgatatccgcagcaggtctccaaggtgaacagcctctagtcgatagaataatgtaggtaagggaagtcggcaaattagattcgtaacttcgggaaaagaattggctctaaaggtcgggtcagccgggctgttgcgtgaaacaggcggcttttgcccgtggctgcgtgctgttctttcggggatggtgcgtggactagtggtgagagctgcttgtggagcgcttcagctgcgtgtatgctcgtcagggtatgcacttcggttggcgctgaacgaccagtttagaactggcacgaactcggggaatccgactgtctaattaaaacagaggagacggatggtccttgtggacgttgaccgtgtctgatttctgcccagtgctctgaatgttaagccaaggaaacttgattaagcgcgggtaaacggcgggagtaactatgactctcttaaggtagccaaatgcctcgtcggctaactaccgacgcgcacgaatggatcaacgagattcccactgtccctatctactatctagcgaaaccacagccaagggaacgggcttggcaaatttagcggggaaagaagaccctgttgagcttgactctagtctgactttgtgaagaatcatgagaggtgtagcataagtgggagccgcaaggcgccagtgaaataccactactttcatcgattccttacttaatcggtaaaacgggagtgcgcccgaaagggtgtccattttggtgttaagtcgggccacccggtggcccggcgacccgcgccgatgacagtgtcaggcggggagtttgactggggcggtacatctgtcaaagcgtaacgcaggtgtcctaaggcgagctcag

SEQ ID NO: 21983 - DNA, 2234 bp, Heterodera glycines
aatgaaagtgaggaagcagaagcggcgaaatccaaacgtggtcttccgggactcattcaatttaatgccctgctcattggcagctctgatcccatcctacggccttgacgtcgaggacaaaccattcttcccccatttggccaaccgaccggagaattatggtagagcgattcatccaactcctgaggactatttggccaatgggatgatgccaggcaaaaggcggcaattcgacatgtggtatgagcagcaccgtgaggaggcatttgttttggatgaggcattagcaaggcacaaatttttaatatttttttcaatttttattttattttgttcagctattgcaccaacgacgttgaaattctgatggccgcactcgtcgcattccgtcgggaattcttcgaaataacgcgacgacaggagtatgtggaagggattgacgaccgcgagaaccatgacggaatagatgctctgcgtgaatgcatgacaattgcgggtgcctgcatgcgccatttccgtacaaaccatctgccagctgagcatctggcaattgtacccgagcgcgggtatgacaacgcgcagaatcaaagtctcctggcacttcgcttcttctactggtactcggaggagtacgatgtagaagtgcaaaccgcacactctgccggcggagaaaagcggattggtccctattccttggacggatggattgaggcggagggtcgagcaattgaagtcaatggtaggctttaatttgttcaaatttgaaaatcatgactttaaggttgtacatggcacggctgtaaaaaatgttaccccaacgacaacatggtacttcccagtggaaaaacggcagggcaaatacgggaacgtgatggtaaacgaatggaatacctaagcgcacgggtcaatcgcatagacgtgttttgggagtgtaaaattgacgagatgttggcgagaagcaaagcgatgcgtaaatgttttgctaactacgtggacgacggacctctggtgatacgcgacgctttcatgggagggcggacggggccaatgaagctgtatcacaaggcggccaggggcgaaaaaatttcttattacgattttacttctctgtacccctatgtgaagtgagttttttattattaaataaaacataaatatttaaaactttagcttcaccacccgttatccgattggacacccaaaagtccatgttttcaaccaacaagtggtgtggaccaaagagtacccgaccggcggtgtggacgacgactaccactgccaacacaatgatcaacagcgaggttgggtcagcacctgcacgtccatcgagctgaacgctgcgctggacgagggctatcgcgtcacccgtctgttccgtgtgttggaatatgaggacagtgacgaccaacttttccgcccgtacatcgcagagttcatggcgcaaaagatccaggccagcggatttgacaacgaaatcaaagggaatgccgccatggaggaacagtttgtgcgagagtgtgcggaaatgtttggcatcaacgtggacccaaccaagatggcgataaacaagggaaaacgttccatcgcaaagttgcgcttgaataacttatgtaagccatttgtttttcaatggattttaaattttaaatttaggggggcgcttttcattgcgaaactttggactttgtcagactctgattacggacagtcctgttgtgcttgccgaatatctggacaacaaatccgttgaagtcgcgtcaattgatcagctggatgagaagcacatcctcatcagctatcagcacaagaaggactgggtggatgagcatgcctgctcaaacattggtgagaattttctttaaatattaccgtaatcaaaaaaaaactacagtaatatctttgtggacaacttccacggcgcgacttgtcttgttgaaggcaatgcaaaaagtagtcaggtcggaacggtgcgagctactgtacacaggtaattgaaaaaaaatattgtttaataatatttttaaattttagacaccgatagtctcgtccttgtccacccggaggggcgttgccctctcaaaactggcccacacctgggccagttcacggatgagtaccccgatcacgacatcgttgagtactgcagcggcggatgaaaacaggtaaatttacacgtttttcaaactgtcataaacgcacaaattaagtatggtctgtgtctgcggcgtaagggg

SEQ ID NO: 21984 - DNA, 2477 bp, Heterodera glycines
  misc_feature (49)..(49): n is a, c, g, or t
  misc_feature (168)..(168): n is a, c, g, or t
tcatcagaatcatcttaattttcccccagtgatttgtgagtgataaganaatagaagaaattcagggattaattcctgaggaatttccaaggaccacgtgcatcattgctacaacggtgcccttaatggctttttaatgtcaaaatgcccgacactagcgcatttctntagacaacgaaaattaattcctgaggaatttcccaaagccatgcgcagctttgttagaccgatgccgaaatggcaatataattggaaaaggacagacaacaatgcttttctttatatcagctgatggtttacaaaaatcgaaatacttcctgagtactttccaaggttcggcaaattccaaattttgttcaagttcgggttggtcaacttgaccttcaagaaaatggtcaatctgctcgggattttcttggcaatttttcggacacagtttggtggtaaatgtttaaatttttgacaatcgaaaaattcaattttaaaattttgtatcccttttctgattggacttattatttaatcaccggtttgttttaaatatttatcacaaaataaatcacaatttgtcaacaatggatcacagatcacaaaaaattatcactgttgtccgactgcggaagtggttgctcccgaattgtccacttcttttgtgcctgtcggcaaaccaaatgttttgcggatgaatgtggccgtccgctcttgcgcagttaggaaccgtctttgatgcagaaggttgttctgcagtttctgtgcgcagatgacggtcttttcgcgtgcggctctagtcgcgtaggttgtcgattggactgtttgagcaattcgtcaaggattttcctattgaaatcttccgcgcgaatcgctttcgcgaccgattctaagatattatttgtttggagttcgaccgatcggatttttctttcctcttgctttttgcactccttgactgcgttcgcccaaatttctgttcgctcgtattcgagcgttgtcaatttctccaaaaaacagttgtcaatttcgggggcgaaattgctgtggaaattcggttggtccggggttgtctcccggattgagttgaactttttgatcgcgtttgtcgtttggaggaggtccgcgttttggttggtttttacggtttgttccacacagccaattgcttttttcagttgtttggtttggactttgatttcggatgctttcagttttgccagtaatttttgggtctcaggcgagagggtgaccgggtcggatttttcagaggtggggtggacccaaggaattggacttcggtttgctccgaaggcgaatgagtgcgaatgactaaaaattggatatcggtacgatcagaaatctttgatcacttttcttcggtggtgtcttttccttcttttcttcttcttcaacttcgtttgggtttgtcggtgcgcgagatgccgatcgggttgttcttttcactgaatgaaatgtgtattgattgatttgtaatgggatttttgggtgtgtttgtcgggttttgatcttgagaaaaattgactgttttgtgtgagatttggtggggttttcctttaaaattttgaatttttgagtgtgtggattggttaccctttgtagcaaaaaattttttgaagtttttttttaagttttctcacgtttgaagttgggctgcggcacgaagagttttcgctgtttcagtagtttgacgatttgttgtcgaatgccgggtcgttgttgtgcgcagggcttcttcccgggtcgtcgtgcaccactttgtcctttccgcaatcggtgatggacaaatgggggggggacgagatgaaaagggagattcgctgagttagcttgggattgacatgctttggactgagatgatgagtaatgaatgagaccaaacctaattggatatacctaatacattagaatggactgaatttcatagtaaaattaattaaattatttttcatttactcacaccggttcaattttggcctcccagttccaaaaagatttgcatgtgtggcgaagtggtttttgtaagatagtaaagggacaaagggtggtggttcgagtccgttgtgcaacatgaatatttttatttatttttgtccaaaatattaaaaaatgacgaattttgggaattatttttgaagctttttgccaaccaaattggataatcttggtatctttcgaacgctcttgatgaggagaagctttttctaagcaaattctaagcaatttgatgaatcagaaaaaagataagagcgttcgaaaatctaaattaacaatttagcaatgttctaggccgaaattcttaaccaaatcactgaaattttgttaattttctttttctctatcggtgtgcaaaatttgaagaagatttaacatcagagaaaaaagttaaatgtcacgaagtgaattcggtttttctctattaacagagataaggaaatagtacgccaaaaagagagatttttttctct

SEQ ID NO: 21985 - DNA, 2350 bp, Heterodera glycines
  misc_feature (8)..(8): n is a, c, g, or t
ttcttttntaatcattttgttttaaattttaccttccccaacggtggccttggacacttagttttgtgaaaaaacgttccccagtttttttagattggtcaagttaaacggcaccctcaaatgacgattatgtggaacagcgatgatgaaactgacaggggaagaagcaatggaaaaagcctaagggaggggaaaacaaattaatgaaaatcaattaaataaactgcttaaacaacacctctttggccctttgaacttgtgtttcaatttgcctaagaatcaatgcgtaaatggcactttgtacaaatgcaaattcgtacaattagccgcgtttcgtacaaaagcatttcaaataaatttgaaaaaagctaacctatttttggcttttttctaaatgctttaaatattatattaaacgcttttttgtacgaaatgccattgtatgaatttctttaaacgaactgccattgatttggacaatagcaatgaaacatttttcggaacgccgccgggacgaggcgtaaacaaccatttagccactgcttgccctatcgaaagagcaccggtgccatcatggacaggcaattcaataaaattgccatcgctgtataaatatcggagagatttgcattcgttcagatcggttgggacaaattgtcccaaatctttggagtgttttgatgagaaccaccgcactgtgcaaacgttgtctttgatcattggccaagcattgcgaatagtgaaatccgaaatttggccatttttcgtatcaattgacaaatttgtgccgaaaaaacgctgaaaatggcacagaaatgccatcacattttggtcaatgtacctggaatttgaagacatattcatttatgagctgctaaaattactgaatccgtaagtgtttgaatccgacgactttgttgggcaacggattttgtgggattggcagcgattgcctacgaaaattggaaatttccatttccgcagtgccattctcgccaattttctgacgaattacaatttctcccaatgaccatttgcgcgttttgaagtgttcgtccacaaaacggtcaaatcggtggctgagcaatgcaattccgaggccaagctgacggggtgagagcaaacggaacaccgccagccaatcgtcggcacaaattggacttggagaggaaaatgattaaacgaaatcccataaaattgctttgaattaatgtcttgggctaggcctagctctaagctttaggctcaagcttaggctttattgcgttttgtaattaaatttacgtttattttttcataattgcttttaattatcgtacaatgccttaggctatgcctaggctttaagcttagccctaagctttaggcttaagcttaggctttattctgtaaattttattattataattaaatttacgtttccttttctatttgcttgttcgcttcttttccgttgtccgacatttttttgtccgttgtgtgaatttaggacgcttcttcttggaattaggttcaataaggctgttaaaaaggatatactgtataaaatttgttttaattcttttaattggcgatatgtttttaaaaaatggcgtttttctctctctttttctctgctcaagtgaagacagagagagaaaaaaatttcatttatcatttttagtttgtctacaagattcttcgcgaacaaagattcaaaattaaaaaatagtactgaaattaggtagttgtaaaaagtattgcaatttgcagtaaaagcaaacttcaaattattttcatcacttttttattttgtctatctaagtgaacaaacaaaaaagacgctattttcgtcctccagcattaatggattattaaattttcaaatgataaacatagataaatcttaattagtattctatacttattttttcgatttttgcattttattcaattcttgtgattgttccacgtacacgaaaaacagcaaaatttttctatggcttctgccgtggtaaagcatccgcttgttttgtgggcacaacgttcgcccaacctttacttggcggtcgaagtgggcgacatgaaaattgaggagttgaccattgaccaagacaaattcaaaataaagtaatgagtttgctggacacatttaaattagggtgcttgccgcaaaaaattccgagtagggatcaaaaaccgaaggggtaatttctgcaaaaacgaaaaaaaaagtagagtaaagaacaaatgggtccacttcgattttttgtcgaccaccacaactctaataagggatcggggggtttttcatgacatcccaatatagtaaatgtttattttcttgacaaattgctcaacttaattgttg

SEQ ID NO: 21986 - DNA, 1136 bp, Heterodera glycines
tttatttttgctttaccatgaaaattatatgacacaaattgacatgaaaaccctaattggacggaaaaaactttttttcttttaaacatattttgagatatttgaatttgaaatacattataaaaattcatttttttgaaaatgtccttaaaccggttttttcaaaaagataccaaaaatcaattttatcctaaacctaattaggtaaccttgtttttattcacttgtccaaaaaatatttaaaattttttatttaggtatgtaatacttacattggggttttgagtatttttcttacatatttcatgattttttttcattcatattttatgtatatattttgtgtattttcttacatataattcccatcaaaaaaatacaagttagaaataatatttttaaaatcataaaataaaatgcatttaatacaaatggaatggaatcatttgcggaaaatcacactgaaaagcacagtgtcatcgcgaatcagaaaggcacagaacggacggtcggcgacaaaacggtattctttgctcgaacaacactccacttcttcttctgtgactgccgcagcgacagtgccctcctcattcacctaaatttcgttgtttaaattagttttttttttgagaattgagctaaaactggtcaaaaatatataaattttctttggaccggctggtgacttttttttattttgcaattcgatggtggcaaatttgtataaatggaatccacaaaaataagggcactaattgtgggcaatcaccgtacctcaatgaccgccttctgcaccacttcgctgagcagcaacgttttcttgccggaaatgccctcaaaattggcgctgttggtgaatgcggtgggcatgcccatgttggtcaacggtttgttcaatccgtgcgtggcctccaatttgaacttgggcaacaccacctgggaaaagaaggggctcggctgggatagggaccaacaatttctccctttttcattctcattccctcatggaaaggatcacagattagggccgactgctgagagttacagaaaaaatatacaaaaatataatcatggtaaatattcgttgataaattggcagacggtttagaggtaaaacaaggaaaaaatcatttcat

SEQ ID NO: 21987 - DNA, 1788 bp, Heterodera glycines
  misc_feature (630)..(630): n is a, c, g, or t
cgggaattcccggtcatccgaggtcccggtcccggattttgaaaagctcaggtcccggtctcatattttttaattgatatatttttatgattttttatatgaaaatccgaccaaattgagcctaataataccaaaatttttgttgaaaatctgttatcaaatctcactcaaattttcaaaatttccccccgcggcggtgactatcggcaccgccggaccacctttttcccaaaagttttctggaaaaagtgcgcgaaaaaagtgatatgaaaagcaacgaccatttagcccaaatgattaattgcttgaaataattgaagaaattttgatttgaaaattttctttaatttaatttagttttaacttttggattttattaaataaaaaataatataatttaattttgtattattttcacttgaaataaattaaaatttgaaaaccgggaaccgggaaaaacaagcactggtaagaatgggggtctgagtggaaaattagtaatgaaaattagagtcaaaggaaaaaatattaaaaaaatgattaaaaatattctttaagcgtgtcgcaactaattgttcaaatgcactagtggctagtccccttgacttttgtcttcttctttcccctggnttcatccctctacggaaattaaaatattttgaattttctttttgtatactcatggttttcctatcgacaaaatatgatttctcatattttttttgtttatatatattttattattttttaaaatgaaaatacgtacaaattgagcctaataaatccaaaaaacctgcctttttgttgataatctgttaacaaattggactcaaattttcaaatttttccccggcggcacctatcggcaccgccggtctcccctttctccacaaaagttttttggaaaaagcgcgccaaaaaaatgatcagaaaagtaatataaatttataataatattcgatcatttagtccaaaatgattattttaaaaaataatttaaataaattattttgaaaattttcattaatttaattatgctttaacttttggattttattaaataaaaaacaaaataaaaatttaatttagtattattttcaattgaaataaattagagatcgacattttgaaaaatgcctggacctggacctggacctggattccatgttggacctggacctggatttcctggacaaaaatccaggaaaatccaggtccaggaaaaatccaggctcctcgagacctggatccaggcctggacctggatttttttaaactcattttaaaaatcaaaaaaatgtttgaaaaattcaattaattgcttgggaacatctaaaaatatctaatttacaataataatttgtttttaaatatatttaatcattttttgaaaacttgaaaaaatatcggtcacttgaaataataaattctaaaattttgtccaggaaaatccaggtttttcgtgttttgcttggctttaatatgagtataaaaagattaaaattggttttttacattaaaaatgggacattacttattttgtcaccatgtaaaaaaataatttaatttatttgtttttacaaaactttgtcagtcacataactcggcattcatgcttatttagaagaaataaaaaacacttttcttatgaatccataggtactgtatctacccaccaaattttcattcggaaaccccacggacacccggggaccttcctttgttagtacctcgatagctttgtggtttcctttgttaactcataaattttaaattcattaagttata

SEQ ID NO: 21988 - DNA, 1364 bp, Heterodera glycines
aaatgtgggggggggggtcagagattaaaatttcccatctttcccaatgccttttcgttttccctaaatttgcttaaaatccgcatgtgaagttgatcattttccttgtccaactatgggaaagactgctccaacaaaaagaaatgtactcacttaacacaaatccgtcaattgttcgtccgtccattttcgaaattgcattttccgcttcgccgttcctcgcaaattcgataaatgcaattctctttgtttgcagcacatccatttttcgaattgtgccaaatttgcgaaatatgtcgaacaaattgttagaatcgattcgcggcgataagttaccaagaaatattttcgtttctctaaaaaaatataaaaaaggtttaaattggtaaagggttagggtataaatcacccgaattcgtttcttacgacgtcctcaaatggtcgattaaaagaaaaacgcgacgacctttggtgattttcttttccagcgttaacaaagactgcatttgatttattttcgtacggaaaagttcgaacattgttgaactaaataaaaaaatatccattgaaatattaaaaaatgccatagtttttgttcccccatttttgtttcctactctttgctgttgtttgccaatttcctgcatggaatgacggctgaaagaagtccgaagagtagggtgatgagaacggtccgtcggagaaaagtcattgaaatttttgcgactaatttcgggcgaaggagcccggcgatgtcgccgaattggaggagaccgatctaacaattgaatcgccattaacccaattccacccaaatggaccccaccagtgttaaaatcgaggcttctcatcggtcccatcgaccgacttcgcaacagcgccgaagtggggacggtcaaatcaaaacggacgcgttttctcgcccttctgtcgctgtgctgcttcacttctctgacatcgctgccgtcatcttcgtccctttctgcgaattttcattttatttaaagaagtgtggcaattacaaccttctagaacgtcgtccgacacttgctcagtgttcccgtccgtgtcaacgccatcttgccgaaaagacttaattagtaatccgtgtttatttaaaacagattggaaagttgcctcgagcctttgaaggccttcggaagtgggcacaatccaacggccggggccaacgacctaaacgatgccgaaatggacaatggcacccgccccactaacattggccagttttttctgcattaatttgctcaatgtttccgggattgtgtcgtaattgcccaactccaaaagtgccatttgcgaaatgagctttgcttctgacaatccgcccttgggattttcaattt

SEQ ID NO: 21989 - DNA, 643 bp, Heterodera glycines
tgtatttggaccaaattcggaaggacgacgtggtcggatttaaatgattcacctgtcaaatgcaaaataaatattgcatcaattaagcttaatcacggtgccatcactaacgaatatttgatcaaacgacaattgaaacacttgaaactgattggcaaaagggcggggggagacgcggggaaagagcacggcaaattgcgagacacccatctcgactcggaccgacgactgccgctgttttcgtacactcccgacacattttccctgtaatatttactcgagtgtcgagattgctttcccagtggcattgcacttttctctctagaattttggtgccgatgattatggagaggaaagaggcgcttgggtccatgggaaacgatgctgcgcttgcctgtctgtccgactacagccccattctcttctcctacttccagcaattgttcgcccaagtcaccaatcctccgattgatccctttcgggaacaggtaaagagttaatctcgactgatttgagcatgtttttgtccctttctcaggttgtaatgtctctccgctgtccaattggccccgagtcgaaccttttggaaccggaaattcaattggaaggtcgcattctgctcgaccatcccgtgctttctctc

SEQ ID NO: 21990 - DNA, 1487 bp, Heterodera glycines
tttcattgccaaattggtcgacgttcagttggttgacgccacttttgcgcgctttaggtgctgaagcgtgtctctctgaagggttggcgatcgcaggtgatcaacattgtatacccggcccgtcacgagcagcacggccttgtcccggcgttagaccgaatttgcagtgaggcgtgttcagctgcgttggatgggtttcaagtgttgattctgtccgaccgtcaggtggcttaataaggcgacagcacatttacggaacaatgaaaaaataggtggacaaggacaatgttccgatcagttctgtgcttgcactcggtgctgtccaccaatgtttgatcaaacagcgcctccgaatgcgagtggcattaattgtggagtcgggggaagtcaaacaggtgattcgctaaatgttatagtcctttagacttggccatcaatgtttgtcattttccaggtccacgacttttgcgtgttgctcggttacggtgcggatgccgtttgtccttacatggtgtacgagacaaggtaccgactgcgcagcatgggtctcatcgacaagtctctgacggacgacgatgtcttccaggggtacaaagcgggcatcgaacggggcatttacaaagtgatggccaaaatgggcatcagcacgttgcactcgtacaaggcgagacaataatatttttacagatcgttccaacaaaaatattgtttcagggtgctcaaatcttcgaaattgtcggcctcgcgcaagaggtggtggacaagtgagcacatttttgagcaattattacttaatagcatcaggtcaacgcacttttcgcgacttaacttttgcgacgattcgtaatttatctctctgtctgtttgtctttcattaacattcgctttcgtggctatttcttccctcttcggtgttcaggtgcttcaccaattccgtgtcccgtttgggcggtgccgacttcgagacgttggccatggaggcatgcagaaggcaccgaattggctatccgaatgtgctgaacagtgacttgtatttgtatggtgagcaaatttgttcagagttttctgtctatgactgtattaccgtaacactctgcaggagacagcaaagtgttggtcagtccgggcgtttaccattggcgcgacgggggcgaaaaacatgtcaacgaacccgtgaacatagccaagctgcaggcggcggcgcgactgaacgacgctaaaagttaccaggaattttcacgggcgtcgaatttggcccaaagactctgcactttacgaggccaattggagatcaaaacaaatgtgaagttgcagattccgttggaggaggtgctgtgacaattcatccgatctcacaaaacataaaatatataatatatgtggtttaggtggagccggccgcagaaattgtcaaacgtttcgtcactggtgcgatgtcttttggctccatcagttgggaggcgcacacgacgtggccattcgatgaa

SEQ ID NO: 21991 - DNA, 848 bp, Heterodera glycines
cttcctctttccatccctcccttctccccctctcctccctccggcgcttcgcttcgtttcacttcactttttctgctgttggtgtccctcgcgcacagaaagtaaatcctgttttagctttagcccatcgaaatgaaaactgacaaagatgaaatgttatggttaatccatgaaaagaaaaggacgaaataaatgacaaatcaatttattcacttcacataataattatgccattgttcaatttttgcttgtcaaaaaacattcggaaatttgtcgtcgcggcaaacatttgccaatgggcgaatggaacacaaattcgtcttggcaaaggaagtcatgggggacgccgtccgagcaaagcaaataatacggcgaacatttcggtccgtacgtgccgttgggcaattgtccgcaaggattgttagctgtggatgatcagtgatcagttcctttatgcggttcccctgctgaccaacccgggtgttgcgggtgtttgcttgggtttttttgcgttccgttggcattgccttggccattcgtctgctgctgatccgtcggcggtgcataaacactaaatttgaattggcgatgcttaattggtcgttttgtcctaacggaggccggtggcggtgccggcacagtgccaccgcattccggcacattgttagcgtagtcgcattggccgaccaattcgctatacttcagaagggccggacacgcaaatgagtatgtgttcagcccagtacagctgaaaagtcggaaactgcgcgaaaacaacaacactcggacctaaagtaaaatggaattgcacccgccgctgtaatagccaatggcacgatcggagcaat

SEQ ID NO: 21992 - DNA, 951 bp, Heterodera glycines
caattaatgagggtttacttgagcgggagacggcggatgccattgagtggccgaagcattggaaatttgggggggatggcgaacggattcgaattgggtcggctgatggatgacgagctgattataagagtaaccagaaacagttgacggagaaggactaaaaggccaattggcacagtggcatttgcaaattaatgattattaattaaactctctcaattagtcaatcttttttcattcattgctttgcgcactttccttccaaattgttggcactttccacggcacaattctccgcgtattggcacgacaaacttttcatttcaaatacgagtttgcctgggcacgccaatttggtcgcctttccccccaaacacgtgtaaaagtgcccagtgcacggctgtcgaacgtaatatccgttctgtttgtccgcacaacgaaaatccgtcgttgggggaggcggctgtggcggaccgtcgggcgaaggcatcgccccgggggtggtcagtttgccggagacgttgctaaaggaaatgcccaagacggaatttgaaagcacttttgagcaatgaaaatgatccagtaaaatgcacgtacgtcgaattgttgcacatttgggggtattggcacagtgctctcgacgggtcaaacacgagattatctaaagggacgaataatgaaacgaagtcgctttcaacccaattggatggcttttgctttgcctggacatgtcagttgcgttgggtgccctccgacgcctaaaaaaatgcgactcgaaaattttttcttttcgaattcacatgtgtaaaaatgagcagaacacggctttttaaagtaatatccgtcgacgcgtcccccgcagcgaaatgagctgagagaaacgaacggacgacgcggcggaggaggcggagacaactgaaaaaaggcaatgacaagaaaatgaatgaatga

SEQ ID NO: 21993 - DNA, 2493 bp, Heterodera glycines
  misc_feature (2355)..(2355): n is a, c, g, or t
  misc_feature (2369)..(2369): n is a, c, g, or t
  misc_feature (2377)..(2377): n is a, c, g, or t
  misc_feature (2390)..(2390): n is a, c, g, or t
aaaagcaaattattaaatccttataaaagcttttggctcacttagttttttttaccaaagtcattttcggacgtttttgaggaccataactgaagtcaatttgggcttgtaattgaaatgccgggagaaattattttatatatatattttgttgatcattcatgagtttttatattttcccaaagctcacttggccttcattagataaaacattcgtttttgattttgttatttaagtttttttttcgttgagtgttcggtttttcctttctttatttatttattgtaatcactgattttgactttcttcggctcccgtgaaaatctaagaattggacaatctgatagcgaataaaaaatataaaaataacgttttataaagcgatcacacatagaatttccaaaaaaaaaattcatttttttttcgctgtcgcaatgttctgccatgcttctgtatatttgttaagatttatttattttttttattcataaatacttttttcgggaatgtatttgttgatgtgttaatagcagacatagcaggaaaacgggtaaaccggggatatcagacggatacggctagtaaaagggaggtgaatttttgaaatctaagatatgtaagggtagctatgcggaaaatcaaaaaaaattttttttaattcttcaatattttgaaacttagcagttttcacattttagcaccttattaatagggccgcaatttttagcgatttaacttttttgttttgttttgctcaattgttttgaagaaagaagttcaaaaaacacatttctgcgttgaaatatcggaattccgatttccgaaaaatttttttgcctcggaatgtcatccctaatttgtggtctatgaaatcaaaaattattaaagggaattgagcagttagttagctttattttttgaatatatcagaaacaaaatgaagtgaaaattgggaatctatcttaggtttttaataaagtactctttgcctaatatctcctaaattgattttgacacgttaaatgaattctttgaaatttttatgaatagattaatgatttgaatgtaatattcgccattagcggccttgatgctacaaaaagttaataaaaacgaaatcttaaacaaaaaattttaaccagtaaactgcataatttataaacacttccaactattaacaaaattaacgtggactaaattttgaaaatttaaaataaattgaaaaagtaaaatatcatcattaccacaaaatttatttcccatgtttaacgcggaaggaagcacatggtattaatatgtaaacaaaattgtatggccaaaaataaaatgaagaataatttttttttggttggtaaaaagaattttaacatgacaaaataaaaatcatttcaaacatttgtcagtcttcccagcagtgtttcatttatcagcagggatgggagctgaatctggttcttgggtagaagacgaccggatttgaatgaattaatgttgagatcgatgagaattgtcggtgaaatgcggcgacgcaaattgtccaaatgattgccggcatttgcggcgcctggtcaaaataatatttgcggtgccgacattttatggtgcccctaattaataaaacatccttttgttttccttatttccgtaagaaattcgttcaaaattaggaaccgctgaatgaattcatttttaatattttttcattggcgtctaagaaatcttttgaattgtgtcgagttcataactttttagccaggcagcgatgggacattgacgttaaaacgcggaaagtggcggttgataagaggcggattgccttggaacgaaatggccgtgcagtaaaggactggatttcacataagcttaacattttgcccatttctttattaagcggagaaaatagataaaattaaaaaaaacatcggcaaagctcaactgacgaatgtttgtcgcaaaatggggcaaatttgacggtcaaatcggcggacgtctttttgtatgaccacacattttccaaagcgtcaattctgttttgccatgaaaataaaattaccaggacaaataatatgaaaatttcaataaattgggaaataaaatttcatcgattaaaacaaaatttatttcctcatgtttaacgcggacggaagcattgaattaatatgtaataaattaaaatattttttggttggattattgccatcatttctcagtctttccagcagttattaatttacaagcagggattggagctgaattcgtgccacaacaaactatttaaactgtttcattaaaataccaaaaaatgattttattatatttctttttttctttatttattggccaacggatttggntgaagagcattcangttattangcaaaaaccctanaaaatgaaacactaaattctcactcatttagcacgatggaagatttcatgcaagatttggccaagtatgcaaatttggtcatgaatggctaacacgatgaaaa

SEQ ID NO: 21994 - DNA, 1419 bp, Heterodera glycines
  misc_feature (7)..(7): n is a, c, g, or t
cagcaanttcacacggaatacatacatatacataatacaagcacagattgtctgatcattagagacatcaacgggtacaagtgatcactaatcacagggatttactccagttaggcgccagccatgtttctggactctaagtcaaccaaatccaacattgttgatctcattcgatagccctaaaagtgtcgtttattaacctgcaaaattccaacaaaaaaaatcgttaattttgaacaattgccaaaagcacagaaaaaacccgggttttcagtcatgtttggccataatttttttgaaccttaatgaaaattttcaaaattttacaggctaatagattgtccggggcccagctgacggagtccggggagagcattcgtcaaatgggcacatcagcggttgggctgcaatgccggacgaatccatgcagtgaacagctcaagcaacaccgaagtcaattccgtggtcaagagaagaagaacgaacgcttgcggtgccttttgctgaaacgtgccgtgccgacaacacattcaaaaaaaaaccctgtccaccacgaagacaaaactcaaattgaaaacattaaattgcacaattttcactgccattttcttatgcaacgcgttctgttttggcgctggccctacgagccagccactccccatccgtttgtgccctcgccccgtcccgcgctcaacttgccttcgcactcgcgtaatgattccgctccagcaattgcctgccaagcgcgcgacacgtgcggaagttctcttcgcgcgtgtcgagatgccacgcctgaggggggagggaggtaattgccgagtcattaggcctaattagcccgtgcagcaccaccttaagcattcgttctccttgcccacaattttcatggtcctctttcgcgcataagcgtctctcagccgtttcgcatcgccctcaatttgtgcccaatgccgtcgatgtctttgagaaatgccttagagcactttcaacaatattaataatacaacactcttgcgatggtcaacttttgcctgttgttttcgtcacagtgcgccaactgacaacgaatcgcggcccaattcctcgggccgtgcgtgcgttttctccacaatgcgtgccaaactgtcgcggatacagtcgtaaaagaatttgtgaatttgacggctcgcctcgagcatctgaagggagacagattatgggactaattaatggtaatggggcacattatgaattttcaacatttgaatgacggtaaatgggaagaacacaaaggacagatgatcaaaaggacggcgatcagagcactcgtcaatggcaatggccgcttcacgtccggacaatttacgcacaagatttaccatttgaaatcgtaagtttgaggggggattggattgtaatgctaattggtcatcattttca

SEQ ID NO: 21995 - DNA, 1461 bp, Heterodera glycines
  misc_feature (96)..(96): n is a, c, g, or t
  misc_feature (107)..(107): n is a, c, g, or t
  misc_feature (123)..(123): n is a, c, g, or t
  misc_feature (135)..(135): n is a, c, g, or t
  misc_feature (141)..(141): n is a, c, g, or t
  misc_feature (196)..(196): n is a, c, g, or t
ttttgaatcaatttcaataggtgtgggactacgctgagtgggacgacacgctattcagtagctacgtcacagctttcgtcggtctcaaagtgcagncgagcggatgnccagagggatgtgaancgaaagagcacngtcagnccttcgtcgcagatttctgcgtacggaaggattcatctggaccgacaaaagatgnccttcaacccgggtctccgtctgatcgccaagactttggcgaactctctatggtattttatttttctacgatatattaaaaaaatgattggaaggggaaagctcgcgcagcgcgtcggccacactgagatacagtacacgcgcacgcctgccgaattccacaagctcctcgacgacccgacttacgacaaactggactttgtccacgtctccgaccacatggaccgtgtcgtcgtccggaagcgacccgagttcgccaaagcaccattgaccaactgccttccagtggccatcttcgtcacttcgtatgcacgtctccatctgtacggatacatggagcaagtgttgacattgaacaacgctgagcttctctactgtggtttgtcttttaccgtttaatgttttagtgacggtaatttagacacggactccatctattacgtcaacaagattggagctccgtgcgtaccggagggcgaagcgtttatgtagagaagaaaatggacacaatgacgataagtcggattctaacgggaaacacaaagaccagagaacactacttgggatgcttcccttgcgacaagctccccgacaaaatcatcaggtacccttcagcattggtggcgaacaatgacccatccaataaagagggaacgcattggatagcaatgttcatcgttgacgacagaaccgtctactactttgacagttttgggcgtactccgaacagatgtatcagccactttttgcggaattatgaaggcgtgatttcaaacaagccccctcctattcagtcagtgttcagtgagaattgcggttattattgtatttattttatttattgtatgtgttcattgagaggaaaaaattatgacagcaattttgaaaaaatgacaaaaagactgaaaggagaggataatccagatttgtttgtatacaaatttgttaagaaaatgatgaaataaagtatttaaaggaattgaatgtaatattttattaataaaaatggatcgattagacacagtaattgcttcccttcttaactgctctgcacgtaatttatgcgaccgcctaaaccaccctgatgaaatcaaaaagattgaaaactttttcaacggaaagaccctgcaaacgacatataaaaatcaactgggcgaagaaaaggattttatttttggtggaatcacaaagaaaagcgcgagaagacaaatggcgtacaacgggttcaagaatgtgaccgtagaccagcatttttatgtacgtcat

SEQ ID NO: 21996 - DNA, 1678 bp, Heterodera glycines
ttccccatgcttttaaagaaattcgcgttttttgggtgcagtagtcaagggctcgcttctcggactcggttcttctcgagactcgtaaaactcgactctcgagcagcacctatttttttaaaaatttatttcaagaaaaaatttttgagaaaatttttcagcgattttttggaatattttttgaaaaaactagtaattcactataaaattgcaaaaaaaaaatgtaatgaattttattataaaaatttttctaaaatttttctgaacaatttcttattttgaaaacttttaaaaaaatttaaaaagaggaaacgatacggaggggtgctatgtcattatttaaaaaccatcaaaataaatatttttgcttataactttgctccaaaacatccaaatctattattaatccttgctatcattcgatagaactaagtgtgtgtgttctttatgagcctgtaaaatttcaaaaaaatttattaactttaaaaaaagttatggccaaaaatgttcgaaaaccaacgttttttgagttcctcgagctacaacttttttgaaacttaacgaaattttttttaattttgcagactgctagagaacacttagggctatcaaatgatatcaagaattaaaaatttggttgctttggagcaaagttagaaataatttttcgacaaaaaaatttcataatgatggttttttaaataacgccctttatgatgttttttaaataacggctccgccccccaaaaactgggctggcgccgaaacgagggtgtccctattaatttagtaattaaaaaaaataaatgtgaaaatcttatttttctgttttatctctccggttagatattattaaaaaagaaaaaacggatcaataagaaggtggttaaatgataaaccaaaataacaagtttttttttctcaaatttaatgctgcttaagacctctaaaattgaaaaaatgtaagtttgaacccgaattttggacataagcgctacgctaatgtccggacacgattttccttccgtttatcgaacatttttcgtttcaatttaaacacaaaatctttccttttttttggctgtctttgcttttcaccttttacgtcagctgtcctccataaatttgttttcttttttcttatacagaaattgaattcattttttttcatcatttcattgtttccatttgcataaaaatctgttgaaaatttttatttgtttatggccaaaagaaatcaccaagctttgttttttacaaaaatgtttttagccacttttttttaatacaaattcatatttaaattaggtataaatttaaacagaaaaaaaaactttcatccgcagaatgggttgaaattttgcagaaaaatgcacaagaattataaattttgggaaaatttttggaaagttttgcttgactcaaacatgaacaactctttcgaatttttgaaaccaaatgaatgtttttctcacttgctaagtcttatgctaaaaatgggaaaataagtgccaaaaagttccgaatttggggggtgtaaaatcgtaaaagtttatctaaaaaggtaataaaattaagccaaaccacagtattgagaaaaatatttttaaaatcacaaattcttgtcaagaaataaataaataattttggagatgtatttttgagaaaattttcattt

SEQ ID NO: 21997 - DNA, 2746 bp, Heterodera glycines
aggtcaaaattacgtttaaaacaaatcatatttaaattattgagccatgaaaaacggaaaaggcacccacaaaatacgaacaaagatgggacgaaacagaaaaactaggcaataaaacgaaattgaaatgtgaccgaatgaacgcagtcagaaatttgaatgtacaatttgtaatttgaaaatgcccaaaattggaaaagaaaattgaagacaaattaaaatgtgcgacaattgaattttgataatatttaaaggcaaatggagtttattttgtgtccgaattcagaaaaaagaggagagatcaaaagagtgaaagttttaatgtaaattcagccaaatcgccataatttaagcaataattaattaatttattgtttttgtgattctctgccgctttgtctgagtgtctgccgttgctttcttcactctctctctctctttttctacctggtcggttgatactttgtctgcggcaatttgtgcgtaacggaggaggaagaagaaggagaaatgcccgccgatgacgacattgctgcgtccaattgacgacgcaaaaaactcctcactcctccgccgaaggatcgaagcagttcacgatgcttgaaaaaaggagtaatttgttgatcaatgcttgtcgttgtgctgttctactgaccgtgctgtaccaatgttcgctgatcagtcgctgctcctgcgtcgcctggtgtttgaactggtccattttgttgcgcaactgttggttctccgcctgcgtttttgtcagttcgtgttggacttggagcatttcggcagcggaacagtgcttatccgacgccgtgctgtactgctcgatcaccgtggccgctttgtctaaggacaactccaaatcgcgcaaattccccttcaattggctgtagttggctaaacattttgcttcgtaatgaatgcgagaagacaaaatcgttttttccagatgagatttcacagaattctcaactgttactgtcgcccgattacccctcccatttgacttcacttgtcccctcaccttccaatgaaattcgccgttcttcactcagtgcttccttttgtcgttgttgttccatttcctcgtgtaattctcgctgcattccttggtaattgatgatttgttgctccaaaaacttcacccgactctccagaccctccttcgcggcaaatttcttcgcgtaatcgtccaatctaatcaaaaaaaaaacatttaagcctaaatctccgcgctgggacgaaaccaggaatttgtagctgttttgtgccaaaaaatgacaaaccttggcatttatgagtcaaaaaagatgaaatggggggtccggcggttccgacaggagacaaaacgcgcctgcaaaaaagtgtgggtggttgaataacaaaaaaaaaaaaaaaaatgccggagaaaaaattggttcttcgtatgaaaaatcgatcccgagacaccccctgtcccaatcgtaagtcgtgtggcccttgggctgagacacctcttgtaaatgtatgttcaacataaaagattaaatgcccttcaaatccaccgtttgtgtagaagctgcaattccctctccttttcctccacttccttcgcgtgtttgtccattttgcccgatgcctttgtatttcgttcgttggcatttctttgctccctcttcaactgttcaaattcgtaccgccgcaactccgactcgtcctgcgcttccttcagtcgtccattcaaattgcgtatggtttcttgctgaaagtgtgccaatgcttttaacatttttcttgtccagctcatatcaatttccttcaaaacaagtaacaaacttaccaatttgatgtttacgacccgcatctcctcgaatttgacttccaaattgttgtattcctcctgtgccatgttcaattggtcgttcagctgctcgttggccttctccaactgtttcattcgcccgttcagttccgtagaacgtattttctgctttgccaactcgtcatcttccgattgtttaccaggcgaagcggagggactgtcggcggcgagaatgccacttttagttggcgatgaaaaaatttgcaaattgttgttgttgttgtgcaaaagcgggaaggcattggcattggcactcatcagcttcccggacggcgacaaaacttgagaaaaaggaagttcagccgagagacgatgcatgcaaagtgtgtcgatcttaaattcatagaaatgaaaaaatttgctctaaattaatttttgctttaatgacgcagggccgtaacgaaaattatgaaaaaaccaagggattgtggtgtttctgaaaaacgaaccatttccccgagtgtccgcgcctgggccttttcaaggcgtgagatgagcgcgttgaattggtcgacatgcaaaatccgcagcgaaaaaaagagagccaaaaagacttttgccaattccatggtgtcatcgttttttgaagagtcatcggacgtgcccaaaagaagtgatgcgcaaagcttttccccggtggccgcttcaatgtcaaaaaaggcggtgtgaatgctgaagccgtgagtgtccatgaagcggagttggccagttttactgaacgaattcgatattttgactctttgatgcaattagccaaaccaacatttgccataatcattttacacaaactcacacaaataagggagagtaggcaacatcggtttggcatccctcacctctagaggaatcttccaaccccaaatcggaaaagagcaaattcaa

SEQ ID NO: 21998 - DNA, 2242 bp, Heterodera glycines
  misc_feature (58)..(60): n is a, c, g, or t
  misc_feature (65)..(66): n is a, c, g, or t
  misc_feature (68)..(70): n is a, c, g, or t
  misc_feature (74)..(75): n is a, c, g, or t
ttcctttgtgctcacttcgcagtgtcctccagttgtcttctaagggactttgaaatgnnngaaanngnnncttnncccccttcgccacttttattttctctcctccttaatcaccttttttcttccttttcctcttttctctctctctctctcctcccttcgctgtcccaactttcccatgcccttttctccctttttctctccccctttttctctagcgttcctcggcccatttaatgtgtgctatttcgttcgttacacacataaaaaccatcaaaaagggcgttatataaaaattattaaatgaaaatttttaacaaaaatttcctaactttgctcaaaagcaaccaaattttaattcttgagattaccgatagccctacataagagttcgctattagcctgcaaaattacaaaaaatttgaagttggaacaaacttatggccaaaagtacaccgggcccaggttttcaaacattttgctcataattttttcgaaatagcgaaattttttgaaattttgcaaattagaagaaaatatatatatagagcaatcgtgtgctatgaatgaaataaaaaatctaaaaaattataactaaaattttttcgttaaacataaaataattttgatcatgaaaaattctgaccagaactttctttgaaccaacaaaatgaagtaatcttgatataattcgttagtcctaagtgttctactagcctgcaaactttcaaaaaatttggataagtttcaaaaaagttatggccaaaaatgcttttaaacctggtttcttgagtactttttgccataagtttgttcaaactttacgattttttttttgaatttaggtgaactaatagagaactcttaagggctgctatcgaatgttatcaaaaattaaaaatttggttgcttttgagcaaaattatgggtagttttttttataaattttcatttatcgactcggcaccatttaatgtctctttttcagtggggccgaactcaggggtgcgattttgccctggaaacccggcatttgccgggttttgggggtccttgccgggtttttgccgggtttttgaagttgccgggtttttgggtttttgccgggtttcctatttcaattcatttatttgagctccagggatcctttattttcttaaaaatttgctcaaaatcgcaaaatttggtcatttttgtggtcaaatctgttaacaaattgtattaaaaatcacaaaatttttcccggcggcgcctatcggcaccgccggcctcccttttccccaagtttttttttagaaaaaagcgccgcaaaaaatcaacttcgattttcgtgctaagaatttcacaaaatgcttatttctaacaaaaaattgctcaaattgatcatggaaaataaaaatataatatttgaacatttttaatgtgttttgaataaatttgtaaaaatgaggcttttttgccgaccaaatgaggcttttgaaaattttaatctggcaaccctggttaaactcattaatttcaatcaaatttaattcaaatattttgtgcccaaacgctcatggttacattctttcaatgccaaatttgctcaaacaggtgaaaagtggtgataaatatattgtttaaatgttattgaccttttttacagtgaataattggcttaaaaaattgccgggttttttggccgggtttttgaaaatttttgccgggttttcgtgcgcccggtttttgggttttggcgatcgcatccctgacatgaatgatcatttgtgcttcataaattcaccacccactgaataaattcatttaagcttaacttttggtattgaaatcataaaagtcaattgcttcaaatagatcagatcactccttcaattttgtagagaattttgtaccctttcattaggcttgtttaaaaaattttgagaaaataattttcaagggtaatgctaggcatttagcacaaatctgactttctttaggctctttcgaaccccaaaaccggattcgacatttttctaaaatttaaaattctcgttttttttttgcaaatattaccacataaattgctcaattgcattgaatcgttcgactgatttcatcatttttgtttacgattatctaaccctgcttcatttgttttcaacaaatcgattccattattaccccatgatttctcatctgaatcctttgtttttcggttggtacgccacaaaaaaaattattttaattcttataaaaa

SEQ ID NO: 21999 - DNA, 1285 bp, Heterodera glycines
  misc_feature (49)..(49): n is a, c, g, or t
gctcgtctatgatgttgccaattgaatggcacttttgttgttggtcacncatggtgccatcattgtccatgtccatgtcggcatggtcgtccccgtggtgttgctgctggaaaatggcatgctgcaactcggcgaacagcacacggccaaactgctgggccaaccggaagccgccggcgctgatggcattttcattcgcgtctttggcaccaccgcaaccgatgctgccgacggagccgtttaatgacgaagcaaatgccggtgacaaggacagctttgcaccagcaaaagtgccatttccatgaatgacgcccgctgctgctgctgctgcttcatcttggctcattgacatgagtgccgctgcagccgccatttcttccggccgctggtgctcagcggcaacaacgggcaacagtcgccgctttcggtcgccgctcgctgccgccggtggcgagcagtacagcaactgttgttgttgctgctgctgttgttggtgatggacgagtgcagcagaaatggctgcaactgtagcagaagttgccgccgaggccgccgaaccgccggtgggcgagcaggacgcggacgacgaggcggacgacgcgttcgccgctcctgcggcgggcgttgcggcactcgctgccaacgacgacagtgtgccaccattctcgaccatgccgccgatgccattgttgacggatgaagccggcacgcgctcgtaatggaacgggttgacgcacaccgagtcgcacttcatgtcaaacgcggcggtgcactggggaagatgcttaacctgtggaaagaaatgggaatttacaaaaacaatgcccggagggcgaaaagtgagacaaaagccaaatggggtaaaatgtgccaaagaaagggtcaaaatggcaaatggggtaaaaaaaaatgtgccaaatttcacttacttcgttcttgtgcaggtcgccccagcggaagatgcgcgcgtacaccacgtgcggaaagcctttgcgaccggcaacctgtcagagagagacaaattgaccaaaaatggatttagatcgcttctgatcagattaggtaagcctagttgatcagagccgtattgtcgtggtggctgctgatcggcagtgatcaaaattaggctaacaaaactaatcagcagaaccaattggaagccctgatcagttgcatgctctctctctttctccctctctctctctctctttatatatgtgaagcgaattggttccttcctcatcagaaacaagaaaaaaaactgaatgggggacgacgagtgatc

SEQ ID NO: 22000 - DNA, 2003 bp, Heterodera glycines
cacattttactggcggagagtccaagtaccttaattggacaattacttgtcaacgaacacagtcgcctttggcctcttatggaacagaaaagggtggatatcagatggggtgcgtcccttcctaaaaatttctcttttcgtctaaccatcccacctttttgtgctctatttcattttcaaaattgggaacatttttttgtatgtttttttgaaactaaaatgtaaaaaatttaataattatttttgatttaaataatgcttctgtttcgaatcttttggctttaagtaattaaattgtaaaaattcaaaactaaaaattttcctctgaagttttgaacttggctttaccctgcttttaagtcccaccgtgaggcgggacagttccaaaatttgtaccacattttactgtgcaaagtccaagtaccttaaggactacagaagagccaatgacgcagtcacctttggacagttattaaaaagaaataaggaaatattcgatggggtgcgatcctttcaaaaaattactctcgtcttctacccccccccccctctttttgtgcactgtttcgttttaaaaattggttccgaaattttttggcattttgaaattaattgcaaaaattcgaaacaaaatactctgaagatttgtaatttcacttcaccatgcttttaagtcccaccgtgaggcgggacagttccaaaatttgtaccacattttactgcggagagtccaagtaccttaattggacaattacttgtcaacgaacacagtcgcctttggcctcttatggaacagaaaagggtggatatcagatggggtgcgtcccttcctaaaaatttctcttttcgtctaaccatcccacctttttgtgctctatttcattttcaaaattgggaacatttttttgtatgtttttttgaaactaaaatgtaaaaaatttaataattatttttgatttaaataatgcttctgtttcgaatcttttggctttaagtaattaaattgtaaaaattcaaaactaaaaattttcctctgaagttttgaacttggctttaccctgcttttaagtcccaccgtgaggcgggacagttccaaaatttgtaccacattttactgtgcaaagtccaagtaccttaaggactacagaagagccaatgacgcagtcacctttggacagttattaaaaagaaataaggaaatattcgatggggtgcgatcctttcaaaaaattactctcgtcgtctaccctccctcgctttttgtgcactgtttcgtttctaaaattggttccgaattttttggcattttgaaattaattgcaaaaattcgaaacaaaatactctgaagatttgtaatttcacttcaccatgcttttaagtcccaccgtgaggcgggacagttccaaaatttgtaccacattttactgtgcaaagtccaagtaccttaaggactacagaagagccaatgacgcagtcacctttggacagttattaaaaagaaataaggaaatattcgatggggtgcgatcctttcaaaaaattactctcgtcttctaccccccccccctctttttgtgcactgtttcgttttaaaaattggttccgaaattttttggcattttgaaattaattgcaaaaattcgaaacaaaatactctgaagatttgtaatttcacttcaccatgcttttaagtcccaccgtgaggcgggacagttccaaaatttgtaccacattttactgtggaaagtccaagtaccttaattggacaattacttgtcaacgaacacagtcgcctttggcctcttatggaacagaaaagggtggatatcagatggggtgcgtcccttcctaaaaatttctcttttcgtctaaccatcccacctttttgtgctctatttcattttcaaaattgggaacatttaagtgtatgtttttttgaaactaaaatgtaaaaaatttaagaaagatttttgatttaaataatgcttctgtttcgaatcttt

SEQ ID NO: 22001 - DNA, 902 bp, Heterodera glycines
ccctgccctctagagtgcgcgagcgaggagcgaagcggagcgacgagcgagtgtaccgagtcaatacgaacctgatcaattcttttagatgtcacttagcgggcatggggtgaacggctaggctcagctgtcttccggtagctgctgctgcacgaacatccagatacgcatctgcgcctgagctgctactgcactaacaacctgacgcatctaccccgttactggctacaactcgacgggataggctcggctttctataaagcgcagccatctaccgggacgcctagttatctatatataaaaataacgggggggctacccactaaacgatttccctctccttaagggctcaacggatcgccacgggaccggtaccaatcgaaagagctcggttttctctacaaaatggcccgtgtggaaaaaattcgcaccagcaaaaattttttgtaaaatagggttaaagaaaaaaaacccggctttttacaattggcaaaaatgggttgtaaaatgtgtgttttcaccttatttctcaggaaccgtaagagctacgcttttgcggtaagcgaacaatttgtagagctcgtcgagaggaagggtgagaaaaaaatttcgtagctctacgacaaattcgaacaaagttataccccggcaaaggtcgaaaaaagccgattttttttgtgttttcgccttccggtttacaatccgtttacaattgtaaattcgtccggaatgtccggaatttcacggaatttgatgtttttcacgtgatttcttcacgtttacgtgtgtttttgacgtgaattctttaaaccagttccggtttttcacgtgtgttcttcacatttacgtgtattttcaacacgtttgcatgcgttttcaatattttacgtgtattttcgtta

SEQ ID NO: 22002 - DNA, 1008 bp, Heterodera glycines
  misc_feature (871)..(871): n is a, c, g, or t
aaatttttgaaatttacagaaaaatagaggaaacttagggctatcaaaagataccaatattgtttaatttggatgcttctacaaaaagttatggcattgatcaaaaattgatcatttttatggtgatcatttattcaaccaagtataactttctatgtacaaatcgcagacccaccattccaaaagcaattcggtagaaaattttgtgctctttccagtgggcttgcccattttctctagaaaaaatttcccaactccctagggatttcgaaaatttccccgattttcagtgtcttttaagtgtccgggtcactaggaaggagtgatctaatcaagttggtgtaagagactatatttctctcataaaaatgtaatttgtttgggaaatattaaataataaatcgacattataataatggtctgcaaatctaaacccatcaatcatacttttttaggccccgtgcgattttcaactttcattaattaatgggcaaataaacgaactgccaaatgataaatcaaaggtggtgtgaccggccataattttttttaacattttcaaaagtatgaaatccgtaaaagcaaattcgaatctcttttcgcttttaaatgattgtgaattcgtcctactgtaaaaatcacgaaattcttactgtaatttattacccaaatatatatattaagctagagcgccacgagaccgggacctggtagcggacaactgagtacaactgagtaccaaggtcccggttttgaccgggaccgggactagtcccggttttcccagccaaaaattcccggtttttcaacccgaaaaggtccaggtcccgggtttgcccaaaattcccggtctcgtggcactctatattanacctctacagatgatcgaccatctttctaatgttggcaattaaatacataaaataataaatgaaaattccagagaattatccaacataatttcttatttaatttttttgaaatgccccatttgccaatgcttcgcgt

SEQ ID NO: 22003 - DNA, 1173 bp, Heterodera glycines
aacatttcccacagccgcttctctttcttcactttgtgtctggcccattttagcgctttttctctcctctctttgctctctcttattctctcaatttctttacatcccttctctcttcgttcgcttcatatcttttcctccatattctcattctcttcccctttaaaatcctcatactctctctcccctctctcactaggctttcctctctcactctcactctctctcctctctttttctcaaccaaaaatattattatcgcactatttcttcaaaattttacttcttccattactatttccactgcttaaaaaaatattttgaaaaacagccccagacccagtgaaaggcacgccaattggggtggagagagagggaggggggcaatgctttttccgctgccttctctgctgttggtgaaaatggggggggaggcttcatctccacagatgcacaaatgcgtggcttaacaaacccacaaattggcttccgagggataacttaatttaattggcgctgcttttttgtcaaaaaatttaaattatttttgctattctgcctgccgtttgtttcaaatttcatcgctttgttttggctttttgttctgtgccagataagagattcgcgatttcaaaatgccatctttttctttttttttggaatggcaccaaatttggccctttccgtcctaacccttctccttcactttctctcattcattcctttcccatttgtgtaccattggtccgttgtctgcttctgctctgtgatcgtttgtcagttgtccctccttccgccgtctgtcgctctctttcataaatctctccttttctctccttttcttttattttctttcctttccttttccttatgcttccgatcaaattctcattacgttacgacaacattatatatgtacatttgtgttttccttccttctatttggttccaattcctcctaaaagtccgttcttttttcacgtgtgccaccacggcaatcattactttttaattttgttaattattaataactcatttttttgcttttttaaatttgttaacatttctccttccctctgtccctccctttgccatttcccacccataacgcccatcaccaccacctttttcttaacagctcgttctgtccactcattcgtcatatgttttgtg

SEQ ID NO: 22004 - DNA, 1582 bp, Heterodera glycines
ttattatgtcattcatataccaaataaaaatctgcaatacataatagcatgcttttacctgacaaatgctttaaaatgagaaaattttcaaaaaaaaagaaatcctaaggaaaagaacacatatttttttcttttacaaaatattttttaaataaatctgctggtgtttgttttttaattatttttgtttttgctttggcgccaaaacgacactttcccgggactggtatgggattggcaaaaattcactgaatagagtgaacatttaaaaagaaattttggtacacttaaagaatttttaggaaaatagaaaaaggaatttaaattagagaagtttttgtttaaaagaaaaaggaaaattgggactttttcacgtaattcatttaattaggaaaatggaaattttaagtcatccgttggcggagggagcggcggcacgtgccatgcgggcccaatgatgacgcgataagttacgtcagttcagcgaatgtgcccacgtccgccttccaattggaattaaaaatattctccgcgataagcgctttaaagcgcagaacacccgaggaggatgacgcgacagagcgggactgggtggaggatgaggagtcgcacggcggggcgacgcgtgaggagtcgcacgacggggcgacgcgtgaggagtcgcacgacggggcgacgcgtgaggagtcgcacggggcgacgcgtgaggagtcgcacggggcgacgcgtgaggagtcgcacagcgggccgatggttgaggaatcgcgtggggcgggtgcggaaaaaaatgaatttagatcggatggaatcatttttagtgtaacagctggggaggataaggcggagcgaggcgtacgcggacccggaaatggcggagggaggggagggatggacgacgagttttacaaaatgaactcgatgatcactgatctgatgcattttcatttcaaatattagtatttaattgcttttatcacttcaaaggatgaattaacaaaattgagtccatgtgaaaaaaaaatttttttgcttaaattgggaaattattacttgtaatgattaaggcatccatttttaagtttttcgaaaaaacaatgaaataacagagaaatctccgcgccatcgaattaccattgatatttgtctttattaagttcagatgcgctaaattaccttaaaatgttagcaagtccataaaattacctaagcatgatacattttaattctttataacttttttaagaagcaacaaaaataattttcttttttttttggaccgagaccccgccggtaccgggacttttttaaaaatgatggaatatcgcttttggagttaatttttaagtagataataagttgtaggccagtccgtcgagtcaaagactccaggataattttcaaaatttgataaatttaaaaaaaaattaattattgtaagtgaaatttcggactcgctcagttgggcgcgcacggttgggcgctcacggttgggcgctcacgtttgggcgccagcatgcttttccacttaagcttttttcattggcatagagatccaataatcttggtatcattcgaaagctct

SEQ ID NO: 22005 - DNA, 2217 bp, Heterodera glycines
  misc_feature (34)..(34): n is a, c, g, or t
  misc_feature (43)..(44): n is a, c, g, or t
  misc_feature (113)..(113): n is a, c, g, or t
  misc_feature (320)..(320): n is a, c, g, or t
attgggcaaattaactaaaaaatatttgtttttntggaatganncttatcggtcttcaatttaatgttcattaaaaaataatgtctggcagaaaaaaaattttagattttcanaatgcgttagtctcatatatggcacagattaagtagtaatatttcttaacaaaaagtctaaaaaatattaaattactaccctaaatatttaaataatttaaaaaaccactaaaatccttcaaacaaaaatttataaaaaattcaatgctcaattatataacaggaaaattgcttaatattttttaattataataaaataaatctatnagcattattcaaaaatggaaaattttatataaataggaattgcttgatttttttatattcaattagtttggttaatgatcagtcagatcattgataaaattttgtgtaaatatttaaaaatatttagccatcaaaatgaattaattggctcaaaataataaaataaacctatgttatgttttaatgaattaggatgaataaaaataaaattagaattaaattcgggccaagttaaacacgaaaaactggatttccaggataatattttagaattatgttattttctagtgaccattctttatttcaagttaacaaacaatgattaaaaaatggattaaagcgatgctatgtcgttataaaaaagccatcaaataaaaattttcatgaaaaaactacccgtaactttgctcaacccccaattaaaattttaattcttaatgtcattcgatagccttaacaattctctattagcctacaaaatttcaaagaattttgtcaagattgaacaaaattatggccaaatgtactcaaggaaccaggttttaaaacctttttggccataacttttttgaaattttgcatgccaatagaaaagagttagtgctactaaaagaaagcttagctttgttggttcgaagaaagttttaagaagaatttttaatgctcaaaattattttatttctaattaaaaaaattttagtttaaattatttatatttttttattttcttggtaatatttgaaagccctaagtgtttactaatggcctgcaaaatttctaaaaatctggtaaaatttatgtttagatgttcctaggcaataaatttttttcttaaatatttatttaccttttaaaacaaattaaataaaaacacacaggccaaagccctggatccaggcctcgattagcctggatggacgggacggtgtggtttgagaatgcaataaaaacttataaataaggaatacgcagccttctcctctagatttcctgaacgaatttattctccaaaagagaagcccccatttttaaaataatagtccttgaaatttttcaaggacggtgtggtttggaatgcaataaaatacttagaaatagcaatataatatgcagccaataaaaaagaaaaaaagaacagattgtcaaacttgggcttttgagaagttcggttcgaaaaagaaattatttaaatgaaatatttgggcaaacaaactaaaactttggaattgaacttaatgatctttcaattaaagtatattaaaaattaatatctggctgacgaattactgaaccaaatgatcatttagaaaaatgcgctcaaaaaacgagaatcacaagaaaataaaaataaaattattttaaaaactatcatttccaagaatttcacatattaacttttaggaaatattttttattaatgtttgtgaaatgtcgtagatggacaaataaatcaaaaaattaaaaaaaaattgtcaggacattaggaatgtaaattttgagttcttggcttaatgtaattggatagcctttaaaaggcgaatttcaattatatgacaggaaaaaagtgaaatatttggattaataaccaaatattaaaagaacaaatgttttttaattataaaaagacaaatgtaaaagcattaccaaaaatggaaaattttattaaaaaatggcaattactttatttttttaatattcgctcattttattaatgatcgatcagagctattcattcgtttattatatttaaaaattgggctgtttgggatgtgttttatgtaaatgattaaaaatatttagccttcaaaatcaattaattagcttaaaataatagaaataaaaaaaaactataaaaagatgattttcaattatataacgggaaaattatgtgaaattt

SEQ ID NO: 22006 - DNA, 308 bp, Heterodera glycines
tgcggacatctacattatttgaattgaaaaaaaattggtaattactctttctttttctccatattcaaccactcataactcatacatcccacccacacctctttcttctttccggccacgccacactaccccgcgactacagcagccgtctaccccatctcccatttcgatgcctcccttcttcttggataagattataagacatgcaagagcgggcaagcgacaatctgatccccatcaagctagcttctgcaggtcctgctcgagcggtcgcccggggatcgatccccgatctagtaacataaatg

SEQ ID NO: 22007 - DNA, 1274 bp, Heterodera glycines
  misc_feature (25)..(25): n is a, c, g, or t
  misc_feature (1045)..(1045): n is a, c, g, or t
  misc_feature (1099)..(1099): n is a, c, g, or t
ccgatcagagcagttgaacaatttntggtcattgggaagcaatcgggataagagacgacccgacagacgacgcggatgcgcaagcagtgatacaattcgaacgatcagtgcgccaactcaacgacgggcgctactccattcgattgccatggtgggagtgccaccccgctttgcccaccaatttcagcatggcctatcgacggctaacgacaatgcttcaacggctgcagaagactcccgaggtgctcaagctgtacaccacagtgatcaccgatcagctcaatgcagcaataatcgaggaaacgacgatcggagctggtaaacacgaacacttcatccctcaccaagcagtgatcacgcctaaaaagttgcgggtcgtctacgatgcgagcgcacacacacgaggggcaccttccctcaacgactgcctactcagaggcccagtttggctgccggatttggccggcatgctcattcggttccgagcatgccgagtaccagtgatcgccgatgtcgagaaagcatttctcatggtcgggattgaagaggacgacagagatgtgtgcaaatttttgtgggtgcgcgacccatttcggccagtgacaacggacaatttggtgacataccgatttcgacgcctcgcatttgggctcacgccaagccccttttgtctcgccgcagttgtacgacaccatctgcgcaaatacgactccaacttcgcggaagaactcattcgggacacatacgtggataatgtgctcatcccggcggacactgcggaagaagcagccattaaaggacgagaagcgaaacgaatgtttgcggacgcgaggatgaaccttcgggaattcttgagcaatgacgagacactcaacagcagcttttcggacgcggaattcctcggcaagacgacggccaaagtcttgggactcgaatggaatgcggagacggacaaaatacgaatgaagtaccccgggagcgaacccggcactccgatcagcaccacacgcagaacggtgctgagcagcgtcgccagcctgttcgnacccgctcggcttggtctgcccggcgaccccagggggcgaagctgttcttccanaagcctgtgggacgacaaccacgaatgggacactcctttgtcccgggaggaagctcgagaatgggagcacttttggcaaagtgggaagggggaaagtaatctgattcctcgagggcgtactgcggggcaggggtcacccgcttcaactgcatgtgttcacggatgcatcgggaat

SEQ ID NO: 22008 - DNA, 906 bp, Heterodera glycines
tcaaacaggtgtttatggagaagaaatttttattttaccccaccaaattactcaaaaaatagacttaatttggtcttaattaatttttttccattttcggggtttggattagttaattgaggattgaccgcgatggggggaaaggaatggatatttgacgaataatttttggtctatctctgggatttatgcgcttttaaaaactttttcgccccgtgtgaatggtctgctgaaaagaggtgggatcgaattctggcattttatttttggcctgaattccaaatgcgtgaaaaattttgagcatccggtcccatatttgtcgaaaatatttgtataaaattttttttttaaattcgctgaaaatttctaccctttttcaacccaaaaacaacaaaccaattgcaggttctgtccgcgaatgcggaagcgtttgcgcaagtggagtgtgtgtttgaggaccgcgacttccgcgtcaaagtcactcgggacgagttggaggcgatgttccgcgactttgaacagcgtcacatggaacccatcaatgttgctttgacaatggcacaactgacgctggacaaattggaccgtgttgtgttgatgggtgccggcacacggatgccacgcctacagaccgtcctcgacatattcctccaggggttggcaaaaaaaaaaaaaatttttttttattgttgacatggaaatggaaatccttacccgagctgtaaattggaaaatgcatatgtgttacaccatactattggatagagcagggttgatttgtacaccaatttttttgaaaaaaaaattctgagggcctccctttttacattcgaatttccaactcattgtcagctttttcaaataaaaaagagatcaacatttagtagaaaaaagacctaatatttc

SEQ ID NO: 22009 - DNA, 385 bp, Heterodera glycines
aaaaaaaaaaaaaaaaaaaaaaaaaaattttttttttttttttttttttgttgggttgggggggggaaggaaaaaacaaaaaaaaaaaaaaaaaaaaaaaaaaaatccctctcctcctcttctcttttcttttttttttttttattttataaaaaaaaaagggggggggggggggggggggggggggggggggggggaggggagaaaaaaaaaaaaaaaaaaaaaaaaaaaaatatttctttttttttttttttttttttttttttttttttttttttttttttccctccccccccccccccccccccgggggggggggggggggggggggtgttttttttttttttttttttttttcccccccccccccccccccccccaaaaa

SEQ ID NO: 22010 - DNA, 1260 bp, Heterodera glycines
cccatttttccgttcccaactggccaaaggcgactgcctacttgtgaccgtagttgtccaataaggtacttggactttcctagtaaaatgtggtacaaaattttggaactgtcccgcctcacggcggggcttaaaagcattgtacagcgtaattaaaagctaaaataattttcgtatatttttcacaatttatttcaaaaagccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaaccgaaaataattttcgtatatttttcacaatttatttcaaaagacaaaaaaaatgattcaattttgaaacgaaatagtgcacaaaagggagggatggttagacgaaaagaggaatttttagaaaagagcgcccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaagctaaaataattttcgtatatttttcacaatttatttcaaaaagccaaaaagtccggaaccaattttaaaaactaaaatagtgcacaaaaggggagccgccgcacggcggggcttaaaagcattgtacagcataattaaaaccgaaaataattttcgtatatttttcacaatttatttcaaaaagccaaaaaaaatgattcaattttgaaacgaaatagtgcacaaaagggagggatggttagacgaaaagaggaatttttagaaaagagcgcaccccatctgatattcccatttttccgttccacaactggccaaaggcgactgtgctcattgacacgtagttgtccaataaggtacttggactttccacagtaaaatgtggtacaaaattttggaactgtcccgcctcacggcggggcttaaaagcattgtactgcataattaaaaccgaaaataattttcgtatatttttcacaatttatttcaaaa

SEQ ID NO: 22011 - DNA, 1651 bp, Heterodera glycines
gggtaggcggacgaggagttcgagcagtacaatgataagccttccttaggttggattgtccatttagcccaccatttcttcggtgtccgttttgcgttggtccgctcgtccattccgtgctgatccgtcgtggcgatctgagcagcggcgacccgcgccatggcgtcgtctcctgcgctgtcgttctgcgttggatgggaatcactcgttcctcgggtcggcccctctgctccttcagcattatcggatgcacagcccattcgtccgcccttcggcgttcttcctcctccaatttggcgtctcttcgtggtccgacgatgatgttctccttctcctccatgttcttgcccaacaaagtgccatatccgtgcaaataattaaccaatcgctcattacggccccataacggagtcaccgatggctttgacacgggcggaacggacggtggcggaggaggcggaggacgtaacggatggacgcgggagggaagcggaagatgggaacgaagcggaggaagggactgttgctgctgctggtgatgggggagttgtgccgtggtcggaggaagggaggggaggggcagaggctgagaatggcgatgggcttcttctctctcctcccgctgcattccgttccgcaacttttgctgaaccatcggcggcggtggtggcggaagttcgtccctttcgtcgtccaattcgacggatgatgaggtggaagactgtctaatgggaggaggtgccatagagtcggtgagtgtgccttggtcgcgtcactctcgcgcacctttcgtgccgttcccacccttctccgccggcgggtgtcgtcgtcgccctttgcgccgccgttgggtccctccgcccctccggcgttgttccccccattgcccccctccctttgccctgggcgtttcctcctcttcctcccccatggcccttttgtgtgccgcgattaaactcgccgccattaaactctcgtccaattgcgggtccgaacagatggaatggtccaattgctccgattcactgaaagggcggcacaattaaaaatgggaggaaaagcattgtgaaaggcacaaaatcataagcattttgaaaattgttttgtttcatttatttatgttgcgcatttgtgtgatcatttgtccgcttaccgacttctgtcgagattaattgacatcgacggggaacggacgccgtactcacttagaaaatggatgattatttattttcaataatcttgacgaacttttctttaggacttttaaatatttgattcaatttatcgcgatcggctgccaaccgaagggaagggaaaacgccgcctgagggggcggacgacggacacccaaatggaagggggagggggagagagatccaaaagataagggcaaagggaggggggaggaaacgagttccatcggagggacggggggcttcgaatcattaagggcaaattaaaataaacaaagggcacaacggacggacgtacaattattacaattagtgactggctaatcatcctcccaacttgccttttttggcatttccttttcttttttttgtcattccaccctcacttttttatttgattcatttgactaactaatttaccgaatttgccattctccgccccctttacatcggcggag

SEQ ID NO: 22012 - DNA, 2589 bp, Heterodera glycines
ttcattggtaaattccgatttccaaggaattcaagacgcaatgcccagatccaaggatatacttataatccgaggactaatgtgaggccgcttgcttaaaattgacaatcaaaaattaaaataatttaagacttttttaattcagcggaaaaaactatgaaacaagacgaactcctcgcaaattttctcagcagccctctaccaccattgccaccaagaaaaaattcatcaacgaatacccgaaagagcacatcggtcaatgatcaacatgaaacgaactttcacaaacaatttggtcaaaatatttttaacagtaaggacggatcaactgaatctgaaaaacgatctaatcagcagacaaaaaaaaatccaattagcatatatggacgagaaggacaagaagtttccggcaaccaaagtgatcagaatactaaaaagacatcatctgataagcaaaggaacgaaaagaataaagacatttcatttgctaagaaagtagtcaaatatttatctgggcattcatctgacacccagaaagatcaaaagccaaaaaatggcaagaacgaagctggatcaactggaaagaatactaatcagtcgaatgatgtcccttctataaataaccagcgtgatcaaatttctcaaaaagcaaccaatgatttatatggacaaccatctgaaaccccaagttatcaaaagaaagcaaatcgcatgaacggagccggaccatcggagaagaaaagcgatcagaatgacaaaagcgagctgaatgaagggacaccatcagaaaatcaaattgacaaaaccaaaacaaatcgcttgttaaaagcaaaagaaattttgccctttcaacagaaagagtagatacatttattagggatgtgtgagaaatgaatttttaccgagaattgagaaatgacaccgagaaacaagaccgagaagtgaaaaaaccgagaaatttctcgagtcgcgaacctagaaatctttatgaaactaatttaaatgtaattttttaaagttaaaaacacacaaaggggttgggtcaatcggaattctgtgaaggagtctcaacatcaaattgacgaccttttatgcgtttaaaaactcttaaaaaatgccaattattgtgatttcgagccagtttatttttaaatgaaaaacaggatttttaggattcaggcagtgccgataggctcgccgtctgggaaaaattggaaatttgaccctttttaacagattttcaccgaaaatagcaattttaggtcaaattttgaaatttagatgaattttggggaccggcagtgcttatatgcgcagacggaagaaattttttgggatttttattgaattttgttagttcaaaatttcaataatttgacctctttacccccttctctggcgaccctcgcccgcaaaaaatttcttggtttccgagactaaaaaccctggaccgagaccgagaaccggaaaaccctagaaatttctctaatatagaactgagactctcgcacatccctaacatttattaacattgttgattatttggacagggctcccatttgttaggctttagccttgaggcttttttcctggtcaaattaaaaaaagagcttgttcttgctttttaaatgcaaatttaatagaaatttttaaattatcgaaaatgcgctacaacctgctaacaaagcaggcaaattattcaaaacacttaaatggcgcatttaaaactttcatctggaagcctttttattttgtgtatacatattttggcactttcctatctttcctttttattttttattttctttattcgtctacctcacatttatatttattattcgttgatttttttatttatgataaaaaaatgtaaattacttgacaacaatggatgagtgagtttaaagagaagttttaatttaaattgacagatgtttctaaagaaatatcagacaaattcttcagttatatataagcaatggctttcagcattaataattatttggggttttccgataatgaattttaaagaaaaaaagaaagcagtctgaaatatgttgtaatccaataaagaaatgttgaaatgttaattgaatcacagataatgatgcgcttttattcggtctcaattttttagatgtgtttacaacataatcattggcttatggcaatcttaaaaatgatttcataaatcttaatatatatttgttaactaactaaccttttcctttttttctctatacttatgcgtttttgtgcatttttctatgcatattctatctattcatgaattattataccccgatttttgagccattacattttttagggaactggggccaatcacaattacgaacgacaaacaacaaaacggacgacaaacgacatatttggcatttgtctccaaatttgtcgttacgacaaaaaatatttcgtttgtcgtttgaataagtcgtttttccgtttttcgtttgtctctgtcgtgtgaattgtcgtcaaatcataattgacaaaatctaccgtaaatttgtcgtttgtcgtcacttttcttaggaattaaccaatatttctcaagaaaatgtaaaaaaa

SEQ ID NO: 22013 - DNA, 2725 bp, Heterodera glycines
  misc_feature (83)..(83): n is a, c, g, or t
  misc_feature (88)..(88): n is a, c, g, or t
tcgcccgtcacagcgatgcttttcggtccaacagtacttttttgacatttccgggcacctcaacaaataagagtaaatcaatntaacnactcatatttcgatagtttccatagctttcattgattcttacgttggatttccgcattcctttcaacaaattttgctttgcttcagtgaaattttgctcgtccaacgaccccttatcgtccggttgccgcatcttcattaaaatctgttcaaattccttccgagttttgaatgaagtaatatcaggaaacaaagctttgtcattggcttttgtctggctacaaaaaatgcattattttttacaattaaaggatttttggaagcgataattaaatttgtgcatccctccatttttgcaatttttttcgtttataagtcttgaaattcgtttccggtagtttcgctttttcgatttagtatttgcataagcagcgacacagaaaccgcaagaaaacatataattttttttgtcaaaaaagggagaactttttaacatttagtgaaattttgacctttttcgccatatgtcaatcgctttaagataaagaagcaaaaagggagtgtgtgagtgctgctcatgggtcatcgattcgaggttagtttcattggccaattgaagcagttcgggaaatgggaagtccaacctagtgaaaggaaggtatgttaataattagtggtcgagagttgcaaaaaatacccctccccaaactttagaaaatttatctaaaaatcgaagtaaacgatgagaaggggcaaccgtaccttcccactccccatagcattatgcttaccgcaagtcataagcagcattttctgcatgattttcaaaaatgtaatgttcccgaaaggacagtcgcaaatgacccatcattccacaaacgttggcatatacaaaaggaatggcatgctcaaaaagaaattggtccagctgacgcgcttcgttagcagttagactggtgccaatcaccagcgaaaattgcagaagcatttggaagtcctgtcgtttgaattccccgaaagaaattggatgatgctgaccgtgcacagaatggtttaattcctttaaaaacaaacacttaaatggattatatttatccaaaaaataagcaccttcaaagccttgacgagacattcggcacggctcgaacccaaagaaccctcttcaacaaaaaagttctgcccaaaatcagcgtggtccaccaacgccttgtcaattatatggaaagaaccgatgccagcaaggacgagactcttgagcgtttctgcagccaatgagttggagccaaacacacaaacacgcgcttgttggattgacaattgaccatcatcgccccaaaggcgaatttgcctgtcatatcttttttgttgctgatccatcaaagaagtttcattatccatttttttgcttaaaatacgaaaaataaaattgcaattgcaccatttatgggaaataaaaagtgaaaacgaaacttccaagaaataaaaacaaaacaatcataaatgtttgttttttttaatttggccgataataaataaaggcgcttaagcataaataacaaatcagtgaggctctggaacatggccatcgacataaaaattcctcgtgattttcgggagtgtcactctgatgccctccaaatctttgtttagaataatctgacaggagagcctcgagttgggcttcagcaatggggccatgtcgagcatgtcttcttcatcttccactgcagctggcaatttgtcgtagtatttttcatccacataaacatgacaagtgcaacacgccaacgatgcctcacaagctccctcaatttcaatgttatacctaaaaaaaagatgagctaattaccttattcaagagtaccggtgagcaagatacatggcattgtcgccgacttttccacgtatttttttctccgttccatctcttgtcacgtaggttatgttgaccacttcttcttccgacttagggtcttcgtattcgaaatcacccgataacattttcaacgtgtggacagtttctgggtgtttagtgtaataaatggaaacaaagaccgcttcaacagtgtttcagaaaagaacgctcgcaaaggaagcattgaattttaacaaaaatctagattaaagcatttaagcaggattgggattagtcttagatcaaatgacgtccttggatctggaccacaccaaatggaaaacaaaactgtctggatttgaccgttttaaaagattacataaagtgcccattttattcatttttcgaatttgaaccttttaacacagagtccagaaaatgaacacctgcatcaaaaatttctttgatgtgtagatgtggttttttgtaagatagtaaatggaaagggggtgaaagttcgtcggtaatactatacacagcggcccaattttgggctccaagtacaaatatgctgggtttttcgtcttagtggtctgtgagttagtcaacaaaaagggggtctcaagttcaattcctccttgtgtttgtgtataaatttcaattttttaaagcaaataaataaaataataataaatacagaacgccaaaagaacaaatacaaacagtaaaaggtacacactatattttacccttgattttatgaaatttttttagcttataacttggccaataatagaccaaaaaagaccattttgtgctcattttgaagggaaaattctgaag

SEQ ID NO: 22014 - DNA, 2197 bp, Heterodera glycines
ctgttccgaaatggctttcggccggcgcccatatgcccgaaaataatcagcggatgatcaacggcaatttggcgaaattttttgtttatccaatagtccatccggcgcagatggaccaccgtgtcgtcgtccaccttggccacccattcgacaccggcacagtgccgttgttgccaagtcagggcaccgaaccactgcaaaaatgtttatagggaaatgtaaatcagacatatttaatttgtcaaagaattgtcaaaataaatgctttttttctccgtttctatcatttgaaaacagattaattattattaattaattaaataattgtcatttgctgatcactttgagatgtaaatgcttgtacttatccacaaaaccgtgcaaaaacacaatgtctccatgctttttctgctcttcttttaatttttgttttacatctgccgcttctcctcccgatgggtcggcgataaaaaatcgttgtatttcgcccggggcctaattaaatgcaagtttatatttatccaatccaaaaaaaaattaatgtcaattttgctcaaattttaaattcaaataagtgcagcccgttctttttcgttatattctttaattatgatcaaatttttttttaattgaatatttcaattatttttttctcactattaatttattcgacatttctcattaattgaattccttaaaattcaaaattgattaacccaattaaataatttacacaacgtgtttcatcaataaaatgatgaaaccaacttaattagtgctttaaattgtttcccccgttatttcgccaataaattattaaattaataataataaaatcaattaaattgttccctaccgcttctttcatccatgtctctctcgcgcccgttcgcctctcaaatgagtccctgcccgacattgccaacatgatcagcttggtgccagacgcacatttattgccaatttccattgaacagttcatgcgaatgtttttgaagagaattgcaaatttctaaaaagtacgctacagcatttctagaactgaccaaaactgtaaacaagtccaaaaaatattaaattaaaatattaaatttaaatgcaaaaaacaaaataataattttaacaaaaatcgtaaaaatggcaaaggtagttaacaaattttattatttttccgtttttgccatttttatacaaaaaagtaaccacctcagttggaacaaatgcagttttgttggcaatctgcttcacaagcgggtcagccagaagctgcattttgccttggacctgtaaacaattcaaaattgacacaaaaaacatgtctaaaagtcccgtgactttcgataatttcatggatattctgcaattagtcttcgacacccaaaaagctgttctcgcccattggcttcaccttgatccaactgatagcccccaatggcattttgacatcggttggacaaataaattctccaaattgtgtgccattcaatttgagcataatagaacagtgctcgttaagcacgatgtccaaattgagcaggtaactgcctgggggcagccgtacgcctttgcctggcattgactttgactgaaacataaaaaatattcaaatggtgataatttaataaattaattattactccggggaatgctacttcaaaatcactgtcagtgccaattttgaagctcacttcagtttgtgttgaaccatctaaaaataattttgtcaaaattcataaattaataaaataatgccaatgtttcatttaccacttttggcattcaaaagttccaccaaaatgcttttaaagttggcatcggttaatgcttttatgctgatcatttgcgactgattcctgctgttgacgaatttgatcggaaaattttggtcagtgtattttggaatcgacgaaattgaatccaaagattggaaaaactaaaagaaatcatcaaaaattggaacattgtgtcagtattagcccattctcagaaaaattaaaacaaattgcagaattaatggtacagcaattttagttgaaaagattttttgttaattttattaattagttatccatgctaaatccatttttaaatatcatttgcaaacattatttactcattctttgacaattaaaattatcccatgctttgtctactaattaccattcttttgttaattaattcattctcatgctttgtt

SEQ ID NO: 22015 - DNA, 2367 bp, Heterodera glycines
  misc_feature (2266)..(2266): n is a, c, g, or t
  misc_feature (2299)..(2299): n is a, c, g, or t
  misc_feature (2314)..(2314): n is a, c, g, or t
atcccacacatcgagctcgaggcggcgctgcgatccgcctacagagttacccatgtctaccgtgcgtacgtctggccgctgtattgtgactggagtaacggcctcttccactcctacctcaacaaattcctgcgcatcaaatttgagggtaagtagtaaattgatcaatcaatcaattaatcaataatcatttagccagcggtttccctgctgactgtgccgctgatgacattgacgaggaggagagggagcgcagaaagcagcaatacatcaacaacccctggaagggctgtacggtgcggctcgacgcaaacaacatcaagccgaatccgggcatgcggtacctttcgaagctgtgcctcaactcgctgtggggccgctttgcgttgcggaatcggctgacgaagacggaaatcatcgactgccacgccgacctggcgaagcttctgaacgacgtcaaaatcgacatcagcagcatcgaccaactgacggagaaattctggatggtgtgctacaaggcgaaggatgagcacgtggtggagcacgacaccagcaacgtcgccattgccctatggactacggcagcggccagagtgcacttgctcaactcactgcaattggtctacaggcaggaaaatctggttcagcgctacgacacgcgcattttatacatggtaagagtgtgacaataaaatattcataataaaatatttttttttcaggacaccgacagtatcttctacgacttcaagactgcactgggagacccgctgaagggaggcaacaagcttggggagctcgcggacgagtaccacagccataccatcgtcgagttcatctgtggtaaggactttgtccaaaataatttgaataaatttcaatcgatttttagctggacccaaggcctacgctctttggcttcggaacaacgcaaccggcgaggacgagtacaagctgaagctgcgaggcatcacgctggactcgaacgcctgcacccgcatcaactttgagaagatgaaagaaatggtgctggagaagtggggcacgcccggcaaccatgtgcggttcgactaccctacgaagaacttccgaatcacgaagcagggcgacattctgacggtgcccatcaccaagcagttcaaccccaccgtgaataagggggtgctccgggaccgtgggcttaaggttgtcccctttgggtatagctcatgggagtactgtaaggcccataacccctacgattgtctctgtaagcgcgaataatttattcattttgtacttttatttttcaaaatcctcatctgtgacccaatatttttccggaaatccgataaatttcaccaatatttccttttttccatccctcattcgttctttgtactttttctcgatcctatacattgtgttttcgtccacttgtacttttgttagctctggcaaataaaactttctctttaattttgtgccataatagtccttgagcaaatagtgcaagggtttggttgtgcgagccgcatcaacggtgtacacatggtcagaatagttgggaatatagccttaagcacaaaaaaaaatacagaaaaaaaaatgaaggagtcactgtacccttctcgaatatgtgtttgagctctgggattctgacagtttctcccgctttgatctttggtctcttctccgctggtacaagtccttcgccatagaccctcttccacacctctctcgcattgacgtcactgatttcgtttggcctaagtctgcgcggcacacagaattgttaattgcagacaaaaacttgggcaacacatccacccacgcagaggtgtttttggcagagaaatatttgtacagccgagtcttcaccgtacggatggctctctctgcgacggcagccttcttctttgagctggtctcatacttcttaatgccattctcagcgaagaactccttcatgggcttggccacaaactccagcccacggtccgtgtacagtgtttccggaagccttggcatttggcccaacacctcctcaaatgcccttttaacgtccgccggcctcttactctttacgggtgagccgaacatacgccgcgacaacacatccaccgccaacagtaggtaccgatagccgctgttctttcgcgaaagggcttggaagtcagccaagtccgcctgaacgtctgagccgatcacgtgaatttaacgtggacaaactcaccggtcatgaaccccgtaggcacagtgcgaaggcgtcggaacttctccctcnttggttaaacagcgtgtaggtggtgttcgctgncaaaggcatcaagtncgtctcttcagttttgggtgcttctcttgacgctgcatgagtgcactcgcacc

SEQ ID NO: 22016 - DNA, 2091 bp, Heterodera glycines
tttttttcaaaaatttcttttaaaccaaatttggggaattttttttcacacttcgagtggtgagaactttatttcccccaattttgtttttttccgcgagaaatttttttctttgagattttttttgtaagccaaagaaatgacaactgcttaaaactcgaaaaagtagtgaatttcccagattatcaagaattttcttgcttttctaatgttttaaaaaaatttttttttttaattttttggcttactgctaggagaaaaaacattttttagtgctcactgatgccgacgggatggcccgtgattttgtagtcgtacatgttgatcttgatcatacgatcgcgcatttcctccgacggaattattgcggacgaaatggtgtcgaagcgttgcttgtcaaaaatctcatcgggcaccttaaatttttatttttcatttatttttttttgtattaaatttagaggcaaattttttttatattggatatttcaaaataaaaatttgaagttctttataaattactttctttgttaataaaaaactcggcacggcaaatttattaataactttttcatttttttttgtaaaaaataaggaagactaggcgtttaaaatgtttggccaaacgacaatcgctcgaatttaaaaataaaatcttttccgttttctaaatattccatgaaaaaatagtttatttggtgaaattcataccaacaaagtttctgggcaacgtttatattttgccggagcaggttcttccccctcgaaatttttttaaagattccaatgaattactactattttccaaaaaactttcaaaaaaaaccctgcaaaaatttgtaacctttttcttaaaattacttatagaaaaattttgaatatttttttcacgccacacattcacttgatagcgtatcacacgtccaatgtcgttgtcaaactcggcataaatgatgctgcacagcttgggcggctcctggctgaagaagtgccgactgcaccgcttctgctgtcgttggggtcgctgctgttgctcctgctgttgttggtagtgccggctgtgttgtcgtccatgtccatcatgttcatctccatcaacatttccgtggcgtgccccgtcatgttcgtcttcgcccccactgccactgttgctcctggttgtctccgccggcaaagcttcctcaaatgacgaagccggtgatgccgtcgccgccctctccccatgcccgtcgaaatgtgcagtcgtcgccgtttccactcctcccacggcattgtccacagggtttgatgtcaaagatggcacgtgtttttgttgctgctggggattattgtccgtttgctgttcctccacgcccatctccatgttttctggtaaaaatatgtgatatatagaaatcgcggattcaaaaaataaaaaatattttccctcgactctaaaaattttcacttttttttatttcctgatttgcagatttttgtaaaatttattttatattttttctgaaaaattatatatttctcaggttataaaagtgctttaacaggaaatcccgggcacttttcttttagcagctgaatatacattaattgtaaattgtgtacattacacaccaacaattgcgctgctcctagaggtgtttgagtctgttgggccgatgttgcgaaaactgacgaaattggagcaacggctcactttggtaaggcgcaatggacggctttctgtttgttggatgggattaaattaaaggaaaagttagcgccgtatttagaatttttaaagaaattttagaaaaaatcctatttgtaaaaaaaaattttttctgtatttattttatgaaaaattggccaccaccttttttgcggacgcgcgaacggaggttttgtccaaatgcgaaaataggcggagagaacggccaacagaacgccaaacagagagccaaagtgtgagcagaggggccacgcttgccaccttaaatggcaaaaaataattaggtaacaaatcattccaatattctaatctacccgcgaatgacgaacctttactttttcagcaaaatattttgaaaatgtcgcagggaatttaatggtaaa

SEQ ID NO: 22017 - DNA, 1074 bp, Heterodera glycines
aaatctgggcgcatcggttcggggggactgccccgacaagggggcccccggaaaacaaaaaaaatttttggctccaaattttggcaaaatccaaaaaaaacgtaggagtcgaagggaggtccccataaattctgggcgcatttcggggggacgaaacaaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacaaaaaaaaagattttttcaagggtccgtttgggggactcaaacaattatggggagcaaaaatccaacgcagaattaaagtacaggctatagggaagctattcccgaaggattcggtctccccataaatctgggcgcatcggttcggggggactgccccgaaaaaaaaaaaaaaatttttttaagagtgcgtttgggggcttcaacaattatgggggacgaaaatccaacgcaaaattaaagtaaagggtttaggggaa

SEQ ID NO: 22018 - DNA, 2147 bp, Heterodera glycines
aattgagaaagcacaaaaagagaaaaatggacaatcgaataaactgcgttgagctggctgcttcagtgtctgttctgcgttttggcttgcgattcgctttttgtcctccgtcagaccgttcgataattgactagtcattttccaatcacttccgatcagtcattaatcactctttctgatcactcactgctgatcactctctgagaatttttttcaagcactgatcaatcccaatcgcttttccgtccactcactttcgcttcactcactgcacgccctcctcagttcgtcgcgactctcttccggcgaaacattcaatgaacaaaaaggcgccggagggcatggcaccggcataaaatattgttgttgtcgctgatgaagttggccaaaggaatggtcagaaaggcactgctccaacagatggacggcgtcggcacggcccaaaacgcgcaaatgctgcaaaaggtcgagaagggcacgctcggagccggcatggatggcctcccacagatcgagcagagtcagcgcggggcatagctcagtctcaattacctgctaatggacgatgaataaccaaccactcatagagcagcactttatgtcccagactttgtctctctctctctttttgtttatgccattcgccgcattagcctatcggcttaaaccaatggctttacctcgtgcatgaaaaacaatctcttacgtccgacattcgctgacaccttgcgtttgacgtcaccccccttatcccaggaatttttagggttttactctgcccggcttttctacctgaacgtggccacaaaggcccaatttgtccgcaagtgctctccagtctggcatgccctgctccaaaacattggccagtttgactcggatggctgctgtcagctggaactgtgtggagatgagagtgtccgtgccgaaggcgctcagtcgggacaaagacgagtcatcgcggcccatctgaggaccaaaaagagtcaatgccaaagtcagtgagtgatgccaacagagatcaatcattcgttggttggcatttgctttgtttgctcacccttttgccaaaaaggttcgggtcatccgcgtccacagcaaaagaaagcacttgacggtcagctgcgttgcccttttggtacagaacgatgcgtccggacagcgaacgcggaagtgccggggagggggcggacgacggcacgccggacacaatcagttggaagtgcaatccgttctgagcacaccaccgatgcacgtggtccggaatctcctgaacacgagaatttgagagatatgtgagagtctttaggttccaggtttttttgtatattggtctcttttcccggcggggctttggtttcgatccctccgatatttgaggatttatcatccttattggcttttgctagaacgatgaagatttttttagaattgaggatttcggtattttaggggtttgtggatttaaaatagccaaaatgtgttaactgttcgactgaaaattccaaagtttttcctggcggctcctatcagtggctcctctcctcaccaagtactggctgcccccgttggggtggccttcaccccccggggaacgcaatttgctcaaggcaacagcacaacggccctttgagcgccagcagaaaattgtgcgtttcggccagtaaaagtccgcccaactgctgctcctcctgctgccgaacattctgcacacccatcgcagtgtcgaggacgcaatagacgcgaagttgggccaactcagccgaaccgatgggcaccgggtcgtacgcattggcacagtccgcggggggcgcgacgggacgatggaagggcgccgcaggcggagtccaataggcacagagacggacctttgaaatgccatcccaacttatccatcaacatggcacacccttgctaattactcacccgtttctgtgcagtcgcgtgtgcccttctcggccttccggtcaacatgaactttccgctcctccgcgtcagcaaatgccactgttggcgttccatctggacaccaaattgactgtccgaacagcttccgtcgtccgattgccacacgcattgccaagcctcggcggaagtgccatcgccagtggttagttgggcgtgcagagagaagtgccagcaatgct

SEQ ID NO: 22019 - DNA, 1029 bp, Heterodera glycines
tcgtatgcaataaaaagaaatttattcaaatagctttgttgtctcgactttattcaatttaattaatagaagatcagtaatttttgcaaaaatttaaaaaaaattacatttgattttttttcaaataaaaatttaagtataatttggttttaattaaaaatcaaaaacaacagaaaattaaacttaaaataaagcagtcaaaaattttgaaactaatttgttttcatttttctcaataactaaatatttaatgaattttgaaaattacgtggttggttgatttaaaacaaagttcaaatcaaaaagtgtgaaaatcaaaaatctgacttttcctatgatttttttatcaataagagttcagtttttgcattttgaataaaaaataattacatttatttaatgttaaataaaaccatcggccagtttaatttgaattttgaaatattatggaaaggttaaatttcaaatggactaaaactaaaaattaacccaattgtaaaactgatatctaaggcatcccttcaactccagctaaaagtaagatgaacattaaatttgtcaaagtttttttctcaaaaaagatttaaaaatggtgggataaattgtggatcaacgccgtcattctcgcgcgttattgaggtgtactaagttttctctctctctctcttcgctctctctcttctctctctctctcttcctctctcttctctctctctcttcccctctcttctctctctctctctacctctctctctcttcctctctcttctcttctctctctctcttcctctctcttctcttcctctctctcttctttctctctcttctctctctcttcctctctctcgctctctctctttctctctcttccctctctctctttctctctctttctctctcttcctctctcttctctctctctcttcccctctcttctctctctctctctacctctctctctcttcctctcctctctcttctctctctctcctcctctctcttctcttcctctctctcttctttctctct

SEQ ID NO: 22020 - DNA, 1739 bp, Heterodera glycines
  misc_feature (1703)..(1703): n is a, c, g, or t
atatttttcgtattttttgtcgattttcattcgtctcaactgcttaactcataaaaatcacattatatgaatttaattttgattacccaacccttcaaaaaattttttttttttcttagacaattaaatagtgtggtccgcaaaagtcggctaaccgtttacaacccttatggtaccgaaatattttgcttgcccaatgtcaatatcaatttctgatttgaggtcggattttgcaccaaaattgccaaatgtgaatttaggcacaattttaaaaacatcccttttttgtcgggctttaccgataggcggaaaattggaaatttgactcgttttaataaaagattcatgtccaaaatggccatttttctggattttaggctagtttttttaaattaaatttaaggcaatttgttgccactgaaataatttcatatttaaaaataattattatgcattttgcaaaaacttcattgctttaattggttacctatcatttcgtcactgatcattccgtcactgagaaataatttttaaaaaatgttggcaaaatgtcattaggtatgtaaattattttcattaaataaaatattttttatttcggaaacggttattaaataattatgttgaaaatataatctgcatttaaattattatttcatatttcaaaatatttttaaaattatttgttacatgcgatggaatacatgcacaaatgagtgcgaattggccagtacagtttgatttgggctttagacagctccacgtggttttagccaaatttttaccatacacgcagtcgttgaattgttaaaatattttgtgctgacgtatattgggccatcatatgttcttgcacatcctcaaattaatgccggagaacaagagggagattatgggggcaagggtgcgacggatggctgcgtgcttgggttcaatacgaaaatttgggacaaaggaacgctctgtttcaagtgaggctaatttaggcattttcgtgcatatattttagcaagtttgttaaaaggatgctaaaagaatttcagcggtggcaacacatcgttgctgattattagagaccgactaaaaaggcactaataatcgcaaaaaaggcactataaatggcacgaaaatcccgaaaaagtcatgaaaaaaaggcattcgaaattttgttattaaggatttttagggcgcaaaacatgtaaaacttaaccaaataacttaattttggtcatttagatgattattttcgaataagaaaatttttaaacctaaaatttgttatcaagaaaaaaatgaaattttggcgatcaatttttgagaaaattttttaattcttaggggtgtattttcagaaaaattttcgttttaggggtgtattttctgaaaatttttcaattcttgggggtgtattttctgaaaatttttcaattcttaggcgtttattttctgaaaatttttcaattcttaggggtgtattttctgaaaatttttcaattcttaggggtgtattttttgaaaatttttcaattcttaggtgttattttcccgattttattgcattttttatggaatttttcggaaaaaacgcaaaaaaggcaccaaaagggaaaaaagccaaaaaaggcattaaggcacgaaaatcccgtaaaagcaaaaaaaaggcataataaaagtcaacgtagaagcctcaatctcagtggaanatgcgttatttatacttaatatgtcgaaactagtgc

SEQ ID NO: 22021 - DNA, 3213 bp, Heterodera glycines
aagactttacgaagaggcaataaaacatgactcttcgatcacaagaaaagacgttgaacactttctcgagggagacagaacatatactttacataaacctaggcgtgttaggtttaagaggtcacgaactgtgcctgctggattcatgactgatgttcaggttgacttggcagattttcaaaaattatcacgaaaaaataaaggattcaattatatattgttgggtattgatgtgttgagtaagagggtttttgctgcacctgtaaagacaaagaaaattatagatatgaaagaagcgtttgacaaattgataagtcaaatgccgatggttcctcatagaatattttcagatagaggaacagaatttgaaaatagagaaatacataaatatttccaagagaagaacatacaaaagcacaaggctcatactagtacggtgaaggctgcgctagccgaacggtgcataagaacgcttaaacaacgactatatcgttattttagtcaaaaacatacaatcaaatgggttgacgttttgccaaaaattgtaaatgctttgaataactcaaaatcacgtattacaggtatgaaaccagttgatattaacccgggtaatgctcaaaaaatttggaaaagagtctatggagatgaattttcacgaaaagcatatagaaagccaaggttcaaggagggtgaccatgttagacttgcaaagtataagtccagttttgaaaagtcataccttcccaattactcggatgaaattttccaagtttacgatattaaaaaggctaaacctcatagatatggaataaaggacgacaaagaagagccctttgatacacgtttttatgctgaagacttggccaaaaccagaaaggacgcggagacgacatacagaattgagagggtgctgaagactaggacaagaagtggacataaagaacatttggtgaaattttacgggtacaaagaaccggagtggattaaagacaatgatattgagagatgaatgtatttaagtgtattgttattatgttttagaaaaataaaaatgtcaaatttattttacgttcttttacctagtgactctcctggttatgacaataagcctaataaatttagggttcatttgcctaggaccctaacttttggaggtcaatggttgtgtgggttgcacagtataatttatacaaattcttggcccgccattggtaccacagagaaccaatggattaaagtgcatttaaaaaatggtgataaaataaaaattgatattcccgctgggtcataccaaaatgagcaagaattggaaaatgctataaatgagtcgataaaaaatggtataaaacaaccagcaacaagaatgaaaagacaaacggaaaatggagtggatttgttttttcattataatccggatgactattgggataaaattgaggaagaaaggcagcgatacaacgaattgttaaaattaatagagacaaagtcaagtgaacgtgacaatgagatggacacacataggaagagaaaaatacaggaggaaaaaattactcctcttcaaaatcaatcattgactaagaaagcaagaatagaggcgttagaagaagcagcaaggcaaagagatgacggaaaggaggaaaaggaggagagaactggtcaagaatttctcaaaatgtatccagtaaactatagagagaagctaaatgaagttcgattagaattaataagagatttattcaacattcaagaccatatgaaaaaataccaaggagtaacagatggtagaacaattcaagaactaaatgaaatagcaataaagatgagaacagcaatgaaacacagaagaaaaaatttgaatgcttttaacaaggctgtattgaaaaatgatttacaaatatcagctgaagaatatgagaggacgagctatgaacaaaataaggattacgttgagccattttttgatagtcatccaacagattactgggaacatattcataaaaaatatgaaggccttcaagacgattacaaaaaaattcgcgaattaagagaacaacaacaatttttgactgatgaacagaaaaaacagtcaattcaggatgaaattgatcaacttcgtcgtcttgtcgattataggaaaaaaagatttgcagcgctagagtatgaagctaaaaagagggacgcactccaacaacaaccaatggctttagccttgactcatggtgaagcactgaaggaacgaataggaaaaattgagggaactaccaccacagcagacggggaagagacaaaaactcatggaaaatctttggttgagttaatagaacaggtacagaaagaaagagatgatagcaaggccaaaactgagggtaagacacgaggagaaattttaggagataaattaaaagccaaaattgatgaacaagacagtagtgcagatggtgcaacccatggtgaagcactaaaaaataaaccagaaacaactattggtgaaaaagtaatgacaagaggagaaattttaggcgaaaagttaaaatctaaagatgaagaaaagaaagaagaaagaataacccatggcgaagcattgaaaaatagaattgaacaaattcccgaagaagaaaaaacaaaaggaaaaataagaggcgaaatattaaaagaaaaaattggggctagtaaaccaatagaagaagaaaaaaaagaaggaaaaacaagaggcgaaatattaaaagaaaaaattggggctagtaaaccaatagaagaagaaaaaaaagaaggaaaaacaagaggagaactattaaaagaaaaaattggagttgataaaccaataagacaagaagaaattgaaggtgtgaaaacacgtggagaatcattaaaggatataattgtttcgaaacaaattgaagcagtattattcaaatatttgaatgagcgtaggaaattttcgatttattttaatgaccgaagaattgaatttattgaattatcagcacaattaggatacattcttgggtttgaagacacgacaaaaattaagaatggagatatagcaaagtattattgtgatttgaagggagggattgatagtctttgtgtttacattaatggaattactgagaatgtaatagtaggcgaccaactggcttcaattttaagaattgtagttgttgaaggaaaatttggagatgtagtagaaaagatttataacactcccaatgt

SEQ ID NO: 22022 - DNA, 1516 bp, Heterodera glycines
aataattaatttttaggttctaaaaaactccaaaaatagttgctaaaaactttcaaatttaggggtgtaaaatgacaaaatttattcaaaaaagtaaaaaattaggccaaatcagtattgagtaaataatttttaaaatcacaaattcttgtcaagaaataaataaataaattttggagattgatttttgagaaaattttcatttcttaggggtgcatttttgaaaatttgcgggccaattcttagggggtgtatttttcatttttattgcatttttcatgacaaatttttattcacaagcaaaaatagttgaaaatagtttttttcaaaaattttatagttttttagttgctaaaaataaaaaactagaaaatagttgctaataactcgaaaagtagcttaacaacaaccgaaaaaaacttgtttttcgtatgttttaggccacggagagctcaggaaaaaaatagtgaaaaaactataaattggagccctaattataataagcactttccattgcgtatattaaattttttttgatgaaaaaagttaaggaccgaaaattgaatatcgttttataatcgaaaatttcatatttaatatgtatcaaaaatcttcattattttataaaagctaaaagttaaagcaaaattaaattaaaataaatatatttaataatatttccaaatcaaatttacttcattttttccaaacaattaatcagaatattattaaaaattcagaatttcaaccttaatctgatcagaaggtaacaccgatttggaaaatcgaaaaaattttgtcgacaacttcataacttcggtattttccaaaaatccaatgtaagtgggggaggcagtgcctttcggcaccgccgtaaaaaatctttgaacttttaataaaaatttgttgacagaatttatccaaaaaatcgccaaacttttgggttttgagtcgttttttaagaataagggagatgttttgtttgtccagcagtcagggacggtcaacgggattttttgccttggaggggaaaccatcgccctgctgctggtcgacgacccttttttttttttttgcttttcaccacttttttcgcggaacgctttttccaagaaaaaatttcgagaagaaaaaggggggggggcggtgcgccgggcccgggaaaattttgaaaattgagtgcaatttgtcaacagattttgtccaaaaatgaccagatttggcgattactaggctcaaattcttaacgcgttttcttaaaaaatgataaaaaattgtcaatttaaaataaatatgaagaatcaaactttgtcgacaggcaattcctgagaaaaaaaacgaaaactaaacatttgcatgttttgctaacagatttgcacttttaaatatccatttttgcattttggctgaaatttttacattaaaaaaatggtaaatgtataaaaaaccaataaaaaatcaaaatatatttgattcctgcggagggattgaatccctttcccccaacctgtacagc

SEQ ID NO: 22023 - DNA, 1337 bp, Heterodera glycines
aaacgattgcaaagtgatcgatcactgatcagacatttccttcctcttttttggaccaaatttcctttcacattattatttttagcaagaattaattgttcgtttaatataatttaagattttttattcaaatttatgcaaataacaaaataattaccctaatttggatttaattaaccttttttaagtaattttttttctttaaaatgcgttttcttcacgcgccaaaaacattcgttgcaattttcggcacttttttaatttgggcacccaacggcgaagcgatggccaaagaatgcacaagtcggaaacggccaaattgcaaggatggccacaacaatttaatcgaaggacggaccgatcggagcagtaattgaaattattttaaaaatttatttgctaattatcattaattataattatactcagtctatagaaggtcatcctgtaaccatcaaattccttcggggcactgtgtacaggtcggacagtacgccgtcctgctaccgtaacaaacctaccgtactccttccaggcgttggtcgtctcgttgaaggttcaaaaattaaaaaaaatttgttttttcttggcatttttttatcaaattattaagaaattttgtacaaaaaatgacaatgttttgtggttttgagccgatttttgaaaataaataaggaggatctgggaaagattggaaatttggcaatttggcaatttggcaattttcttaacaattttgcaccaaaatgataaattttggtgagtttttaaacttataaaaaataagaaagttatattttttaaaatctaacaaatttttgagttgggaaaaatttattaataattaataaaaataattataaaattacttttgtgaaatatctgtgagaaagagaaatcgagaatttccgtcccggtccgtcaactctaagtttggacaaatattttttatgtgtttattatttctatttaattcaaatatttgcccccaggcgaaatgaccgtcccaccgaacaattacgacctggtcaagtcgggtactgtaaaaatgacaataaaaagtccgagtttcgatgacccactttgtgtggagggcgtcagtcaatacattgcgctgcccaactcaatgtggtgagcaaaaataggaaatgcaaaaataaatatgtaataaatatatttttaaataaaagatttttcaattttaaataattaaaattattttattaatttttaacgacggcttaaaattaattaaagagaattaactgaattattaacaaattattccttttctttatacctttttaatattaaatattcggaattaattttaaatt

SEQ ID NO: 22024 - DNA, 281 bp, Heterodera glycines
cgggggacctctatatgcggacatctacatttttgaattgaaaaaaattggtcttactctttctttttctccatattgaccatcatactcatactccccccaccctttctcctccttcattttttttttcctttccttctccaaccctctcctccctctcttgatagtttaaactgaaggcgggaaacgacaatctgatccccatcaagctagcttctgcaggtcctgctcgagcggccgcccggggatcgatccccgatctagtaacatagatgacaccg

SEQ ID NO: 22025 - DNA, 133 bp, Heterodera glycines
gcaaaaccgaaggcgggaaacgacaagcggagccccagcaagccagccacggcaggacccgcgcgagcggccgcccggggaccgaaccccgagcgagaaacaaagaggacaccggacccgagaggacccccgg

SEQ ID NO: 22026 - DNA, 210 bp, Heterodera glycines
tcatctatgttactagatcggggatcgatccccgggcggccgctcgagcaggacctgcagaagctagcttgatggggatcagatcgtcgtttcccgccttcagtttaaactatcaagagtatgagtatgatggtcaatatggagaaaaagaaagagtgattaccaattttttttcaattcaaaaatgtagatgtccgcagcgttattata

SEQ ID NO: 22027 - DNA, 2258 bp, Heterodera glycines
tttcgtaacagcctgcaataaatcactgtttaaaatgaattttgttgaaaaattttaaattttcatgaaaatagaaaacgttggtttcttggcaaataacttgttcaaaaaaacgggacaggatcacgcgggattaatccgagcatcttttgctgactggtatccagcaaaattccgcgcgagatcctatccgcgccgggcactaaaaaatacaccccctaagaattgattctaaaattccagaaaataacgcctaagaaagaaaaaaatttcaaaaatgtatctccaaaattatttatttactttcttgacaagttgcaattgtatgggtgaaattgataaaaaaaatctcatttttggaatttttgtgcataaaaacagtggacccaaaatcataaaatattaattgtgcaaaaaacgaagccctaatgattaataagtagggatgtcaattttatgtaaatacattttttttttcctggcttctccatgctctaaatagtaggaaaaacactttcttttttatttttgcaaacaaaaatcgggacttttatttacatatttcggggttttatacatattttacatatttcgggattttatacatatttggtacatattttggactttttcttacatattttgattttttttacataatttgcgggttttttacggaaatttttggaaatcctcaaaaaaaaatccaaaattttggtaaattttttatttttttatacatattttgagaatttttgaaaatttttagaaatttctagtgaaaaaattaaaaaaaaactttttttaaatgtacccctccaaaaataatttcttaaatgttaaaaggtgattctaaacatatttaggtcatttttatgccattttacgcctatttaacactttacgaaggttttttctcaaaaaataaccatttaaaaaaattttatttacatattttcgtacatattttgggtttttatacatatttcttacatatttggggattttttttacatatttatgtacatattttgaccaatttttgtacatatttttgacatccctatcaataactaatttagaaaaatgaaataaaaattcttttacttcgcagcctacaatataaaagccattggaaataagttttcatgatttttgataacaaaattttttccaaaaaatgtgttcatcaaaataaacattaatttcataattaagattaattttttcggtagaatatggccatttttgtgacatacattcaccagttatactttcgcaatggcggtaggggccaattccgtatcagcaaagttcaaaaagcttacacttttttctttgttgataaaattaacaaacatggtatcattcgaaagctttaaatcttttgaagatatttctagctatttttaaatggttaagcggctcacaaaaaaagtcgtcgcttgaaaaccgcaaaaaggcagaattttcgaagtttttttaaaatttttttttttataattcgacattctcagtaattatagtaggctattagagcctgtaaagagctttcgtttgatgaaaagtgttggattctgtcaaacaacttaaaaagttatattgactcaagttagctcagcagacggagttggcccgtttcgcccaatagaataatttgctccgccacgtttcatttcgccaacaatctctccgatctcgactcttcggttgaatacttttctgctcatgacttttttaaaacttaaattctttgaaattttacagctaatagaagactcttgtggctatcgaaagataccaagaatgttgaatttggatagtgtttaaaatttaaaatattttaagtgcctttacgatgtaactctctataggtctgagtagagcagcgcgggaccaggaattttgcccaaaaccgggacttgccgggacctgagaagccgggaccggaacctcgattttcgtgcgggaaccgggaatttttaaagataaaaaaaaaattcaaatttaatttattcaagtgaaaaaaatacaaaattaaatttttacacaaccagaacaagatttaaaaaaagaacaaacattaataaataatatatttatgaattcgaacgaaaaaagcaacaaaagacaatgagagagcatttatgaaaataaatgagcatcaaaaaatccgtttccaattggtgagatcgatcatttcacaaatataattaattcacttccgcacaatttgacattttcacaaatatcactca

SEQ ID NO: 22028 - DNA, 1362 bp, Heterodera glycines
ccccagcggttaacaaccgataaaaatggctttagtttgacggcaaatccgacgacggcaccaaacgaacttgaaaaataaatgattattctatttttgattttattaataaaaatgcatgattaattattttaaaatttatatatttaaaaataaataaattttcttacccgagcaaatgttcgatagcaatttcgaagtagaaaaggccgttcgaatttgcacagtcttgaatggaatgtttcgcaaagacagttcgccaatcttttgtcagggatatgtttcattaatcagataatgataatgctatggtaaacatacatggaaaaagggtgggggtgtaaaagaggtgcggggggggggggtcgtcggttacggggaaaagaggaaatttctgaaaatttggctattttcttaacaaaattcattaaaaactctgaaaatttttccccggcggcgcctatcggcaccgcaggccccccaaaaatcctaattttccttaaaaaattagccaaaaatctcaaaatttggtaatttttagacaaaatctgcttacaaatagcattaaaatttaaaaaatgaggtttgaaaagcaaaaaagtcgtcaaattacatggctggaccccttcgcaaaaatttcggttgacccccccccccccttttccatgtatgatggtaaattagcataccggggttatattttctagtagtataacggatcgtcctatttttagaatcaaggatttcgaggtcacataaaccgtagcagggataatcatgggaacgggcctcgtaatcccaaaaattgatttgtttcatcggtcccatcggctgtggtacgagaaaatttgacgcctaaaaaagatgtgaacacgagaaaataagacatgagaattttttctaaaaaatatttttactctatatttgtctaattttaagaaatgacaaaatatttgtgggatttgtaataataataataaataatttttctaataaaataattcgacgcataaatgcggatgtaataaagtgataaaaaaacatttttattcaaataaattttcaaaatttaatacttgcgcttttttctgttgtttggcattgcccaattttgtggactctttcgtcgtttggtttgccaactgaaaatttacgaaacagcaatcactaattagtcgaggtattttttaaaagaaatatttttatcaaaacaacaaaaataatccgaaaaaattaaatgatccacgcctcaattgaccatttgttgttgctgcgtctccaattggacaattcgtcccaaaagcgcattctgatcattttgaaactgagtcaattggccaactgaaactgggcaaagcatta

SEQ ID NO: 22029 - DNA, 1242 bp, Heterodera glycines
aattcattttggatggtttttaaaatatcgcacataatgatgatgtttatatataacatgacatcgttgtaaagattcaatatatatttatataagatcataatttctaggaagatttggtaaatgaactcagtaagaaggatgagtgtggcggcaaaggcagaaaatgtttttgttgggcacatacgaagatcagctcgtgaatctgctggcggctggtgttatatttatgttctgggacaagacacaatgatctcgatgtgaaacggtagccatggataatgacaataatttgattaattaacgagaatttaattgtcattcttttgcattggtcataattctttcattcagactggctttcgaatgataccaattttgaagaaatcaaccgacgaacaaaaaagttatggccattcccattcaaattgtacgaaacgccattgtacgaactgccttgaccccagtttccttcattgtttttaagtggtgttatgtcgctgaaaaattcgtttgctcttttttgatgcaattttattgaatttttaaatttttatttcatctacattagattaaaacattttgatatctattaatttttattttttaagatatctcataatgggtcaacatttttgcaattattattataatatatataaacttttttaactgaatttatgttttttatgatctgaaaacgaaaactttcatttttttctttaaatgctcaatattcaatgtaatttttgtaataatttatattatatgacccctcatgataagcagggctgcaaaaaagtatgcacgaaatggccaaaatatgtgtataaatatgcaaataaagtcgtgaaatatgcacaaaaaaaaaacttgaaaattaggggtgcaaattaattagaaaattttattccacgtaaattttatcggttgtttttgcaattgcaaataaagatttcttaagattttcggcagtgaagctcactgttgacccacttgcgcatccattcagatttcgatttacttttaggcataatcaaaattttttcaataagagatattcaaatcggaaaatatttgacgaaaatggcaaaatatgcaaaaaatctgaaaatatgtaaaaaaatgtaaataaaagtcacgatttttatattcaaacacaaaaaagaaagtgtttttcatactaattagagcatggagaagcctggaaaaaaatgcatttgcatattttttgcaaccctg

SEQ ID NO: 22030 - DNA, 1964 bp, Heterodera glycines
ttttgtatgtttgtcgtttccttttgctccaccatatatctcttcacattatcgtaaattgtggcggacgaccgtattcaaacgtctctttttttctatcgtttaaaaaagatgtaaaagcaatgtatttgagcataaaataacagactgtggaatgagtagaaacgaaagaggaaaaagatcaaggatgggggggggagagcaagcacaacaatagtccaattgcgtagccagacccttggcttcggggggggggggttgaagtcaaaaattcgatttttaggggtgtatttttcttttttcagtcgatttaattgcttaaaatttaaaaaaaattaactgaaaattttttacttttttgggtttcgggggggggggatttagcccaccctcagccctccccctgcctacgcccttgcagtagtcatcacagtacatagtccactctccttttcgtcgacaaaatgaatacgatcgtcttctgatttttgactttcattcactcaaaatccaaattaaagtttaaaattttggcgttcttcctttattgaaaaaataataattgtcgaacagacccaaattgagttgctttgtgcaatagagaaagccctacattttgcaatttagttccatattgcgagagttacaatttgactgccctattcaaaaataacaattttccttaaaatctgttaacgaatgtgctcgaatttgaaattccaggcgacgtctataaattaaataattctgatttgtttcgttcttcagttggtcagtgtctgttgcgccttgctgctgtgtcatcgtcaaaagtgcactttttatataattaataatttaagaaaaggtaaataattaggtaatttcgtttagacattttgttggacaaatattaaaaaacaaaaacaatttatgcgagagatccacataacattcaaaaaatggctgtccacaacaacgtattttattcagtttgtctggtctaaatttattcaatttgaaacagcactcaaataaatagcatacttcgccaatggtcgggcgcatcaggatcatcattattatcatcatcgtcatccgcgctgaattgtgttacgcgatttagtttaaaaggcataaacttttaccttgccatggaataacctccaccggctcttcctcggcttccggctctgccggaggcagccgattagcttccatccgctcctggcggcccctccgattctcctccttcattcgccggtgctcctccaaaccttctccctcttcgtcggtcgccaaattcgatctggcctcctaaagatattaggggtcaaatttaaggaaacaaatgcgaacaaaccagtattatcaaaacaataacaccagagacaaggaggacaactagaattgctgaaaatgatcaaatggaaattacactaggtcagtccctcccatgcctaccctttcttccacttcggttcgaaggaaatggacggacggcgctggcgataaaggcatagtcgacggtcaactgaagaaagtgtaacccatcaaaagatcaaagggaaaaacgtacactcaaagtgcgacgatggatcgccagtccacaccattgcaatttgtcatagcggcgaatgtgaaacattattcttagaaaaaaaagttgagggggaaatgtgaacgaaacacaaatacaaaatattcataaaagcaaaaactgtatactagtgaaactaaatgcaaaaaagcgtttattcagttcttctcacttagggggaaatagcaacaaataaatttgcaaaacaaaatatcaatcgaaattttcctgtccgtcattttgcgttttcgtcccccctctccgccggcgtatttcttctgttgattgtctcgcggctgttctctctgctggtcgctcgctgtggcggtgttggacaaaaaggccaaaattcccttcgtacaacgatttgcgtaatggccttttt

SEQ ID NO: 22031 - DNA, 1571 bp, Heterodera glycines
tattaaacttcggcttaatggcttactcatcagctccaacttttgcttcaccatctgatcaatgcaatttgtgtcgcagggatcgttaatttgttccaaaatttctgtggtgccaattgtttcgaataagtcattcaccgctgttggacgttcggccccgacactttgccaagtgtggcttggcaaaatcagaaaaatgccaaagtttgtcagttcaaccgccgcttccattcggcacaaatttttcacccatctcgccgtctgaggaaattgaaaaaattccaaacaaccaaaatacatattcattaggggcctggaccggatcggtagatcgtcgggatttccccagcctccggaaggaaagaccggggtcggcagttaacaacacaaaaaatctcgaatttttcggcttttatcttgccatctaaaagccaaaaatactttttctggtgcaaaataggttcagcaaatcttgattatattggatcaaaaagaaaaaaattggagattggcacaattttaatggttttagtggattgtgattggaaaattcggaaaaaggattttaacgctgttccggtccttccaagtcccttttccgggttttcaaactttttaattttcaaaattcattacaattggggattttgacagggcgttcagaagtgtgtcacccatctcattaagccatttcaacagagtgttcgtttcttgcacgaaggtttcgttgtctccgctgtcgctgatcaaagcccaccgcaaagcattggccaatttgcgatacaggcgaatgtaagtgaacaacagaatgtgcttttggcctttctgagagttatccccgaagatggcactttcctctaaaacttcggcaataatttcattgatcaccggatcccgcttctcctttaagtaagcgatcagttttgaaactgtctccgccccttttccgtgttggtcgttgtcccgtttattgaccaatttggcaaattcgtggcggttgttcatcaaatttttcaaatttccttcatgaaaaaaattgatttgaaagaacccaaatttgaggacgttctctcccatctcgttgacactccccgaggccgccttaatcactgattctctaatttttgcgcccgttctcggctccctttcttcaacagttttgcgaacaacaacatcagtcggcatatttgcacctttaaatgttttatgtgcccaatggttgtcctcatttgactaattgccattggggggggggactcgagaaagccagggtcttggctaactaatgacgggatagaaaatgatatacctaattattagggttgtaaattatatggattaacatattttttctgcgcatatgctatgaagaaaggggcttaaaaatagcatttctgcgttaaaattttttgatttggtgaaggtttttagtccatataaatccatattttgggggttttcgggaataaatccatatttcgccatttttgggtttttagtccatattttggccattttttggaaattttcacaagaaaaatgaaaaaatacgaaaaatacacccctaaaga

SEQ ID NO: 22032 - DNA, 2167 bp, Heterodera glycines
  misc_feature (1906)..(1906): n is a, c, g, or t
  misc_feature (1960)..(1960): n is a, c, g, or t
  misc_feature (1987)..(1987): n is a, c, g, or t
  misc_feature (2012)..(2012): n is a, c, g, or t
  misc_feature (2049)..(2049): n is a, c, g, or t
  misc_feature (2067)..(2067): n is a, c, g, or t
  misc_feature (2069)..(2070): n is a, c, g, or t
  misc_feature (2106)..(2107): n is a, c, g, or t
  misc_feature (2117)..(2117): n is a, c, g, or t
  misc_feature (2131)..(2131): n is a, c, g, or t
cattgatgactcttttgttgtgtattttatacacccgaagaattgagaatttttggtccgacaacgacagatataacatcgatattattattatttaagcacagcacaaatttgatccatgcgaattcacttttgattatctcaagatattcagaacgaataaaaaatatttttagtgtttttatggcttttccatttccacaacgcatgcaaatgtatagaattggtgcattaatcgcaccagcaattgtgatcaattgtgctgctaatcgattgattagaaactgcagttaagtatcactggtgatcagtcctcgtgccaaaatcttgttgatcagtgcaaacaaaaatctgaaaaggcattgttttaatttaaatttatatgaaatatttttaattgtgtaattaaatttaccctttagtataattcccatgacaatataaatgacaattgtagccaaagtaaaaataaccgttatatgagaaccaagcataattacatttgggatgttgtagggcaaatttaaaacacaaataaaggatataaaaggtaattgacgatgaaaaaacattggtaaatatgacatatttgccggctgatctggagctgttacggaaactaaaaatacaaagacaaattttatttaaatattaaataattacaaaacggggaatgccaatgccaccaatcgatcaatacttatccaaaacagattatgaaagaattaataactgctgtaggtccaaaaaattgggcataaacccaagtaaaaagtggaattcgcacgcgaaataaaacgaggactaaaaatataatattaattaaaaaaaagctgttgcatcgcctgccaaaggaaaagtaattttcattcaatttataatatttattttataattttctcatttttaatgaaaatgtatcaataataatatttacaatttgagtacaccgttgctccgtacgcatttatataaaatcttcttatattttttcaattatacaattttctatttcaagctacaacttgtgcactggatggttcagtctctacaggctcagcctttggcttggcttaaatcgccaaattggcacaatgccattcattaagttagaatttaatgagtttacctgctgctggtacctttttgtcctttgttttgtctaaatttcattttttaaattaaattattcttacaatattacctttcttagctgcatctttccctttgcctgccttctttgccggcttttctttcttttctagatttcaaaaacattttcaaaaaatctttttcaaataccaactaaccctttttcacttttccgtcctttttgcccgctttttttgcatcttttttcccaccttattaatttaaattattatttaatataattaaaaacatattaaattcgttaccctttgcagcttttccttttgctgggctggcaccttttggcgaagcttttcctttggcaggcgatgcaacagctccttaaattttaatatattgttattttcaacaattatattcaccttttttaccgtcctttttcactgcttttgagttcgctaaaatagatatattttattattgtttatttttaaataatttttattaccagtctccaaaataacagccatcaccagacaaaccatagccaggaagagaacggcacgcatttttttagatttttaattaattattaagaattaatattattgtaaaatccgaatctatgtttgtatgtgtttatttaattccttttatacacctttaatttgatgacctgaaaagatgccaacataacttatttgcttcatttcgacttcctttaattacatcatcatcttttttgccaattatttattttattatgcctctataatgttaaattttttattanaaaaatataattaaaaaataaataacattaaattactaggtgccattctctttnttgtcggatatcattcaaaaaattatnggtggcaaaacataaagatgatganattcattaacatcgatagacgaaatatttataatttngcatgacatttgcacganannttggtggcaccatttccgctacccgattatggcatnnattagcagcnaacattaataatanagtaaataatttaaatatattttatctaaattaaat

SEQ ID NO: 22033 - DNA, 2249 bp, Heterodera glycines
  misc_feature (2178)..(2178): n is a, c, g, or t
  misc_feature (2197)..(2197): n is a, c, g, or t
aaaaaaatttttatttttgtttttgtttgtagatttatccgggagcgttcattttcaatttataagaatattttagcagacaacaggatgagcttcacgcccgaaaaccttgagaaatttttaatttgtaattgcaaaaatagccgatagacagatgggatggcatctttttttgcaactcaccagtcatgcttcttggagataacacattggaagacagaaaagcacaattccaaaaaccaagcacaagcgtttgtcgtacaacgctcttgtgaaaaacaactttggtgggccactttgatggaccgactcacttttggcaatagagcagcatttgttataattggattacaacaaaaaatggaccacataacagatttaatcgccagaataatttgaaaaaaattaatagttatttcgttgggggaaaatgttcccgagcagttcaaaaatcacaaatcgctcaaacaaatcaccgagacatcaccagccaaaatattaacttctttgatcagtttggatgtgccatttgagtaccaaaagggagggcaatctaaagaacacaaaccacgacaaaatttgatgacaaacggttaacagtaaatgtgcaggatgataatgacgatgtaaattttactgttgttttaaatggggaaattaaggcataaaacggtccttcgtggccatatccgtcacaggacgttagacaacagacaaatttctttcgaccttcatttccaaacccgaatttcgtccttttcgatcacaatttttcggcactcaaaatttggcacgaaattttcaacaaaatttgaatttacgcgacaacaaaataacaacttttgacgacagctacaaaaaataaaaaagcactttgtctgctaaaatattcttataaattgaaaatgaacgctccacccttgcgccgattgaattggagcatatttgaactttgcaatcacatcgggtggcaaatgcatttgaacatattcgccccataagaccattccgatttcctaactttctttaattaatgctgtcaaacttcaacttttacccgcatttgaaaattataaagacatttaaaattcaatacccagaacaaacagtcattggattgatcgaaaaattttttaattttttgatagctttgactatcaaacatttaaaatcagtattcgacatggcgagaaatctgaaagagaagtaagggatttatgatttaatgtaatcgaagaaccctttgaccaattttcaaattcgccaaaaaattctttcagattcctgcattacagaccgagaggcgtcaaatgatatatcattcgtccaattcggtgaggtacacatattcttcaatttttcccacatctgaattgaaatattttaaaatttaaatttattcgcaaaaatttcacaaaaataaaatgcgataaatgagaaaccaaaaatttattattaatcgacaaagcatgaaaataaaacaaccacataatggaacttaattttggtaaataacaaacaaaacacatttacatatatattagctaggctttggacaatcgaacaataattaattaatcagttagcgaattttgcacaacaacaaaaaataaacgagatttcttttaccatgaaattccatttaaatttttgatttgccacaattttttgttggtatgcaaaaaaaaatctgaaattttggcgttgatttcaaaatgtttgattgcaatatttggtgttttattcagtgaaaccctcgaaactcctcccaagttcagtccgtttccttccattagtgccattaatcaccaatttgggtggtgccgccgccacttctcacggtgtgctcacatcgaatgccactgtcagcgcttcgtcctccgctcggtaaccgttggagttctgccaatactgtggtgaaattagcattttcaattgggcaccaaattaaaaatgagcatcaatcattacgttaaacagcatgaaatggtggaagaacgcgcctttgttcggcgagtgaatggcgccgactacgccctcttgcacatagtccgccttgccctccgtccgcgccggaatacgacgtgtgacagtgcaattgcagctccacgtttgaactaaattcccaaaaatttaagggggaaaaagctcattaacctccgctcccgatttttttanagactaagttttttgattntttctttaaaaatcgaaagaataaaaaaattctttttgaaaggaaatactat

SEQ ID NO: 22034 - DNA, 2208 bp, Heterodera glycines
  misc_feature (46)..(46): n is a, c, g, or t
  misc_feature (65)..(65): n is a, c, g, or t
  misc_feature (106)..(106): n is a, c, g, or t
  misc_feature (121)..(121): n is a, c, g, or t
  misc_feature (200)..(200): n is a, c, g, or t
  misc_feature (260)..(260): n is a, c, g, or t
aattcagcagcaatgacgatgtgggaggaatattccgagcgagatntgattaattttgcatattntatgctcgccgggtccggatttcaggcaaatttgtgcattntaatgaaaaaaatanttaacttattaaaaaacattcaccaattttttcgggttaaaggtacgtctttttgaaaagttatgggcaaaaaaatatnttcttgttgattgtatgaaaagaaaaacttttaaaagattgatagttgaacgaaaaaaangaaatttaattttgaatttttcttaaaatttttcttaacaaattattttttaaaaaatttagaaaatggaccacaaatatttcaatgattcggagaaaatgcggttgaacaatttttacgacagatttcgccacaacttaagcattgaccaatttttcaacgaattttttgataattttggcttatcatgcaagcaattttttcaattctgccaactcggcgacacagttttggactgttgcaaggtgaaatatttttcttcaataaccttggaaaattatgaaactaagttccaaagtcgaacgcataaattttgcccaacaaaatatttaaccgatttcaatgacagaaaatcattttaaacaaaaaaatttcgattcttattcgttttatggtggaattttcagcccaattttttttcaaaaaatattaaaagtcaaattttaatgaattaccaattgcacgctttaagaatttttttaagaaaaaaaaaaacttttgcttttttccttttcggacaatttataaaatattattaaattaaacaatttaaagatttttgagccaatttatctgatcagacggggccgttgctttcgtagcatcaaattgtaccaaagcaattttgatgagcttggaaaattgcgtgttcaacttcggcagccctacaaaatggacccacaaatgaaagaccaagaagtaataaaaatgctaaaatgcctttcaaataataaataaaatatacaaaaactaaaatttttaataaaaacgatttcagtctttaacttagggttgatccacgagtctcaagggaagaaaagtcgagattggtaagggaaaaatctcgatgcaatttattgggagagaaaattttcataaaaaattgagaaaaagataacagaatttttgatagtcttgggaaattcaaaagtcattttaaaagatgaaaattttgatattcgaatgaaaaaaattacttacattttccaggaaattatggcatttattgccgaatataagccccaacttgcgccattcccacgccattatctgcagcagggaacatggacaaaaatgcggttgaatgccaagcatatcagtctgtttccggcagaagaagtggggacccaaaaaaaatcaataaatatttgaaaaaattatcgattgaatttacaaaccttttcgcctgttattgattaaaggtgtgcagtcagacaaatgatcaattgggcaaggacacatgctatgttgaaaattggctacaaacacatgtggaaggcccactaaattgcacttttccgtatgtgcaagaaattacaaaggataggcaattagagaggtaattaacggcaattaatttttaattaaaaaatttgagtgttcaatttaatgaagttgtgagccattgaaattggttgacaattatataaatgctgtgcagacaacaaattacacaattcattcggtgagttagagaaaatttaaaggtttttttgtggattattcaataaaaattaatttatttatggattaaagtaatataaaataaatttaattgttgcgttttttagtgtgtgttggcttgtgaccgttgggagtacatggtttccatagaagtaattaaagattgtatacattttttaaaaataaattagctgttcaagaaaatcgacatgaaccgggtttacaaaaatgttaatgttttaccatttgtctaccgtatcgatctgtcctacaatgatttacagtatgaactgattgaggaagtgagcacattgacactggctgggcttatagcgcagattggaggccaagtaagaaaaatataaaaaacaaaaatatatatcatatttattttctattttataataatttttataataattctattttcgagtataattttttacaaaaattctattattgtcaataaagaaaaagcccacaa

SEQ ID NO: 22035 - DNA, 1426 bp, Heterodera glycines
aaatatgtaaataaaagtcccaactttgtttcgcaaacacaaaaaaagaaagtgtttttcctactatttagagcatgagaaaatccagggaaaaaaaatgtatttacataaaattgacatcccaattgatgactgcgtcaaaatattaaatttaattttaagaggaaatttttgaatgttttttaatttatttttcaataacttaaaatattattttgttttattcattttttattttcctatgtttttcagttccatccgaagtgttatcagaagatgaagtgatcgacatttatcagttccatgcccttccaaattgtcatggaatatccgacggatttttcccaatgcaattttcgacaaatgaacggtttatgaacacgggcacacttttgctggacattgaaaaagtgtcggaatttgggcaagaggaagatagtagtcggtgcagcaaaaaaatgtacataaatggactgtcatggaaaatattggcacaaattggaacgagaattgaatccgatgagagacgtatctacatttatctgttgtgcgatgctccaaatgaaggtgcaaattaagggctaattaatattaattaaccaattaatttaaattgagcagaaaattggagttgcaaatgttcggcaaccattcgaattatctcacaaaagtgtgatgtggcggatgtacggaaagaatacgatgtcgattttggaaaaaataaaaaatatgatagctggggatgccgcgattttagaaggagatacctcgatttggttgaatttgctgtgggtggcatttaaatgtctttctctaattaaaatattataattaagaaactggttgatccgaaaaatggcttttacgacaaatgcatggacaaagtgacattttccattgatgtcaccgtgaaagaagcacaaacgggcaaagaatgctgatattcataatcagtgatcccgaaaacccttcgaaaacatatgtattttcatttgtttgaataaaaaaaatatgataaaaaaactgaccaaaaaaggcgatccaaactaacactagtttagctaactttctttgaacaaaattcaaacaaaatttattattttaattattttttgagtaatatattagctttaacccaccgtccaaaaattcctacgcatttgggttacttttttccacctcatttctgcaaattatccacatatttcaagttcaaatgcggaactgcttcctgctcctgcttgttgtctgctgctgttgacaacttcagttgcaattagagggggggggggggggggcttttccccccggtgatgcttttattccaaagccttcgcaaaccccatagttatatagaagaatgcattcccttccagccaaagaatacccccacccctttcctaatgctttttacaccttttcttaa

SEQ ID NO: 22036 - DNA, 1475 bp, Heterodera glycines
  misc_feature (1420)..(1420): n is a, c, g, or t
cttgaaaaaattttattaagaaaaatttcgactttttcgcaattttcatgcataatttttgtctactcgcgaaacaatagcttaaaaaaagcttctaaaatgttaagctttcgatggatttggatgataaacaaaaaaattatagaggaaaagcatgctggagcctaaacgtgccggcccaactgaggtgtaccgtttcttaggggtatatttttgaaaattttggcgttttgaacagtaaaaccgcatttttgtagttacatcgaccattccgtcgtcgcatttctccgtgccaacaagcaaatttgggacaaaggcaccaaattgaatttgtacatatcctcaactgacaacgactctgtccagccgctttggaatgtttttgtccgtgaaatttggcccatttttgcgccaaacattggccatttgaccatttcaaatgctgagcatttggacaatttgcgtcggctcatttcaccaacaattctcaccgatctgaaccaattgacttcaatccattcatttggtctgtcgcccgctgcgtttggtgatgattttgatgggccaaattcaacaatttctgcaggccaagcattgtccaaatggttgcactctccgagaaaagatgggcagccaaagcgattgcattgcatagattacaacgaacaaacggacttcgattgggtcaacaatttcaaggaggtgtggccccacattttcaacaaaaaagttatggttaaaaatatttagaaaaccagttttttgaaatcataaccttttttaaacccacccaacgaaattttttgaaattttgcaggctattagatgactcttaacgctatcgaaacaaataagaatctttaatttggatgcttttaaaaaagttatggtgcattaaaattgtcgaattattttatggtcgtgtctttttttgtggtcgtgtgaaccagggttgttccgggacgagaaaaatgtcgggattcggacaaattttgattttctttttcaattgtttaggcatttctctgtgccatcacttcgtcttctgcctgctacacaattcaattatatttgtccgcctcattgccaattgtgccatttgaattggtgaacgaacgaacccatgaaaagctgacaatggccaaagacggcacatttggatttactattcgatggataatccggcgatgtccaattggggagacggttcgctggactaacgagaatccgccgaacaatttgaacggcacattcttccatttttatggtggcaataattgcattgggtgagcagcaacgacatttgccattgttaaagtgttcatcatcaaattcaaattgacacataatttagaccattgtgtccaccatcaacgaaagaagcggagaagagcgcatgaattaattatgtggtagccanattaattacattagcttaaatggcgatcatttcgaattattgaatgaaaaattgt

SEQ ID NO: 22037 - DNA, 2607 bp, Heterodera glycines
cgtgccgtgccctgtgcattatgccaatgtgttcgtcgtgcaaataggcaatgccgtagagcatttggacaaaataatggcgcgggatcagctccagctggggccgctgctcgtcctcaatcactaaacgcagcgacgagtcggccaaatcgagcaccagcgacacaaacagtggcggctgcgactgctcgccacgctcgccggcgccgccgttgtcgctgcgctgctgttgattagccggcggcgaccacaaaatgtctaacaggcgaatgatctgctggcgaattggcaaagatgactgatttgttggcatactgtattgtacagtacagtatacagtacgacttatccaatcatcttacggcattttattttaataaaatgacattttaatttaattggacaatattcttagaaatttttatttggtagagacgaggctttgcattggcaccaaaataaataatttcgaaagctaggccttcgagtttttttttgggggtctccaagttaaaatctcgactcacagcctcggcatatttcagtctcgagtctcagcaaattgcccctcaaaaaatgccaggtgtcgccaaagcgactaagaaagtggagaaaatgaagaaatgatggagagagagagaaattggaagaaaattgaggaagagaaatttaattgttaatttggaaaaaataattattagtcattgaatgtgatctttgaaattgtgattttgtccctccattgaacatttttagcattagtcactactattttgtgcacaattctctgtctaaaattgctcctcctacgctttctgtctccacaaattgctccacccccgcattttctctcctcataagcatttgcgttttcacacattttcttattctgacatcttatccagacatcttattcattttatattatatttattaaataaacttctttcttatttgggaattattttcccttattccaccccgccctctctccgtcgcgccttcccatttttgcccccattttgccgtccgagccaacaggatgcttcgatgacaattttgccaaattttaaggcctttacctaatttttgtggtccgtttcaaatatcagcacccaatcttaagtagattcaatgatcacaaaaaatctatgaacaaaatgctcagaaaaagtgagtccatttttgtgtatttagccctaattagcaatcaaaaaatgttagtgcaaaatcatccgtccgcctctgacatttggtctaacgcgacctttttccatgctgtttattaaattttaacgaatgaaatgacaagcaaatataataacaagagcctaagaaaatttacttttcattattagggccccgacttttagtgaaaaaacttttttttttgctcaatgttttgaggaaaggagctcaaaaaacgcatttccgcgtaaaaattttttcctttggacgtcatttttcgtcactgtgaaaattcacttttttggcgttttgtcactattttttcactatttcgacattttttggaaaatttattaacaaaaatgcaataaaatcaaaaaatacacccctaagaatcgatctaaaaaaatttcaaaaatacaccactaagaatcgaccaaaattttttttaaagacaccactaagaattggaaaattttttcaaaaattcttcccccaaattttttttcttgacaaaatttttgatttaaaaaatgtcattatttgctaagagaattttataaaggaaatgtagctcatttgcaactgcaatcagtgaataaaaattattttttgcgtcactttttcgaacttttttcactattttgtcacttttttggcactttttcgtcattattttagttaactattttgagatttttcgtcactaaaagtcggggcccttttcattataaatgaattttagcttttttttctttttgtaactctgtttaaaaatcattttaaattaatcgtaataaaatttttcgaacaaataaattattagaccattagacgctgatgaccactttgcttaatttgttggacatttaccatatttgtacattttggaaataatactcatcatacagtcacggtcaaatgtattgcatcaaaaaattttttttgaaaaattcgattttctcaaaaatgaatggtgtgaaaaatgtctaatttatgccataagaaatgttaattagtccactaataaaaacccaaaaactgcccccgtaactgctttgttgacgaaaaaattggtcatgacccgaaccacccccctttttggtgggacaaaagtaatgcatcaaatgtttaaccgacccaaactcaattttatgttgagaaaaaaatctgaaaaaatccctgctaagctaacttttgatactggtcaaaaaagtcttttacaccaacttgatcagatcactccttcatggtgatctgaaaagccaaaaatggactggaatcggggaattgttggactcattttcaacaaaaattcctagggggttaggaaaattttttttgaaataaactctttaaaaacaaaatctccagcgacaaattcaagtgattctaacgatgaatccaacggaatggatg

SEQ ID NO: 22038 - DNA, 1335 bp, Heterodera glycines
gtaccttaaggactacagaagagccaatgacagcagtcacctttgcacagttatgtaaaagaaataaggaaatattcgatggggtgcgatcctttcaaaaaattactctcgtcttctaccctccctctctttttgtgcactgtttcgtttaaaaaattggttccgaaattttttgactctaagaaattaaattgtaaaaattcaaaacttaaaattctcctctgaagtttcgaacttggcttaaccatgtttttaagtcccaccgtgaggcgggacagttccaaaatttgtaccacatttaactgtggaatgtccaagtaccttaattggacaattacttgtcaacgaacacagtcgcctctggcctcttatggaacagaaaagggtgaatatcagatggggtgcgtcccttcctaaaaatttctcttttcgtctaaccctccctctctttttgtgcactgtttcgttttaaaaattggttccgaaattttttgactctaagaaattaaattgtaaaaattcaaaacttaaaattctcctctgaagttttaaacttggcttaaccatgtttttaagtcccaccgtgaggcgggacagttccaaaatttgtaccacattttactgtggaaagtccaagtaccttaaggactacagaagagccaattacagcagtcacctttggacagttatgtaaaagaaataaggaaatattcgatggggtgcgatccttacaaaaaattactctcgtcttctaccctccctctctttttgtgcactgtttcgtttaaaaaattggttccgaaattttttgactctaagaaattaaattgtaaaaattcaaaacttaaattctcctctgaagttttaaacttggctctatcctgcttttaagtcccaccgtgaggcgggacagttccaaaatttgtaccacattttactgtggaaagtccaagtaccttaattggacaattacttgtcaacgaacacagtcgcctctggcctcttatggaacagaaaaggggaattatcagatggggtgcgtcccttcctaaaaatttctcttttcgtctaaccctccctctctttttgtgcactgtttcgttttaaaaattggttccgaaattttttgactctaagaaattaaattgtaaaaattcaaaacttaaattctcctctgaagttttgaacttggcttttcaatgtttttaagtcccaccgtgaggagggacagttcaaaaatttgtaccacattttactgtggaatgtccaagtaccttaattggacaattacttgtcaacgaacacagtcgcctctggcctcttatgaacagaaaa

SEQ ID NO: 22039 - DNA, 3371 bp, Heterodera glycines
  misc_feature (97)..(97): n is a, c, g, or t
gcccgcttccactcacaatgtcccgctgttgctccccactttcgcgcgtctctttctctgcaattgcgcgtcgcgtggtcgtcaccaaaaacgcccncctcggcggcccaccgccacccaattcttcggcatttcttccccctccgcctcctcgtcgccggggagcaccggtgccgtttccgtgccgccgtcttcaccgcctacttccacaaaaggcaacgtcggcggtcgatgtgtgctgctcggggaggtaagaggcaactgattgttgtggttgtccagctgatgacggtccccaacagttgaaggccccgatgacgtcatcttcctgcggattgaattcagatttggcacttttggcgttgtgcctttctcgtcagcctaccgtttccgccatgggctgaaacggcgcgccgaaccgaacattcccccagaagttctgcttgtgctctcatggcgcagcttgcaacggtacagtttcatgatctaaagttttataaattaccaaagacaattaacaaaaaagtatttgttgaaccctcgtattctttttgatattccatgcccgattattattaattcatgaaaacgaagcattcggtcatgacgtgacgacattctatgtaattagtccctcccccctcatttacctttgccacgtccatttcactgagttccatcgctgttccgattacatttgtgaactgtaaacattcgcattatgaatccgttgcataatcattttcaataaatcattttaaaatccgtttattaattttttaaatgaaatttaaaaaagccattaattttatgactgtgctgcttgctcacttggtcaacaactgcttccaatgtgttccgaccgtttcgactgaatgccgacgacccgtaatgcataattgacctgaaagatgacagcaaagagtttaataatgccatgataacttatcagttaaagcatatcaaatagacctgtaatcgtacggctcgccaagtgtgtcctgaattgccgaggaaacgatgtcaaactgcgagtccatccctgggaaagaaacaattaaaaactatggattaactagatatttaatttatttttttaatgattattcctttaaacatgccgggcaaaatgttctcccatcggatgacaatgtgttcgtctctgtcttcatttgcttttacagtgttaccgtacgcccaccactaccgtacctgcccggctatgttcgtgccaaaagcccagtgaatgcattaactaagaaagagaaatattttttgttagaatttatggttaggtgttatttgagctgaaaatttcaagaattggaatgagacctcaaaactccgtgaatttaggccaacactttttgaacctaattacaaggtaattaatcgaaaatggtcggacaaaattaattgctcatttgtcaatgttatataataatcataatagtgcccctccgtttttcacttcgtgtgttatcgtttcgttgaacagacagccgcgtcccagcgacagctcctgctttccgcctgttctgcccacctgtgaatagcatctgatccgggaggggaggggaagggaatggaattggcacggcacaaatgccactttttgagcgatgtacgcaggggaaatgccgctttgagttctgtgagtgtttttcgacaattacccctcattcttttaggcctaatttcaaatcttcgatcgggttggaatcatttgtataaagcattctgaatttcctggcacccaagcggccgtgcccaaacatctcggtccgctttcggccgtgcccaaatgtcccgtccgtttttgggccacataagcattgccatttcggtcccagttttcttctgtcccagctcacccgttgcccttcacaatgcttaaatagtccgtttcgccgcttcgcctcggtctgaaacggatgcagccgaaggtgcggcggcggtacgtgcgaaagacgcgctgcagaagacgagcctcactcagtgctgtgtgtgtgcccaaggcaattgtcggggtacggtcggaggagagcaaatacggtatagacttacgtacagaatgccacgtccaattcgtacggtacaacgcctttgggcctgaaccggggaaaggcgatcaatgtatttgatagcacacatgtgtgacgttttattcaaaatgttccgatcagatctgctgattatttaccgctgtgccctgactttttgtgccaatttttaccatttttcatagtgccaatgccaattttttcgggactctttctaagaaggcaccgcccttttctcccctgttggtgattaaattttctgatctaatctgttccacaattctcttcatcaattaccaaatcagctgccgatttcgcaatgcgttgaattgtatggccgggttttgcagcttcaaagttcagggaaatttgccaaaatgtcatcattttgccaattattttatttacttggcgcagcaaatgctcatcaacgccatcgatgtcgccttggaatttcccttaaatttgttttattttatttgtttatgcttaatttttctatacacagaaagtaattaatgagttaatttgatcagttaaaataggaaagtgtttcaattaaaaataagcgaaaatgaagtgccaaattatatttacaatgtcaatggtttggaaaggaacgcatttgaaattgctgacccgatcgaagccaagccggctctctgacaatggcagttgatgccggaattgggttcatctcttcataaacttctatagaagcggagctttctgcggaactttttaattgatctgtcggcaaattccgatgggattcggaagtgatcggaattgagtcgggaatgatttgtttgtttttctgatcagttggtggtccattcgggcgctgaatgtcgtccacccgttttgctccgccatcgtcaaaatttcccccgtaagaattgaacgcaactgacggcgaattggacaaaagttgcgcaacggcaccaccagcggaagaaacggatgaatcaccggcagaggaggaaaacatcgaattgcgcaccttttgaacatttttgacaatgatcagacatttttaggggtttagaggatatagaattttgatcagccaaaaggagagggatggaaaagtgaacaaaacaaaccgataaaaaatggcgttgatcggcccaagcgttgtgaagcggtacaaaatggaggagcagacggatgaatttggagatcattgacaaaaagagggaaaaatgggaagaaaaaattgataatgaatggccaaggaatgatcagcagcagaacaccaagtgataattgaatgagctgatgatgagtgatggcgatggaacagaa

SEQ ID NO: 22040 - DNA, 1988 bp, Heterodera glycines
  misc_feature (17)..(17): n is a, c, g, or t
  misc_feature (29)..(29): n is a, c, g, or t
aataaaaatgcattttntagcgattatgncataaataatcgaaaatgaaaagaaattattttttacatatttaatcataaagccaattttttcatatctcttttcttcagacaaagtaaattttttaactgaaaattttgccgggaaaataagaggtgctagctagtcgtttcgtaaaactgccaaatttatagatttttcgactttcagaagttttctgaaagatatctatgtctttaaaattttattcagaactttctaaaaacaaaatgaaattttcagaaaattttatgctaatagagtaagtcaagagctatcgtatggtatcaagataatttctggttgtgtttaagaaaagctatgacgggttttcctcgaaaatctgtaaaattggcagtttttacgaaacgacccagcacgaaatgagagagacctatagataagaaaatctttttaattctttaaattttctaaaattacaatatcaatattggtaaatttgttcaaatcagttgcatgatacctggttcaaaattcaatccttcagaaaaacaaaaagcgggaacaaattgcaagtgaattgggtgtgacgattcatcaaattaaaaattggacaaggaaatttggcttgggtaagacatatttttttcttaaaatttttcacgcacccacaaaaatagcagaattcagcattacgtttttaggcaatcaaaaatggttgacagatcgccaacgaaaaatgcttattaaaaaatttgacaaaatcaaagaaaagcgcactcaaaacggtttaccagctggtgaaattcgagaattggaagaaaaaatcgcagaagaaataggcataaacattcggacaatttacaaatggagaaagaaatttggcatctcaggaagttggcaaaaataaacaaaaaatattaaaaattaataaattattttataggaataaaaaaatattattcacaagaagaagcacacaaaatttttaaacaaatgaagaaagaaagaatgaataagaaacaaacaaacaaaatgcggggaaattaattttcacataattatccccaattaaaaatacccatttcccctttttatttgttaaaaaaagtaaattctttgctttttttaaactatgtgggattggtattacaaatccgatcaattttattaattcgtttgttattgtcagcatttttcgataaatgtgacagatttacttgggatttattcttgttatttcccaaaaaatgctttttcctgaaaaacatatcttttgattggctgaatttcgaagaatatttaaagccaaacaaaagttggtcatggcacattcaaatctttctcaaaaatattccttagaaaaagtcaaaaatattaacccaggaaaaatatgtatttacgtatttttgccatcctaaattttattttgatagtttttgaatgcattgttgtttctcttaaatgaatagaaatcttttttaaatccttggaaaaattaaagttttaccttttcaactttgcactattaaacataattagtacttgttttttatcaattagtttgatcactgtactgaatatgtggaaaatattgatcttagtccccaaactcaaaaatgcttaaaaacaggcagaatcatgtaaaaatgttcgaaatgggttggaaaaatagaattagtggcgcgcttgccctttttcaggctgaaaagtgccggaattggagtgccaaactcagctgggacgactcaagtgaccgcactataaaaagcactcaaacgactttttctttttaaagaattttctagggtaatttgtggcgctgatcacgaatatgacctttattttgcaaaattccgaatcccgaaccgaattcgaacaaaaactctaaattcataaattaaaagaaaagcatatttttaggggttttcgaggttgttgacacctagggggggataggcttaagcaagcctaagcttaagcctaag

SEQ ID NO: 22041 - DNA, 3138 bp, Heterodera glycines
  misc_feature (97)..(97): n is a, c, g, or t
  misc_feature (2320)..(2320): n is a, c, g, or t
ttcgacttagcacaaataaaaatgtacataataattcaaaaatttggatgcaaaaaagattaatttgagtgttttttaactcctgtaaaatctgtanacaaatggaatattggtggccaaaatcactgtgaaacaccccattttgataacatcgtatttttcgacttgaatgaaaggaacagaaagggttaggcgatattggaacaatttaattattttttttgcttttccggcacaaaattttttgccagtgttttttaaatttttgctccatgggaaaaaaaggaaatttagccaaattttgttagaaaggattctgttttttaagcgtaaatgtttcttatttaattatttttaatccttcaatttgattaattcccattagccttgttttaatcattgtttttaatttttcattattttaacttatttatataaatcacttaatccaattattgtgcattacctacagtatgaagaacccttgaaaaattaattacagtatcttttgttgctttttgttgattattatgtaattaattcctttgctgtttattataagtttttattctctttcggtaataatattttgatttcatgaattttttatttaatgattattctaaaattcatttttttttttttttgcttttcatatttaacccattaatttatgagtttttttttctttgaaaaatttaatttattcatttatctctaatttcataatattttattttattaaattatgctaaattccttcaaatttctcatttacttttccattttttcaaactcacgttcgtgatactattcgctggaaagtggattacaacttcggaataatttacaaatttaattatgaacgtcttctataatgattctttctaatgaatatttttaattaattatattcgtatatttataaaaataaataaacaatatatttaaattttacatttttgaattttcaacaggattagaggaagaaaagttaaaaggttttttctatgttaattgagccatttttttaatattttaaattaaatttaatttttgatgctttaataatgtattgagggtgaacagcgagaataataatgatgttttaattttcttatatattatatttacttaatttgattcattaaaatataaaaagtaaattcttttgattattattatttatttttaattattatatttagttttaaattgtatatatatttattgaattatatattttttgttgattttatgtttttttaattttgtcaatttttaaaagtttttattatttctttgatttaatctttcatccgatgcttctttggtcatttctgctttttaaaggtaattaattatttcttttcgcgtttatttattacagttttcagttgatcattcccaaattagccttctttaattattatttttcttttattttcattcttttttaagatattattttttgctaattgttttttgcttttttgaaaattattattttactttatgtaaaacaataatccaattcttgtgccaccttctccatcgaattattccatacattatagttttatgttctccaatttttcacgattttcaaaaaaaaaatttttatttttttgacttaatgtaaatcaataaattatatttacttttaattatgtctaatatatgaatgtccataacaaattcccaatttttcagtataatttttaattaattttcattattcttttaaaattttttgaaaatcgaaaacaaattcatttataaaaaaattgcctaaaataaaaaaaacaattgaacgaaaattagaaaattaaattaaaatgagaaaaaaatcgctgttttaaacaaatgagaaattgtgtctactgacaataaacgaaaataaacattttttaattttatttttagtgccttaggcatcaaatggaaagataaattaaaaaattttaattccagcttggatttttttggtgtttgttttatatttcctacatatcaatccgaattgaagtactattacacgagaaaattgtttttttccaaaaaatgtttcatttaattaatttaaatcaaaaaaaaatattatttttttatttcctttattatcatttgtagcctaagggttattttttattagcttgcaaaattaaaaaatttttattgtttttcatttttatttttgattttgctatttttttgtttttcagtgccttacgcaaaaacactatttatatattcttttaatatgtttctatttcttggattttttcatttatttggtaatttatttaatttttattanattatgcttaattctttccaaattctcatttaatttcactttttttttcaaattcacgtccattcgaccgttcgcatcagcgaaaggatggataatttgtagattttataatgtgtattttctgcagtatttccttctgtttattcttataattattttactttcatttaaaattgaacaaaacattttatttaatatattctcattatgacaattgcaaattaaaaaaatattatcaaattttatttaatgtatttagtatttgtaccaatctactcgatcgatgtctgtacaacagattaactgcatttcgtgggttctttttaaagtctcaaatttagatatattaattattttcttctggtttattaggatcaatttttactatatttttaatttttgtatttaaaattaaaaaaatatttattaaattctctatgaaaattgcaaataaaataattattaaatcgatttaatagtatatttatttaagattttatcatttttgtataattacttttatcctttttattaggttgaattattttacatattttaatttttgtataaaatattgccagcttcactaagttaatcaaataaatttatttttcacttttatttgggaacaaaaatcaaaaacaaattcatttataaaaaattacctaaaataaaaatacaattgaaagaaatttagaaaattattttgattaaaatgagaaaaaaatcattgagaaattgagtttattgacaataatcgaaaattaaatgttttttttggttttcagtgccttcggcatcaaatggaaaaaaactta

SEQ ID NO: 22042 - DNA, 1293 bp, Heterodera glycines
  misc_feature (1262)..(1262): n is a, c, g, or t
cgaaaatttatacttttcattcatagaaatattagaacatattcaaaaattacccagtcttattatgtatgagtatagaaatcaagccttagttatggaaaaattagaaattggcattaaagaaacaaatatatttaaatgtcaaaaagcagagattatatctaataccaatttttagaagataaatgagttccaaaaacaagtgcgaaattgttgatttgacataaaaatgttatacaataaaattaggataactgcattaagccatttgtttaaacccgaaaacgaaatattttttagcccaaaacgaaacatttttgcagatattttttcaaaaaatttgagcaaatatcgcagtcatcttcgcatttgccttttaattttctcacaacttccttcttcattttgtctgcctttgtagtttctcctctctcacgttttgacccttgtgaggaggcactggagcttgcggcactcgttgatgccgtgatggcttgtcgagcagtttcacgctcttcaggcctttcgattcctagtcggctgtacgctcgtcgtacgtgttgctgtgtttgtttctgtgtggaagtgcttttttgtgaataggtagatcgctgcgatttgtcgctatcgagttgctaaaagagaatataatttttgcgacaaaattctatttttattacgtccaaaatgctccgcattacggttgtctccaccgggaacgattcactttcggcaatttcaagcactggcgtttcggaaatttcagagaatgcaacattttgatgttgcaatggttctttaaagaaaattagattacctatttcgatagtttatgaagccacagaaggattttgtctcaaaatcaggtcaataaaaatcgggtacccggattaagcaccttttttattgtaggaggtccaactgtgccgatgtgttttctgagaatttgaattaatatgaaaagaaattatgaaattttccaaaactttgcccgtttttactagaaaaataccaaggcccatttaatgaaaagataaataagatttcccctaagtccccccaaaaaatgtgtaccaatgtttgtcgtactacttgtacttgccacattgttcagaggctcaaattgaaacattttcagcggtattgggcgtagaatttgttgttgttgttgatgttgttgtgttatttgtgtttgtgtaggttgagtttgtgatggctgttgttgatgatgtttttgttgttgattttgttgttgttgttgngtttgtgtttgtatttgtttttgttgtgttg

SEQ ID NO: 22043 - DNA, 1465 bp, Heterodera glycines
aaccttggcgcgtattgttcaaaacgatctttctaaatataaattttattcttgcaaagtttataaaaatagttatgaaatacatttgccgggctcgggcaatgtccaacatgttataaaccagcgctcgagcataaattgttgccaggaggtttcccaacaaaaagccgctctaaattaaaaatcaattgtttcttgctcattatttacgtgttcccaaacatcttcatcaaggaggtagacgtttgaccaacgggtcgtgaggacatttttccgacttgtttgaaggtaattatataacatttgcgctcttccctacagacggcacattctttgatgtcatacaaagatgctgccaacacttcgaaatttttttcggccgaatccgccttatcgaattttcgtttttaaattctgtaaaaatagattttaagattttgtcaattatatcacttaatcaaatatttattatgaagctaaacaaccaatttgctaattaatatttttataagcatctttaaactaaaaaattcataaaaactatgccatttcgcacaacaaacttttctatgaaggaataaaacgaaagtttgatacattggtttaatggcacttaaatctgtcgaggacggcggtgccaaaagtgggtaattattatttaaactcctccattgactagtaaaggaattaatgagtacacttaatgaaagtgaaacatacaaatgccaacgcgtagaagccaatcatcgtatgctttgggtagctaaaatctcattacattcctctactcactgtctcttctgtttatcattgaaattttaatccaaaaactgagattttatattttgcaattttaaaaatttttcctttcttcgtgaagttattttcaaatttttataaaatttatttttaaaggttgtttttcatttttccattttgttaaagaaatttcctggaaatcccggctttttaaaatagtttttcatttttaatagaaatttcatttggcgaaattttgtgaagaatggaaccgtgccaatattggagctaagcggggtctatgccaaggcagacggactcattttaattgatcggaacagattcatatcatcacagacaatagaaaattttagatttagactttgacctttagaaccaaagattactgaaaagcgaaattttattggaaaggtacagcacaatggaaaagtaccattttttgcaatttgtttaattcaattgctctatacccaaagtaaaaagcaaaatttaaaatcatgtctcttaaacaatgttcttgtaatttaagataatcacgtcaaatacaattctgaggaatggcaatgacaattcattaaaacggacaattaatgtaaaaccagggaatgaataaatcagaaataatgagtacaaatttgaatgtcaaaagatgttcaatttctttaatgcttacatgtttcaaatt

SEQ ID NO: 22044 - DNA, 2124 bp, Heterodera glycines
ccccgcgctgctgttgggtaggtttctataacttggctgtaagagcaaaaaatcaaaaaatcgcgtttttgaaatgttttaataattcaagaaaaatttccccaaaaataagagaaaaataaattttaaattaaaatattgaataaagcgtatctgagctaatacaaactctcaaattgtgagtcgtagtctgtccaagcattccgtcgttcgtcctacccccccccctccctccggctctaggaaaatccgacaccggaaaatccgacactggaaaatccgacacaagcagaaaatccgacaccgctggaaaacccgacactagcggtaaattcgacactggaaaacccgacacgacaccaaccttaaatttaaaaaatattttttgattattgagttaatatctggctatgtttatcaagttttcgaattgaatttaaaaaaaaacggttgcgccattcgatgggatattgctggcaaataataaaagggttgtcgattgttgcgagtcgcataaatctctgtgagattcatgtcttgcaccacgtacactttcttatgcttcatgccctttcctctgattcgatttgccgcattttttacaattttttgagatgatcaaaaaagggcattgaaataaatataattattatatgcctaccttaaatagattttatagcaataaaatatttattttaaagaaatagtttttatagcaataaaaatattaattttaaagaacttaagttttgtaacttttattacatgtattttaaatattcactgactcaaacaataaaaaattattttttaaatttaaagttggtgtcggattttccagtgtcggattttccgggctcccggcataacaatccagaaagggccgagggttcaattcccgcccagggccgctggcgctcaacccttacagcactcacatatttgaagccaatgctgaccaaagcgggcacaaaattcaggcacagctcaaagcatattgtgacgatgatcatgcaattgttcttataaaacattacaaagaaaaaaagaaattaattttttcattaatttttcgttgaattttaccattttcaacagcacattgactgagtgtaagctgcgcataaaatacacacagcaaacaatgttcaaaatgctgattgtacatttgaaaaacagttgtggcatgttgccccattttagcatcaggcaggaaaacgactcgcaatcacttgcctgtactgaaaggggaaggaaattgcgtaattttttaagtacagcataaacgacaatttggggaggtgatcaaaaattcagcgtaaccagcaggaaaatgcgtcagtgatacgatacttacagagataaggtacggtaatgttattcagacggcggctgttatgaagccaagattggtcatggatagggaaacagacatgtcagtctcaaacatcatatacgacatacaattggtgatgttcaacggcagttcgtctatgtaaatgaatgtactggctgaataagcggccaacattgtgccaatgccgacccagcacaaacggcgctcaattcgtgcctgtttggtcgggtttgtggccaatttgatgatgaagcatcgttccatggtcagaaataagacggccagcggtgagattagcgtgtacgaattttgccactggcccaaccagtaaacggtgtaaattgtgccagcggaatgctgcaaattgttttttaaatttttttgaaatcttttaattggaagagctagggttagcatttttaagcaaattcctaaaattcctgcgcaaatgtggggggagggataatcgggtagggtccccgaattttaatgacataatgctttcgattcagtaccaatttttcaaatcataactgaggttggcaccagagatggaattaggaatccctaaaaaaatttcgaaagtcggaattccgtcccaaaaaatggtatactgacaactcgtacaaaaggcaagcctacaatgcgtaggctaggtttaagctaggcttaagcctaagctttaggctaagcctaggcttaggcttgcttaggcctatgcttaaactttggctttattttgtaaaaaaaaagtttattgtttgcat

SEQ ID NO: 22045 - DNA, 2163 bp, Heterodera glycines
  misc_feature (39)..(39): n is a, c, g, or t
  misc_feature (53)..(53): n is a, c, g, or t
  misc_feature (65)..(65): n is a, c, g, or t
  misc_feature (77)..(78): n is a, c, g, or t
  misc_feature (129)..(129): n is a, c, g, or t
tgttagctaattagtcagcgtctatttattttctgtaanaatttgcctcttantttaaaataaanttaatatattcnnatgaaataagacactaaatgtatagagaatgaattaacgtggtcgatgganataaatggaaaaaaaagcaaagtcaaaacacaaaaccttaaagcactagccgattgaaataaatggaaaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaataggaactttatacaaatttaaaaaagtaatattttgtatattgtatatgcatttaatcaaatttctactttctttataaatgttagctaattagtcagcgtctatttattttctgtaaaaatttgcctctttatttaaaattaaattaatataatttcatgaaataagacactaaatgtatagagaatgaattaacgtggtcgattggaataaatggaaaaaaaagcaaagtcaaaacacaaaaccttaaagcactagccgattgaaataaatggaaaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaataggaactttatacaaatttaaaaaagtaatattttgtatattgtatatgcatttaatcaaatttctactttctttataaatgttagctaattagtcagcgtctatttattttctgtaaaaatttgcctctttatttaaaattaaattaatataatttcatgaaataagacactaaatgtatagagaatgaattaacgtggtcgattggaataaatggaaaaaaaagcaaagtcaaagacaaaaccttaaagcactagccgattgaaataaatggaaaaaaaagcaaagtcaaaacacaaaaccttaaagcactagccgattgaaataaatggaaaaaaaagcaaagtcaaaacacaaaaccctaaagcactagccgattgaaataaatggaaaaaaaagcaaagtcaagaacttattctacctaatttcatggtgactgacgaggcatttgactcccttaagagagccttcccttctcatgtacttgtacctaaaatgttgttggcacaaaaagtaaagggggaaaaagaagacaaatcatccgatcaagggctaagtctcaacagatcgcagtgtaaaagctgctctactgctaacaaccccctgaccagtagtcaagtcgtatacaagtgattttgcgccccgacgttccaccatggcacacgagtgctacggctttggcaatgtgcgagcaattaagcacgcacatcgggccagatgctggggcatttgtgctgcaccgcaagcggcgcataagtagtgcctcccgacaccggggagcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagcttgccttaggacacctgcgttacgctttgacagatgtaccgccccagtcaaactccccgcctgacactgtcatc

SEQ ID NO: 22046 - DNA, 976 bp, Heterodera glycines
atggccttctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatggccattctattctacagggaatttttaaatttattctctatgccagaaaaatggctatctcttttttgcgagaaattttgtaccatacaaatgttcccagcatgggcagaggggcgcggagagcaatgggcattctattctacagggaatttttaaatttattctctatgccagaaaaatggctatctctcttttgcgagaaattttgtaccatacaaatgttcccagcatgggcagaggggcgcggagagcaatggccattctattctacacgggaatttttaaatttatttctctatgccagaaaaatgggtatctctttttttgcaagaaa

SEQ ID NO: 22047 - DNA, 1147 bp, Heterodera glycines
cattatgaaaggagttatatccaaaaaaccggcatgcggctcaattgtatcagtggaaaatctcgtaaaattttgctctcaaattgcaggcattgtcagtatgagtatataaaatacagtatgggcatgtgaaatttgttaatattactaattaaaaaaagcataaacaaattggtacaaaataagcaaaaattttgatgagggttcaatgattgatcagattttctgctttggatttgattttcaatgattgatcatttgtgactgacagtgatcaatgttcaaaaaggcgagaattatgagtggcccgtcaaaaactggccgtcgggattcagatcaaatgaaatgctagccaaaaaacttaaattttctgattaaatgatgactaatcattaccaatttctgatcttgagcattgaatgattattggtctcataaaagtgttcagatttttttcaaattattaaaaaaaaatttttttttgacagactgtcaaatgtgtgttccttgtcaaaagcattgtgaaaatgatcagaacaattcctgataaaacttcttggcaacataattccgatgaaagaacatgaagcgggcaaattcttgaataattaatacctaactttttttgaataatgtaaacaaattcgaaatcattcgtcctccaaattaactaattaggcagttgtgaaatttgtagtactttttggacgcatatccacaaaatattcgagaacttttatgcttaccgatcaattccaatgatacgaatttggtgagtgaagaagctgatgctatataatgtaatgaatatctgttggtttctttgcctccaattaatgcttaattgaaccactaaactaccgtatctcactttcaaacattttgtagacacagttttttttcttgaatatttgctcaatgttttgcaaagcattttctgatttactgttgtaatgtctctgtttgttgcaattagcctaacattcaaaatgatttttttttaaatttttattattcttttatgttttgggaggtggtgctggttggttattcttaaaatataaatttccgggcttcctcataatttaggtcgaccatttggccccaccaaatgttaggaaactaaatttttgttcattttggcact

SEQ ID NO: 22048 - DNA, 2092 bp, Heterodera glycines
tggtctaattaaagtatggccgccaaattcaatttgtgcctgctgctggagcgcggccatttcaactacattggccgcgttgaacaactgttcgatgtccaacgctactgcatcgactgtgaacggcgagcacacctgcgctaccacttctccggttgtaaggttgtgtgccgcctttgtttacggtttgggcccgaatatccgtgccaagcacaacaggtacttttcgaaataaaattaaatagaaaaacgtactaaaaaattaagcttccaaacggcgcaagtactgcccgacgttgtgctgcgtgccagttcatctttccaaacgatgactgctacgactaccacctgatcgaacatgctccagctccaatggatgcccgtggacagcgtcagcgtcagccaatctgtcaatggcgccgagtgtgtcgtgattgcgggcgtatcgcctaccagggcaagcatcaatgcccatgccaacaccctgatggcaacaggaactgcaaacgttgtgacgggccacacacgaccgacgagccctgcttcatccagccaatttgcgatgcgtctgctcgacaacgcgcatcaattgctgtcgataacgatgacgacaactccgatgacaacgacgaagacaacgacgaggacaaagacgacgttttgccgcttcgactttgcttcttcgatgcagagacgtcgcaggacagcccgctccagctgaacaaccgattggtgcagaagcacgtgccgctgctgatcgtcgctgaagtcatctgtgaacgttgtatccaggcaggcatcagcgttaacgatgggcttggaagaagagcgccggattgtgtttgtctgtgtcgtatggtgaggggacaacagttgcgccagtggtcttcaccaccgtttgccaacgcacccggagacaacacagctgtgccagtggaggcgccgacattcaaccagcgccgcttctacttccactcattcgacaacgacggcaacgacccagtggaccaatttttggattttttgactcatcatgggccaaaaaaggcccacacggtgtgcgtcgcgcacaacggtggcaagtacgacttccatctaatccttgaggcactacatcgccgaaatatgccaccaaagcgcctgtgcacaacggggctcaagatttactccatgcgtctgtcgggacgtaaccaacgacgagtcaccttcaaagactccatcaattacttcttctgtgaattggatgcgttggtgaagagctttgaactgcccgaacatcaggcgatggttaagcccttcttcccctacctctacattcagcgacaacatctgtcgcagcgcctcaacggtctaccggctcaagagttttactcaccagacacgatgaaagcggacaaacgggccaaatttttgcgttggcatgccaacaacaacggcaacagatttcaactgcgcgaacaactcatcatgtactgcgccaacgacgtggccattttgagggagtcggttatccgatttcggcagctcatcgccgacaacacgcagggcctcgaccccttcctcaacgcatccacggctgccggtcttgcgctcgccacgcttcgtcgttgttttctggccccaaatcgcctggtgcactcacccgagggcggctacctgcgcggacgtcgtgcttcagctgagtcgcagcgctacatacgcttcttcgagctggagaaccccggagcgcaagtgcaatgtgcaagctggtccgtcggggaggcgcacattgaggacaccggctaccgcgtggatggtctttggcgacgcgatgcgcctctccgtcccctggccattgaatggctcggctgttactatcatggtaatttttttttccttaaccaaaataaataaaaattaaggctgcccaaagtgcttccccgaccgacaacagcgacttgcggcgggacgcaccgcagaagacctgtatgaacggacggagcggcgcctatttgagctggagcatgactatggttgtgagatccacaaggtgtgggcatgccagtggagtgaacgaatgcgccacgacccggagctgaagcgacggtacgat

SEQ ID NO: 22049 - DNA, 923 bp, Heterodera glycines
  misc_feature (810)..(810): n is a, c, g, or t
ctgcagagattctatgtcaatgaaagttggacagatatcccctttattcattatgttatttattgttgcagaactttattcaccagtgtatcgagtttattgctttttcattacccatttaaacgcatcgcttcgttttttattacggtaaaatgtcaacaaaattctttttcgaaagtgtttattctccagttaaactcggctcttccttccccgctgccgttaattatcttttatagtggtatctgagcgattcatctctttttttacaccttcttctcttttgtgtgcctttcttcctcttttgccagtccattttctcttttttcgcgcttttatacatatatttacatatgcatagctttgcgtttatgctttatgtacatattcctacatttatagtactatttattccccaaaaaactcattacacgagattagtttcacacatgtatttatgtatgactaaaaaaagatattttattttatcataaaagttaaatgttaattttattattacggcaagtgtttgttttagttttagggcttttaaataggaatttattttttaattactcgtattttgctccccccccccccccttcccgtttcaaaaagagcttatatttgaagggctctccaaggaattaggtaggtaatcaaagtgatttcaaaaaattttatttgacttttaagtaaacaaaaatccaaggcacacacctaaatgatgaattctagagatcgacctggacctggatttttcctggatccaggtcattttttggcaacctggatttttcctggacctgnatttttgtccaggtcaaatgtgaaaaaaaatccaggtccagggcaaacacgaaaaacctggatttccctggacaaaattttagaattattatttcaagtgaccgatgtttttt

SEQ ID NO: 22050 - DNA, 1110 bp, Heterodera glycines
ccccccccccccccccaattacaagtgcactttttcatcggcaattggttttttgcacattgacaagtcgtctcgctttatatgtataaaggctctttgattttgatgcgggacggaaaagatttttaaaaaaaggaaatacaaattctcgagtcgggagacaaaattggtggccaaactgttcgggagagggggggggggggatggtggccgtggttacggtttttttgttgttctgacggtgatttaatgtgccattccatcacaaaattggccagaggatcaccgaacctcataataaacacaattggcattggggcgtgggaagggaattgagttttgtcggatgcgcaagtgaatgggcggcgtaaaataaaagtgaatgtgcggaggacaaacgaacaaacgaacgaaagtgagggaggaaatgggcggtgggggggggagaagcggagaatcgatggatttgggagagcgcgacggaatggaagggcatcggacggacgatggaaatcggtggtcggacgggacggacggaccggagggatttggggggggggaagaaggggaaagggatcggacattgttggataggggcggatgatctccccatttacactcccttctttcttcttttcatcccatcccattgaatccgccgattttctccaaaatttgtgtttgcgcgagcggaacggaaaacagaaagcacttttggggagagggggggggggatttgtgtataaaaagagaccaaagagaccgaccaattcattcattcaatccgtccgtccctccgtcttcccgcttcgtttgctctgctggcggagatgaagcagtcattcacattcaatttgaacgtttttctcattggagaaaaaaaaattatttttcatagaatgctaatccaaaaaataaaatcatatttttgtgcatatttaacagtcaaaaaaaaactgaatgaataggcaattaaaaagaaatatttattatttcaaaataatttatgcctctcaaaatcttttgagaattatttttaaaaattatttttgcgtaaatcgaagcattaacaatttgaatcttttagtgattgcatgaattcttttgact

SEQ ID NO: 22051 - DNA, 2551 bp, Heterodera glycines
tatcggttattttgattgcttctcttttgacatacatatgtgtatttattgaaaatttacgctgttttgtttttcttttctctctcacatacaaatgagtgactgcagagacaacattatttaagagaaacagtataatagaaaacgacgaaaaaaggaagagaaatgcgagggaatgaaaaagtgcgttgaattttggaggttttctcttgcatttaatgcaccccatttcataaagacaaattatttttccttcattttcccgctttgccttttgttttgggggttactacttacttgactgtcttcaaaggatagtcggaatttttggaacggggccaatccggaatggcccttaaattaatagattttaattattattttcttttgaaattattttcaatgtatacaaatgcaaatttgtatcaaataaaaaaggaattttaaaatagtgcataatttatattcatgctttgatgatcggatgtttgagaggaaatttgtttgtttgtttttttaatttattctgaattctacgaaaatgagtaaagtaatattaattaaaattttgtttattaaatttagtggtaagacatccacaagatttattttttttattatcaattttcattaatcattatgttttccgcttttttaccctgatcacattttatcctttataataagcattggttctaattttaaaaattatcaaaaaaaattcatcaacttttacttatcgacgacccatcccaattgaaatgcccttgccgccgcccatgttcattgccaccgcttggcaccagacgccgtctttaatcacatggcaaaaattgtccccggttgctgacagccgcatctttttctggaaagcctcgcggcgatcggctggcgaacatgcaacaatgaaagttccgcgcacggcacgcgacaatgcctaaaaaatgagaaaaactttgggatttcaaatcagcgccgtatcccgtatccagaaaaaatcaatgtgtcgattggcggcattgggaaaaagctttaaaatttttaacttatttttactataatatataggtaaaaattgtttcaaattcaaaaatgtacacaattttctcttacatttttttaatctttaatttcaatggacgtgaatgcttttaattttttagaaaataagcaaaataattaatttttcatttttctttaattggcacagaattagtcattcttgtttagaccaaacaaatatagaaaataattctttaatttttaatacaatttaaaactttgaacaaaaataaataggaaaatgtttaccgtttgcactttgttggtcgattcatttgggttttttgtgattgcctttgggaaaaaacatatatatttaaattaatttttaaatttttttataattatttcactttttccatcgcttccttccatgtcggttgtgggcagggcggcgcttcatccgaaaaagccatttctgtctctttttggggttgtgcattttgtccacccaaatggggaggtgccatcatcggtggaaggtcagtctttttgattaaaaaataattttgtatatttaattaaattagtttttacaaatatttaaattattgtcatttttaagaatcacttggcgttggttgaattgtggtgtcattccttggtttgtaaattgttgctaaaaagaagtatttttgtttttagaatagatttttgcctattttgaaacctgatttggcattggcattctgttttgttgagggataaacgtttgcggttgttgcaatgctacgaatccctttttaagatttaaacgatgcatgatgcaattaggcataagatttttctaaccgcctgttgagtttgttgtgcctgcggtggtgttgcaaaattttgtgaaaattgttgctgctgaggctgcatcatgttttgctggcgatagatattaattatatttttttaaattttaatatttaaaagtcataattgttagtttattttcctaatattcaattattaattttgttttggtcacacaaatttgcgcattctttcattttttaattttagaaaaatctaaattcggcatccatttaatttaaaagctttgaattactaagttttctttttcaatttttaagatttatttaaattaaaaaataaataaattttacgatatttctaaaaatgccttaccgccaaatttcctcccattccgctggattgaacctgggatgctgagccatccaatgcgtttgtgtcccgttggatgacgaaaaatttctgtccattgccacctaacatctgttggctttgtgccacacgggcattgccattatttacccggacattttggcatttgcacattgccagaaataaaataaaaacaaaaatttgggaaaacattttctgaaacatataaataatcgtcactttgttactaatttgacgaaattatgaaacgcaaaattagttaaaaattttcgtaggtagctatttttgattataagcaaattggttttaatcaatgcaaaatatgaacatgaaa

SEQ ID NO: 22052 - DNA, 1293 bp, Heterodera glycines
ataactattttttctttccatacgttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaaaagagtagaaaacagcttcgatatcaagaaaccaagtcaa

SEQ ID NO: 22053 - DNA, 1969 bp, Heterodera glycines
ctcctccgatcgttcgatgccttggcacgcgaacttcgcttgccctcgccggctgcacttacgtccttttcctttccggcttcctctttgtgaacacattctttctctacttttcttctgcccttctcggattgggagctgctggtaagccataattatggcgagatctttaattgattttaatgaagtgatctggacagcgcaaggcaaatatttggcattgaacagctccgagcagacggctggcaagcacagctcgctatttctggcactttccctggcgtggtccgtatacttcctccattcatccttttccgtctctctctttcaattgccctttcatcctttcccattttaccatcgcctttttcttgtccgttcagtctctcattcggtggtttcttcctcctaatcatcttcctggtaaatgacggcagtgcttccctctcctcctcctactcttcttcatcgttttccctcaataattcttcctcctcctcttcggccgatatttctccttcctttgaccatcccaccatcaaactcatctatggcagcttcactggcattgccctgctcggtgtggctgtgctcgcacttttgccgcctactcggacaaattcgaaggtgagttatgtgaatgacaaagatggaataggggtggaagagttggagatgaagaagagagaggaagagcgacggaagaagcagcaggacgacataactgatcagccacggcgggaggagagcagcttggagcggatcagtcagtggcaatggcacaattccaattttccgcgtcccctcccctcttcttcagtggtattggccgcatcgcgcaaaatggccgcattggccgttgtcttcggctacaccggcattttgttgagcttttggagcaggtattacataagcggtcaattgacccctctcttttcgcttttagcatttttcctaccgcactgatcaacactcttcaaatgcgttcccaattcagtcccaaaattctgattgctttgaatgccattttcaaaggcttaggacaaccgttttgttcgttcttcgggagatccgtcgatgacattccctttttaagtgagtgtccttttcgaatggttccgtctccaccgcgtaaagcgcagtcggctggtgttcgtcggcatgcttctccacctgttggcctttgtgctcatcttcctcatccttccaaatgaaagtccgctcggtccaaccgacaaaacggcgatcattcggccaaagtcacttcccccactgtcatttctctgctccattaatctttgttggtggtcattacagtgttgtgatcgcacttttctgcggctttttgctcagtttcggcgacgctttttggagcactcagatttttgcatttttgatcacaaattaccccaaccgaagtgccgagtcatttgccctcttcaaattctatcaggtgccctccccctcccctcccccgtcttcatcgccaattcccttcccaaattcagtctctgctcacttccattttcttctacctgtcctctcatcttctgctccattggcatcttctgattttgtccatttccgttatctttggttatttctcttttgttgtggctgaaaaaatggaaggacaacgaaaaaccaacggaacaacggagcaaaaataaacatttaactaattgcataattacacataacctagggatgtcaattttatgtaaatacatatttttttctggcttctccatgctctaaatagtaggaaaaacactcttttttgtgtttgctgacaaaagttgggacttttatttacatatttcggggttttacacatattttgggattttatacatatttggtacatatttttgactttttcttacatattttcatttttttacatatttcgaagattttttacggaaaattttgaaaatcctcaaaaaaaaagccaaaatttcggcaa

SEQ ID NO: 22054 - DNA, 1274 bp, Heterodera glycines
atttcacagagaatttttaaatttatcttatatctaagaaaaatgactatctcttattttgagaaattttatacgttacaaatgctctcgagcatgataggaagtgcggcgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggcgcgcaatcgccatttaatttcacagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttattttgagaaattttatacgttacaaaagcgctcgagcgtgagagggagggcggtgcgcaatcgccatttaatttctcagagaatttttaaatttatcttatatccaagaaaaatgactatctcttcttttgagaaattttatacgttacaaaagctctcgagcatgataggaagggcggtgcgcaatcgccatttaatttctcagagaatttttaaatttatcttatatccaagaaaaatgactatctcttattttgagaaattttatacgttacaaaagctctcgagcgtgagagggagggcggtgcgcaatcgccatttaatttctcagagaatttttaaatttatcttatatccaagaaaaatgactatctcttattttgagaaattttatacgttacaaatgctctcgagcatgataggaagtgcggtgcgcaatcgccatttaatttcacagagaatttttaaatttatcttatatccaagaaaaatgactatctcttattttgagaaattttatacgttacaaatgctctcgagcatgataggaagtgcggtgcgcaatcgccatttaatttcacagagaat

SEQ ID NO: 22055 - DNA, 1807 bp, Heterodera glycines
  misc_feature (1701)..(1701): n is a, c, g, or t
  misc_feature (1782)..(1782): n is a, c, g, or t
tttcatcctgaaattttttaataaatattttcaaacttcctccacattaatttaaggagaattttgccttttaataaattctcttgtgaaaaggcaaaaaaataggcttttttaaaatatgcctatttaaatgacttaaatttttttcacttttaaatttatttaaattttcaattttttttagctttttccgaaaaattttgtcttttttttcggcaggcactgcctctgacaatgttttttatttatttagaaatataaatttattttttttctttttgatttattttaattatatttcatcctgaaattttttaataaacattttcaaactttcaccttattaatttaaggcgaattttgccttttttaataaattctcttgtgaaaaggcaaaaaatagtctcttttaaatatgcctatttaaatgactttaattgctgtcctttcgcttacgaccataccacgttgaaagcacgccatcccgtccgatctggcaagttaagcaacgttgggccttcttagtacttggaacggagacgtcctgggaatcgaaggtgttgtaagcttttttacttttttcacttttaaatttatttaaattttcaattttttttggcttttttcaaaaaattttgtctattttttcggcaggcactgcctctgacaatgttttttatttatttagaaaaaaaaatttattttttttctttttgattattttaattgtatttcatcctgaaattttttaataaatattttcaaactttcaccttattaatttaaggcgaattttgccttttttaataaattctcttgtgaaaaggcaaaaaaataggcttttttaaaatatgcctatttaaatgacttaaatttttttcacttttaaatttatttaaattttcaattttttttagctttttccgaaaaattttttgtcttttttttcggcaggcactgcctctgacaatgttttttatttatttagaaatataaatttattttttttctttttgattattttaattgtatttcatcctgaaattttttaataaacattttcaaactttcaccttattaatttaaggcgaattttgccttttttaataaattctcttgtgaaaaggcaaaaaatagtctcttttaaatatgcctatttaaattactttaattgctgtcctttcgcttacgaccataccacgttgaaagcacgccatcccgtccgatctggcaagttaagcaacgttgggccttcttagtacttggaacggagacgtcctgggaatcgaaggtgttgtaagctttttttacttttttcacttataaatttatttaaattttcaattttttttggcttttttcaaaaaattttgtctattttttcggcaggcactgcctctgacaatgttttttatttatttagaaaaataaatttattttttttctttttaattattttaattgtatttcatcctgaaattttttaataaatattttcaaactttcaccttattaatttaaggcgaattttgccttttttaataaattctcttgtgaaaaggcaaaaaaataggcttttttaaaatatgcctatttaaatgacttaaatttttttcacttttaaatttatttaaattttcaattttttttggcttttttcaaaaaattttgtctattttttcggcaggcactgcctctgancatgttttttatttatttagaaaataaatttattttttttctttttgattattttaattgtatttcatcccctgaattttntaataatattttcaaactttcacct

SEQ ID NO: 22056 - DNA, 1470 bp, Heterodera glycines
tttgcccatattttacattccttgtcagttgtgtattcgtcaacaatgctcttttcctccgccctaaatcaacagaaggtagcgccaaatgcaagcgaaatcgcgggacgtggcaacgcaaaaggatagaattccgtcagaggtggagccgagcaacattcattttgataaaagcttatttttactctttttcagtgaaccgttcagtgcaatcaaacggagacgaaggaatggaaatggttgaaatgaccggtaagaatggacgaagcattgaaaccgttgaaaaacgattgacaattttcattttcagagattcgctacgaacagaagcaacaggtcgccgccgggggtctctgctgctgctgcataccgtgtggctttttcaacgaatcgtcaaacgaggaaccgccgaaaatcttcaaattcttcatgacaaaaaagaagactccacaaccgcctccagcagcagaagtcgtgcaaccgcaaaactccgttccatcgccaaaggcccttcctgtcgaaaactacacactcaacgcgacgtttaggaaggaagaggcgcgtggatacgcaaaaagtgaaaaataatgtctaaattgaatgtttcccaattattactcattttcagtgacttttaagaagagcaaaaagcgtgcagcacagaccaaacagccgaaactcgtcagaatttcaattttcttcgctttcccctgcaaaatttccacttcttttaggtttcggcctccagtcagcccagcgaaacttcggtgttgggtacggcttccgcatttgcagcaggtgtcgttgctccgcataaaaaacaacaaatatttttttcagcaagcatcagaacccctcagtcagtgggaagccatgtcggtccgtcgaaaagcaaacacgaaatggattctccctccgtaagacactcattacccacttatcgtccgctattatatttaaaattgtttagaatccgacttcaaagggcagcgcatacttttaagaaggaaggcccatcccatttcaactgtgagagatgatcaaagaaagcgcgaagaattgccgataattattttgaagatgatgatattatatatatatacagtcatggtcataagtgttgtcccatcatgctttgaaaaaaataattgcgtataaattgtcattttccaatttcaacagataagtagcataccattggatagcattttttatgggctttccaatgataccatatttgcatttgtgacataaacatttatttgatttattttaccatattcacaatttgatcaaaatataggtggacaaaagtgttgtcccatttcatttttaaaatattgcttctctggatcagcattaaaaaaatctaaagaaattcaggtaagcataactttggatgctgatcaaaaaaggtagcaacacctagatgatcagatcactccttcatggtgatctgataagcccatt

SEQ ID NO: 22057 - DNA, 715 bp, Heterodera glycines
ttgttgtgtctcaatgtcggacacacaataaaataataaaacacaatttatgtcggaggtcaaatgcagtacaaaatgtaaaatagcaaaatgaataagggggagggattgacacgtcacaacattaatcaataatcgatgcgcgccaaattcaaattctttaacactccaacacctcccttctttaagctgaaccctcaggggtttggcgagaagcggatcggcgctttccgttggcgttgcgatcgacgcggggccaaaggaggactcggagatcgtcgctttgcctgagtccgtcgaattggtgccggttgcggaggaggctcgcggatcggcgatgggtcccggtcttgctcttcttgagcctggggtgggatccttaccgtatcattaccgtcctcctcaagaggataacggcgtcgcagttggtttgcgtgccggtggacgtttcttccgagagccgggacgtggacacgatacgtcggggacttttccaatctttcgatgatctttccatttagccaaaatctctttccacggttgaaattcaaaagcaaaacgggatcttttggcaaaaactcaaccgattttgatccttggtgttgatcaaattgacgggccatttttcgcgcataatcagcttgtgatttgcggattttggctgggtcgatgacttcggcttgttcttccttcggatggacgagagacagctgag

SEQ ID NO: 22058 - DNA, 1294 bp, Heterodera glycines
cttccctctttctcattctcatcaacattgctctcctcccagtggctattccttctcgggtatacccagttctgggattgttcccaaatttttaagtttgtccacatccctccgtcaaaagccaattaaactaattaggtgatcattagtcccttcctctatgattaacatgtcccttataacattcatttccactcaccccgggaaaaacagatgatttaaatgctatttggcatgctttttccattcttcaatcattataaagtcttcggcccccctacacccaattaagaccaacaaactaattgctttttcattccgtttccccaattttggctttatcaccccacccgactgttggaccacctctttggccttggttctttcctttatttttctttgtttttttgaactttttgcacaaataataaatgtgttcgtcacttcgtcagtcagtcccaattaattaactaattaattagttagggccatcaatcagcaattattattctttcgttgtcactttgtcttttttcttcccccccccccttttttttaaaccattcatttattcattcgttcattctcgtgttttttagcaaaagagttcgccatttgaaaactgacaaaatttttgttaaatccttagagacattccattttttttgcggtttagtgttaattaccaaggcttttcctcccctcccccttacactaatgaccctttcattattttcttagatcattgccattttccaaccgcttttgcccttttgctgatcattctttcccatcaaaatggtattcattaactcattgccgtctctgttgtgtgccgaagagactgtgaattgtgagtatccgctcgactcgggctccatgttggcctacgtggcaccgcaacggtacagcaccgtattggccgctgtcaccaagggcgaccaactttgctcgcttattccgcccgcacatccgcgccgcaagctgagcattgcacacggcggtggtggtcagttatttgatcacttttaagtgccaatgccaagtcagtgtttgcaccgatcgggcggcacgagaaatagtggattctgataatggatcagtcgctttataatatcagacatatggctaatttttgatcatttttgaattttatcagttaaagtgagtaattgtgtaaacacattggttttcttcgctaaaatgatcccattgatcattcctctcccttcttcaggcattgacgacataggaggttgggagggcgttttggatttttgcgatgctttggact

SEQ ID NO: 22059 - DNA, 2270 bp, Heterodera glycines
acttttatttttatatctttttttaaaatgtttttcttctggggaataaaatttatattatagagaaaaaaattgcgcttttttgtagtattttacttttctcaaatagcttttcagaagggagttacgaatttttttctgaaaaatcgaatttttccagaaattctggaataatttttttattttggaagatagaaattccaaataaatctcataaaattctcccaatttttctctatttttaaagctttattccactaaatttgaccaaaaacgaagagatttatgaattttcgaaatttcacaggattttccggggctcaaattttgacgatttttcaaaaaattttaaccaccttccaaaaagtctgaaacacaaaataaagcgtatatacgtattcagcacctcaaattatgccataaaaatgcattttggctaatttaggagcaaaaaaatttttcatgaaatgcaaaaccatggggtcccccctatggttttgagttttaaaatcacaattaattttataactttttttaaactcatggtaaaaacatgagataaagcacattagatagagcttaaaattctctacaaaaatgctctaagacaaattttcgctaagatcaacgcctgacgagttataagccttgaacggaaatggggagctcaattccggaaaatttttctatttccggaaaattttgaaattttttcaaaaatgccaccaatcgatagagctcgaaaaacggttgcttgaaagtggtctccgttttcctgggaaaaatctgcaaaaaataataaaattcaaaaacgaaaaattttcgagggggccaagctcgaaaaattttgaaaattttcaaaatctgaaaacgtcatctgatgcagctttaaaaactacacaaatgcgcaagcggcgccaacccgctccgcttaacccccagcgagttattcacgaaaagccaaaaccggcattttgagcgccgttcagtcgccaatttctacaggctcggcatttgatctgatcaaaaagtgatcagtgacaaagttgtagccaacatgtctggggtgtgccctctcagcggactttttccgctcccggttccctgagaaaagttacagtccgaaaaccgcgacgattttttttatttggccgtttcagcgccgctggcgctcaactggccgccggaccgaaaaatccttatttttcccagatgcgcctcaaaaagttgcttaagcaatgccgcactttcaggagcctccgggcaaaccacggggacttataattttttctacgagttgcaccttttctctatatatagtagaaactagcgggtgcgtgaaccgtcggctatttagctgggcaaaagcgcttcgcgctttgggagcttcgctacctagactgtgaagcgattcaaattgatcgaattggttggagatttttttttgaatttttaaaaaattattatgggtttttagtccacatcgaggctcaagatgggctcttcgcgcccttcgcgtcctcgaacggcgctttgcgcccgtttctaatttttgttgtgcttttcggccgcttcgcggcctcgaacgggcgcttcgcgcccgttttttaaattttgttgggccgcttcgcggcctcagtcgggcgcttcgcaccggtttttcaatttttgttggccttgaacgggcgcttcgcgcccgttttttaaatccgttgaactcatacgggcgcttcgcgcctgttttttagcttgttaggccgcttcacggcctcagtcgagcgcttcgcccgttttttaaattttgaggtacaacagcgattagaagagtgattagaagaggtacaacagtgattagaagaggtacaacagcgattagaagaggtacaacagcgattagaagagtgattagaagaggtacaacattgattagaagaggtacaacagcgattagaagaggtacaacagcgattagaagagtgattagaagaggtacaacagtgattagaagagtacaacagcgattagaagaggtacaacagcgattagaagaggtacaacagcgattagaagaggtacaacagcgattagaagagtgattagaagaggtacaacagtgattagaagtggtacaacagtgattagaagaggtacaactgtaattaaaagaggtacaatagtgattaaaagaggaagaacagtgattaaaagaggtacaatagtgattaaaagaggaagaacagtgattagaagaggtacaaaagtgattagaa

SEQ ID NO: 22060 - DNA, 1632 bp, Heterodera glycines
ttcaaatattaataattagtgaatataatgcccacaacattaaatgtaacattacagaaattcttctgtttcagtagaccagttatctctttctgatcaacatcccaatttaaatagaaaaaatcaaatagcgattctttaaaaaaatatcactgcgtttgcgtttaaacaaattttaattttcatttttttcacccccttttctcataatttgaactcaattgaatgtttaatgatgctgcatccatcaaatttttcttaattcgataagccctcacaatgtccgcgtcgaatagcgatgaaagcattgaatttagtctttggctccattctgtccaattcgtctgctgattatgcttttttccctctgctgatgaatgctcttccgtaaaaatgttgtcctctaattctattccgaccaaccaaatttttcggtaaaattgtctaaaaataaaaaatgaaatgccaaaaagtgataattaaaacagagatgaatacgatgtaatccaaattggaaaattttaaaggagcaacaatgaatgatcagaggacattgaaatcaccgaaacaaataaaattaatcagagtttcaaaagcctcattagccagacaaaaaccttaaaagtcgtaaaatgcaatcaaacaaaggcctcagcataaatgccaaattttgaaaattagcctcattattggggatgggatttataatccgttagtctcacgaactatgccttattaattttttttttctaaaacattctatcgcttttacgttaaatatttatttatttaaacattggcatttttttataaataaattaatacaatccttaattatcagtagagctcgcattttgaggcatatgcctttttttctacgcactagtttcgatatattaagcataaaaaacgcattttccacttggtttgaggcttctacgttgacttttattatgcctttttttgcctttttcgggattttcgtgccttaaatgctttttctggcattttgccgttttggtgccttttttggcgtttttccgaaaaattccattgaaaatgcattaaaatctggaaaatacacgcttaagaaatgactcgaaaaaatttcagaaaatacactcctaagaattgaaaaattttcaaaaattttttgctaaaatttcattttttcaataaaaatttttgagttgaaaatttttccttattcgaaaaagctataaagaaaagaggagggagagagaagggagagacagaaaagagtagagaaaaaaagagactgagagagaggtgaagtagaggcagagaaaagagagagagagaggagagagtgaaatggagagatagagaggggggggaagagagtgggggagaaagagaattagagaaagaagagaagagagaaaagaggagagagaggacaaatgagagagagggagagagaagagagagagaaacagagaaggagagcgaaaactaatttgtgagagaaaacgatggggattggggaaatgtaagagaaagagagagcgaataaaaaggaaagatatgacacaagagagagagagagagagtgaaaagagagaaaaagaatgaaataagaatcgcgagagaaataaaaggagagtgagt

SEQ ID NO: 22061 - DNA, 1301 bp, Heterodera glycines
  misc_feature (1263)..(1263): n is a, c, g, or t
  misc_feature (1266)..(1266): n is a, c, g, or t
agtatatgttgtgaacttttgtatttaaaattgcagttggagaacgcattttgcaatactccaagaaggatggcaagcaatcaaaagattctttctttgtgggaatggccatgacgtttgtcgtgcgttcttctgcgtagcgagtaattaaaaaaattattcaaaaagattagtgatgaacgatgctttagaaatttactggccaaattaaccctaaccatcaatcggaaactgcttcttacattgacattagcagttttagtttatattttgccgattttctgtcatacgtattgattgggctgatcatttggacacgatcaacacaaagtctttccttttattaaaaccaaattttaacgagtttttggcattgacgcgttaaataatgtaaatttaaataattagtttcggcacaaacgaaaaaattgacagtttctgtcagtgttctcatggcaattgaactcatctgctttattttggtcagcatattaaatgtttaataattaaacttaaatattaatcatttcagaatacactctttgctcgtttcatatttccattgctcaattttgacgcatttgcaattggatttttcgttatccaattagtagaggtgcgccgtgactgagaaaacctgtgaaatgtgaccgtgaattttttgagttaaatttttccctgtcggcgaactttttcgttttacactgtattttgtggtataattttccaaacaatttcttttgtgaaaagggggtccataggcaccgataaacgccgccacaaaaaattttgaaaatttgaattcactttgtgcacagattttgtccaaaaatggtcaaattttgagaatctgaaccaattttttaagaaatgaatagcttttggagcccggcggtgccgataggcgccgcagggggaaaaatctaaaattttagtttaatttgtgtacagattttacccgtaaaatgagccaattttgcaattttaatcaatttaaaaaggcaaaaaacgatgaaaaaatttaatattttttcaagtaaaaaaaatcgggtacataagtgtgcattggcacgcgcgccataatttgcattttctcatcatttagcgttctaaggttttgtgagacatatgtaattacctaatttttaaagaaaaataggggttttagtggaaatttttgaaaatgggctttgttaacagcttttgcccaaaataactttatttcgagcgagttttttttaaagaatttaatgagttttattntanatgtggtcatccttgaaactttgctttttatttgt

SEQ ID NO: 22062 - DNA, 2169 bp, Heterodera glycines
ttaccctgtgaaaatggcccgtgaatttacccagtgaaacatatccgtgaatttacccattgaaacatgtccgtgaatttaccccgtgaaacatgaccgtgaatttatttaccctgtgaaacatggccgtgaatttacccagtgaaacatgtccgtgaatttatttaccctgtgaaacatggccgtgaatttacccattgaaacatgtccgtgaatttaccccgtgaaacatgaccgtgaatttatttacccagtgaaacatgtccgtgaatttatttaccctgtgaaacatggccgtgaatttacccagtgaaacatgtccgtgaatttacccagtgaaacatatccgtggatttaccccgtgaaacatggccgtgaatttaccccgtgaaacatggcccgtgaatttacccagtgaaacatatccgtgaatttaccaattgaaacatgtccgtgaatttaccccgtgaaacatgaccatgaattacccagtgaaacatggccgtgaatttaccccgtgaaacatgaccgtgaatttatttaccctgtgaaacatggccgtgaatttacccagtgaaacatggccgtgaatttaccccgtgaaacatgggtgaattactccgaaccatggctgtgaactgaagtcgtgaatcatgactgaatatatcccgcaataattattaattattactattatgaaaaatatttttgaaattttgttgatttctagctgtatttttaacattccatcttttttttcactttttacacatatttaggtgacaatttagcgatttaattatttatttatcgtagctctaatatttattttttatattaaaaattcattaagataaatgcttctacattcttatattctttttgccattttctgtggcatttctctttttgatatgatatcttcgatgagtgaaaatgtttttcctgcaaattttcagacttatgctggcacagtttcaccgcctgggttctacaaaattatcgtttgggacaaactgacaatgagcaaattgaaatccgaaaactgcgcagatttatttttttataagcctataaaagtcttttttaaagatttatattaatattttattgcccaaccccggaaaaattcaaaaaatatcctttaaaattttattttattgtattctattattagggttaaaagctttttgtaagctattgcttggcaattcgacaaatatcaaaaaagtaatagcatgaaaactaaaaaaatcaatttttttgaagtttttcttcataaattttttgcaggctagaaaatctttttgctttttgtaaggctaatagagtatgtgaagagctttcgaatgatatcaagattgttggatttggttgacaaagaaaaaagttatagatcaacaaaaactgggctggggccgaaccgtgcgggccgaaatgagccggtccggttcattttgtttccaccgttcagtaaagaatgggtcataagtttgaattttgcgcaatgccttggcatattcaatttcaacatttagaataaataatttttcgtcaatttaactttttgattttttcacaaacatcagaagtcggctaacccattttcagctgtgtttcaaggatatattctccatttttgctaaaattccattggtttgctctcactttgtttatttatcagtggcatttttgcacattccatcggaaataaatcgaaagggcggggcattgggtttgaatttgtcactgatcacatatattcttggcattttgtcctcagttttcgtctccgtccgtccatcggtcggtcggttcggctccttctcagtgcgcttatccattctgagcaatgttcacattcgcaatgtttattggcacccagcgctgctgttgcggactccaacgccattgctgttgctgccgtttgacgcgcttcttaatgagtcaaaggcaaaaatgccaaaaacggaaattagaagccagagcatggcgcaccatgccaccgttgtcggccgcgtccgcatcaaaagggttgttggaattagcagagacgggagcgaccaaagacccctgaagcatggcacttttgaccgggtgttcaatgaattgcttataaaaggtgcctacccaaaaaggatcacaagcaaaagccaggagggccaattt

SEQ ID NO: 22063 - DNA, 2142 bp, Heterodera glycines
  misc_feature (2080)..(2080): n is a, c, g, or t
gattttgattttaaatgaataattcttatttttgttctttaaggctatgataatcaattctgcaaaagatatgttccatcaagaaatggatcaacaaatattggaatcattctcgaacagtgcagatcacaacttgactgagcactcaacaaatggtataaatcaagaaaaattacaaaattaattactatttatttaatcgcattgtaatggatactctgaaaacttattaaaaatagtattttagaaattaatttttgagaattttttgttctcactcttacagataggacgtatactgtaaagaattttttgtaatatcgctgaagtcaacttaaattattaaatttttatatttttatttaatttgttataaccattaaagatggcatgactgatgaggagatacaattaatgtttgaatataaagacaattggactaagcaatatgagcaaatgctgagtagattaacgccagaaaaacaggtaataaattaatatttttttttacaaacattttgcatttttttaaaattaattttattacaatggaaaattcattttctgaaaattccttacacaaacgcaataaaaaacgaaaaaccactcttaataagttgaactaaaaaaatttcgtacaacaacaaataggcatccgttttttgtgattttgtacctaatttgtgcctgttttgacattgccgatttatgcctttactggcgattttttgtgtaatatgtataaaatatcaatttattcataaaaaattgaaatttaatttaatttaactttttgaaatttttttaggaaatggttataaattatgttatcacacaagaaaatgatattgaattattgaaacgattcttgaaaactgatcgttacgaattgcttcgggggttaaagagtgagtttaagttgcttatttgtgccatgacaaaatgaacataaaattgagcataaaaaaaataagaagccaagctacagtaggacgagaacggattcgtttttcgctaattagtttttaattacaatgattttttttttgtttgaaaatatgaaactctaataatttttgtctaatttcgtttttcgatggaaacaatacttttttaaatttgaaaacttgcttcgggggtttcaaggccttggccatgattatgatatcctattttttatcgaaaatgaataagtacgaattgaaaaatccgtttttttaatctaaaaaattgtaaaataaaaatttataagtttattgaatttaaattatttttaagccaaatttaaattgctttttgtagatatttataacgaaaaacgtcatttcataaaaaatttaaaagtgacatctaatcaaatgaacatatgaatattttatgataattaaataaaggaaaattcaatttttttttttttgttaaatgaatttataaatttaaatttagataatcggcttaaaaaaaagctaattgaagagatgcttggcaaaatggagcttgaagagtttaaaattcaaattgcacaagcgattgcgattaacgaatcaaacaacccaccaacagatcttagaaaggaatcaaaaacaaaaccaaaaattcgagttggtagaaaaaaaattatttttttaaataataaatttataatttaaaactaattagatatttaaagtaaaatggaacattttttacattattttaaggaacttaaaattgatgcccatcaatcatcacaaaatttggcaacaaatcttcgtgataaaggcaaagcgaaactggaagacggacataaatctccaaacattcgggtaaattcagttgaatcgcatatatttaaaaataataatgtttaaaaaatttaataatcaaaatggagcaaaaatattttattttttaatgaagagtttgaacttttaattttcaaaatgctaaacttaaaaatattataaacaaaacaaaatatatttttaatattttattttttaatgaagagtttgaacttttaattttcaaaaatactaacttaaaaatattataaacaaaacaaaatatttttttgcggcctaatttattgtttaattanataattaaacatttttgtagaatatttttttaattgtttggactttaaggaacgccaatctt

SEQ ID NO: 22064 - DNA, 1158 bp, Heterodera glycines
tttcccggggcccaaatagtgacgatttttcaaaaatttgtaaccaccttccaaaaagtctgaaacgcaaaataaagcgtatatacgtattcagcacctcaaattatgccataaaaatgcattttggctaatttaggagcaaaaaaatttttcatgaaatgcaaaaccatggggtcccccctttggttttgagtttcaaaatcacaattaattttataactttttttaaattcatgataaaaacatgagataaagcacattagattgggcttaaaattctctacaaaaaagctcttagacgattttttgataaattcaactcctgacgagttattgcgccagaactgaaattgaggtctagcaaccaaaaattttctatttccaaaaaaattttgaaaattttttctgaaaatgacaccaatcgatagagcatgaaaaacggttgcttgaaagtggtctccgttttccccggaaaaatctgcaaaaaatactaaaattcaaaaacctcaaaagtgacgagggggcctagctcgaaaatttctgaaaatttcagaaatacaaaaacatggttggatagagctcgtcgagctgtacaaaaaagccgcttacaccgacctcctccctcaaaaccccgacgagttattccgccggcgctgaaatggccaaaaaagtaagcaatttttccacgactgtacacggaatacagtaggccgtagagaaaaatgattggaagcgaagttgtagggcacacttcaacttaaaatcctcccagcaagcattttttgatcaaagcaaaagaaaaaaatttcgtaacagtgagactgaaacgaaaagccgtttcagcgccgtcggcgctcagttggccaccggaccggaatgcccatagttttcctggatgcgcctcaaaaagttgcttaagcaatgtcaacatttcaggtccccccgattagccgttcccgagatttttgttttagcaatgagttgcactgttgttctaaggtatataaactagcgtgtggaaattgacgggggcggcgtaggccgttgggttttggatgaagataaaatggacatgctcatttgttattttaaacagacaaacattaattgcattagtgtgaagttttaaagcgctatcgcgctatgggacgcggtttc

SEQ ID NO: 22065 - DNA, 2555 bp, Heterodera glycines
cgcgaatcgcggatcgcggtcgcgtcccagccctgatgcactgtctgctttttatccgctttttttttaaacagcgtaggaacaaaatgaaaaaacaccacaaattaggtaggtgcaataacgtaggattatgcgcagtgaagaaatacctacatatgtagtttgagatttctctcacaaattcacgccattttatactcaaaatttttccactgaaaaaagttcgttacagaagtgtataaaagggcacgattttgcttggactgatcattcatattattaattcaacacatcttcaattgcctacctacctaaatcatattttgctgataatggctaccacccatcagcataatcccacgcccgaggtgtccatttttgtccatgtttttttcaacacatttaattttttttcgtccaggtgaaggagctgtgcaagtgcctggcgctggacgacaatcagctgcgcgacattatggcaaagttcgagatggaatacaaaaaaggccttgacccagtgaccggtggagaattttgaccatttttacccccttcgtaacctccctctcccattttcagctccgacagcttgcgtcaaaatgcttccgacgtacatccgcgcgattgctgttggcgaagaaaagggcgaattcctggcactggacctcggcggaaccaattttcgtgtcctgcgcatcaccttggagggcggctgccgttctacgatgcacaacaaaatctacagcatgcccgacagtgttcagcaaggcaccggcacggaggtgagttttgcggatgattcagaatttgttcaattttaatgtttcaacaattttttcagctgttcgaccacatcgctgcgtgtctggccgactacatgcgtgagcagaatctgacgagccattcgaagatgccgctcggcttcaccttttccttcccgtgccaacagaatgggctcaccaatgccgtcctgacaaactggacgaagggatttacggttagaaaattgatttctgaatatttagtaaactccatttttcaggcttctggcgttgttggggagaacgtcgtccatatgctgcacgacgcgttcaagcgacggggcgacgtggacatcgacgtagtcgcagtgctcaacgacaccacgggaacgatgctcgcctgctccttcattgaacaacattgctacgtcggggtcattgtcgggacgggtaaagaaacctaattttttgtttgattttcaattaattcccctttttttcttttcaggttgcaatgccgcatacatggagcgactggagaatgtgccgaaactcaagggaattgtcaactccgcggaaggtaaaaatgggaggtgacgggagcccgtaaacggcattaatttttgaaacaattcagatggtctgccggcggagatgtgcgtcaacacggaatggggaggattcggcgacgacggagcactggaccaattcctcaccatctacgaccagcagttggaccagcagagcctcaaccccggccgtcaacgcttcgagaagaccatctccggcatgtacatggtgggaaattttcaaatttaacaacaaattatgttaaagaaagttttcagggtgagatcgtccgtcttgcgctggaggacttggcacgtcgcgggctgttgttcagcggcgactccactcgaatttccgaacgcggctgcatctccaccaagatggtgtccgacatcgaagggtaaaactctgctctaaaaagtgcttaatttcccttcatttgcaggtttatgcacagcaccgacgggaacccattcgccaaagtcggcgagatgctgcgcgccattggtgagttgtcatttgatcactttagccattcaacatcccaatatcccattttaggcatttcgaactcatcggccgccgactgtgcaaatgtcgcctacatcagctcgttgattggcacgcgcgccgctcatctctgcgcctgtgggcttgccgccatcctcaaccgcatgcagaggccccgcgtgactatcggcgtcgacggctccgtgttccgcttccatccaaccttcaaattcaacctcgaccagaagatcaaggcgctgttggccgtcaaatgcgaagtgagttacatagtttctaatatcgtttcggaatgatatgaataaatctcctctaatttcagttcttcatggtgctcagcgaggacggaagtggacgaggcgcagcagtcgcagcagcagtcgcattgcggatgaatcgccttgtgggagcgtgaacagcctgtgacgatgccgtccgatgtcagatgtgtgaatcttaggccccataatgtcatatgtattgtaatgttaggcattttgtcccatgtctgtctgtatataaggttgaattcctaagcacaatgatgttccattattcacaatttgtatcaattgttcatttgtattgtaggtgtgataaatgagaaaacatttatgtcgttgcaaagaaaactggaaaattggtttgcctatttcagtttcagaagttggcactcgtttagttgggttttgttca

SEQ ID NO: 22066 - DNA, 908 bp, Heterodera glycines
acaaaaatttcttccgaagagcggcaatttcaggggtgtgggagtggagaggaaggaatttttcggacagattgcgtttttctttcacactctctcttccctcctttcaagtctgccgaaattttaatacaattgaattgaaaaaatgttgatacaaactccataagcttagcggattccaagacaattataaaaaaagaaaaaaaaaagaaagaaaaaggttttctgtaaatcagcagaagagccgataagagcgatggatagatttaataataacaaaaaaaaaggagtagaaaaataataattggattcatttttttaccaagggacagaagcgccttaaagagaatatgctggcagttgcaagtaatcgcaaaattaaaaaaattgcgatatgcaccaaaagggttcgaaccggcgcatagtgcaaaactgcgcgttctacgttattaaagaaaaccagcaaaatttttcagtctcttctatcccacctatatcctagcgcagaggaaagaaagcgcctaataaaataaaaaatcaaaaaatcatattaaaaaattcgtctcagccaggaaaaccggtgcgccttgtgatgctttgtccgtccccacccatggggggggggggggggggttctccaaattggcttctcctcaacagtcaaaaatccacaatgccggcacagctaactcttcgccaggagcgccacgtgctaaataatgcttttcgggtcgggctaatacactgcttctcctccacaaatatttccaagacggagacaaatcactttatttaaaaccgcaacaataaaatgggagaagagtcggaggaaaataagaacaaaatacaaatatgaaagtgcactgccaacagaatgaattgaagggaagacggggggggggggggga

SEQ ID NO: 22067 - DNA, 1247 bp, Heterodera glycines
  misc_feature (63)..(63): n is a, c, g, or t
  misc_feature (87)..(87): n is a, c, g, or t
  misc_feature (1222)..(1223): n is a, c, g, or t
  misc_feature (1239)..(1239): n is a, c, g, or t
gaggaaaaagaagatgatcaaagaccaattaagcacaaaaatatggccaaatggatggattancaatagaaaagtcatacataattntacacaaatgcaaattttaataatttttttgcatttttgcttgagggcactgtcggattttttttttcttagtacaacagaaaaattcatgtggcacaactggttaaatttgtgttttttggcaggtcacggttcgagtccaaagaccgaaaatttgtttaaaattccttacaaaggctcgtgggcttgaaccatgcacccacccctccgaaaaaacacaaaattaaccaactgagccacagtaacttcgttactgaaaaaaaaaaaatttttggtgccccaagtaaaattatcagttttattggcgtaaaatagcgagactgtccccatcacaaaatacaatgaaatgacactttttcgatggttctcggaattttcaggttcaaatttttactcgtttttcgagttattaatggggccccagactcactattttacaccgtgccaaaattgtatcgaaatttatcggcttaaaaattcaaaacccacaagtttttgctccagtcgccctggtcgtaggttttgactttgttcagcggagtcgcccaactgacgccgccgcttggcctcgagtttgtgttgttattattattcgagctgaaggacgaagtttggttcgatttgctgaagcctccgcttttgttgtctgaacacggaaaaagggaaaattagggagaaaaaaaagaaaattgtgagaggagaggggggaattctttagagaatttttggaaggatttgataaaaagaagtaatttttgtcgagtttaatgggtatagaaaaaaaatagtgtttttgaggggggggggggagggttttgggagtagcattagcataagttggaatatttaggggaattgaagggaaaaaaaactgaaattttaatgggggagggggaggggttaaggagttaggagagaaaaaaggggcggtgagttggcaggggtaggtagaaaatttttttttgttagggaggtttgggtcgaaaaacggttttcaatgttgaaattttttttttgttagggaggtttgggtagaaaaatagttttcaaactaaaatatgcaaaaactcagacaaaaagaccccattttgtttgacaattttggtcacacccataaaagagctacaataaaaannttgcaacaaaaaccanaatttgat

SEQ ID NO: 22068 - DNA, 2063 bp, Heterodera glycines
  misc_feature (1777)..(1777): n is a, c, g, or t
  misc_feature (1967)..(1967): n is a, c, g, or t
  misc_feature (1980)..(1980): n is a, c, g, or t
  misc_feature (2015)..(2015): n is a, c, g, or t
  misc_feature (2032)..(2033): n is a, c, g, or t
tcttttgtaaggattttgtgccaaaaactacccttcattttcaaaatggctctaaaattttttttccaaattccgcgtatttttattaaagtgtccgctttttagggtttttggtaccacattttttgatttaaaaaataaattttttaatgatttcaaatttttaatctttagccgatatttcggacatatttcgtccatttacaatcaatatttcactcttgatttttttgtttttagattgatttgcaacgacgtttggatggatattttccccctttttgaccgtcctcaactcggtctcaaattggcattgcttttgtcacgtttcgatgtgctgttggacaaacatttcgatgccaaaaaagtgaattatttttaagggtttttgttctattaaggattttgtgccaatttggggcctccgattctgcccgttttaaaagatttttgcacttttaattcttaacattttcagcaaccaatgaaaatttcttccagtttttaatttgaaaaaaaacaataagatttaccaatgcagttatatatacaaaaaggcagaaatttttcattgcacatttaaagattttcaaaaattttaatagttttttatgtgttttttgaaggattttatgcgtaaaatatttaatggcctccaagtaggcaagtttttttgtttttttttgtgtgtaaaaatgagaatgtttcaattttttaaattatttttttaggatttttttccaaaaaaccgaacttcaattttcagaatatcaaagtggcggacattctcccctttttgaccgtcgttatcttaagagaacatttttttcttaaaattaaaaaatctttttttttggaaattttacatttttaatttaattttttggccctttttattcattaaaaaatctttttttgtgatttgtacctcttctaatcactgttgtacctcttctgatcactgttatagcttttttcccattttttaaataactagagcgcaaaaaaccttttttttcagcgacgaatattgattatattttattattcattttctcagtatcaacattgctttcgccccgtttcaatgctctggtggacaaacatttcaatggaaaaagcggattgaagtcgtaagtttcattttttcaaattggcaatgaaaatatttctaagctctaaaattttgattggattcggtgcttaaaaaggaatttgtaaatattttttaagaaatttgcgattttacttatgtttcagcatattttatctatgttttaaattattttatttgataattaaaaacggtaacaccttaagggaaactttttctcttataattaaaacttattttggaaatttgatattttaatttagttttatggcccttttactcaattaagactacaaatggattttctatgaacaaattttctcatttaactaacatattttttcaaattttcagctgggtttgcaatgatgtttggatggacattctcaccttttgaccgtcctcaactcggcctcaaattgacactgattttgcctcgtttcaatgtgttggtggaaaaacatgtcaatgcaaatgcgaattttttcaaatttcggtaagtttttttgtaagtgattggttttttggttacttttaactacaataatagtgtttttatggaatttaggcaccacatacctttctcgggttcaaaaatgactcaaaattattattttttactaaagtcagtattttttgttaaagtgccgggtttttatgggnctttttggttacttaatttaattgggatttgaaatgcaatataaataccgattctgacatccattttgacccaatccgaactccaaacccagattcgaacaaaattcgaaaaaagtcgaaaatttttttttcaccaaaattcacgttcattgctcaaaattgatttttaagggggttttttcgggtcggngaaaaccgattcntgacatccatttaaaccaattcgaaataattgaangcgattttgtgcataannatgtgaatttttttgaaaaatggattttga

SEQ ID NO: 22069 - DNA, 1797 bp, Heterodera glycines
ttttaatttttcagggaacattcgaccgcttcgcgacctcaggacgggcgcttcgcgcccgtcctttttaaattgttaagaacattcggccgcttcgcggcctcaggacgggcgcttcgcgccccttttttttaatttgtagtgaacagtcggccgcttcgcggcctcaggacgggcgcttcgcgcccgtttttttaattttcggtggacattcggccgcttcgcggcctcaggacgggcgcttcgcgcccgtttgtttaattttgtggggaacattcggccgcttcgcggcctcaggacgggcgcttcgcgcccgttttttaattttaatcgcacagggattctgaggtcttaaccatctctaaagtaaaatctgattgcatattcgtgatcagcggcccaaataacccctaaaatcatatttttggaagatttttggtgaaaaaaattttccactcaaaaatcatggtcacacccctgtggtcccggatgccaaaatcacttttatttctataactttttttaaaaaagtgataaaaagctaaattaaaatttgtaaaatagagcaaaaaattgcggattttttgagtatattatttttataaaatactttttcagaatggagttaggaatttttttttgaaaaatttaattttttaagaaattatggaataacttttttattttggaagatagaaattccaaacaaatctcataaaattctccttattttttgctatttttcaaactttattccactaaatttgaccaaaaacgaagagagttatgaattttcgaaatttcactggattttccggggctcaaattttgacgatttttcaaaaaattttaaacaccttccaaaaaatctgaaacgcaaaataaagcgtatatacgtattcagcacctcaaattatgccataaaaatgcattttagctaatttaggagtaaaaaaatttttcatgaaatgcaaaaccatggggtcccccctatggttttgagtttcaaaatcacaattaattttataactttttttaaattcataataaaaacatgagataaagcacattagattgggcttaaaattctctacaaaaaagctcttagacgattttttgctaaaatcaacccctgacgagttatgggcctgggactgaaatgtcccgctcaggccaaaaattttttctatttccgggaaaaaattgaaattttttcaaaaatgccaccaatcgatagagcttgaaaaactatgttttggaagtggtcttcatttctctgggaaaattcgttaaaaaatcaaaaaattcaaaaacgaaaaattttcgagggggcctagttcgaaaaattttgaaaattttgaaaatttaaaaaacccatcttatagagctcatcgagctgtacaaatagtttgctggcgctgacccgctcagctcaaaccccagcgagttattccgggagtaaaaaaaaacggaaaaaaacgaccaatttttacagagttttccagaacgcacgtttgttctgatcaaaaaatgtttgctggcaaaattgtctggcacatccatcttcagggcctttaattagccgattttcaaattatgcttttaaaaaatatttatagcccaaaaaaggcaaaaaaattttgaaaaaagccgtttcagcgccgctggcgctgaactgtccgtcggatcgaaaaacctatagttttcccagatgcgcctcaaaaagttggttaagcaatgtcacacttaaaacccacccccggcgcccgttcccgagatttagtttttggaaacgaa

SEQ ID NO: 22070 - DNA, 1688 bp, Heterodera glycines
tccgttgcgagcggatgggtcggttggaggaagacgggggcaacgcatgggcggcgccggacgcggacgaagtcggctgatgcccgctcggctcctgccacggcttcgggctcgtacggtggtcatccgtccctacggtgttcgtccgcctcctcccctttctttccgcgtccgcttcttccacttcgtccgccgaaatgcaactgagcatccgcagcctctgctcagaaagttggtactggtcctgctaaatgatgccatgccgattgcccgacttttcacgtccttcgcttttcctaccagggcgaccgttgccaattggtggagcagcagaaatgccgagtcggtgctgcaccgcagcacattttggccaaatggcgtgccgacaatgccgtgcccatcggtgccctcctcctccgccgtcttttgcccattgtccgctgatccgacggcgtccgccctttgcctttccaacccggcaagtgccttaatccgtttcgtgccaatttggtccgtttctcctctcttttttcttacatttgccatttcttttgagctaatttcagtcccataaatttttcttaacatttccaaatgttcgccgtccatttttctataattgacaatgaatattttaactgttaatgaaattccacctaaagcagcaaacaatttgaaaatttcctacgattgaataaatgggaaattaaaggggaaacttccgaattaaatggacagattaagccgaggaatttgggggagggggaggggagggggaatgatctccgagcaaaactaaataaataccccattaacaaggaatgtgttgctgaaggcatttagcgggggtaaagtggaaatgttcaattggcaagaaaacatttggccgctttttatgcacttagaaccgattctaaggtgaaaatattaattattgggcctattaattgggcgaagcaaagagtgaacgaatgaatgggtggcttatgcctatgcttatgagtaaggccaacggcgaaatgcccgggggcatttgtccaaaagaaacatttgtcgcctcagcaacaaaagcgaagaaaagtgagaaaagggcgacggggggagcttaataataataataataataataataataataaagtacaaattaacaaatgggtaaagcaaagggaagaaagaaaaagcaaaacgaagtaaacacttttataatggcaaattaatgggaaaagcagcgaaaaaatggagggggcaaaggggggacattggcattggcattggcggggaggggggaggggggtggcactttgtgtgtattgtaacgaaagaaacagtgccaaatgccacggcaaagggccaccgattgctaagcatttaattagcaccgatggcgcaatgtgtgcatgtcattaggcattcgcacaacactgccaccttataaacaataattcggtgttatacccttctgttacttttcctcttcctctaataaaaatagcattaaataacctgtataaagaaacaaaaaaaaaagaaaagaataattgcaaaggtacagtatttttgggttcataaaatactgtacaatttttggaaatagcttgtaatgacattaattaccaataacaatcacttcccaacaacagcccacttttattgcacattcacacggcaaaacgaaccaacgcata

SEQ ID NO: 22071 - DNA, 2661 bp, Heterodera glycines
cagtgtttgacatttgagtctgatttgtggaacaaccgtcaaggcaccaacatggttcagaggtaaaataagaaataaaattttgaaaattttaaaataatttcttaatctgttatttttagccttttttaagaaatgtttttatgttttttttaaactgaaaaaaataaaaccatagaaaaaaacaaaaaaaataaataaataagtaaaaaaaacaagcaaaaaaaattattaaaaaaaaaaatattcaatttaatctaaaaactttttttctaaaaaaaaaaagcaaaatattattatcaggattcaaataataaatttattattaattatttaaaaacccaaaaataataaaaatttattcattaaataaaaactaaaaataaaaaaaacagtttctttacacgcccttatgtgtctatctgaagaagggatgaattttgagggttttgcctatttttgtctgaactcccctccccgtctgaaacatttgaggtgtgtcattgttttggcattttccgagtgattatattttgatacttttgcctttttagtcaatatttcgatcatttttgtcaaattttcataagaaaaatgcaataaaaacgaaaaatacaccctaagggtcgacttttttgggaatttaaaaaatacacccttgaaaatcgaaaaattttgaacttcttgtaagaacttttgaaaaaattttgatgcaaaagatacaaaaaaagtaattttgtttgagcataaacaaaaaaatttgaaaaaaaaaaaattcaaaattgcataaataaattttgaaattcaaaattttttgcaattgtctaaaaacgctcattagccattgttttggatgttttaaagtcaattctaaatttttacacaatttttggcatttttttttgagggctaaagccatttttggcagtttttaagacatgttttagtgcatgtttgggcatttttcgggtttttaaggcatatttaagggatttttagtgcatattttatgcgcatatttggcattttttagtgcatataatttatagccctatttataacacaaaaaaacgaacccggtgatgagcacagagtcgtcgaagacgaagaatttcatgtgctgtaaccccacaatttcgttggtcagttcgggcagcgcacttttgaggaggccgcgcaatttgggcgtatgaaagagacggacctgggaaattaaaaaattttaaagaatttgaactacctaatttaatggcgttattgaaatggaaaattttaagaaattgcgaaatttttcaactttttttggagcaatttcattgcccaaaaactcaacattacccatataaaatgcatttgaaatgtcagaaaaaatgttaaaaccggagggtaatatataataccagtgtcccgacctttgcgcctttgtccaaaatctggttcaaaactaagttttttcaatcactgatcgcataaatagctttaaataagcgattaaaagtgattgtacatgatcatttgatcttcaaaaaaattttgaaaaaataataaaattttcaaacaaaaaattattgatcataatgaaccataaaaccgtgctttcttaattttaatgcatattaggctatcaggggttgaaaaaattcaactttgagtccgattttggacataggcgcaaatgtcggggccgcaaaagtcggaccgcaaatgtcggggccgcaaatatcggggctccctctgcaccattgtcagtcgtacctttgagtccgtgcaccaagtctcgaacaattcccgactgagtccgttctgcaacattccggggctggccaacaccacgcatgggccaacatcgtcgaaatggtcgatgctctcaaagaaatttaatttattgcgccatgtttgatacctacctttaggttagagacgtgtttaaacacgaagggattgttgatcgaaatttggcgtttgatgttctgattcattccgctgacaaatgtctgatagaccgccatacatttcttggccaatgaactggcatctgtacaaaataagcaaatgaaagcacattccaactcaaaaatgataaatactcacagtaaacggggatgtcgtgaagttcggggtgttgttcccaatatctgaaagtcggacagaaaaccatgctcaaaatgggcaatacttaaaaattactcatccaaaatcagcagcaattcctgcgcccttccgagtgcaaaggcggggatcagacagcgcccgccgcggcccacaatttcgtgcactgtgctggtgaagcggcgttcgcgctcttcgcgactctcgtggatttgcgtgccataagtggattcctgagcagaaaattggcattttatgaattatttaatggcttataaaatgattagcttacgcaaatcatcacatccggcgaaacgttgggaagttcggcggcgcaaagatgccgatcctcaagccgagaaaagtcacctggaattggaaatcaactcattgttagtgcaatataaatgataaatggaatgtcaagaataatatagcaattgaatgtcgcaattaatggttttgaaccctgaccaatccatcgcgagacaatttttcgggagagaatattttagtcatcaggtggaaaactatgtaacaaattgctgcgct

SEQ ID NO: 22072 - DNA, 2499 bp, Heterodera glycines
tgtcctttgtaaatgcattcgcccgtttcagagacgctcaaatcctaaaatatttttgtaattaagaaataattagtatctttgaccgggtcccatttttgctctttttcaaaagacgtgtcatttctatgccatgaccattttgaaagtgcaatttattaatattggattaattctttccttaccggtgcaactgtctcccaaattttcttcttcggatttaattgctgaggcggacggcgtacgaacggttcacagacgacgagatcaccgggcacactgtccgggctcacttccaacacttccaccttttcaggcgtcgacgcacacattaccatcgcctgggactcaacgccacgcattttggccggcttcaaattgcacagacagacaacaagacggtttttgagctgttaatttttaaacttaaaaattttttttgtggaaaaattagtaattcatcataaaatttcgaaagaataggagaggaaatcacgggaggtggggtggggaatgatgtacatacacccatctaaatcatgaaactctgctgctgacctgctcaagtgggacaaatcggaccaggccggacaccaccgtccgcggcttctcctccccgaggtcaatctgttccacgtacagtgcgtccgcgtccgggtgtttctgtgcctcaatgatacggccgacacggaggtcgaggcaaccgacgtcgacggtgtcatcggccggggcagtcgcttgctgttgctgcggcttcttctgtttcggctgctgtttctgttgcgtttgttctttgctcgcatttgacgctgctgtcaatttgggcggtgtttgcggggaagaaactgtccaaatgaaataaattgcttattttttaatagttcatttaactgaagcagaaaatgaggccatatgaattacaaaacgaattaaaggaaaaaaatgcaatgaatgcaaaaaaagaggggggggggggggtaaggtatagtaaaaattttttgagtaaaaaataaataattaattttaaaattgaacaaaaagtccaatcgccgtacaaaggatgagagagggagagaaaaagaaagggagagagagtacgaaagaaagggagattcacctgctggtggcacaacgattgccggcgttgcttttggcatcggcggtgagaacaatgcgccggtgaagcccaggcgcgccttctgctccgttatttgttctttcaatgcggcaatttcggtgtccaatttttcagattcatttgtgacgaaaagtgcttctagaatttggaaatatgagcaaccattgacagaaattaaaaaatccaatttagccaagtaattttttgttatttcccattgttgcaaaaagaccattgtgggcagaatgccaaatggataaaagaagaggccgctcactcgctttttcgaatttggccatcacttccgcgtaaatttggcccacttcgccccgctcttccgccatgttttcctttttcttcttctgctgctgcttctccgtcgtgtttggtgcctttttgctgctgctactgctcatcgccgttggtccgttgttcttcggctgattttgctgctgtttcccactgccaaagagttctttccactcggccaccttcgccggttcaattttggtgaacaaagcgaaaggctaagaaagggaggggagaagcaatcactgctgctctaagagaaccattatgtgatagtcaattagcgtacgaattccttaatgggcttttgcgccgtttcaacccacccaaatgcaattcatcaaataatcaatttgcctccccctttttacactctattttcatcggattgacctgtgactataaaatagagagaaagggtgagagaatgaggaaagaaaaaatgtgagaaaagacaaaaaggaaaagagaagggagaaagcgagaaagagcaaaaagagagagtgagagagaaaggagcgatttagtcgcaaaattaatgaaaaatgattacgcattttggtcaatgtttcgctatcattttcacggctgcaggaaattaaaaatgattttgagaattataataaacaatgggcaaataaaaaaatgaaacccgtgctgttctttgtgccaatggaatttcccttttctcccctttaaatccgtcaaaatgaatcggaattatgttgctgctgctgctgctgcatcattgtcaccttgttgtgtttgtgtccagctttcagaaacaaaacgaagtgctcgggcatgacaatgtttttcggcagattgcactgttgttggatttgtgcgctgatgttgggcatgaaaggatagagcagcacggacagcagcacactgaggttggcggagacgccaacgatcgtttcggcccgcttccttaaaaaacttactaaaactctccaaattcttcggcttttatcgaactctgtgccttcccttggttaggggaatggcacaaatgccatcatcgccaaactgaccgttcttcggca

SEQ ID NO: 22073 - DNA, 2101 bp, Heterodera glycines
actgtaaaaattgctctacaaattggcagttactgtccgatgtgaattcgccaaaaaatttgactttaatcgctttttggaaggggccagaaaaaagaagcgaaatggaaatatgattaatctcggttctggaacagctcgaacaaattgctgatttgtcatttggctctaatttaaagatagaatggtcttaaattgccctttttcttaataatttattgctgaaggtttttaaccggcgacatggctttcatatgcgcttggatggggcacatgggaccagccttgcacagcgccggacgaaaatgcattgattttttcgaaaaaatgggtcaccagcagaaaagcgcaaattgcaagaaataatggcaaaataaaaacgaaatttttccaaaaattgattccataaaatataatttttttttacaaaattgtaaatttcgaattttcgtttaactttaaatcatcatacaatttaaacaaaaaaacttaggaagaagagagaagagtagttaaaattatctagtacaatttttcaatttttaaacattttttgatttaaattgacatttttctcgcaactatccccctctcgatgaggatagtgattttaatctgcagataggtagctgctaccctatccttagcattgtacatatgtagcctagctgcagctcaagctaaggattttttttgaaaagaaactgtcattgtgcatgcggattttaatccttagcattgtgcatacggatttatctgcagatagttagcattgtgcatactagcataagaaagacggtcccctcgtctttaagttcgtggcttgggcactgtgggggcgccatgtttttggctgagctcggcgaaatgtagtcgtgccctttttttcatttggaataatttacaaaatgttcttctgtattgtctacttatttgttaggaggttttttcggcaatcattaagaattgatgtcccgacgaaaaatttttttctaaatttgtcgagtttccttcacttactgtgttgtatgtctacatttattttgaaattttgcacttacaaatgtcaaatcctcaaacgtacgtccattctttgattcccccctcttcctgttgatgctgctgctgttgtgtttgctcctctccgtctttttcatagcgttttattcgacccttccccgtcctctccccccccccccccccggcgtccctttcctccccaaacaccacagccacaccaattcattctcttctaactttccaaaatgtgacggcgtgcaatgaatttccctctcttccttttccttcatctttcagcagagctttctttcttccaacccgccgttcgttgttcttcgttgccttccctcgcctcatcaaaaataattcttacacatatagcagaaaaagcagcgaaatggcgggaggggggggggggggggggaagacggaggagtggtgaaacacggtgatgggtggggtgagaatgactaactcaaattcccattaatttttaaaatgggcaagaccaaaattgatcacttcgtcagcaagaccccctctcgccccatgcagcaaatagcaaatgtgtgacaataaattgccatcccgcgctatttgaacagtccgtcgcccaaacaatcaatcattcccgacaactattcatctcgctcctttttttgtgtacaaaatttgatgtctcatttacaaaagtatttttgcgatttgacccaactcacgccattggccttgttgcactttcagcaaaatttgtaggaatattttcaaattgaccatcataaatttactattctttaacattttcgcacacgctttcgtttagcgggagaggggagagttccaaattagaaaaaaaattaccgagagaagatttgaaaaaggctgaattttaataaattcgtcaaaaaattaaaattaaaaaagtaaagattgagccaaataaaaagtgtaaatattattaaattattaaagattggggtccttccaacaaaaaaatgggaaatgtgtttcaacagaggtggggaaaaacagctgaggctggaacctgaagtttgttgttttttttaaaattctttttgat

SEQ ID NO: 22074 - DNA, 792 bp, Heterodera glycines
atagagcatggttaacatagtaataatataaattttgggatttttttgggctggttcgtggagagcagctcgggaccgaaaactcgagaccgggaaatcggtcccgatgaaaccggcccaaaaaatccaaaaatagtggcattcgatagagcatggttaatatagtaataaattaaattttgggattttttgggctggttcgtggagagcagctcgggaccgaaaactcgagaccgggaaatcggtcccgatgaaaccggcccaaaaaatccaaaaatagtggcattcgatagagcatggttaatatagtaataaaataaattttgggattttttgggctggttcgtggagagcagctcgggaccgaaaactcgagaccgggaaatcggtcccgatgaaaccggcccaaaaaatccaaaaatagtggcattcgatagagcatggttaatatagtaataaattaaattttgggattttttgggctggttcgtggagagcagctcgggaccgaaaactcgagaccgggaaatcggtcccgatgaaaccggcccaaaaaatccaaaaatagtggcattcgatagagcatggttaatatagtaataaattaaattttgtggattttttgcggctggttcgtggagagcagctcgggaccgaaaactcgagaccgggaaatcggtcccgatgaaaccggcccaaaaaatccaaaaatagtgtcattcgatagagcatggttaatatagtaataaattacattttgaggattcttttgggctgcttcgtgtagagcag

SEQ ID NO: 22075 - DNA, 1542 bp, Heterodera glycines
ttttaaattagatcgtgacatcatccaaaaggatggccagcctttgtatttgccgccattcaatcgaccaatgctgctaatgccaggcaaaattcacgaaattttttaaattttataatgccaaaaatatttggggaattgtgatgggagagaaagtacacaatgccatacattggggagacaaatgatttcaaatttgagcaaaaggatgttgaacaatcattggtgctgatggacgatgatggggccacagatgtggccaaatcgtcatttgatgtggaggataaaagtgcaatttaattttaaataatttaattaaaattaatatttaaaaggaaaaaaattgaaaatatggaatcattaacatcaatagaaagcagtacaatggaaacatcttcagttgaaataattatgacttcacaaaatttaaaaattggaaaattaaagtaaatattaaaaatttttaattttctttcttaaattgggtttatttatgagaaattttttagattattctataaaaatgctaaaattaaataaattcattaaaaaattcaaacaaacatgctttttaaaattaaggataaaatagataatcaataaaacttcttgaatacactgcatatttatcaaatattatttatatgcctagattagcggaagtataaatcgtttaaaaatgattgtatttattcgcacaaatattttagtaacaaatagcaaataatcattgtaatagacgaattatttatgcatttattttgtttatacccatagattagcataaataaatcatcaaaaaatattaatctattctcgaaaatatttaattaaaaattggccagcaataagtttttagcgcttaaatatttcccagaaaattgtttatgtaattaagcaatttataaaaatgttttttttcacaaaacataattttattgatatggtgcaggatatttagtcaggctaatagccaaaaggggtacagcgataatgagtttggatttttcgaatttttgaaagcaattttttgaaaagacatgaaaaaaagataaaatatcaaaagcaaaaaaaaaaaggataaaaaattgaaaattcataaaaaggctcaaaaatgtaaagaaagttaccaaaattcgacaaagtaataaatcaaattctacaaaattattttaaatatatattcaacataagatggataaaacaatgaatgttttatctctgtttaggaatcactcaaggtcaaatgcgctcaaagatgggcccatcaaattgttggtactcatcccaagatgaaatgcgctcaaagacgcgcccttcaagtgattggtactgacttccattatatccattgtgagtgtggcttgatgagggattgtttagttgatcagttttatttttctgcccaatgacagtacgacagattggacatgaatcttttgtggataacctttgcaaaaaaaaagtgtaaaaatatgaagtaaacaatatttttttctctgtcatagtaattcgtaaatgggagtttcgtaatatatatat

SEQ ID NO: 22076 - DNA, 1044 bp, Heterodera glycines
aggtctttgtcccaactaacaaaagttaactcactaaactgtgtaggcaggctacaattactaaggaaaagagggagagataagtaattggaaaaagacaaaaatatgaaaatgagaggaagagggagagaaaaaaaaagaagatgaaaaaaaataagggagaaggtttatgaacttaccaattattttttaaatgtgaataaaaaaaaagatattcttaaggatcgaacttatattctaaagatatgttttgaattatttatttaaactataaaaaatcaaaattgtgaacaaaatttgagctttaaaggcatataagtgatatatatgtttggtgatgactgataataaacccgtttgatttgttttcttcgcttttcttttttctccagtctttgcctcactcatttctcctttcctcgtaaagtgcttttgcgtttggcatttgcttttgtccatggcatttctcgtggaccgcacttccgttgaccaacaaacgaacatctccgaccggggcagaggcggaaggactgactaatggatcgctgaattaatgcgatccatcaccaataattaaagaaaatcattagaaaatgcttacaagcaaatctcgcatctcagctcggtgaccattccatgggtgccagcaacgaaaggctccggcctcagccgtcgctgaaacagcgcaaaagtgtcagacgaagcgacggaattcgaatgctccaacagtccgacgcgaagcgcataatcgcggagtacttgcaggagacagtcgcgcagtccgtcgatgaccattttattttgaatcttaaaataaattgaggtgtctgcgacaattttgttttgggtttattgtagaattaatagttaatcttttttggggattgaagggaataatttcccgtataaacacacttttttgccaaaatttactaatctcgggcttggcccacttttccctcccttgctttggctaatcccacaggcattggcatcttatcaatgggatcattggtcgaaaatgtgctcacattttctttgcca

SEQ ID NO: 22077 - DNA, 1336 bp, Heterodera glycines
  misc_feature (1303)..(1303): n is a, c, g, or t
ccgttggccagttggaaaacagaaaaaaggggatatcagatggggtgcgttcttttttaaaaattcctcttttcttctaagcctccctccttttttgtgcagtatttcgtttcaactttttatcacttttgtgttgtctttgaaaataagttgggaaaaaatatacgaatatttttttcgcttttaattatgatgtacaatgcttataagcccagccgtgaggcggctcctttttgtgcactattttcgtttttaaaattggatccggattttttggcttttttaaataaattgtgaaaaattcaaaacaataaacttttattgcgctacaaacgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgttcttttctaaaaattcctcttttcgtctaagcatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggcttctttttgtgcactattttcgtttttaaaattggatccggattttttggcttttttaaataaattgtgaaaaattcaaaacaaaaaacttttttattgcgctacaaatgcttttaagccccgccgtgaggcgggacagttccaaaatttgcaccacattttactgtggaaagtccaagtaccttaattggacaactacgtgtcaatgagcacagtcgccgttggccagttgtgaaacagaaaaatgggaatatcagatggggtgcgttcttttctaaaaattcctcttttcgtctaagcatccctccctttttgtgcactatttcgtttcaacattttatcaattttttgttgtcttttgaaataaattgtgaaaaaatatacgaaaattattttcgcttttaattatgatgtacaatgcttttaagccccgccgtgaggcggcttctttttgtgcactattttcgtttttaaaattggatccggattttttggcttttttaataaattgtgaaaaattcaaaacaataaacttttttattgcgctacaaatgcttttaagccccgccgtgaggcgggacagttccaaaatttgcaccacattttactgtggaaagtccaagtaccttattnggacaactacgtgtcaatgagcacagtcgccgt

SEQ ID NO: 22078 - DNA, 1020 bp, Heterodera glycines
taagcattgtgcattatgcaaagatactttataagatctgggcgccaaaaaatgtataagaggcaccaaaagcccaaataatgttactacaccacagaacgtcttgttttggtaatacaaggaacaattggcctgatcaggacataagcattgtgcattatgcaaagatactttataagatccggcgccaaaaaatgagagcaccaaataatgttactacaccacagaacgtcttgttttggtaatacaaggaacaattggcctgatcaggacataaccattgtgcattatgcaaagatactttataagatccggcgccaaaaaatgagagcaccaaataatgttactacaccacagaacgtcttgttttggtaatacaaggaacaattggcctgatcaggacataaccattgtgcattatgcaaagatactttataagatccggcgccaaaaaatgagagcaccaaataatgttactacaccacagaacgtcttgttttggtaatacaaggaacaattggcctgatcaggacttaagcattgtgcattatgcaaagatactttataagatccggcgccaaaaaatgagagcaccaaataatgttactacaccacagaacgtcttgttttggtaatacaaggaacaattggcctgatcaggacttaagcattgtgcattatgcaaagatactttataagatccggcgccaaaaaatgagagcaccaaataatgttactacaccacagaacgtcttcgtttggtaatacaaggaacaattggcctgattaggacataaccattgtgcattatgcaaagatactttataagatccggcgccaaaaaatgagagcaccaaataatgttactacaccacagaacgtcttgttttggtaatacaaggaacaattggcctgatcaggacataaccattgtgcattatgcaaagatactttataagatccggcgccaaaaaatgagagcaccaaataatgtactacaccacagaacgtcttcgtttg

SEQ ID NO: 22079 - DNA, 2282 bp, Heterodera glycines
attcatgcaatggaattgatcggtttgcggctttcgccgctttctgatgttttcccgttttttgatgcagagaaattgcggttttcccaatggaaaggagattaatatcatcgttgcagacgacacaaagggcaaattcttcgccttttcgacttttttttatgtgccggaattctttttcgtagctctccaagtagacatgtttacgttttggtggcattttgtgaatttcactcaaaaaatgaaataaaatgtaatttttttttaaatcaaattaattcaaatattcgcttcagaaaaaaatgaaaaatcaaaatagtcattcaaatttttcattttttattttcaaatccaaaaataagcacaaaataagcacgtaacgctgaaataagcacaaatcttagaaataagcacatttttactttctaagatccgacccctcaaaataagcacacttgggaactctgatttacacacaagcgcgatatgaacaatataggaatatcacatatatacaaatagctaaggcctaagagattcagaacaactataaatctccacattatgcaatataaagtcatcatcatagatcggtcctcccattatgctttcttctccaattcgatcaggtgtttcactccgtcgtacatctgcttcaccgcttcgaactccgtgagaccaagacgggccttgttgctgatgtcataaacgccgccagcgctaagtaaaggacaattgtttcaaaaacagaacaataaacaattacctctcggaatgttcgccgtgaatcccgcggatttgcaatttcaggccgtcgcagatggacttgaagtcgggttttgcgctgatcttcggaagtcgaatatgcacactcgcgcgaacagtcgttcccaagttggtaggacagaaagtcagccagccaagacggtcgtcacgcgaaaacggaactttcgattcgatggccttgactccctttatgagacgctccagcacttgtccaacattgccgccattttgcatcgaaatgatacggaggtgcttaattgaaaatcgatatcaagatggaatgaaacaaacaaacatacatcttcctcgttgacccacaccaaaaaggttttcttggcgttatggaaaattccgcgtccggtgggccaataacggcaagcattggcctcctgcagaaaacggtcgccctctttaaacaagaagtggtcggcaatcagctaaatattccaaaaattaatgacttattatttgttggaccgaacctggttctggacgtccttggtcatgccctggagcggatagtaggtgcctcccaactcggcatctaaaacattaatgttacaaagaaaataattagcggttgcctaccgctcttcagctgctcgaagaccgctttgacctttgattccatctcgacgtaattctccttggtcaagcatgggttgaatggatacccctgaatacgactgttttttggtatgttaaattcaaacaaacacctgaagagagcggccgcaacgaacgcgagtcgaattgatgaatttcccctccgggtccaagtccgtcagcagttgagtcttcccctcaccaaggtccgttgccggttgcttgctgctcggtccaaagccaccatgatagtcgttgatgatcgggtcgaacaatggtttgaagagtgtgtaagcctcggctgaatgaatatttatggttgtgattatgcgtagcaatttactgaccatctggcgcatacacgccgacaccactgtccaagttggcaacccccgactggatgacgtccaaaaaagtcgctccgagcttggtacgcttgtccttgcatgcatcgacgacgtccttggtgaggtacttcttcaacaacgatttgcaatcagccgccgcctgaaagttagttcaaaattagaatagttaacacacacattgtgtgcacctgaagctttttgtagccagcctcaattttgtcaattacttcctgagggacagccattttggtttatttcaaataatgtgtgtctgaaaataaaaatatgcatttaaagagaggacaaagttagtataagaaacagagatgattaaattggagttcaaaaaaatgagtgaatgacggacatacgagaacgcatgaatttatatactaaaatttctctggagactcactttggctatgggtcaactccaatgtgcagagaaaagcatagtactatctcgtcgtttctctttttctttgttatttctctcactttggcataatatctcttcatttt

SEQ ID NO: 22080 - DNA, 1627 bp, Heterodera glycines
  misc_feature (43)..(43): n is a, c, g, or t
taattgaaacctaattcatttgctgaatagagagacactttcntgtcttgcaatagcaaacggtttaagaactttagtatagtgtccgacagaaaaattattttttagaggaaggtgatttaaatgaaaccttgtcgcgttgagcgaaaatttagtttcgattccccccggcgtttacccgtcgtgtcagacccctattcccgccgttgcacctattccctccccttcgccaaaacttttctttttccctagccccatctcattgcctgttgcgcccgtcctttaccccgtcggttcttcccgtgttccatttccctttgatcccccctctcagtgacaacgttcaaatttgcccttatgtgaactttgataagatcgctcccccccccccccgtttcttttttttctcatgcttttcactcgttgatgcttggcgttgctgccccgcccccttttgatgatcgccggtttacgcttcttcgttgttacttcacttatgaatttttgttgatgcttcccctttttcccgcttttgattaagaaaataaagtgaaggattgttggagttgtgtctttggttagctcggctctcttttttggtacaaataaaactcagtattcggatttggtcgtctcaccgttgctttggaaatcgttaattcccttcccattcgattccttcccattccctcccaccccaacatcccagtcaaaattccctaattgacaccaaattcgacaacctaattcatttgcggaatagagagacactttctgtcttgcaatagcaagcggtttaagaactttagtatagtgtccgacagaaaaattattttttagaggaaggtgatttaattgaaacctaattcatttgcggaatagagagacactttctgtcttgcaatagcaaacggtttaagaactttagtatagtgtccgacagaaaaattattttttagaggaaggtgatttaaatgaaacctaattcatttgcggaatagagagacactttctgtcttgcaatagcaaacggtttaagaactttagtatagtgtccgacagaaaaattattttttagaggaaggtgatttaaatgaaacctaattcatttgcggaatagagagacactttctgtcttgcaatagcaaacggtttaagaactttagtatagtgtccgacagaaaaattattttttagaggaaggtgatttaaatgaaacctaattcatttgcggaatagagagacactttctgtcttgcaataccaaacggtttaagaactttagtatagtgtccgacagaaaaattattttttagaggaaggtgatttaaatgaaacctaattcatttgcggaatacagagacactttctgtcttgcaatagcaaacggtttaagaactttagtatagtgtccgacagaaaaattattttttagaggaaggtgatttaaatgaaacctaattaattggcggaatagagagacactttctgtcttgcaatagcaaacggtttaagaactttagtatagtgtccgacagaaaaattattttttagaggaaggtgatttaatttgaaacctaattcatttgcggaatagagagacactttctgtcttgcaatagcaaac

SEQ ID NO: 22081 - DNA, 2371 bp, Heterodera glycines
tcagcctccattaaacaaggttttataattggatttaagggcaaaaagattatttcaggcctccaataaaaaattatttgtgtaaaaatgcagcaaaaaaaatacagccaaaaaatgtccgtttgtgacaactgccttaacttaagaacgtttgacaaagtcagcattattggtgcttttataaatataaacattcctcaaaaatccgattgccaaattcaggaaatttgaagaaatctttattagaacgatttctgacgaggaaagagctggtcttacggttatccatgttaattgaaatgatcataactgataactgggcttcataatcgaatcgcagtgatgtggctatgcttgtaataacaaaagttcattagtcgaaaactccgctgtctaaattatgtacttttcaaatcttttattttcgagtcgatattttaaggaaagttttaggtttgcaagtttgtacgttctcgtagaatttcggtataattatactacattcattgagggaataagtatatagaaagattcaattagtaagaaagaatcttccttatccctatgaaaagctaaagacatttctgggtttaggatcgttcgtatttattttgctcgttgtatttaactagctaaaatgtgttatataaaatggaaaaaatgttgatctagatgaggttgtataagttcattctctcagttaagttgcagagactgaatctagctaataccagggaccgcgtcattcatcactagaacccaattttcttcccaccgatggccaaatgtcctatactggcagcgcaaatcactggagtgtatcgctcttggatggtttgttggttgacatctgcggcccactcctccaccagcagacggcacacctccaaactgccgccaatggcagcgctcttaagtgcgaaatggaatcctgaaattaggacaacatttgtggcatggtatttttgggtactgtaacagtaatcccccaccttcgaaatccatttgctcgacatttgcaccatgtgtcagcaacaagcgcacaatgtccacctgaattcaaatggaaatgttggaaaacatttcaccaatggaaatttttccctacatttcccgtgtaacacgcgtacatcagtgctgttgccccatcaccattctgcagattgatgttggcaccattctcgacaagaaatgtgactgtgggggaaaaaatgacgggaaaaaattacgcattttttcaaaatttcgtctctctaccaatttccgtttgcgatcttttgcaagcgtgcatcagcggcgttgtggcaaagtccgtgcccaagtcaatgttggcaccacgcgcgaccagcacacggcacagcggcaaattggcatggcggacagcaaggaaaagaggcgtcatatctgcacaaatggggaaaacaaaaatattatgtccaaacaaattgatcgccggaatccgtatttcgaccaattccgaatcctggataagaattcgaagaaaatatccaaatttcatttttcgagaaaaagaattcgaaattggtcgaaatggtgccggatttgttaacacagtgacactcgaaaatccatgctaaaacattcatcaacaacactcactcgttctgtgatcgtgcgcttcgaaaatgatcggctcattcggatctgcgcccttctccaactgaaaatgccatacaaaattagtgatttaaaccagaaaaaatgatcagtcactaccaagagatcaacaatttcgaagtgtcgtcgaaagaaggcacaccaaagagctgatcctgttcgggtgacgcgctccaccggatcaaccgtccaccgcagcaaagtgttcagctcgtcggcgtccagcgaatcgatcagcacacgaagttgttggatgttgccatcgttgatcaggtcgaagaagcggagagtgcgcgtctcaaagttgtccacaacagcatcagccggagcatcagcagcagcgggaggttcagcatctgccttaattgtggggaaaaaatcagtttttgaaaaaaaggaaaaatctgatgcagaatttgtgcaaaatatttttcagggggtgggcttcctgaacaatagtaaaaagtgactttgaaaacccggtggaatgatgactttaagaaaaaaaactcgaaaatgggagggggggggggaattgaactttaaaagcatggcgttgcaatcacaaataaaacaaagatgttaaaaatgatttacatgaaaaatattgcccatgcgaatcagcgcagttgaacagagacgacgaatgtgcaattataaataatagtgaaaatggaagacgaagacgcaataaaatggcggaaaatgttaatgtcgcatgcttttatatgcc

SEQ ID NO: 22082 - DNA, 2170 bp, Heterodera glycines
  misc_feature (62)..(68): n is a, c, g, or t
  misc_feature (72)..(73): n is a, c, g, or t
  misc_feature (90)..(90): n is a, c, g, or t
  misc_feature (103)..(103): n is a, c, g, or t
  misc_feature (109)..(109): n is a, c, g, or t
  misc_feature (114)..(114): n is a, c, g, or t
  misc_feature (135)..(135): n is a, c, g, or t
  misc_feature (159)..(159): n is a, c, g, or t
  misc_feature (162)..(162): n is a, c, g, or t
  misc_feature (169)..(169): n is a, c, g, or t
  misc_feature (185)..(185): n is a, c, g, or t
  misc_feature (207)..(207): n is a, c, g, or t
  misc_feature (209)..(209): n is a, c, g, or t
  misc_feature (219)..(220): n is a, c, g, or t
  misc_feature (234)..(234): n is a, c, g, or t
  misc_feature (243)..(243): n is a, c, g, or t
  misc_feature (247)..(247): n is a, c, g, or t
  misc_feature (260)..(260): n is a, c, g, or t
  misc_feature (263)..(263): n is a, c, g, or t
  misc_feature (276)..(276): n is a, c, g, or t
  misc_feature (289)..(289): n is a, c, g, or t
  misc_feature (308)..(308): n is a, c, g, or t
  misc_feature (310)..(310): n is a, c, g, or t
  misc_feature (312)..(312): n is a, c, g, or t
  misc_feature (323)..(323): n is a, c, g, or t
  misc_feature (331)..(331): n is a, c, g, or t
  misc_feature (338)..(338): n is a, c, g, or t
  misc_feature (347)..(347): n is a, c, g, or t
  misc_feature (350)..(350): n is a, c, g, or t
  misc_feature (356)..(357): n is a, c, g, or t
  misc_feature (373)..(373): n is a, c, g, or t
ttttgtatctttaaaattccaaatatttttcaatatcttccaaaagctgggcatttaaaagnnnnnnngaanngacttttaaatttgggngattttttgaagngttttnaaagnaaaaaaaaataagaattgttnggtggtgttaaattcaaaagtatngtntgggaanttttgaggattttggnttgatttgttaagagatttttnanaaaaataggnnaatttatgaaattntgggtaatngtangttttagtggttnaanaaaaaaaaaggtngaaaaaggaattntgagtttttttgtttgtgnananagggggttttnagggaagntgattangaatatganatntatttnngaatattttgaattgngaattggaatagttaaaattaatttttcacctgtattatccaaaatcgatttagcactaaatgaccataaatccttattttctattatattccatgtatctgactcgattttggatcataaatatgaattttggtgaaaaattagttttcgacttttgttcgaaatcgggtccggggttcggaattgatcaaaacagttctttggttcgtgattagcgaccccgaaaacccgtggaaaagcttttttgacaattttttcaaaatttttacaaaaaaaaaattgttcgagttcgggaccggaattgaaatttgtcgaaacggatgtcatattcgtgatttctgggctaatccttgtcccattcattcatttgccccatattttccggcattttaaagccaatttttttttggcacacaagggggttttgggtttctaatttaacttttctaaaatttgatatatctgtggttctaaaatagtgccggtgcctgaacacggatttaaattttgttttatcattgtctccgtcatattcaatttcacaattcttaaatgatcaaaatgattatttaagcactgaaatttaattagacaattacccaatttttgtgaacgttaataccttttaattcatcaaatgcaaaaagcgttatttaataataaaaattgctatttgaattgacatttcttcatcataatttcttatccattaaagccattgtccttaaatgaggctttatggcagcgaaatgagacttttcaaaaatttttcatcttcgagccatgagtttactggtaccataaaaaagcaaaaatggctgttttgtctttcctaagctggtcatggtcaagggcgcttgatcaggggttgcgtgcgcctacctcaggtgcaagcgagcgaagggttgcgtgcgcctacctcaggcgcaagctagcggagagttgcgtgcgcctacctcaggcgcgagcgagcaaagagttgcgtacgcctatctcaagcgcaagcgagcggagagttgcgtgcgcctacgtcaagcgcaagcgagcggagagttgcgtgcgcctacctcaggcgcaagcgagcaaagagttgcgtacgcctatctcaagcgcaagcgagcggagagttgcgtgcgcctatctcaagcgcaagcgaggggagagttgcgtgcgcctacctcaagcgcaagcgagcggagagttgcgtgcgcctacctcaggcgcgagcgagcaaagagttgcgtacgcctatctcaagcgcaagcgagcggagagttgcgtgcgcctacgtcaagcgcaagcgagcggagagttgcgtgcgcctacctcaggcgcgagcgagcggagagttgcgtgcgcctacctcaggcgcaagcgagcaaagagttgtgtgcgcctacctcaagcgcaagcgagcggagagttgcgtgcgcctacctcaggcgcaagcgagcaaagagttgcgtacgcctacctcaagcgcaagcgagcggagagttgcgtgcgcctacctcaggcgcgagcgagcggagagttgcgtgcgcctacctcaggcgcaagcgagcaaagagttgcgtacgcctacctcaagcgcaagcgagcggtgagttgcgtgcgcctacctcaggcgcaagcgagcaaagagttgcgtacgcctacctcaggcgcaagcgagcaaagagttgcgtgcgcctacctcaggcgcaagcgagcaaagagttgcgtacgcctacctcaagcgcaagcgagcggagagttgcgtgcgcctacctcaggcgcaagcgagcggagagttg

SEQ ID NO: 22083 - DNA, 1128 bp, Heterodera glycines
attgcccgttttatagaactctttaagtgaatacaaatttaattccaatttccgacacttttaagtcgcttcaatccttaggcctttttaacccttttgccgttgcagcaaatgtcgagactttctgaattaattcgaccttctatttataatgtaaagttaacaaattattttaagaaattcgatgtatttttttctttaaaatttgttacgcaattttcctttcttttttgttttgatttttctattagctactcatttttttcacaaccttgagccgaataaaaataattgattatagctaacaagggaacattccaaactgaatattttttattatgtagagcatagtcgatttactattgccaattttcggctttttttagccctgactagagatgtgccgtgaatcacgggcacggttaccgtgaatttcacgggttttttcgatcactgtcatggtcatgattagaaatcagaagtttaagactagagtgccacgggaccgggaattttgggcaaacccgggaccgggaccttttcgggttgaaaaaccgggaatttttggctgggaaacccgggaaaaaaccgggactagtcccggtcccggtcaaaaccgggaccttggtactcagttgtactcagttgtccgctaccaggtcccggtcccgtggcactctatttaagacttgagttataacgtaataaaaatttgaaactcgcacagctttttctgagatgacaaatagcttagcattcgattagaaaaagatttcctctttcaaaatcttttttagataccaaatttatatattttctcttttcaaaataatttcctggcagtgcatatcctctgagatacccatgatttttttttgtaatgatatacaaaattattataatatttaatcttttttgttgtgtcaaatttaactcctcgcaaaaaactaaccaagtcgttaactttcatgcgtctaatttacaggaattggtaaagaataaaaagcatataatgaggagagatttgagttgaaaacatataaatcaggttaaaaatgtttattcaacctagataaaaagtagttaacggaatgaaaatcttgaaacaacaacgcttaaatcaacata

SEQ ID NO: 22084 - DNA, 1938 bp, Heterodera glycines
  misc_feature (25)..(25): n is a, c, g, or t
aaaaatgtgataacaatggacgaantcaccggagtcctgatgaatgttgagttgttgcgcaatcaaagggttcggggaaatagaaaagacgtcgaaggaagcgggtccgacttcaaattgttgtgcgcagagtaaagggccgtccgggtgttgaatttgaaaacgttgtcacggattttttcggcgttctggcccacctaattaacggaatgattgatgcgtaacaagactatttatcagttatgttaaatttcagggaaatgggcacgttttgtttttgaaaattcaacttgagcattaaatacgaaaatttgccttgtcattaatttttgactgaattttcatcatgaattgcaagccattaaatcataccaagagattcgccacccaggttttgttgtaattgagagttcctggaagagcatggaacaaatcggtgtaatcaagcaccaaaatcgggtcctcatccgaacgcggcgcttcctttagccactcaacaacaccggcgtcgagattcaatgcttccccgagatcttcagcagtctcgaaaaccgcctcactgttgatgctagaaacaaaaattttttttatttgttgagacaaaggtatggcacattcatagttttaggtaccccgctgaaaaaccataacttggtaacgatttattatattttaatcaatttcaccaagtcgcagattatgaatttttttgcaagaaaaaaaaatcgaaattgatccccatattcattcattggtatatcgaaattaaaatacgattataatagagatagagcacaattaatcgctaaactaaaaataagaaccttttgcatgaaccatccgaactgctaaacacggacatgtcgaagtgaatgaaagctgtgaaatattttgtcaatctaattcaacttagtctttaatgccgacaaacttggtaaattttgtgtgataaaatgggagcttttattcgactgaatcgatggctattttcagaatcagggttttttatgcgaaaatggtcgattatttttttgcacaaatgcactttatgagtccaatcgacttttatgagcccaaaggtatttttatgagtccaatcaattgaaaatacttcgtttttatacaataactttgttcatgttcgagctaaacctatctttttggtatcattcgaaagcaccaagtgtaacgaagctaaaatatataaaatcgcagcgttcatgcaattaccaaaaaagctatggattgagtgatgctgattatttccatttgtaactttctttaaatgttataattctcttgttttctcgtataattacattattaagactatgggctttcgaatgataccaaaaataaagggtttgttcggacatgaaaaaattattatataaaaacaaagtattttcaattggttgggctcataaaagtcgattggactaataaaggcattagagccgattttttgacctattttaacttaggaaagcttttcaagttggttagcacattatgagaatatggacatgacgagggacagaagggcaaagggcgaatattgattaaacaatataagcaaaataaatgggtacaactgaatgacggaaaggtcagagggcgcgcggtatttatgtgggacatgaacgaagagagaaaagagaataaacgggagagaaataaagaaatgaaaataataatgggcggacaaaagagtaccaatcccaacaatagagagaaacatttgagagagagggaaaggatagagagaaaatttgagagagggagagagagagagagagagataaaagaggagagagaaatagatatacccaaaagaaaatccaaatctctaatcagttggtcaaagtgtttccatttccgatatttctttatcaaatttctatacaattcactgacaaaatttccagatttgttatt

SEQ ID NO: 22085 - DNA, 2173 bp, Heterodera glycines
  misc_feature (11)..(11): n is a, c, g, or t
aaatttaaatntcggagagaccaaaaaacggtgggaggcgttgcgggggggacggactgacaccacccaacgcattcattcattcactcaattttgacagttccttcaattttgttttccaaattagctcgtcatccaaaaaccgtttttgttaaattctgtcttttatcggttcgttcgattttatttccctttttccgttagtccttccagttcatttttaaaagacctgctgtcccaacttgattggtaaaatttgggaaattctgggattaatccggcaaacccacccggcaataaattgggccccaatctcgaaatcgaacccgctaatttgaattttcctgtctagtcaatttacgaacaaaatgagcgcaaaattggagtcaatttatttatgattaaaagctccgttgaattttgaaaacattttgcagcagcattttctgccgctgcataaatttaaattcggagtgattaaattgggggggggggggacggactgacaccacccaattttattcattcattcatccactcattgttattttgaatttcgtcgtcaaaattctttttttttgtcatttatttttcctttaaaataatggaattttatttattttttccattttccctcacttttccccaaatgcttttcattacattttgaatccctaattatataattaagaaaattttgaatttcaattaatattttaaaggtatcacaatttaagttaaatttcagctgaagagaagaataaaataacagcgaaatataaaaaaaacaaaacaaatttcttgacctcatttatttattattattaggtcgcgacgtttcttcactaaaatagttaaacttttctattttggtgtttgtcacattttttcactatttcgacattttttggaaaattccttaacaaaaatgcaaaaaaaccaaaataaacacccctaagaatcgacctaaaaaattttaaaaaataccactaagaattggaaaatttcttaaaaacttttcccccaatttctttcttgacaaatttttgatttaaaaatgttcaatatttgctaaggaaatatttctaccacatttgcaacagcattcagtgaataaaaattatttttgcttatttttgactgaaaattatgtcactttttgtcactatttcgtctttttgccactattttggcatttttactcactattttagttaactatttcgagatttttcgtcactaaaagtcgcgaccctaattattatggtaaaatgtaataaaattaaaaaagtacataaatcattttatttaaaactataatttgcaaaatcgtactctatcagttccaagtacagtatgccgtttcatcaaatttaaaattcataaaatatgcatcaaaatttattcaaagcatacgttggataaatcaagataaaacaaagaaaaagaatttatgcagtcgccaattatataaaaaagaattgaaaaatgaatgaatttattaatattaaaaactgtaataaacgaattttagggaaatttaattgtaattatttaaattattatttaattagtaattcgtaaagcaacgacatttttaatttttaaatgtgaattatctcatcttgaatcaatgaaaaaagagtatcagaatatcgtatttatctggaaaaatgaaacggtagaggagcgcaaataattttaaatacaaattattaatcataatttatatttcatcataactcatgcacaaaatgtatttgaaaaaattttatgttaaaaatagaaattaaaaacaccgaattttagtccgtctctgatcagacaaaaatatttgttcatcgatttcaaaatataatttttaaaaaatttacaaaaaaaaacgaaaacaatttattatttattaaaaacagaagccttatgaaaaacagtttttttaaaattcttatgctaacattgattccaacacatattttgtaataaaaaaatttcccgtaattattcagataaaattcctgcatttaaaaaatattaaatataaaactatttactatattagaacaatttgtaatttttaataaatattatttaaatatacaaaaagttcgtttaaaaaaatataatttaagcagcgacagaaatcagaaaaacatctaatcatcagtacaggaaa

SEQ ID NO: 22086 - DNA, 755 bp, Heterodera glycines
tttcctctcgatattttctcgcgttgccgctctttccttcttgaccaattcagaaagcctcaaaaaagttacgcagaacttatttgagtaaaatgagttagggttcgctgtacaaaggttttttgttgttcggcttgaattttaggaataggaaaaaataaatgtgcttttctaattagaactatcgagtcattccataattattatcctacgaattctatttaaaaaaatattttgcatttgatatcattagaattagaatacagagctgaattaattgaagctttataggcaaaaatgaaaaatctgattaaattattgttttaaattttccatgtattttattggttttttaaagtcaaacacaatcggtctaaaacccgataaaattatttataagtttttccgagaagcgcgcatcaaaatatagctgacccattaggctttagaagaacatcaattatgtcgagaaatagttgataattcaaaagtttgccaattataatcgaagtggaaatatttatgaaacgaccaaataattaaaatgagagagcctagcatatgttttcagggagcaggtcgttgtttccccccgaaaaattttttataaaaatttattcgggggggggggggggggaggaatgaggagcaccctcgtttgtgccaataactatttccaatcggttgcattaattttctttgtcacctcaaaatatgcgcttccgccttggaaagagtgtactttcgattctctt

SEQ ID NO: 22087 - DNA, 1035 bp, Heterodera glycines
tccgtgaaacggaccatctctttttctatcgggtcggggtcctggatgaaattggccatctcttgaaactcaattgtcagtgttcgagcagtgtcgttcgggttttttcgatgaacatccttcaaacgtttttaaacgagaataaaactcggcgaattcgtttggaccgccaatggattggacttctttgctgcgttccccgtgttcgtctttgtaggcattgattagcttttccgtagccaattggtttctcttaacacacagttttgacattacctattaagaattaaaccacaaattacctcaatcaaccgttttatgcgttgatcggaattaattctttcgcgttgctaaaaaaaaattccaattactaaatttattttttcaaaaaaaaatttttggaaaataaatttgttttataggttttcggggtcgggaaacccgattctagcatctgttttgacccaattcgaacccctaacccggattcgaacaaaaaagtcaaattccatttttcagaaaaattcatattttatccacaaaatcgcttcaattatttcaaattggttaaatggatgtcagatcggttttcccgacccggaaaacccctaaaaatcaattttgagcaattaacgtgaattttggtgaaaaaagaattttcgactttttttcgaatccgggttcggggttcgaattgggtcaaaatggatgtcagaatcggcataaaacaaatttattttcaaaaatttttggaaaatctccgcacagctaacatataagtaccaaaaaaacatactgattttttatccatcataaattctttaaccatcagatcgatgcaccgttctcgctcctcatgacaatttcgttggacttcaagcaaagattccatttagataataattaattgctttttaaatttaaaatcagaattataatcattcaattcaatttgaaaagtaaggtctttccaatctatggaatgatataacggactgatgagttacgggcgtcccctttagaagatccaaatat

SEQ ID NO: 22088 - DNA, 2050 bp, Heterodera glycines
gaaatccctacacaataaaaaccaaaaacacacccaaccatttgtcagaaaatacacccccgaagaatgaaaaaaaaaagctaaaaaaaattaattgaccctcataataattttttttccttgataaaaatttttggtttaaaaattaaaatattaatcattcagttgaaaattgtacaatccaaacattctcttggtatcaaacaaaagtttagagaattaaaccaaccaagacaattttgaacagccaaattccaaatccaagcaaatcttttaaaggggaggcgcaaacgacgtccccgcactcaaaaatcagaaacggtcccaggattttgccttggcggggatatcatcgtcctgctgctggtcttgacaacctctttttcgccactctttttttgcggcacgcattttctaaaaaattttgggaaacagttcccgttataaaatatatgtattgatgggaaaaagcgtttcggtgaaaattttcaaaaaaaaaaaaaaaatttctcgcaaaatttggctcgagattcatccagcacaaaaaaaaatcccaaataaattgggatctcagcttcggaatggagataattaaaaataaatgtttaagaaaagattggcaaaagttgaggcccaaaatggagtcaaaaattaaaaaaaacattttaaaattttaattcctcaacaatttccaaatgaattcattaaatttatgcaaatatttttgcgtttttagtccgccatcaaattttagaattaatcccatataaactgaaaattttgacatttcaattctaatggacgtgattggtggaggcgtaatacatatttcgccaatttttgagttcttagagtatattttatctttgttagcttaattccacgcagagtaagacggtagaacaattcatttggatgaaaagttgggccgaaattttaaatatgctcaataacccaaaatggcacgataaaaatatgtgtgaagtataaaatttttcattaatccttcttcgatagcaaacacacgaataagtttgattaaacaaaataaatttatgtaaatatttaaaaaatttctcaaaatagtgacaatttttaaaatcaaaaattttataaatttgataattttcgagaaaatgtttatttctgcttagaattttataaaaagaggagaggatttttacaaaaaaatgataaaatcatgatcaagaataatgaaaaatacatcatttgatcatttttgcttactttttgtaataaaaataaaatttttaagcgaatttatgaactgataagaaaattaacttatattcaaacttcatgaattttacagccctggcaatcaatcagagattggggtgggaggcatttgttaacaaaggaagacaaaaaaaagggagaaatagtacacaaactagtgcattatttatcgacaaagaaacgagcgcagcggagaaatagtgcatggatagtgcgccccgctgccatccatccctcgccccttttgaaccccacctaaaaatataaataacatatcccatcttttataataaatttgtgtgcttatttgccctgcggttgctcgccggcgccgtttcgcgccccccgccctctgtctcgtatctcctcagggagaacggatattttggcttgacaatggcttagaccgcatgcgcagtcgtttgaagacgccatgcggcgcttgcattcggttggagtcggcttgagcgaaatcgccaactttttttttatttttcaaatttgctgtaaatccttttttggtactttttaaaatgtacatgaccaccttcatatacattttaaaaacgacataataagaaaggctttcgagaattttctgggtcaccgactctgcatatgacatccatttcgacgaattattgtgagccccggcccagaacttgatcgttaagtcaaaccttcaaatttcataactcaagcattactttaaaaattcgactggtttgttcgaactcgggtccggattttcgaaatttgtcgaaatggatgtcatattcgtaatcagtga

SEQ ID NO: 22089 - DNA, 1146 bp, Heterodera glycines
catccacttcaccacaaagcccgaatttttactctaaattattaaaccgtcccaaatccccgagcggtgatcctcaatgagaaatgttcagggttccgggacacaaaatgtcgtttttacaaagaatttggccgtaatttttaaaatcttccacttctaccgtattcttatgcgtcgggagggcgggggagggagtgaagcgtcagcagcaaaagacggaatgaaggaagaagcatcaccggcgggtaaaggaaaagccatgttaatgaatttttgatttttttgttttgtttttgtgtgagatgcgtccgccgttccttttgcccatcttttgctcctctgcttttccccctcaatgtgctcccgcttttccccctacttgagtgaagcgggaccgggccggggaattcccggtcctccgaggtcccggttcccggtcccggattttgaaaattttgaaattttctgcctaaaatttctaaaattggcaaaacaaaaacaaaaaatacactgtaatctgttgaaaggttatgccaattaatttttgtgttttttaaatttcagtctttcaatgctattttggcacattgtttaatggagagaagctggctgagggttttcatgttcatcccatgaactgttcacaggaaagtgacatttgcgtcgcttttaagtgtacggcgggtaaaatttttattacttcctttttattttaattacctataaaaaagcaaagatttatgtgaatttttctcaaaaatttcatataaattcctgagttgaaaaaagaaaaaatttcacttttacttatgtttaggggacgaccatttggatatgtggacatgttacagaagtacccatatgagtgttgaaatgtgccccaaaatagattttcaacatttcatcaaagggagtattgggtaataataataatataataataataataaaagtaaccgtaccgagtaaattcaatttttctctattacatatataaagaaatagccagccaaaatgagagtttcggcaaacttttcatttttttatgcatattttgatttttgaaaatttttagaaattttttttgaaaaaacaaaaactttttttttaaatgtatttctaaaaatagcaaaaattaatttttaa

SEQ ID NO: 22090 - DNA, 1338 bp, Heterodera glycines
  misc_feature (6)..(6): n is a, c, g, or t
attttnttatgcatattttgatttttgaaaatttttagaaattttttttgaaaaaacaaaaactttttttttaaatgtatttctaaaaatagcaaaaattaatttttaaaatgttaaaatgtgattctaaatctatttaggtcatttttatgccattttatgcttatttaacattttacgaagatttttttccaaaaaataaccataatttttttttaatattttcgtgcatattttgggtttttatacatatttcttacatatttcgagatttttttttttacatatttatgtacatattttgaccaatttttgtacatatttttgacatccctagtcatacatattgcattcattattcaatcgaatgtttttttaaaacaagggactaccatttttggcatcctgtttgtttagtttagttaacttaaaaacaattcgaattttttgtcaaaaaatgcaaatttttcaaaattttcgtgtttttattttaaaaatttaacttaaattcatttttggctccctattttaatgtatatttgggcatatttcagtgagttacagtgcatattttatgcgtttattgaccaaaaaaaaaagattattaaattaaatatatatatttaagagaatcctgaagtagcggcactcccatgggaatgcacttgtgaaattggcgaaaagtacgaaagttttgcagtttcagcgccaagtttgttgttaaacgattattatttttaattaattaaccatttaaaatattaaaaattgttctacatacagtgccattgacaacaacacaactggagggacacagtaagaaagaaggatacagtaagcaggagggacaaaaataacacattaagtaagaggaatacagtaagaaagtgtgttgtcaactttgaggaatacagtaagaaagtgtgttatcaattttgaggaatacagtaagaaagtgtgttgtcaattttgagaaatacagttagaaagtgtgttgtcaattttgagaaatacagtaagaaagtgtgttgtcaactttgagaaatatagtaagaaagtgtgttatcaattttgaggaatacagtaagaaagtgtgttgtcaattttgagaaatacagtaagaaagtgtgttgtcaattttgagaaatacagtaagaaagtgtgttgtcaactttgagaaatatagtaagaaagtgtgttgtcaattttgagaaatacagtaagaaagtgtgttgtcaactttgagaaatatagtaagagaagtgtgttgtcaattttgagaaatacagtaagatagagggtgtcaactttgagaaatatagtaagaaaagtgtgttg

SEQ ID NO: 22091 - DNA, 1000 bp, Heterodera glycines
  misc_feature (983)..(983): n is a, c, g, or t
tgtcaaacgccgcgactgcatcgttattatatcagtcgatagaatttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccagaatttaaaaatacagtttgctatggcttcgcatcacccgcttcaacgggtgctcagtgtaaatatcgactggccattcaaattctgcctttccagccttatggaaagatattatggaacttttggttccatctcagttgtcaacgccgcgactgcatcgttattatatcagtcgatagaattttcgaatcgcttttaaatcgtctcttttgcgtcccttaatcttcactctgagccgagttactgcggtctaaacacgtttttggtagaattgcggccangaatttaaaaatacagt

SEQ ID NO: 22092 - DNA, 2356 bp, Heterodera glycines
  misc_feature (22)..(22): n is a, c, g, or t
acgcggaattgagaagcatttntggaaagtgatcagaactaaaatgctgcttttatgggttggaaaattagttaaattgaaaaacaatcaatttcattatccaattttcagaataatatttaaattatttaaaattgatgccaaatattattatttttattaaatccgtcttccataaatttatgtaaaattaaaattttatttaaatttaaagttttgtatttcaccgacgaaaagaaaattaccgacgcattgcgccactttctggggaataataactttataataaaaactgatgaaccggaaaatataattaggcattatatgagcaattcaaagtcattagcggatttctgtaacgatgaggaagaagaagaagaagaagaggaatacggtggaggggaaacaaaggaaagcagtgaagaggaggaggagaaagaggaggagaaagaggaggaggaagaggaagaggaggaagataggaaaaagggaaacaaagagggaaaagagaaattgagagagaaaggaaaagagaaagaatcaatgggaaaaagtgatcaaaatcaagcagaggacgacaatgttgatcatgatcatgatcagcagcagatggatgatgatccatttgatcaaacacaaaagcaagctgatcaaactgatggccaagcaaaaagcgagcaatgtgaagctgatcagactgattccgagcaaacagaggaagaaacaatgttgtccgacttgaatgaagatgatggaaacggtggggaagaaaatccgaattctcttggatttggatacacggtatttcagggaaataatttttaaaacgatttttttaaatgtttgatttggctagtttcagtcagccgaatgcccgccaaaggaaatgccattaaaaatgctgcaggaaatagaccgaaagaatgttattggtaaatcgtaatttagtaaaaatataaataaaatcaattattttgtaaatcgaaattaaaaattatttttcaatcgaaaattaaaaagaatttaaaacatttaatattttcaatcggaaaatttattacctgtattaacaaattaggcaatgaaaaaatgtaattatgagaattgattggcatatgaaaattgagtatttggcagtttttgaatagaatttttaataaaatttgttaagaagatccttttcagacccggagcaacaccatctgatgggcaattatctccaattgttttggcatgacaatgaaaattttcttccattgtctccacaaaattcggttataatgaaagtcacccaaattttggccaccattgccttttatcgaaattgtgccatggaattgttcgcattgcccgatttgtacacggagaatggcactttttccgccaaaattggcgattatcggcaaaaatgggccgtgacacaaatgacggaaagtgaaacaatgggcgaaaacatttgcaaaatttaccaattcatttacgaaatggtgaacgatgaggagttgaaggccgccggggcggtgtgggagcagtatttggcacggaatgtggtgaaaattggccaaatggaagcgaaggaacaacttaaaaaagtggaaattttaaattggaaaatttaaaaaatggaattaaattgaaattagaaaaaaaacatattttattatggaaataaaattacaataaaaatatatacaaacgcattttattaaaataaatatttaaatcaacaaaaaaacatcaattttaatttgaattattattcaaaattttaaataaacaaaacatttttaagctggtaaaataaaaaaaaatagcttatactgtaattcaattacctttttttctctttataaaattgaatttaaaaataaattaaaaataaataaaaaattaaacaaatgaattgtgcattgggtataatgaccaattattaagccatttaaactattttacagaggattgtcctaatgccctccgacaaacattggcatagcatcgattgtgctgagcggaaaaatgccgatgcctttcttgatgctcttctctcgtccgctccgctgatggaggtcgttcacacgttcacttttgtccgtctgttggctcaattttcccaaatgcgtgccattttttgccgtggcactgaacgcgaaattttgtggctgaagcattggatcagagtgttcatttcggacactgcattgacacgcttggaaatgctttctcccgaagcgatgcattacggtaagtcagtcgcccgcacggcttaccattggcagtgggtactgtaggggagaggaaagctgtccaaaactgcagaaggggctgaaattacgatcttaggcagtgggtactgtag

SEQ ID NO: 22093 - DNA, 931 bp, Heterodera glycines
ccaaaaaaatcgatttttttcaagtgtccgttggggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaaggcagaattaaagtacaggctatagtgaagctattccg

SEQ ID NO: 22094 - DNA, 2234 bp, Heterodera glycines
catctgctgataaagcaaataaaaattatgggaaaactcaaaatagaaacgtcattttgtatcgatgtttcaatgttacggaaaatattacccaccaatcaatcatcaatataaaaaaaaaagacaatttcatttaaatgttcctctccaattttttctgaatattaattaatttaattatccttaattgatttgaattttcttcggtttttctttcggtgaatatttgataaattttaaattttattagttttggcgtaatgccatttcaaaataaaaagaagacgccgcttccttttttgtctcgctccacaaacacggcatagcaatagcaattggaatgtggtggatttgcttttattttatgtgtgttttatgtgccttttttgtttgtcgagccttttccgtttgccctattggttttcttccgttgcatgagaatggcactggaggagagaaatggcagcataaatttttgagtgacagcatcatcaagttttgtggatgatgccagcatttttaagcagacgaaaagctaaaatttccgaatgaattattttttctaaaaatatttttatttttcacaaaaaaccgaataattctctatttaaaacgttaaatttagtgcgccaaaattgaaaatttatatccattcacatgttgagcccaatttcaccttcccccttccccttttcaaaatttgtcagttttccgtgtgatttatttgtcacactttctccccttttagggcgaatttatcgcttatctcattgattgattggatttggtgttggtgtatatgaactgtttagaggtcagaccaccctttttctgtttatgcatggcatccgccgaccaaaaaaacacttcctccgccaccgcttcgtccgccgcttttgccagcgaccccccaaaaatgggggcggaaacaatagcaaagccaacggcaccaccgcaaaaaatgaacacgcattttttgaacagcagtaccacgccacagcaaacgcaccaccgcaacaacagcaagcagccgccgcaaccgcaacaacaaccgcagacggcgcgccgcaactccgctgctcgacggcacacgacaccggacatggcggcttcggccgcatacggaatgggtaagcgaagtaagcgcaccgcaaaatggacccctgggagagggggcactcccgcccggggggacagactacgtttattgttagagggtccctccgccgtaaaatttcctaaattttccgtcgatttctaacagattttcctctaaaattggtaatttttgatagatcctggagggggtaccaacaaggaaagtcgaaaatttacaaccaaaatatctcttaaaaatttcgggtgaggagcggtcttgggggtgggtatatacctcgcttacccccgctccccatccccctgggatcgtccctgcccaagtcccaccacaatcatcaatcttggacacgtcactggtatagagcgacacgaaaaataatatttgaaatatttatggaattgaaaattggatgggactgaattggacgcggcgaatcccagacagagacatccaaaattaaatttattatcatttttataatatttttcacattttaatttgtctaatttttacgcgttttttagtgttgtgcggcagtgatgagatggagcagcggtacagaggacgcattgagaagtttgtggccccaacaaacgacgtaaaaatgccatttattttcacagagtcaaatttggcgttcccgtcaacgaggccttttgtccggacattccggcgacacttttggtttgtattaccaaataataatacaaagacatgtttacaaattggaatttcctgtttaaaaaaatatctatataggttggattcgaaatatcccaattcctcaaaattcaatgagtttttaatgattcattcattgattttttataaataaatttgtaaggcattcacaataatgaatgtcatactgaaaatcatttccaatgtttaaaactagagtagattcaaatgccacagaaaatcccacaaatttgcaatttccagtctctagtttataaggtaaaaaccaaaaacaattaaaatgcccaaatagacattgcttgtgttggcactcactttcgcaacatttgaccccgtaatagcagtaaagggtcggcctcgcgcacactttgcattcgcccacttcccttttctttcgccccctcccaatttt

SEQ ID NO: 22095 - DNA, 1527 bp, Heterodera glycines
  misc_feature (1513)..(1513): n is a, c, g, or t
tggttcattttggacgaacgtaaactgtcgcagcaccgggttgattccggtttaagagtgtaattatcattatctaatttaattaccctagttaataaatagaaaatgacctttcttaagttcgaaaaaaaagaatgctcaattttaggtgttcacatgaacaatgtggtgatcagtgtttgttgaaaatcaacgggtttttcatgagtttttctctcaaatattcagaaaatgatattctgtgatattctatgcctaaaattctgtttttctgtgccgggttgtagaacataaaaggtaactcgcccggtgggactcgaaccgcggcctttccatttcgtgccgtgctctaaccaactgagctacgggcgctccttttagagccctaaaaaaacactttccaattataaaatatgtaaataattagaatttgatttgaaaattaattgtgaaaaatgtttttattattacagcagccgttcgttgaccatggaataaacgaaatggatggataaagaggaaaattgttgatgatattagcacctttcattttagtacaaagttgtgttgattgtagtatttagctcaaaaaaaaattaaaaaaatttttgatcgactaattaataattatataattcatttactaattatttgacaatttaaatgacccgcggacctaattgtaactgatcccaaaagtaaataagataatatagtaaataggaatttattaaaattaattgcaaattattcaaacattgcagatgcactatcttataaatttaaaatttgcttattaaaaggattcatatttattttgtgcttaaaaaataaaaatttataaaattgcctatttttggtgcaaaatctgtgaattgcataaaattttcaaaaatctttccaattatttttcttgttgccaaaaactgacaaaattgtaatttttgattaatttttaaaataaatatcatcttttttttataattttgtttttttccttaaaaattttaaagcaaaaaatcaacaaattttgatgttcttttctactctcgaaaaataaaagaaaattaacatttaaaaatattgaaagctaataaaagtgaaagaaaaagaaatagaaaagaaagaataaagttggaaaatctatcttctacaataaaactgcacacttcctcttcacagattttctgttctgttcagttcttcaaattatttttgttggtttttgtcttttctaaactttggattttcaattttaaaataggtaattaatagggttataatttgtatgattttgcatattttttctgcgcatatgctatgaagaaaggggctcaaaaatagcatttctgcgttaaaattttttggttttgtgaaggtttttaatgcatataaaagcatattttcggtcatttttggcaaattttcataagaaaaatgaaataaaaatgaaaaatacacccataaggatcgacctcttagggaatttaaaaaatatacccttgaaaccganaaaattttgaattt

SEQ ID NO: 22096 - DNA, 1967 bp, Heterodera glycines
attaaggagagaatcgcatcgcttacaaaggaaggtccttggtgggtgggaagagcacccatgagttcttaagaagtgtttttattttctattaaatgagcccgcgtgccgagttctgacgtgccaaagtttaattttttactattaaagaaaaatgaataatatttcctagaggaaatgcgtaagtcaacttttttgggctcccaggttcgaatcctctgtatgcaaatatattttataacttttatttttgctttttatgcaaagtaatatcaaaatatgtttacgaaacaaaagctttttataatgtattcaacattttctccaaacaattcttgatttagagcaggggtgtgatcgaaaatttttcaaaataagaacaacaagggcaaaaaatatgattttttggtcaaaaataagaacatttgcaaaattgcatcaaaacagttatttttacaatttattcgataaaaaggtgtaaattttatttttcaccacccattatcgcatttaacaattttggggaagaaataaacaaatcgtacattttagagcattcgggatcaaaaaatcaggttttaacatgaccaaattttgcgcaaagctataaaatagtgatattctgccataaatttcaaaattatgagtatattaggaaattcgaacaaattttggtcgctaccccaaaatcagaacatttcttagaaataagaacagatcacacccctgatttacagcgatttataaaacataataaacacatattttggcgtttttggacataaaaatatagcgcacatatttcgtgatttggcacatattttgtacatatttagccatttttgaagaaaatttgtgggaaaaacatagaaaaattggaaaaatacaccccaataaatcaattttttgccatattttcaaaattttttaattatttatttcgaatgactaaagatgcaaattactgtagatgttttcattaattcgtcattggtttttgaagttcactgctgagacttattcaactgactgacaacttacaaaacaatttatctgaaaaaggaccattttacccagaacacttcacaatgtatttgatttgcgactgtgcaggcgaaaatgataatgaatgaggatttttggaatttttatgcaaaacacacttgatttttttaatttttaacacattttagcagatacattcgacacagtggagaccaaaacaaagaggcggaagcaagacttgctcaaatgcgggagggtgtcttccaatccgccttcaaatatgatgcactatatttggatattcttactcatcgttttgtctattctaaatatttaaatctcgaggtccaggaatcggttacactgcgagaaatcctcgattagcaaagctcgccttttaagatgatattctgcatgcaccgacgggtataccgagagcccgcagatgcaggaaaattcagaaagtgcaatgtgcgcgtgggcaaccacaaacctgtacaccagcggctcgtcgcattgaaatggcagaactttttgaatggttcaacaatgcgaacagcacctcggcgtgttgcagctggttgcagaaatgcattatcaccttgtatgtttttataatataagaggacggtaaaatacaggacggtattatgtacatatcgggccaggacgttttcgtacgagtgagtatggaaaaaattgcattcaaataatttgttaattttttttaattacttttaatgttttgacagttaagcttttattaactacaaaatgaaccagcagcaagtaattaaaacaaaacgaaataatgataaattggtgcatgatggtgcactttatgtgttccacaaattcagtaacgatggacttaagaaattttggcggtgtgagtttcatggcccggcaggccaatgcaagggtatgctaatatattattttgaattttgaaaatcttttaa

SEQ ID NO: 22097 - DNA, 1654 bp, Heterodera glycines
cgcatcctttaccatctcagctttgatttgttccaacccccaccggtacttttgagtggttctttttgctttggtgccattaccttgtgatttacctaaatgaaagtttttgaatgaatcaaatgtagaaaaacatgcacaaaaatttttatttatttttattaatttttatccgtttagtttggcgtatggtgtttaaatttgtaaattaaatttttaatgggttttgaaggaattttggttaaattttatctttcttatgtcaattttagacactacttgtcattcttaataatccatagaaaaaataaattattcattaattgaatatttaatggacaaatatattttttaattttaaaaaatctttagaataaaattacgttccaatactctgctcattttaaatgccttgaccagtttctgcactttttcataattttctttattagcaaaattttgcgtaattttttcaaattcattaaggttttcctcttcaggtgtaatgttaaaatgtttgtacgctttcaacaatatgatttttatctccgaaatgttgtcgttcgaactcgagagaaatgatggcttcaacgccaaattctccaaaaggtctaaaaattttttaaattttcggctttttcaaattaaaaaatatatatatatatatatattttgccaattcagaatgacactctatgcaacttaacagtggaccaaaactcatatatttaaaaaaataactcaaaacggataccgcttataggcaatttttcaataaatttttaaataaaattaaattttaagaaccaataaaattttgtaaactccgataaagtctaagttccaacttcagaatttttgggctcacatttccgacttccaaaaatttcagccccctgagttgcaaaattaataagtatttctctattttaggatttatctaacaaaggaaggtccccaggtatccgtggggtttctgaatgaaacttggtgggtggatagagcatttattttttgcggaatttttatttttgcttttttatgcaacgtcaattatcaaaaaaattatttatcaataaaacctttatttttaattatttcattaaaatcaaaaaattcattaaaggtaaagaagcagtaaatctcctttaagttaaaataaattgattttgtctaacattcttcattgcgtatcttatggtgttaaaataataaaaaataaaaatttggtttcataaaaatattttcgataattgactttgcataaaaaaaagcaaaaataaaaattgttaaatggtttttgcatgcagtgggttagaacctgtgaccgaaaaaattgagaccagcgcactaccccaacgcaaacaataaaccactttttaagaacctataatctaactatttttaatttccaagtcaaatctcacgtcccgcatgcattaattatttaccttctttttgtataaatgccaacttttccattccgtttgtttcttcattaaaaactcttaatgcgtgaaatctcaaataattgcgcaatgctttgttggcaaattttagaatccggcatttgtgcaccgtttcattgtgggcatgatcaccacgaattccttcagggcaaagccattttttcttaggcattttttgttcgtct

SEQ ID NO: 22098 - DNA, 1010 bp, Heterodera glycines
  misc_feature (984)..(984): n is a, c, g, or t
  misc_feature (993)..(993): n is a, c, g, or t
tttttttttttgcaaatttgacccggatccggatttaagtaggtggaatatatcgtgaaaaaaaatttttgaacttttcatatttacacatttcaatataaaatagccgggttctcgtgttttgccccaaaatttttacttttctatcgggaatataactacaaactacagaattctagaatggataactgcaaagtaatgagaaagacctcattaattagaaaatcccatccaaattttgtgtatttttgagcccccctccacccttgccttcctccctcttatttcttctcctcttccccccgccgttctcttttcatcttctcacttttcctcttcctcctcctcatctcttcctctttctactgccctcttctttcgtccccaattcgtcctttttcctcccattcttcctctttctcttccctcttctttcttctcctcttcctccttcctttcttcttcatcgttctccgcttccccaccctttctcttcatcttctcacttttcctcttcctcctcctcatctcttcctcctttcgtctcctcttcctcctttttcctctcattcttcctctttctcttccctcttcttctctttgcctcctctcttctacagtttatcttcacttttcttctcgttcatttcctttccactttcactgttttcatcatttttgccttccttcttctcctgctgctctttcgcgttaatgtaattgtcgaatgccttcttcgcctcctcatagaatgttttgtgctcatcaaagtgcctctgggcctgcttattcttcgcctttacagccatattatgcaggttcttctcaaatttatagtaaagaaccttcataaaattttttttttattagacccctcgtatccggtaggatgacaactgaatccccctatccgaggctgaaagatgatatgttctcgtcccgaatcccgacccgaaaaactttggttgtcctgcggcaactatnttatcctanaataatatatttcgaca

SEQ ID NO: 22099 - DNA, 1554 bp, Heterodera glycines
gcgacgcaaatgtcctaggcacaaacatctgggttgcaaatgcccaaggcgcaaatgtccggggcgcaatgtccgaggcgcaaatgcccggggcacaatgtccgaggcgcaaatgtacggggcgcaatgtccgaggcgcaaatttccgcgacgcaaatgtcctaggcacaaaaatctgggttgcaaatgcccaaggcgcaaatgtccggcgcgcaatgtccgaggcgcaaatgcccggggcacaatgtccgaggcgcaaatttccgcgacgcaaatgtcctaggcacaaaaatctgggttgcaaatgcccaaggcgcaaatgtccggggcgcaaatgtctgcacacagagccaacgtaccccgccccaatttattatttttcatttttcgacacactgtcctgtgccgtttgcttcttctccaactcattcttcgcgttctcatagttcctttttcgatccatcaatgccaacaacagtttttccaattccttatcttctttatctttataatctttacattcagctccttcattagtagaaattttttgatcatttttcaatgaaaagggaaatgtgtaataagtgtcgtttttttctgcttccacttctgaaaagagtgaaggaaattgttaaaaattggcacttatgccgccgtttttttttttttttgctttgcttttgcacttataagcgccttctgttgattttttaaaagttctaaatttggccagaaaactgaaaaagttcccaattttcatagtttttgcaaaacataatttttgacgctttaatatatatttttcaattctcaatgtttgcgaaattttttgtaggcctccggaaccaggcctagtttggaagctcttttttccatgaaaatccacagcaggatgggaattcgcagagtctttctttgaaaataattgtcccttatacagtttacgctccacctttttttctggcaaaagggtcccaaacggatgtcggattcgtgatcagcgacccttaaatattaattggtatttttttgaaaaatgaaaaaatgtggtgctaaattctatagggccaaataattaattgattgttctgagctttatgttatgcttcaccttgacttaaaagggtatgtccaagctttgcgcaatcagcgaaacattttttggcattggcagagactgggactaggctagagagctttctctcaaaaaataggcttttatggtgatgctttcgttgtgatctgcttgtggtgctgcctcaccacctttggacagcaaagtttcgtcgataataataataattatgaaaatgattaggaggaggcgggtgaaaatggtggggagaaaatttgggggaaaatgggtcatatttggaaaatgagggcacattacaaatgaaaatgaatttggtttgtgtaaaatgaatatttcttttcccttacctattatattcttatacataatgccacgcatgcagttttttatgaaaatatggattttcttagctatacatttttaagggttaaatttttaaatatttataaatttttata

SEQ ID NO: 22100 - DNA, 3382 bp, Heterodera glycines
atcagaacaacaaaaactactgtgggtgctttgaatattcttttctctttccatttaaatatactaaaatgctattaaattcaattcattaattaattagcattatataaaattaggaattgtccgaggggaaatatttgtaaattgctccaatttaaattttttttcaatttggagaaaaattgataattcaaaaatttacaaaaattaaactttcctttaaaaactctttacaagaaaatgtaaagtttttattagaaaaagttcaaaaaataatatttatttctataatttgtttcatttcctgaaaataattaactttattcaaaacatttttcttatttttaaaaatattaaaccccccccctttttttggcaatttaattaaaagagttgtatttccatggtgaacatatttctgccaaaaaatcaagtaaatagtaaattaggtttttagctcgaaatgccaataacttcaacaaaaaaaacacttataaaggggaagcggccactttggcgccagccattttggcgccaaacactataacatttttatttctcattcaaattaaataagattgatatcgttttaaagcgcttgatagtccctaatagcctgcaaaatttcaaaaaatttaattgatacataaaaaagttatggccaaaaaacctaaaaaaactgactttttctggccattttggcgccgcacgctatatcttttgtcaaaccgaatttatttttctaatattttgcaggctattaaagagcacttatgcctatttaatggtatcaaaattatttatttggttggataagaaaaaagttataacactttaaagttcgcggcgccaaaatggcccgcgccaaagtgaccccgacccttataaagaggctaatttgttaagaacccaaaattttttcatgttcaaaattggttttattgtaattcattctcagtgaattattattttcataatctcaaatatacaaaatttattttcttaaattaaataatatttggtcaatttctcatcaataaaaattttctcacttaaaatttaattgtttgaatatgctatatttgaaaattttagtcaataaaaatctgagtttctctgtagataaatttgtcttaagactgccaacaatattaatgatactgtaattagcaaaatgaattatggtactgtaattagcaaaatgaattatggtactgtaattagcaaaatgaattatggtactgtaattagcaaaatgaattatggtactgtacttagcaaaatgaattatggtactgtaattagcaaaatgaattatggtactgtaattagcaaaatgaattatggtactgtaattagcaaaaattccccaccgtttccctttcgcgcgacttgcggcgccacaacagccaacttttttctgcttctgatcatcttttgactgctgcggtttttccattggaatattagcaaatcgaatgaaaggaaattataaactaaaatatttaaattaaaaaatagaataaataattttactaacttttttcaattataaaataaaaatgaatttaaattacaatttgtcttctttaaatagccgatttctgattggcttaaagcataatacagatgtgacagattaatccactcagaagagcgaaagcgaattaaatattttaaattttagtaaatgtgctaattaggctaaatgattttgattttcacattatgaaagggatttgactgattaaatttttgtcggcatcctttgatgaatgattgcatatattttgacgaatgcgtttcataaaactgtcatactcccacaaacactccaaaaaattcttaaaaaattgaaaaatatttaaagaattttcgaacattttaaaattttgcgaaaaaatttagattttaagaaaaatatcaaagtatttttatataaatataaaaattatttgcttatagttttaaaaatttactatattttttcccaattttttcttgaagaataatcatttaaaaatgcaattttctttttttaggttttacaaccttggaaaattggaatttttaatttcatgacacgtggaaacaaaagagtttcaagcagtttggaggacgagagcaaattcggagcagcggcgtattgggcggggacaaagggcccaatttcgaacaaaagttcgagcggaaggcatttgagtgccacaattaggtttaggggttaattagggagggttttatggattgttactgtaattgttattatggcgactgattaatggtgcccccaccactgaacattcattgcaatttttctcccccgaggggcgttggcgttgtgttctctgtctgtctgtgtctgtcttcgtctcccaataaaataataaattttctgtatttatccgattaattcttattaaaaattaattatgtattgggctcaaaataatatatggacaacaaatgaaaaaatagaaacaaaaataataaaattaatggcaaaaattctctgtttagtgtgggcattttagggatacggtaaaataaattcatacggtaaagagagaacgaaagagagacagagagagaagggggagagagagagactatgagaagagagacaggggcacatggagagagtgagagatgtgatgctaagaaagaatgtgaaactgtacaggtagacaaaggactgtgggagagagaagggtgaatatacggcacaccatttctgcggaaattttgactctttttttactgccagtaaattacggtatttttcaaaattgtatgaatttttggcagatctttataaaagatcattcttttggataaatatgaaaaagctaatgaaattggtggtccggcggtgctgaaaggcacgccccaggtgaaacatttagcgatttttgtctccaaaatttaattaaaaactcaaaaagttgcccagcaggtttacatgcctggcattggccttttaaatgcctggccattcttttcatttgttggtcccttctctctacccaatgaaaataaaattaaaaaaggaattttggcgaaatgtattttgatcgtggcaataaaaagtcgtaaaattgatgagtcatcgggccatttttttcggggccattggcgcctcaccacacgcgacacttccgcgccggattcattgggctgcccgccggacagtcgtaagctgtcgcaaagtccatcgaattggacaggggacctttgacactgtgaaaggttggcaaaattttaaaatttagtttttaaatccaaatttagcgggacaaaggcggcttaattcaagaaaaatatgcatttttgaaaattagaaagtttcttaacaaacgcatttaaggctctaagaaatttt

SEQ ID NO: 22101 - DNA, 1950 bp, Heterodera glycines
ctgatcactactcgaaaaatgagtgattgaattttcacttaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaattaaaaaattttttaaatgagaattcatgcgagattttctggaaataagcttaatagggcctagttaagctgtaaaaaaaaatttggggcgatttgaaagagaatagaaagaaccaggttcgatgaagttttggtaagccaaaaaaaatccaaacatttaaaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaaaaatccaaacattttttataaaaaatttaaaaatgagaattcatgcgagattttctggaaataagcttaatatggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaatttggggcgatttgaatgagaatagaaagagccaggttcgatgaagttttggtaagccaaaaaaaaatccaaacatttatttataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaaaaatccaaacatttaaaaatctataaaaaatttaaaaatgagaattcatgcgagattttctggaaataagcttaatagggcctagttaagctgtaaaaaaaatttagagcgatttgaatgagaatagaaagagccaggttcgatgaagttttggtaagccaaaaaaatatccaaatatttaaaaatctataaaaaactccccataaatctgggcgcatcggttcggggggactgccccgaaaacaaaaaaatcgattttttcaagtgtccgtttggggtactcaaacaattatggggagcaaaaatccaatgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctaggcgcatcggttcggggggactgccccg

SEQ ID NO: 22102 - DNA, 2836 bp, Heterodera glycines
tggccggacgattttggtggttgatcactttgaagggccactggcgaatgtcgcgctgcaccatcgggtcgtcccagggccgtccgatcagtcttttggcctcaaaaattgtgttggtcgggttccgggccatttggtccttggccgggtcgccgatcagtcgctcggtgtccgtgaaggcgaccaccgacggagtggttttattgccctaaaaatcctaatttttaattacatatttaaaaactaattccacaaagttttattgacttttaaatttatttttgtcggcagcttttcatttttattaacactgtaaaaactatgtctgcacctcgttgcttaacaaatgtaaataatattatttccatttatttattccaaatttaataaaatatattttacctgatcgttagcaataatctccacctttccatgctgataaacgccaacacatgaatatgttgtgcccagatcaatgccaattgctttgcaagacgccatttatttttatataaaattagttttgtaccaacaactaaaacaattaaaaaataaattattattgaaaataaaaatgaaaacattgttctcaacatggcaattttgtgcattttattgatgcatatgtaagtcagaggaaagagaaaaggctcaaacaaacaaacaaaaaaataacaaaataacaaagaaccaaagattacggcgggggaggacgggagggggaagtatcagctggaaatcacgcgaacaaagaagcgggtggcagaaagaaaagaaagaagggcacaagaaaagaaaagaaaatgccagaattatttaagaaaatttaaagaatttcataattattgtgatagaatttgagctctcaataaaaatatagtgaaaggcttttctaaatatgtttatgaatttaaagatttcggtttgcttgcagagagatgtaaaaataagcattttttgttttcaaatcaaaatatattcatttttatattccgtaatttcataattaaaaaagtaaacaaattttctgattttccattaaatctcttctgtctttctttggccttgaaaaatctaaatttaactctttccaaaaatataagaattaaaaaattaatgaaggtcgagatgaaagaaaacattaacaaattattgtgtatgtaggtccgaccaattttcggtccattaaaatctttttgaaattgcaaatgaaaaacaataaatacgaattaaaataaatcataaaagcccgaaaaattgaaaaaacgagttttaattacaatattcaggaaattagaaaaatagaaatttaaattatcagtagcgacatttttcttttccgtctcgcaaaaattctcaaaaacaccaaatgatcctcaaattcatgtacattaaaattcaaaaattcaaataaatttgaaatgaaagcataaatataaaaataaaaaaattataaaaaaaaagaaatttgaagaaaatttgttctcgaatgttcgcatgaatgagtcagaaaattcccgacaaaaattacaaattgggaggaaattggcggtttatataaaaaaataaaaataaaataaaaatttatatatttaattattaaaaaaaaatagtttttatgaatattaaatctagaaaagaagaaatgaaaaacttcgcaataattaaaaaatatcaaaaagaatcctttgtaattgtaataaaatataaagaaaattaatttaaaaaaagaacataaagaaccaataaaattgaaacccaaaaaaataaaaaagcaaaaaaaaaaaaacaataaaaaatagaaaaagaaaaaaagggaaaaatagacctaaaaatcatagcaaaaatatttgtttgtattgaatctttggtttgaattttttatttccttaacatgaaaaagtcaaagatttcgcgctatgtttaaaaaacttattacaagaaaaaactttttatgaccaggcacattaaaaacatcatatgtaattctttttattttattccctcccatgagtggcggttgtgcacaaatcttttgacttttcttcttacaatacacgagtagcaaatttgcgcccttccagtcgttttgtaagaaaattctgccaccaacagttcgctggtgccggtgtcatgacaattcataaaaaagtcaattctacaatttctttaggcttgcttagtcctatgcttaggcttaagatttaggctttatttggtaaaatacgagttgccttttgtatgagttgcgattgacccttggtgctgacaggcgcagccagagaaaaatttagaaatttttaatgcgatattccaatttttgaggaatttttcaaaaagcacaaactcaaaaaccattttagaaaaaaccgtttcgaccccttcaaataccacaaaagaggacaaattctcagatctgagaatcttaaacattagcatagcaacgaagtcaaatatattatattttgggtgcgaaaatgatttgttctctagcagcagatgaaattcatctcttcatgaagtaaacgcaaaaaatcgcagcccagcaaagtgtccaagccatcaatatttatgatgcgatttgatagaaaattgtttgctgatcatttttaaaagaagtttatggctctatcatttgttttaagtttttatgaatttttaaaaattttgtcattttcatcgatttttcagaactttgatcacttttttctgatcagtttggaggacaaggccaaaaatggcaaaaattgtgtatagcagatcgactatgctctacacgaaaaaaaaggatttaaagtgatctgggtgggtacagttcggaatgttcccctgtcag

SEQ ID NO: 22103 - DNA, 1283 bp, Heterodera glycines
ctatttatgaaaataatctaacaattcagatgttaaactttattatgaattccgaaacaataaaaatttgaaaagattcgttccatttaaaatgtccgccaattttgcgacgaaaaaattgaaccaaatttcggagttatggcaacacatggcttttggagaggacagatttaacgaattggacatttacaatttggtatttttaattttaaataaattgcaaaatgaattatttatttagaaaaatgaaattgcaaagggaaataattatctgatttttgatgtaaatcaaaaagccatggttgaaaatataatcagagaaatggatgaacttctcaaaaattgggtaaatatttaataaatttgttgattttttaaaacttgatttttagtcatcaaaaataaattgccatttctccgacgaatggctgtttagacccaaagaagaagcgaaactcagtgccatttgcataatgccatttgaatttgacatttcgtcctttttgggcacttatttttcgagtaattcgtcagttttccatgaccaatcgctgttctgtcgactgtccaaagtaaataatttattttttcaaataaattttaaattctattttttcaatttccagaaggaaaatctattggcactccaaagaattcaaaaagattatttcaactccgtgccacaaattcatttcacttaccaaactctgcctgtaaccattatggccattttggtaccaaaccttggccaagaagtgccaaatgggccattggatgaccaaaaaatcaaaacaatcgcacaaaaatttggcgatgaaatcgaaaaattgatcagagctgatcatctttttgacgaaggccaatttcgaatcagccaaagagtgaacgaccaaacaatggagcagttggccaattcaattgttcacgcaggtaaaagggcggacaatcaaaatgaagagataattaggtaattaactgagtgttaagtgccaaaagaagcggccaaaattatgcaccaatgggtaatgttcgatcagttaaaagacctgctgttgaaggaccgacaaaaagcaatgaacctgagggaatctgtgaaaactcatttggccatgataaaggcatttgcaagtgcgaaaaatgccaaataaagtttaaaacccaatttttgaaattttagactttacaactcatgcaaaaatttcattggtttttattggacaaattggacacaacacaaaaagaagcagccagcactgtgcttaacccgcacattaataatcata

SEQ ID NO: 22104 - DNA, 969 bp, Heterodera glycines
atggcataattatattaaatagaatctctcaaaaataaaatgcgattaattaatactagttaattaactaattaattgcaggccctggccactgccggttcaattgacagaaatttgtgtccacagaaagggcgaatttctgagttggatgccgggcagagaatggttcacaaaaaggcaacattcgcccaaaaagatgctcaaggcgatccatgccgaattggcaatggccatcgttacgccgacattccctgaacgaaatttggcacaaaactcaaatatttccgctttaaaatgcatccaaaatcaaatgaataaaggcaattaaatttgaaataattgcacaaataaaatgataattttagcattgaaaactctgcgaaatgaatctgagaaaaatgcgctaattgggccattaatcaacaaaacattcagccaaatggtaaaataaaaattaatttcataaattgttccattaagtatgagcacttcattgttgtcatttgcgctgctccgaattatcaaattgaaacttttgctaattttgttggcattcgaattgggcacgaattgccagaaataatcgaaaatccgttggaaagatggattaagttttgccatctgtttgcccgtccaatttcacttggcgaatgtaataataataataataatgcaccatctccaaaatcatcgtcgacgtaaaaacatttttatgcttttaatttaatatatataaatttaaaaaaagatttatttttcagttattgtaaaaagatttggctggtcggaattgaagtgaatgagaagcaaaaagaattgagcaaatttcaggacaaaatgcgagaaaagcttaaaaagaaattggccaaaaaaatcatcagcaatttcgagggaagctttgttgaaattgaaacggactatgtcaatgagcgggaacagctccaaaaattgtggtgaacaattggaaag

SEQ ID NO: 22105 - DNA, 1744 bp, Heterodera glycines
aaaatttgggtgcaatttgttaacagattttcaacaaaaaaaggttggtttttgcgattattaagctcaattggtaggattttcatttaaaaaatgataaaatatgtatcaatttaaaaaaaaaactatgaggaatcatattttctttataggaaacccacgagtatacaaaaaaaaaattgaaaataatctaatttctgtagagggattgaaccaggggaaagaagaagggaaagtcaaggagactagccattaggccatttgcacacttgcgcagtgttacttttaaagaatatattaattattattttttatttttctctttgactccaattttcttcactaatttttcactcagaccccattcttaccagtgcttgtttttcccggttcccggttgccctaccgggaccgtgaccgggacctgagattttcaaaacccgggaccgggaaccgggacctcggatgaccgggaattcccggcccggtcccggtccctgtcccgtggcactctacttagaaatattttttgcggagaatcaacctcaatgttgatatttatttaaatcaacaaacattacgccatcaacttaaatatcaacgtaatttttaaaaatttaaaaatgaattccattatttagtatatctcattagctataaaaggaattgaaggaaataaaaataaatatgaaagcaaaaaattatgttgtcaatcaatttgttgtctttcaattgaaacattgactcatctcctattttccgatcgcctacagccgtctctccgtccgttgacaatcatttcgatcgtttacagcgatttcttcgagaatgcttcttcttgttgcttttcctctcttaatttttctacggatttgccttgttaacataataatttagaatttatggcgagtcattccgatgaatacgaaattgatgaattttggttggataacattgcctatgatgacggcgagccacgtccaaagtcgaaaaaatgcgaaattattgcagggattgaccttcaaagtcacagacaacggcgagagtgggctgaaagtcgaatcttccgtcaatactacgatattattttggatggaaatggaaatttgactaattatgtaatatgcaaatcctgcgtgccacctgcgaaacctgttacatttaattatgccgggtttcataatttgcggtatattaaagactttaatttaaatatttttggatttgaggagacatttgaaaaattggcatgggataaaatttggcacaaatgacaaatatgacaaaatggaattagcattggttgaattttgtgttgctgatggacgtcccttttcaattatcaagggcgaaggattcaagcatttcatggatgcttatgccgaattaatgtaaccggttttggatgagtataagggaaaagttttagtattgaacggcatctgcaaaagcgatcagtactctaagctgatcttttgccaaatgagagaacaattggcagaaaagtgattgaaactctgcagacaaaggaatcggaactggacaaagaattaattgacgtcagacaaagtgcttgcacattgtcactcgatttttcacaaaaattgggtgttgattatgcagttgtagtgatcgagaaagtcatcatttttgccttgcgcatatcatttctacaatttgtcggcggatcactgaaccttatgtcaatgcgaatttaacaaacgaaaaaaagcagattgttaac

SEQ ID NO: 22106 - DNA, 2007 bp, Heterodera glycines
ccttagcaaattttccctttctcaaactgtaacacattatggaagacaaatttataataattttattcacacgacggacacacaattttcagcatcagaaggaggcggacggaggcgacttcttgaaagaaaaagcggatcaagtggttggataatgggggggggggataaattggttgggaagaagagagagagacggtgctttctgaagagagcgcatgagaaatggggggaaattgaaaattgaatgggcatggaattggggcgcaatttgaatacttttgaagattttgtgggcacatctgacccaacataataacaacaatctgaaagtgtgcccacatagagtagcataagcagggcaaaatggttattaagaaaatttggcggaaatttggggcaaatttaggggagatgaaaggggccaattccaaatttgaataaattaaaaatagtttgggcggttaatgccaatgaaaaatttgattaaaataaaatagtttagggttaatgccaattttaaaaccttaatagttaatgagaatttaaattaaaaaaaaactgaaaagggccaatttttaagttgaaaaaattggaaataaaatgagatttattgaaaattttgtgggcacaaaattcaaatttgaataaattaaaaatagtttgggcggttaatggcaattaaaaacttgaataaataaaaataataaattttagttgatggttaatttaaattaaataataagtattagaaactcaacaaattcaaaaaaaattaagatttataaataaataaaaattaagaaaaattatgagacttagatattaattagctcgataataatgtaaggaaatcctaggctttcgtggaaaatcaaaaactctgtagtttttaatttgtatgggtttagtatttcatgtatcatattatgtttcaggtagaattgagcaaataataacaatgattgcataataaagcaaaataatacagaaaattttttcaaaataataaacttattcataaaatatatttctaatacaattaaaaaaatatataaaatagtctataaaggaaaactaaaagattaaaaatatatgaaaaccatggatatttttaataatgaaaaaaatataaaaatcaaaatctaaaaaattcatataattaaaaaaaaagacgaaaaattctgtctcaaaatttgtgtaaatttgtttttattgtccaaattttggctcttgaaacaattaaaatcgccgcgccgtgccgcgcactttgtcccacaacgatggaaaagaatgccgtgggaggatgtgccaatcaattatttatccctcggggcgttttgccttcgccggggggggcaggggcgggggagacgataattatcatcctctggtcgtcacatcttcatcatcattatctctatagcggggggcagtagctcttcattcattattgttttctgtctttgtttctgcttcgggcaatggacggaggatatgctggctaatttgaatttggcgcacgcctcttggcgcattgccaactgacaaaacgagttttaatttatcaatattgaaaaatttggtcattaacaaaaaaaatttttttttaaacaataaataaccaaataaacccttttctttaacttataattatgccttgggggcgaattctcatcttcagctgatttttgaatataaaatttacaaaattgtataacggtctgccaatgaaaacaattcaatgtttcattcttatcacattgataaaaatcaaaagtgattgatcccgctttgtcaaattgaccttttcaaaaatatggcctctgaaattgattgggtttgggatcagcagagagggaaagctgcttgctggcccccacattttgggcttttcggtgggtggtttagttagtccttgcaccaccactcatcagcaagtagcccacccatactcaatggcatccgtttttggcatctcccggtgcgggggggggggggagggcg

SEQ ID NO: 22107 - DNA, 1369 bp, Heterodera glycines
agcgtcatttttctcaaatttggacttgagggatgccaatttgcaaatggagttggacgaggagtccaaggacctttgtgtgatcaatacgcatcgcggccctattccaatgccagcgcttacctttcggagtaaagtcgacaccgtccattttgcaacatgttatggagcagatagaagatcgacctcggggggtactaggggttttgacgggttgggcaattctgatgacccccgggggggccatatgcaaattgggcggaacaatggcaaaagaatgaagaatgagaaagagacacaagacaagaaaaaaagaattggaggctgagaaagatgccaaattcaaatggcatacaaatgcattgatatgggcataaggttattgggaaattggtttggagaagaataaagaatatattgttgattgaattcgaaattgtaatttaaatttaaaaaggcacttttggaaaagcaaattcgattttttttttttttgattatttaattgatttctattttttcttatagatttataaaataaaaattatgcatttatttttataatcatttttcttttgtttaaatattttattttaaaaattatttcaatgaaaattatttataaaatatttaaagaattaaaaaattttagctccaatcatttcaaattagcatcataaaattggaaaatgaatgtgagttaagttaattttaaattttcaattaattaaaataaatttaaaagatttctcttaaaaacaatgaatgtattaaatgtatttataaaaataaaatttaaatttattttgaagctaaatttaatttgactaaaatttgtattaaacaatgaattaaattaaattttaaaagaaaaaaaagtattccagaggaaattcgaaaaaaataatttataattggaaaatggcaatgaaattaatcataaactcttttaaaacattgaagaattgcatcaaattttaccagggatacctagataacaggagactattttaatctgtaatttaatactcatatattagaaataacaatttattcgatttttaaattttaaaaattcatgtttaatttataactcttcaaaaatgctcagaagtctcatcaattaataataaataaatatcacgcaacgataagataataggctaatggagaagctataagaatgtttttgaatctttcaaaaaattttttaatatttttttaaatcgcataaatcgagcaattttcatttaattttaatttcatatcacttccaactaggaaaatgtttttcaatctttcagttttttcttaacaatgttttatttttttttaattagattaattgaaaattacatttatttttatt

SEQ ID NO: 22108 - DNA, 1700 bp, Heterodera glycines
aaaatttttcaattcataaaggtatattctctgaatttttttagatcatttcttaggcgtgtatttttcagatttttttgaatttttaatggaatttttcgggaaaaacgccaaaaaggcaccaaatcgctaaaactaatctttgtggtttttttagaatcaaggagcaaacatatgttttttggctgcattttctatcattttccaaacctttagtacaccattgatagagcttcaatagctctacaattttactcagaggtgatctttcgctttttctattgataaaaatggtttattgtttttttgggaaaagataaaaaaattcaaaaaaaccgaaaccaaaacggtataccgaaaatttttcttcggttttttcgatttcggtttttttcggttttttaaccgaaaccgttcaaccgagaattttttgagtttttcgggttttttcggtttcggtttttttccgttcgaacgaccctcttgtccggtctctagtaaaaagtgaaatttagaaaataaattttacaaatgagcttttacattttatataaagtttttttttatctaaaacgaaataaaattgtaaaatatatttttaatgagaataataaaaattgtttaaatataaaaacataagaacgctaaaataactcatattttctgaatataattatacaaaacaaaaaaaaaacatttataaaaacataaaatatataattgtagtagtgacaacgactgaatacgcagagatgaataagccaagaaaaattaaaagtataattttcttaaaaactgatttatgaataaaatgctaaaatttagaaaataaatgatttgctttcttagtatttataataaatagcaattcataatttgtcatcaaaacggaaaagtaccaaaatagcttaagggggatcggtggtgccgacagacaccgccgggggaaatttttttatgaatttcgttagaaattagccaaatttttcagaaatttcattcttttggatgaaaatacgccctaaaatcagaacatttctcaaatgaaaacatcaaccggtgtcgaaatcctaacaagaaatactgttactgttaaagcactaccactaaaccataaatatattggaaattaacagcaaaatttactttatttcataaaaattttgtcaaagatccccggcgggggtgacgggggcggggtccaaaccctagttaaaagttcccaaaatatacataaaatattcaaaatttgatttaaaatttgcatttttttaagaaaatctcttaaaatgaatgaaaaatctacaaaacttccccacaccggccccaaaatccttattctcttataaaaattggctcagaatcccaaaattttggtctttttgaactaaatctgttaataaatcgcattaaaaattacaaaaattttcccggcgacgcctatcggcaccgccgggggctctactgcattttacgcgtccaatcgacttttacgcgtccaatcaaaattttcctaaatcgaacatcctattgacataagttaccaaccattgcaaaaagaaataataatttaaatattaaaaacgtaacaccaagagaaagaaaaaattactaatcaatttttaataaaatttaaatccgtcattgatcaattattatcaaagtatcgataggtatatacgcattcaatcaattgttat

SEQ ID NO: 22109 - DNA, 2113 bp, Heterodera glycines
gaaaaaaataaggacaatttacaaaagtcggtgaattttagaatggcatggcaacggaaaaagggaacactaaaaacaaatggtattttgattttaatatttttcaacaatttatttgcccctaaattacccattttaattcgctttgtctgtttgatcagtgatcagggtcttctgccgtcgttcacttgccaatgccaaaatgatggtcgttttcttcctctgctaccgcttctgtaacccttcgaatgtgtcgagaccagtaattaagtgccccccgccctcggggcattcataaccattccaagtaaatccccccacccccccccctaccgtaccctttccttctctccccatttgctcatccatcttccttcttctctcttgtgtaaatattatttgtgggctccaatgcgactgacaacgagcggactgtgcgttggtcgttctgtgacattcgaattgcacttggacaattagtccatttttgttaattggcactttcactagtgacgcaaatgaaaatgatcactaataacttgcgagaattcataaggcaaacaaacaaagaaagggagaacgaatttagcatttccatcggaaaactatcaaaatcaaaaggaatacataaatttgtaactcatattaattaatctttggcttgcaatgaatagtggacaatcggcccaaaatggctcatcccccgctcaatcactacgtaatgccaacgccaatcccattattcggcgggcgacgatttgcccctcgggcgaacttcccgcggtgcgacgaatgactgaaagtgaaatgaatgaaaaaggggggggggggggggagaccatcgcaggcaaaggcattgttcgtctgtccctctcctcccaatagcccggggattgcatggatttgatggcttcacaggtggcgcagtgccaaagaaaggggccaattcgaaggagggaaattccttcgtcggctcaattttaagaagaaactgaggaaataattattgtcctgaagataaagcataaaactttcagagaaacgcagaggaaatttgaacacaaatgttaggacaaattggaaaagcaattcaaattcaataaaaaaatgaaaggaaaagcgatggatgacttaaattgtttatgtttttgtttcgtttttgtatgtttatttttgcccgttttgtgcgaaatcccccccccccctccgccattcgttcgtttccttttctgctcacctttccttttccatttcatccctccgcgcaacactcagtggcaatggcaaaggccgataattgcggaaatatgtgccgatttgacacttcaaaagctttgccgcccttcgttgaggtcacacccaacccttttgcaaggaaaatgccaaaaaatctcctgggaatttccgttttcgctttcctaaaaaccgcgcttttttattgccattcacacatttctcgaacggttatgtaatcaatggccattttagtgcttattttaccattggaaaaattctaaatcgaatgaatgccatggcattggcaaagtcaaccaaaataaggcattgagcggaaggttaatccatccatcagtagcagaaaacgcatcgtccacccattcagtctcatccggtgatttggttggctttgggaacacaacgccacaccacgactaatccattcgcaaatccaacactaactcatcgtcggatgggtggcggggcgggggaagagaggtcgagattggtccgccgatgccttcccatccatcttcattttcttgtccatttgctaatctcaaccggggaatgttgtgcaacacaacatcagtcagtttggcctcattgcccgcttaattggactttcaatagcaaatcgccaaatttcaatgaagaagatgaagggagtcattgaattttcgctaataatttcgaaataattaaaaaagtttggaaacattgagtgaatttcttccgccgttctttgcttcggattctttttctcttccgctatttttctcacttttccggttctttttttgggtttggtaaaaaaaagaatcccttggctttgtttgagctatcatggccatgaaaatgaatggtgcagctgtta

SEQ ID NO: 22110 - DNA, 1123 bp, Heterodera glycines
ctcttttgctgccggtgcctttctccgccgcattttcttttaggcgatggatttaccgcctattttatgtatgggcgaggttaatatattcttaaataatctctgtttgttccaccattttctttttcccttgcattagcaaaaataataataataattattaatattattattactttttttatttgagtgaaattaatccaaaaatgtaattccatccgccgacttgtttgcttgtgaatgctaatttgttgtcagttattattttgctacaacaataataatgatgggatgggaacacgagggacaacggatgggggagagggagagagggggagggggaaggcatcagcagcaagggggagtcacgaggggtgggcagcaggggaggggtgtccccaaatgacccctaatgatcttccctcccttttctctctcattccctccatcccttaaaatcggtgcaacaaattccccgccccccctccttttttctgatcgattcatcagcaccccaaataaatttttatattaagaatttttctttttcacttcaatcccccttacgctctctctctctcactctctctctccatctctcctctcactctctctctctccccctctctctctccatctatcctctcactctctctcactctctctctccatctctcctctcactctctctctctctcactctctctctccatctctcctctcactctctctctctccccctctctctctcctctcactctctctctccctctccccctctctaagtctgttttaggttcattttctttcttttatctctctttgtctgtgtcactgttctttctccgttttatctcctcttccttttcactgcatcctttcatgttctcttccctcatctatttagaagaaagtggaggaaggtcggctgacaataaaagaaatgctttgcagatagcgccggcggccaatgtgtgtgtatgtacctctgctaacgaaaaagaatagagagaaaaagagtgggataggagagagagagagagagaaaagagagagagagagagaaaatgttgaattggaatgcaaagggagcggagagtgtgagacaacaatagaaagatga

SEQ ID NO: 22111 - DNA, 692 bp, Heterodera glycines
ggtggtgcccttccgtcaattcctttaagtttcagctttgcacccatacttcccccggaaccggaagactttcgtttccgggaagctccccaccagggcgaataaatccgccggcggatcgctagttggcatcgtttacggtcagaactagggcggtatctgatcgccttcgaacctcagactttcgttcttgcttaatgaagacattcttgccaaattctttcgctgtagtccgtcttgctacggtccatagaatttcacctctcacgtagcaatacgaatggcgccgtctgtcttcagttacccattatctcagggggagaaaggaaggagaagagaaggggggaggggagaccgattttggatcgaccgggagtggagggattggcgtggggagggattgtgagcattgttaactctgagcagttgcaaataattctaattattttttccaatttctcaaatccgcttcctcccaggcttatcttccccccggtgcccgcacttacagttgcgcccattgccgtgccaatttggcccatcacaatgagctgatctccaagtctttccaagtgaggagaaatgaaagggtagaaaaaagtgcgaagaaatgaggtccaaattcaaggggagtcagggcaaggcgtatctgttcaattcggtggtgaacatcgtttgcggaccggcggagg

SEQ ID NO: 22112 - DNA, 1415 bp, Heterodera glycines
actgaacgaagaaaactgaactgatgtctacagaataataaattttgaaattttacagttccatccggtgtgttaacaatgggagaattgctcggcatttatcagttcaattcccatccttataatcttcgtggagaccccgggctgtactcgttgaaattcccaagccatggccgaatttttgattggaacatagccaaggacaaccgaagggggacacttgcattgcaaattgaagaagtgtcggaatttgcgggagagtctgtctggagtagacgattaagtgatgccgtggagataaaaggattggcattgaaaattagagcactaataagagaaaagagtgaaggcactgatgagaagaaatgcttgggattttacttatggtgcgatccaaaagaaggtcatattttaataaatattaaaaaaaaaaattttgatcaatgataggagggccgaggaacagcgttttttcggcaacatttcgaattgtatcggaaaagatcaaagtggaaaattccattgggaaactttatgataatgttattgaccctgtatatcaatttggattcggaaattttattacttttttagtgagtgagaatttaactttgccttaattggtctaattatggttacttaaggaattaatggacccaagaaatggtttttacgacagagaagaggacaaagtgatattggctattgatgtcattctgaaagatgaacaaatggagaaatttatttccgatccgaacaaatccaatggaacaattttaatggacattgaaaaagtgtcggaatttgcgcgagaaatcattgggagtgaacgcaaaagtgaagctgtgcacatcaaaggattcccatggaaaataagggcagaagtagaaaagaaaaatgacaatgagaaatggttgggcttttaccttttgtgtgccgctccaaaaaaaggtgcaaaattaaagttaattgataataatagtaattaatttgcattgtttagaaaattggagttacgaatgttcttcaacttttcgaattgtgtcgcaaaagagtggcataaaagattctaagagagaaataaacgaaaaaagaactttcaaaagtcaaacgaccaacaggggattcccttatttcattccatttgtggtgaatgacaataaactttccataattgacccaattatggctaattaaggaactgatggacccggccaaaggcttttacgacaaaagcgaggacaaagtgacattggccattgatgtcagtgtgaaataagcataaatggagaacaaatcataaattattcatatgctctgggaaatctcgtccttgaattatcatcctatggacctttttttatcatatttcttactgtttaaatttgttcattatataaaaactggattggatt

SEQ ID NO: 22113 - DNA, 1742 bp, Heterodera glycines
  misc_feature (1590)..(1590): n is a, c, g, or t
  misc_feature (1615)..(1615): n is a, c, g, or t
atgaaattcagttgatgtcaaatcgcccgttgggacaattgagtgtcccccagatatggtccataatttaagtgaaaattagtttcctgaaatccttaattatgctgacatgagcatacatctgacattaattttttttttcatatcaaactgtcaaatctaagctttagaatgcaatcattttcaaacaaatataattatgactttcttctgaaaaatccaattacttttttgttatcggctgcttagaaaaagcttttcctcattaagtgcttttgaataatattctaaaaccgccttggcaattgggtttttgataatataaaaattgtaagcatattgaattgacattatcttagtttaggcaatctgtgtgattaaaattattccagatacatgttcagcaacccaagggaaacattaataaactgattttatgaaaaaactaatggatccattttaaaagattgcacaaaaatttactagataattcattttaaaaagttgttaaaattaaaattttattttttatttaaggtaataaatttttcttcaaaatggcgaaccaattctccttgttctttttgctcatcattttcaatggaatcatgagttacgtttttgttccggtagcattttttattattttgctaaatatttaatttctatttatataaaaaaatatttttgtgggttttaggtgaagttttagggaaaaaggaatattaattattaattttgaagatagaatactactagtaattttattttaattatataaatcttttttttgaaatattaaaaaaaaatacaaaatttttctattcatttgcatggaagagggagcaaaataatttttttgctcacaaatcaaattccagtagggagggtgctccaaattgctatttgctttgcccttaataatatttgttcagtgacaaatgagcaacttttccattaacgtttaaccactatttttgtgtggtgaaatgtaaaattttcaaaaaatttatttaaatttgatcaaattcatttcttcggtggctatttgacaaagaatatttcttctttagaaatgtgttgttttttaattgaaattgatctgccctttttaaaaatttttagagacgctgctatcaattctacacgactgatgatgatgaaattgttggtgaagaacaaaaatggtcccgcacagattgtcaataccaagttggatttacgttcgtgcagcttaagtctaaatgctattttatgaactgctcaaatggtattttttcgaataaaattttaacaattataatgtatttatttataatttattctaatatacttaatttaaatcaaggagatactaaccagaaaacatatgggtgcgccactgatttcgattcttcctataatgacaaatgctttccctatgaaaaggatggtaatgcttgctggatttgattcacgagtttaataggaaaatattacgattttcttccaagaataagattatgttcaatattgtcctgcaaaatttcaaaaaattttcatttgttttaaaaaaagatgaacaaaaatgttcgaacataagttttttanattcctctgtcataactttttttanagttaaagaatttttttttgaaattacagtctaatagagagtaatattcttatcgagagatttattagaatttcgtattcttagctaatataatgaataattttgagatagctatgtaattgcactg

SEQ ID NO: 22114 - DNA, 1143 bp, Heterodera glycines
tgccaacctaattagcagcattaccctcagtgctgttcttacttgaaggatcagtcggcgtggcgaagttttgccgaaacggcgatgacaaatggaaacatcgaactcggtcagtgagtccattggttaaatgcatttccaattgcaattggaactgtgcccaaaaagctgtgcgaatatttcggcacctcggtgacgtggcgatggtttgggcacttgagcaacttctgaacatcgaagaccaacaaacgctcagtggccatgtggccgcactgctcggcaacttcgacgaggccgacgattttttctccaattcgtcccaaccaaaacttgccctggaggtgctggggcactcgtcaacaattatttcaaattactttcaaattttccaatgattggtcttttgattctgatcagtctattaatttttgctccataattacttatgatttttcggctttatttgctgttagatgcgccgcgacgttcaacattgggaaagggcgttggaattggcgcgacaaacggcgcccgacgaattgccgggcatcgccaaggaatacgcggtacagctcgaatttgcggggcaacacgcggaagcatttcgctattacgaagaggcattgatcacttcatccagcggaaacgcatcgaaaatgagcgaagaacagagggaggaacacaattgggtgtgctcggcggggtgagcaatgggaaaatggacggagacggggcgggggggacactgaatgggatatatcgtaaaggatttacggcgatcagcaaagatggaaagctgatcggaatgcatctggatgactatggggaggactaattggatggaattcactgtttagactagccagaatggcacttcatatgggcgatctgaagaggtaagtttaagaaaactaaaatgattaattaacccagcaattgtccctctcccccaaaaggggcgtggaaatcgctttaaaattgccgagtcgattggccaagagagattgtggcattgtgcttgaacagcttagagtaattttgtgattgctattctaaatttagcttttcatttgttagcaattcgacgaggcgggaagtgtttacgaagcgggtcaattttatgatcgtgccgcggtttgacta

SEQ ID NO: 22115 - DNA, 1366 bp, Heterodera glycines
tttggaaaagcatggcattcaatgggctgagcatttgagtgccaataattgcttaaggacccaaagtttctgttccaattgtacgtcaaattgaaaatgtacagcgaagcggcaaagaccgcactgatcatttcgcatgagcaacgccagcagggcttttacaaaactgcgcatgacttgcttttcggttgggcaaaggccctttcgtccgccacccttttgatcatttccccaaggaatgtgccgaacccttcgcagcgagcgcatccgaacgccgtccgaaatggaaaactcactgatgctgctgcacagttacaatttggtcaaagttttgttgaaaaaaggcgacaattacgcgggcgggcgattgctgtgccgagtggtggccgacatcggccaatttcccgcacgtccgtgggaagggagtgaatgccaatcgcaaaaggttggaccattcagatgccgtgccgattctgaccagtgccgtgatcacgtgcacaaaaggtttctgctgttagtgctgagttcggcggatgattcccccaattttaacaattgaagccggcttcaaaaagtccgccttcaaatttgcttcccaattgatgcagccgacgaaccgacaaaaaattgacgagaaatacaaaaagaaaatcgagctggtgatcaggtggctgggctcgggcggcactgatcagccaataaatgcctttttgtgcacagaaaattcggccaaaatgcgcccgacgttgaggagcacagcgcgccctgtcccttctgcgacggtcccgtgaaagaatttgcgctgagctgcacggaatgtcaggcgaccattccctactgtattttaacggtaaatgctgaatttattcgatttaacgacaattcggaaaaggggcgacacattgtgaagacggactttgccctttgtccgcactgccaattcccgggaagtttcaccgaatttaacaagtcagtgatgagtgaatttatggtaaaaatgaagcaacatcagctcaacatattacgtattaagcatcaattattggtattagtgtagcttcatttaagtgcaatagaatcacaaatattttaaaaagcgtttagtcagaataattcaatgttaattttaataattgtaatttttaggtatttaaattcaagttgcccaatgtgctacgaaacgataaccgagcaaataatgccaagcaaattcgaacaatttatcaaagacaattctttttaaaataatgtgtaaaatcatgcacgcatttattatttaacgacaatagtacaaataaacaagcaaatgtacggtattcaatagagggcacaactcgaaaatgaagtactagtagttaaggcttat

SEQ ID NO: 22116 - DNA, 1033 bp, Heterodera glycines
  misc_feature (987)..(987): n is a, c, g, or t
tttaaaaattcataggaaattaaatttcataggtactactgctaaatcaacgcagagacgcctttccttgacctttttaggctcctgcaaaacctggtgcacttctgatcactactcgaaaaatgagtaaattaattttcactaaaaagttaagcctaaactttttggcctgtttaaagaggaattaaaaattttttaaaatttattcatctccctttttgatagaaaaagcatcagagtgcctaaaatagcttgtaaataaaatttggtgcgtttcagagcactttctgaaaaaataattatgaattaattttgcaaaaaataataaataattaaataaaaacgaaagactctgattttcgaaaaaatttttaaacccagctagctcggcgctcatttcagtgtaagttagtcctttaccggggagtttccctgcaaagtttggtgcgcttctgatcagtttctgaaaaaaaaagttaagcctaaactttttggcctgtttaaaaaggaattaaaaatttttaaaaatttattcatctccctttttgatagaaaaagcatcagagtgcctaaaatagcttgtaaataaaatttggtgcgtttcagagcactttctgaaaaaaataattatgaattaattttgcaaaaaattggaaaagtacgcaaaattgcaatgtctaaaatttttaaagaaacattatgggacagttaaataattatatgaataagcattattctcagctgttagccctgcaaaacctggtgcgcttctgagcactactcgaaaaatgagtaaattaattttcactaaaaagttaagcctaaactttttggcctgtttaaagaggaattaaaaatttttaaaaattttattcatcttcctttttgatagaaaaagcatcagagtgcctaaaatagcttgtaaatagaatttggtgcgtttaagagcactttctgaaaaaataattatgaattaattttgcaaanaaataataaataattaaataaaaacgaaagactctgatttcgaaaa

SEQ ID NO: 22117 - DNA, 1669 bp, Heterodera glycines
gccgaatcgggagcgctgaagtgtgtgggtgccaatcagtgataaagcggagtgagaaaaattttgggtcggggtttagggtaggacattaaaaaaatattgggttttgggttgagaaaaacttcgggtttagggtttagggttcgggttggcatcattggtatcaattaacaaatgcctatggcaaaatgcagtgtcaatttcaaaaattgccgttccgtgcccatatggtcgaccattatcgtgtgccaaccgacattatttatcattttattattttaaacttggctatttgctgctgcctctcaatttgtttaaaaataattcaaaaagcaattttatggatttctgctgtgattttctctttaatcttcggcagcctttgcattttctattcacaactcgatattacccaaggcttccgaacatttttttaaagtgatttttttgtgtcgagttggcggggggggggggggatttggggttctgacaatccgtcagtggacaagaacaatttgtgcttcttgtaggttttgcaatcaacatactttaagaacatttgatcacatttaccaaaatttcgagtgtttacaatcaaaatctctaaaaataagttgtttttttgtaaatctgatatcatatccgtgatcagaagggtgttatgtcgatcgacgaaaagtgcaaaatttgttaaatttttaactatcttagacgcattccaaactaataactcggggtccagccccgtgggcgggggtggctttttgcgggggcgggggttaacggggaacagagtcgggggtgaggaactgactcgcccccagggacggggcacagtttatggcggaacgccatttgaggccgcgaagcggccgaaggccgagaaatttttgtattttcagtttttcgatatttaattttttttttgttatttttttgaaaaatatcgatcgaaaaagtttagaatcctaaggcatctcgaaaaattctggtctagtaaggaattctactatctgctgaaacatttttgtatgtctaaattaatgaataaaatcagtgcttattctacggctaccttgggtcggtcgattcgacaattatcctcttgaaatgtggcgagaaaaggcaaatgaattccccgaattgaggattctgcttaattacaaataaacttttagtcttggcagaaaagcacaaaaattcctgagcgctccagcgatgagtttaaaataattaaattattgattttttcccactaattgaccattcttttcccccttaggcctcactttcgtttggccgtcattcttttgtccgtttcggtgtccgttctcggtttcattgaaccggcagtgaatgcattcgttttgatagcttcttccctgccctgtgccattttcatttaccacgagggcactcggtttgtttggcaaaagtttattttgaaattgtgtgaaatagttttgctatttctactcagaaaaggtggcatttccgaggttccccaattgactaaacgcattttgttcgcatggataatggtagtgagctgttggctggccgacaaaatgatttgcgacctgtggcttcagcttggcacgccgtatttgcatgccatttggcatttgttggctgcttatgccgggtgaggaaaagataattattgatt

SEQ ID NO: 22118 - DNA, 2321 bp, Heterodera glycines
aaaattgaaaaaatattttgaaatttttaaaaaattctaaaaatttcctaaactgaaaatgatcatcagattcgtgctcagcaccttaaaaatacccagaaaaaaatttttcaccctctttttcaacccaaaaaaaaattccgaaaatttctagggggcctagctcgaaaatttttgaaaatttcccgccatatggcacaccattcgatagagcttcaaaagctctacaattttgccctaaggcgtttttgcgataaaaccaacccctaacgagttatggacccgggactcaaatgtcccgctcaggccaaaaattttttctatttccgggaaaaaatcgaaattttttcaaaaatatcaccaatcgatagagctcgaaaaacggttgcttgaaagtggtctccgtttttctgggaaaattcgttaaaaattcctaaaattcaaaaaccagaaaaccgttttttaggcctagctcgaaaaattttgaaaattttcgaaattttaaaaactggaaaaatccagctcattgaactctacaataagtctgctggcaccccctcgctcagttcaaaccctggcgagttattcgcctgggactgaagtggacaaagttggtactgaatttctccatttttctgcagcccttcctattataggtagaggcctggaattttttttgttttttagaaaacacttcaacttagccccctcacagcgaacattttttgattcgagttttagaaaaaaagttatgggccatcaaacgcaagcaaaagtgagaaattagccgccgggactcagttggccctcggagaaaaaaacctatagttttcccggattctactcaaaaagttgtaagacccttccaccactttcagggcgctcccggccttcggccgggagattttgttttttgaaacgaaactcaaaacctatataacatatatactagcgggtgcgtgaaccgtcggctatttagctgggaaaaagcgcttcgcgcttcgggagcttcgctacctagactgtgaagcgattcaaattgatcgatttggttggagagatttttttgaagattagaagaggtacaactgtgattagaagaggtacaactgtgattagaagaggtacaacagtgattagaagaggtacaactgtgatcagaagaggtacaacagtgattaaaatttgaacaaaagtgattagaagaggtataatcatggtttaaaatgaaataaataagaaaattgtattattggatgtattataaatttatcaaattaaaaaaatccttttacttattaaaaataaagttagaaatttataatatagaatatttattgaaattaaaaggaattaatttctcgaaaattcaaattaaataaaacatttattaatcagaaaataattttaaataattaataaaacaatattaaagtaaataaaaaattaaataatttaaattaaaacattgttcaccaaaataatttaatttaaattaaaaatttttatttattattaataatacaaaacaaattaattaaaaaatgtaaaagtaagcaaaaaatgcacagaaaaataatgttacaccgtccggattcgaacctgccgcccccccccccagaagatgactcagaatccccaatcacacagggattctgagggcttaacgatgtaataactgaaatctgatgtcagattagtgatcagcagcctcaaatagccctaatgacatgtttttggaagatttttggtgaaaaaaattttccactcaaaaatcctggtcacccccctttggtcccgaatcccaaaatcacttttatttttataacaatacgcaaaacagagataaaaatttaaaataaaatttatattatagagcaaaaaattgcggatttttgtagtattttatatttccagaatatctttttagaaccgagttctagatttttttctgaaaattcgaattttttcagaaattctggaataacttttttccttttttagatagaaattccaaataaagtccataaaattctcctgatttttctctatttttaaggctttattcctgtaaaattgatcaacccttcgatttgttatgaatttttaaatattaggccaaaatcccgagggccaaaaaattgccaaaaaataaaaaatttttaaaaaattccaaaaattctgaaacgtaaaacaaacatcatattcgtgctcagcacctcaaaatagcccagaaaaatatttttcacacccttattcgaccccaaaaaaatttttgaaaatttctagggggcctagctcgaaaatttttgaaaatttcc

SEQ ID NO: 22119 - DNA, 1584 bp, Heterodera glycines
  misc_feature (16)..(16): n is a, c, g, or t
  misc_feature (55)..(55): n is a, c, g, or t
attcgcagtttcgctntgcgtcccgatccatccatcggtggccgccaccgacgtntaaattcgctttttcccactgccgccactcccatcgaattccatttcactgctgcttcttataatttgacagtttacgaaaatgccattggttaattgcgtctgtttgtttttccttttcgtaatttgcgtctttaggccaaagggcggtcgcctcaaaccccgaaaatgcccaaatggtcggcgtttggctgccccggggatacaatcagatcacttttcgcattttggtagcattttcgggcaccgcttttcgactttctcatttcagggggatgacaaacaaagcgtccgtttcactacgtcggccaaacgcatgggcaatttcgcctttttgcacttggaacatcgcgatcaaatggacgtattaaacagggaattgcaagtaagcaaagagaacggggagagcatgatcaggcattcattccactggtgatttcaggcggaattcaccttcacaattcgggcgaccgcaaagcgaaaaagggcaaatccaatggaaacatcggcgacggtaagaatggcaaacggcgaaccgcgcagtgatcggactgtttgatcagcttttgctcgccctttttaaccgattgatcattgaccatttgtccgtcgctctcttttcaggttcatcttcgcgtgttggatgaaaatgacaacccgccgatgttcaaggagctttcctatcgggtggaggttgaccacgacgtgccgcttaaccaacgattacttcgggtggagggattcgacgcggacgagggactgaacggggcactgagctactctctgatcactccctcctcctttttcttcatcggtctgatcaatcccccgtcgtccgttccccaattcatttgactttcgcattcagagccgatgaccggttggctgcgcaactttgcccctttgaatgtcgccgacaggcaaatccccgagagtgaattgcaattggaggtgctaattgaggaccgagcttcgcgactctttcgacacggtcaacggacggccgaaggcgcggagagtccaaatcccgtcgcatccattcgaaacaaagcgaaagtgcaaattgtgatcagacgaaaggaagaggaaaagccaaatgtgcccaatcgaattgcgacccattcattagttaattgcattgcttcaattaagctctcctttcggcttcttccgttcggccctttcctttccgaacccaccaaaattggcaccgtccgaattaatcactccgacgccgattcaatcattttggacatttctccccggcaaaacgcaccaaatgtcataaattgcgcgtggttggaaaggatcagtgcggaggaaatcgacctttggatttgtcccccttttcccgataaggaatacgaagaaaaattgcaaatacgactcataattaacaggcaggaaataaagcaaattactgctgtataaataattgttagattgatttccagaatctctgacaaaatcagcggaaaaagagaacagatcggcgagaaaaacggtcgaagtttgggcggacccatcaaa

SEQ ID NO: 22120 - DNA, 1703 bp, Heterodera glycines
atgtgaggctttagcctcattttgtggatttttgataggtcaatgaggctaaattttcaaaatgaggctttgaggctttttgtggttttttgagaaattatgaagatttttggggaaaattcgtcagatttttaaattttgattaattttgataaattggcataatgtttttggccatatttgtcgacaaatctgttaacaaatcgtattaaaaatcacaaaatttttcccggcggcgcctatcggcaccgccggcccaccttgttccccaaaaattttttgaaaaaagcgccgcaaaaaaatcaacttcggtttttcatgcttagaatttcacaaaatgtttatttcgaacaaaaaattgctcaaatcgatcatgacaatcaaaaataacattttaaacgtgttttgaataaattttataaaaatgaggcttttttgcctgccaaatgaggcttttgaaaattttgatctgggagccctgatttaagactgtgcccaaactcaaattgaaaactaattaccgtacttcctcgattataagccccagggcttctattgttcacccccctccaaaggtgacttatattcgaggggggggggggcttataatcgaggaaataaggtatcttttgaattttttctttataattttttgagcccggaaaattgagtccccgtcccatttcagttccactacaacatttacaatcgtgtgggcgacattttggatttgttgtcattgtgtaatgcatgcacatccttcatcatctattgtacaatgagtgcacaatttcgaaaagtcagtgaagatatatattttaaaatttagaaatatttattcttttaattttgaaaattgaacatttttttaaaagttttaatttaattataagattaattaaatataattttaaaaaataatataaaaattcaccatttttataagggattatatttttataaaattaaattttatcaatgtaaaatccgcttgttaggctttaaacaagccgtcgtataaaccataatttattcaattctttaattttcctggttcaattataaccacgaagcaaataaaaatttttaaatttttttaaaattttgtcaatattatacataattaaaaaatatttccatataattgttgaatataatattatatgaaatttaatgattcgcataattaaatttaattatttgatcaatcacttagactattttcggaacgcccacaatgagtttttttcggttcgatctaacaacgcttttcggcattcctagcctggtggacccaggcaaaattcaactaatcatttggcacaattcaaggaattccggcgcgtatttctgcccgcctacagccgactgaaatgttggcaacgttttgtgctccgttttgacgcgcccaccaatggcagcggaggcggcggcgccggtggtcggcacggaatgtgcggcggcggcggcgttggcacattgcgtgatgaaatttcggagggcaaaaatttgttggaccgggacaacaacggttggcaacacagcgcaccagcgcagtacggtgccaacatggcggcgggcgtgccatcgcaacgcgggacaatgggagaaggtatagtgggagccatagagatgagacaaactatggaaaattgatgccaaaaaataagtgggatacatatgcaactcccgagagtcgagaa

SEQ ID NO: 22121 - DNA, 1907 bp, Heterodera glycines
ttttcaaaattttacctataaattggctaattttcagtgaaaaactgtttataaatgatcaaaatttccaattttttccccggcggcgcctatcggcaccgccgcgcccccaaaactcctattttttcttagaaaatggcccaaaatcgcaaaatttggtaatttgatgaaaaactgttctcagcggcgcgccaaaactcttatttctcattagaaaaatgatacaaaaatcacaaaatttgatgattttttggtgaaaatctgtcaacaaattttaatcaaattttcaaaaattttcccggcggcgcctgccccctcttcccaaaaagtttttttggaaaaagcgcgcctcaaaaaagcgttttattgatttttaaatttggaataaaatttaaaaaaatgatttttgctttatgattttaactattaaaaagttgaatattttggggagggaggggtagcaaaacaaggaagtacccccagtgttaagcattttgttaagcgaatgtttaaagatttggtcgctggcagcacattgtatccgattactataatgtaacggtcaacgggattatgtgaaaaggccttaagaaagtccatttatctgcaacacaacaatttgtaacaactctttgctggattcaaaaagctgcggacaagacccattgaaaatttattcaaaaaactaattttcgaacgcccatatcttttttctaactcatccaaccggttagcatttgcttagaaaaagcttcttctcatcaattgctttcgaatgataccaaaattttcaaattgttgtcaatttctaaaaacttttacaagagctcattttcgggatggtgtgttaagtgaaatatcacaccacttaacacaaatttaatgctttttggtttaaaaattttattaagtatatggcatagtgtttatttttatttttttaatttcagtgacgaaaagtttagtgacgaaagggttcagtgatgaaacatcagcagggagccttacgagttggcatagcacgagttatgtatgattttccattttaatcgtttagatagtttgacttttatcataactagggatggtaaaaatatggactaaaaatcgcgaaatatggacataaaatggtaaaaatctcaaaatatggacataaatttttctaaattgaggggtaaattttcaaaaaaacccgaccaaaaaaccgaaattttccattttttgcttatctttcacataaattaaccaatttttaagaaaatttaaatttaatcaattttttgacaaaattttgctaaaaaatgtctttttcggaaaattttccggtctttggggttaaaacggccaatttagctgatgggggccgttctaataggggtttttttggaaaatgccaaaatatggacataaatcgcaaaatatggaaaaatatggaaaatatggatatagaaatccatcttaaaagcttcaaaccaagctaaaggcccccagcagctaaattagcctttttgagcccaaaacccgaaaaatttttcaaaaaatcattttttcgccaaaatttctcgagaatattgaataaatttaaattttcttataaattaataaatttatgtcaaaaataagcaaaaaagcgaaaatttcgcttttgttgttgattttgcgctaaaaaaattaataaattttagcttttatgtttctttcttttaaaatggttgcacgtaattgccgaaaaattcgagaccaatttccgatgttgaccgactaatgcaaaacgaaagccgtcttgtcaaagcgccttactgagtcaaaaaatttggaaatgtatctcatatgcaatttcaacaataaatttgaagaatttttgaactcaattttgaaaaatttatggccatattttgaaatttttg

SEQ ID NO: 22122 - DNA, 932 bp, Heterodera glycines
caatcaacgggactcaatccaccatcatttaatcttactggactcaacccaccaacattccaatcaacaggactcaaccctccagcattccaatcaacgggactcaatccaccagcatttcaatcactgggactcaatccaccaacattccaatctctgggactcaattctccggcattccaaacactgtgactcaaatctccggcattccaatctctgggactcaaatctgcggcattctaaacattgggactcaacccaccaactttcaatgacattccaatcactgaaactaaacccaccagcatttcaatctctgggactcaaatctccggcattacaaacactgggactcaacctcagcaaatttctttagcatttttaactttttgtgtgccttgggctgttgaacttttgcgccaaaggtactcgctcggccgcttcgcggcctcgtactggggccttcggcccccccacaattttctgcccaatccaccatcatttaatcactgggactcaacccaccaacattccaatcaacgggactcaatccaccagcatttcaatcattgggactcaattctcctgcatttcaatcactgggactctattctcctgcgtttcaatcaaaaggaccaacccaccgcattcaatcactgggactcaacccaccaacattccaatcagtgggactcaacccaccaacattccaatcaacaggactcaaccctccagcattcaatcactgggactcaacccaccaacattccaatcaacaggactcaaccctccagaattcaatcactgggactcaacccaccaacattccaatcaacaggcctcaatccaccaacataccaatcaacgggacaatccaccaacattcaatcagtgggactcaacccaccaacattccaatcaacgggactcaa

SEQ ID NO: 22123 - DNA, 2022 bp, Heterodera glycines
agaagaggtacaactgtgattagaagaggtacaacagcttttagaagaggtgcaacagtgattagatgagtccagcagtgattagaagaggtacaacagtgattagaagaggtacaacagtaattagaagaggtccaacagtgattagatgagtccagcagtgattagaagaggtgcaacagtgatgagaagaggtacaactgtgattagaagaggtacaacagtgattagaagaggtacaacagtgattagaagaggtccaacagtgattagatgagtccagcagtgattagaagaggtgcaacagtgatgagaagaggtacaactgtgattagaagaggtacaacagtgattagaagaggtccaacagtgattagatgagtccagcagtgattagaagaggtacaacagtgattagaagaggtacaacagtaattagaagaggtacaactgtgattagaagaggtacaacagtgattaaaagaggtacaactgtgattagaagaggtacaactgtgattagaagaggtacaacagtgattagaagaggtgtaacagtgattagaagaggtacaacagtaattagaagaggtacaactgtgattagaagaggtacaccagtgattagaagaggtacaactgtgattagaagaggtacaccagtgattagaagaggtacaagtgattaaaatttgaacaaaagtgattagaagaggtacaatcatggtttaaaatgaaataaataagaaaattgtattattggatgtattataaatttatcaaattaaaaaaatccttttacttattaaaaataaagttagaaatttataatatattgtagaatatttattgaaattgaaaggaattaatttctcgaaaattcaaattaaataaaacatttattcatcagaaataatttaaaataattaataaaacaatattaaattaaataaaaaattaaataatttaaattaaaaatttttatttattattaataatacaaaacaaattaattaaaaaatgtaaaagtaagcaaaaaatgcacagaaaaaaatggtttatgaaaaaatataattaaaaaaatgtattaataatttttaaaaaattattaaaaaatgctttcttttattaattaaaaataaactttaaatttacaatgattgagtattattgtattgaaaataaatttttgacaaattataattaaaaaaacaaataaattctttaatttaaaaataaaaaataattaattttaaattaatacatttatttaccaaaattatttacttcaataaaaatttttatttattattaataaaagaaatctattttttattaataaaaacattgaaaataatgaaaaaatgcacagaaaaataatgttacaccgcccggattcgaacttcccccccccctcaaaatgatgcctcagaatccccaatcacacagggattctgaggtcttaacgatgtcaaaagtaaaatgtgatcacgtattcgtgatcagcgtcataaactacccctaaagacatgtttttggaagatttttgtcgaaaaaattttttcactcaaaaatcctggtcacccccctgtggtcccgaacaccaaaatcacttttatttttataacaattcgcaaaaaagagataaaaatgtaaaataaaatttatattatagagaaaaaaattgcggatttttgtagtatattacttttacagaatgacttttcagaagggagttatgaatttttttctgaaaaatcgaaaattttcagaaattctggaataactttttttctttttaagatagaaatcccaaataaatctcataaaattctcccgattttttgctatttttaaagctttattgtatgaaaaattaccctctctgaggtgagttatgaattttccaatattcgcccaaaatcccgagggccaaaaaattgaaaaatatttttgaatttttaaaaaattctaaaatttcctaaactgaaaatgatcaacgagattcgtgctcagcacctt

SEQ ID NO: 22124 - DNA, 1678 bp, Heterodera glycines
attgaaaatatgtcaaaaataagtcaaaaaaatgaacatttttcaatttttcatcaacggttttttgacaaataaattaacataagttgaacaccgtgctacaaaaaatggccatcaaattttttcccaacctttctatataattatattttcttattacatattttacgattattacgattttttttacatttaatcggatcattaataattttattagcattgcatttcccattttataagtgcattatttttaattaaaaatggtatttattatgtgatcagcagatttgtcactatgggaaaccatcaaaaaccatcatccatttagaaagtgatgaatgaattaatgaataattactttttcaccatttgtgaaggcccaaaagagaaaaatcacaaaaaatggaaattaatagcatttggaattcattttatttaattatcaagaaatttcttttagagcaaataattaaatattttgctttttttatcgttattcgttggatattctcctgctcatcaaaaaaaagtcaattcaaatgtaattgatttgaaaataattttttattatttaaaatagatttttttgctaagttaccaatggcaatggttggagttttgaaacgaattcttttttgcgttatgttttgtcttttgggccagtgctacggtaagattatcaatttgttgtaaaaaatacgtgctgggacgttttataaatccgctaatgggttcgaaaataaaaaaaaattaacaaattaaaattcataacatggctcaaactcaaccaaattaatagggagccggaaaatccgacactggaaaatccgacacaagcggtaaatccgacattggaaaaactgacaccaactttaaattttaaaaataattttgattgtttgagttagtaaatatttaaaatatattaaaagttgaatacttaagttctttaaaataaataatttatggctataaaatagatttaaggtaagcatataataatcatattatttcaatgccctttttgatcatctcaaaaaaattgtaaacaatgcggcaaatggaatcagaggaaagggcatgaagcataagaaagtgtacgtggacaaatgacagagatttatgcgaatcgcatcaaccgacaaccctttattatttgccatcaatatcccatcgaatggcacaaccaattagttttttaaatccaattcgaaaacttgataaacttagccagatattaactcaaattacatttaaagttggtgtcgtgtcggattttcctagagccattaatatcccatagtatccttcaaaagctttaagtgttctttattagaaaattattattctttacatttttactaaagaataaaaaaggttcggtcaaaaaattcccacaatttttgaaattttaaggcaatttttagactttattaataattttaaaatataatattctaataataaaacatttaacgacgatattggatgataccatgaaatattaatttgtctcgatttgaaccaagatatgaatttttatgtgttgcattttttttactttcccacccattggcggttatttatgaaacctcctagcgtttaaaaaaataacatgacaatgcaaattccttgcccattttaatgataccccttaggattgacatgtaagcat

SEQ ID NO: 22125 - DNA, 1264 bp, Heterodera glycines
agcatgtacagtaagtatactgaatgtttacacattagagactgggtcaggcacagagtgccaattttacaaggctcggcaaaccggcgcggcaatttttggaattggtactcaattaaatgtactcaaatgaaaaaaccagtcaaaaatgatgacattttaaatttatttgcattttagctcttctccctcatttgcatgatttttgaatctcataaatttaattaagaaataagatcataatgaaagcgttacctatttcgtaggattcttgcttttgataccgtttttatagtaattatgctccaaggaaggcactaacccacacatggaaaatccgagcaattgcaatatgggaattgaatctcccacatcgtcggacatcggaattccgactccaaaaatgtcggacatcgaaattccgactccaaaaatgtcggacatcggaattccgactccaaaaatgtcggacatcggaattccgactccaaaaatgtcggacatcggaattccgactccaaaaatgtcggacatctgaattccgactccaaaaatgtcggacatcggaattccgactccaaaaatgtcggacatcggaattccgactccaaaaatgtcggacatcggaattccgactccaaaaatgtcggacatctgaattccgactccaaaaatgtcggacatcggaattccgactccaaaaatgtcggacatctgaattccgactccaaaaatgtcggacatcggaattccgactccaaaaatgtcggacatcggaattccgactccaaaaatgtcggacatctgaattccgactccaaaaatgtcggacatcggaattccgactccaaaaatgtcggacattggaattccgactccaaaaatgtcggacatcggaattccgactccaaaaatgtcggacatcggaattccgactccaaaaatgtcggacatcggaattccgactccaaaaatgtcggacatcggaattccgactccaaaaatgtcggacatcggaattccgactccaaaaatgtcggacatcggaattccgactccaaaaatgtcggacatcggaattccgactccaaaaatgtcggacatcggaattccgactccaaaaatgtcggaaaccggaattccgactccaaaaatgtcggacatcggaattccgactccaaaaatgtcggacatcggaattccgactccaaaaatgtcggaaaccggaattccgactccaaaaatgtcggacatcggaattccg

SEQ ID NO: 22126 - DNA, 1418 bp, Heterodera glycines
  misc_feature (1410)..(1410): n is a, c, g, or t
acaaaatccaaacagacgaaccggaaattgtttgaacctcatttggccaatttgccaacggcggtaaaacaaagaacaaaagcattggggaaaggcacttcccagcgaaatgggcgaaggtgaaatgccaaaaaaggtggatgggtcagcgaataaaattcgccaccaaagtggcgactacggcggctccctcccccccccccccctcaattaaacgattttggataataaatttgggaatggccggaagaatttcccaccgcttttcccttttaaaatatttgaattaattcaataattaaaagaaaagattaagagacttcgcgatcaaatagaagcaaagcggacgcactgctcgcatcagtcgctggtcgtcccacaatttaaacttcaaaaaggtccatatcctccccccctcctcaagatgccgcgcacttttcaaatgctgcaaaggggcaattcaatccctctcccccccccccccctctgccccgggtccatgaccttgcccttctcttctcttccctcactctttcacgtcgcgccaagcacagcacgacgaaaagcacgaagaagaagcaaaagtacccaaaggggagggaagaggaaaagggggagagatgagcacttatgaggggattttggaaaaccaatcaaaacatagagagagggacagagagagatgagagaaagagacggagagagagagagacaagaaaagagagagagaggaaagttcgattccccccccccccgccccagcagcagggttgttccgggtcgagaaaaatatcgggtcgggtttcgggtcgggtcggccgaaaaatcatcgggtcgggtttcgggtttcgggtcgagaaaaaggccgggtttcgggtatcgggtttcgggtcaattgacaaatttttaatttgtttaaaaatcaaatggcactgcaatatttgcagcgaattgcgccatttataggacgatggaaataaaaccaaatggaatcaggtttttcagccatctgctttgcttaaattcaagaaattcatacaaaatatctttagaaaaaggataataatgaatagggctgccaaaaatatgcacgaaaagtggccaaaatatgcgcataaatatgcaaataaagtcgtgaaatatgcaccaaatatgcaccaaaatcggaaaatatttgaagaaaaatggcaaaatatgcaaaaaatctgaaaatatgcacaaaaaatggcaaaatatgcatgaaaatgtaaaacaagccaaaatatgcaaaatatgcataaaggcccaaaatatgcaaataaaagtcccgatttttatacgcaaacacaaaaaagaaagtgtttttcgtactatttagagcatggagaagccaggaaaaaaatatgcatttgaatagttttggcagccctnaataatga

SEQ ID NO: 22127 - DNA, 333 bp, Heterodera glycines
tttcttggcggcgcctatcggcaccgccggagctccattttctttaaaaaaagggtctttgggtcgggtatcgtttgtcctttttttgaaaaaaaacttaggagccctgattttaaacgttttttttgttgcttttaaaccacttttttcgcggatactttttccaaaaaatgatttggcgaaacgtttgggaactatgggttatggatgttttggagtggtgtaccgacaagaaaatcgaaagtttcgacaatgatttctattttcccctaaaaattgattctttcgggtgtcgaaggttttttgggagtggtggagggggggggggactta

SEQ ID NO: 22128 - DNA, 1232 bp, Heterodera glycines
ccccccccccccccatgggagggggggggtcaaagtcgatctcaagacctcttggctgaccccccccccttgcacaggtatgctttatagtcgacataggtggacaaaggggcggttaatttcgtaaaattttcgggaaaatcgaaaaaacactggtaaagacgggaaattttaagaaaatgggaaaggaaattaaattttttattactcaaaaattttacacttagaattgtttttgttaaaatttttacatatttcgtaaatttttctattttagtaaatttttcccacttatttcgtaaatttaaaaaattatcgatagttttcttaaaaatctatttgcaagttgcacaaagttttcaaaaaaatttcccgactttgccttttttatttgaaaaagcaccacaaaacccccaaatggaatttttttttctcgacatatttactttaaaaatacctaactagtttcaattttctccaaacagactttgggacatcgaatgcggcaactgcttgcgcgtgttggaaggccacgaggagttggtgcggtgcattcgcttcgattccaaacgcattgtgtccggcgcttatgacgggtaattttatgcatttaaaaatcggtcaaaaatatgacgtcatatcagtgatatgacggaaattgaaataagccccagaaagcgaaaaaagggaacttatagcagttttgcggaaccattttgaggtcagattttcataaaataagacaaaatgggggggggggaagacggctacgggcctgcttaatacaaaatgtatttttatgtaaatttttaatttctgtcattcatatacagggggtgtctcaaggtgctacaccccccccctccgaaaatttaaaaagaacatagaaaaaaacaatcaaagtttttagtttttttttgcaaaattaaaaaggtataacgaaaaccaaaaaaatctatttatttgcccttctttgaattaccttgtctaaatgctttaacttattcaaaaaatatttaaaaattaatttttttaaatttttttttaattaatttttctcgtttctttttttgaaaatggcaagaagttttcacggatagcagaatgcttaattttcttattattttttaacataatttaaaaatatttgtttaacagcaaaattatgatctgggacctggcggcggcacttgacccgatgacaccgcccaactccatctgtataaagacac

SEQ ID NO: 22129 - DNA, 1805 bp, Heterodera glycines
aaaattctccctatttttctcgatttttaatgcttaaaatgagctgaatggaccattttgaggcgagttatgaatttcaaagaatcactaaattcccaaaccaaaaaatgacgattttcaaaatttttttacctccctccaaaaaatccaaaacgcaatataaagtgcatattcgtgttcatctcctcaaattaccccagaaaagtattttttggcaattttaggagcaaaaaaatttctcacgaaatgcaaaaccatggggtcccccctttggttttgcatttaaaaatgcatttttattttatatctttttttaaactcatggtaaaaacatgagataaagcacattagatagagcttaaaattctctacaaaaatgctctaagacaaatttccgctaaaatcaaccgctgacgagttataggcccgggactgaaatgtcccggtcaggccaaaaaatttttctatttccggaaaattttgaaattttttcaaaaatgccaccaatcgatagagctcgaaaaacggttgcttgaaagtggtctccgttttcctgggaaaaatcggcaaaaaataataaaattcaaaaacgaaaaattttcgagggggcctagctcgaaaaattttgaaaattttcaaaatctgaaaacgccatcggatgcagctttaaaaactgcacaaaagctcaagcggcgccaacccgctccgcttaacccccagcgagttattcccgaaaaacggaaaatgccgaaattgggtgccaaattttgccattttctgcagcattggcatttacagatagccccgccaaataagcgccaagttttcccaaacatttcaacttaaaatcctacctccaagcattttccgctcccgcttcttcccgcaaagttacaggccaccaaagacggataaaaaaaatttcacgccgtttcagcgccgccggcgctgaaccgtccaccggatcggaatgccgatagttttcctgaatgcgcctcaaaaagttgtaagacccttccaccactttcagacccctcccgacagccgttcgactcaaattagtttttaagacgaactgcaacttttctctatagtaatataaactagcgtgttgcacagtgggggatgttgtgggcagtatgctttttgtatgtatggacgggcgctgacatgagcgcttcgcgcaaaggacttcgttgctagtgcatgcgcggcttccataatcgatgcgtgtaccacacacatgctgtggctccccttccttatcaaacaataagatttttaacaattttttgcgggtgcagtttttccataaaacttctggtgaacgggcgaggggagggggtccggcggaaaactgatttttaacagaccaaaaaaggccaatttttccaataaaaggcaagcaatgactttttcaaaggaaagatttgattgtccggcttgttatttgtgattttttgaacgagttctgtccttatttgtgaatttcgtcatttttgtaccagtgttacctatctcaggaattgaaacagaaggaagggcacactctgaatttcagtttatctccaaatttgggcggctaacattcgaattccaaacgaaatgtgtgactggtagacttataggaaggaccacttttgtctaaaactcattttgacctgaatttacaaggagtgagcagaccgagttctacgcgagctaaagcctccgacccaacagaacgcaaattttaccacccccgccccctttctacaaaagcattgaattgaaccacttatgagaatttattaagcacaacacca

SEQ ID NO: 22130 - DNA, 495 bp, Heterodera glycines
gaaaaggaagaagaagagaaggaagaggaagaggaggaggaggacatagaagaggagaaggaagaggaggtggagggcatcatcatcatctgccgacagatggggcagaggaagcggcggagaatgggccagccgaagaatgaatgatgatgactcacattggggaaggtatttgaatgctctcaatcagcagcaattagccaaatggtggactttcgagagaaatgacaataaatgaatcattcgttatgccttgcgaatgcgtttgacttgtcaccccccccccccccctcctcccccccatccgtgccattatccattcttaaaagcctctttccccaagtttggcccgttttccttcccttccacctctcttccttataattcgcttcttccgtagcaacacacactaattggcaaatccgagcgtaactttccggggacaatgccacggaggaatggcggctcatggagacaaggtaaaattactccccg

SEQ ID NO: 22131 - DNA, 1050 bp, Heterodera glycines
tatgtttatggtcatacaaaaatgtagcgtcgtttaaatgcatgaaaattgttcaaacttcttgtaattcatataacccttggtatgattaaacagtcaagatttctctattattctgttaaccttcagaaaattttatagagttttaaaaagtaggggacaaaattagtgagtctaaattttttgggattttttgcttacaactctttgtaaattaaaaaaaattataatatagtagaagatacgtagagctacatttcaataaccaagtttaatttattttaactaaatttaagctaaattatgatgtattagcgtattattttcatgtctctaatagggaaaggcaccaaaacggcaaaatgcctaaaaaggcatttaaggcacgaaaatcccgaaaaaaggcaaaaaaaaggcataataaaagtcaacgtagaagcttcaaactaagtggaaactgcgtttttttatactagtgcgcagaaaaaaaggaatatgcctcaaaagtcggtctctgattcagggctcggatcgtaccaagtcactttcaaagtacatgcatgccaatttgcaagtacataacgggggaaatttgtgaaaaccaagtacatataaaaatttgaacaaaaaaattaaaaaggttaaattttcctcaaatttttttctatttttgcccggaatgattttaagcaggttttttttttgctattcaaacaaaaaactttttagggacttgaccggcgggggggggggggggaggggtccggcggtgtcgatagatttccaagtacgatctttgaaataagtacagttaaaaatttccacgcaaaagccgaaatccaagtatgtacttggcatccaagtacgaatccgagccctgctctaattataacgtaataaaattttgaaattttcataacttttctcatatgtatcgaattgatttagcatttgcttagaaaaaaaaattcgtttcaaaatcttttttttttaattaccaattttgttcagtttaattgtagatgaagcgagttatgactgatcaaatta

SEQ ID NO: 22132 - DNA, 1123 bp, Heterodera glycines
gaaaaagagattaagccatattttccaaattttttcccaaacaaacggcccgggggaacaaatttccagacaaattagtatcggggtaattgttctgaagaattcgggtggtaattcctattctgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttgtaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttgtaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattagtatcggcgtaattattctgagaatgcggttggaattcctattactgttgagcagaaaaagagatagccaattttccaaatttttcccaaacaaacgcgccgagaaacaaattccagaacaattattatcggcgttattattctgagaaagcggttggaattcctattac

SEQ ID NO: 22133 - DNA, 2574 bp, Heterodera glycines
ttttttagatcatttcttaggggtatattttctggaaattttttagatcatttcttagggtatattttctgaaattttttagatcaatttttaggggtatattttctgaaattttttagatcatttcttaggggtatattttctgaaattttttagatcatttcttagggtatattttctgaaattttttagatcaatttttaggggtatattttctgaaattttttagatcatttcttaggggtatattttctgaaatttaaggcgattgcggaaggccccatacaatcacaaagtgcttgccacgccatccactgggtgtgcagctattttgctgccgtatgggaagacagcccattccaccttcagactgggcagagatgtgtcactggacaagtttccaagcattccacttgagagcttctttgcccgacggattcgtgcggcacaactcatcatcagaaagacggttaaccgcacaagttacggcctgctttcaaacttctccgttgtttcgtcaattcaccacgatgaaattgaccatcaaccagagattaggccaaggccagcaagcttacttgcaaatgtgccgccaaattgggctcggagagaccggagaacacttctggattcctccgcagttcatcgtaaagagcagggaagagctgataaactttgtttatccaaactttcaacaactccttggcaatgacaaggagctgctcaaccgtttgatactcgcccagcacattgatacgtgcgacgagatcaacgaaatgatgatggcgaatgtgacaggtcaagtgcgggaatatttgtccacggacaaacctcttgacgatcgcccattggacatcgatgagatcgagtccgaagtggcagcattaaacagacgcacagactctgggatgcctccccactgtctgcaactaaaggtcggaagcgttgttgtcctccttatcaacaaaagtgatagggaagtgctgatcaatggcacacgcattgtcctcgaagaacttggcgatgatcgccttgtcggtcgtgtaatcaatcaatagcaatgctattggtggtcaagtgaggtttttccttgaaagatctcacaatatcttcgaggacaaaacgcctggtgggctaaaatacgcgcgtttgcaattcccaattaagcctgcattcgctatgaccattcaaaaaggtcaaggtcaaacaatccgcactgtcggcattgacctggaaagggaagtatttacccatggtcaattatacacggccttctctcgggcaacggacggcaacaatgtccgtgtgcatgctcccaaaagggagatcgatgcccaaggtcaagcgaaagtgctgtatattgtggccaaaaagatgctcaaattgcaacaaaagagcaatccaagccattttgtcatgccaactgttgcgtttggatctcgattgcataaatcaaacgagctatagtccagtgtgtgcggtactgatccgatgccgccccattctcatctgcacttaaatatgcatataaagtactgccacctggactaagggagggaggtggacccatgatgtgcgagttagggcacttccggtttccattgcattgaaatatgcaatgtgtcagctctttacatgagtgaaaccaagtgcatgtcggctgacgcaaagaccctaacataagcctaggtagcgaagctcaagaagcgcgcagcgctttaaagcagcagaaactcgcaagcacacacccgctagttgtttatacaaatgactaaatttaatactaggtacagttaagcacgaaaagcgcgtttttagcttgttttgggtggtttttgtgttaaaaatcgttattttgacaattttttgaggcaaattttgaaatattttttattatgagtcaggcaaaaccggaggtatttattgaaaatttatttttctttttgaatttaaccttaatcccttctcgcttccccaaaattcttatttttatctcaccgacataaataagtgagttaattaatgtctttttaaaattcatttttatttttccataaaaattcgtaaatatattattactagggatgcaatttatagttttttcactatttttttcctgagctctccgtggcctgaaatgcacgaaaaacatgttttttcgactgttgttaagctacttttcgagttattagcaaatattttctggtttttacttttagcaactaaaaaactataaaatttttgaaaaaaactattttcaactattttggcgttttgcccaaactttttttagaaactaaaaacgaattattttggcactttttagcaactatttacctatttttagcaactattttgggttttttagaaactaaaaactaattattttggcactttttagcaactatttacctatttttagcaactattttgggttttttagaaactaaaaactaattattttggcactttttagcaactatttacctatttttagcaactattttgggttttttagaaactaaaaactaattattttggcactttttagcaactataaattgcatctctaat

SEQ ID NO: 22134 - DNA, 2087 bp, Heterodera glycines
taaggagacgaaaacgcacagaatcgttcacagccgaaggttcgtcaatcggcgagggcgaccgttggacgctgatcagagacattagacagagaaatgttagcacaattattaaaccaaataaatattaaatatgtgtaatttatctgctttttgaaaatgaattgagcagtcaaaagaaacattatttgcatcatctatccaggtttaatggttgtgtaatttcagatttcaaataacgaaattccagtgctggaaattggtgttgtacagcagctaattaaatatgaatcacgaaaataaacaaaacaaaacgcattcattagagaaagcgaattaaccaaaagcatagacatagaaaagaagacaaagttaataagtgaaacagagaaagagaattaggaaaagaaagagaaagaaaagaaaaaaagaacaagagaaatagtgtgtgacattttcctttttctttcgcagtcttttcaacccatcttttaatagtttctttcttcataagagtttattttttgacttttcttaaaattggagcaataggtactgcaaagtttaagttgcctgaaagggccataaattttgaatgtctctctttgacgggttaaaattgtaattaataaagtcgagtgataatagttatcttttatccgatccttctcttcagggatgtaagggggaaggttaacaaaataattaccgcattcaacactaggctttatcataacataaatgacactttaaacaaacagaaaggcagcaacaacaataatggcgcttgttacaatacacaataatggcataaataagcctatctttgtcacgccttaggcttaacagtgtacacatatcctagtctgaacattaaattggcggaaggggagcataaatttccttttgctgcaattttccggtgccatagcgagccgatttcttaggtggcgcgtacatgtcatctgttggcatcggtttctttggtgcagatttaggccgtgcggttgcagtaacgagtagcaaacgtccgctgccgtcgtccgacccgttcgagcgcaacgattccggcacttccactccgaatttatgcggcatcgtcacatctcttgacgcgtccgagcgcaatgattccggcacttccactccaaatttgggtgcgatcatcgctttcctgataaatggcccgcgtccgccgtcctccctgtccgagagcaatgattcaggcacttccacgccgaattcagacgcccttgccgaatagcctgtgaaatgcattgaatgagaaatttctccaaatattcatcgtatacgacgaatcatccatcaccttcgtgtgacatttgactctgatttcccgccggttgttccatgcgacaattgtgcaccacaattcttgttgctgctggtctccccattttcttcgtccgtttgtcatccatgtcatcatcacccccaaccgtatgagaagcagactttctttgtcgacgaaccaccagcacaatgacaatggtcagaacggcagccaaaatgatgagaccgcctctgaaagttgggggaaaaatgtgtgccattttaaagaaaaaacaaatgaacgcacccgaggagggcgtagaaaagcaaatccttcgtgttcaaaatgccgcccttttgccaacactgctcaaccaacaattcagcaccgctttccgccttgttcagaagaaccacgacatcgtccttaaaaatgcaattaaatggcaattaaaaataaaaattggaaatgaaacgcacaataaatgctttccattcgcactgaagcaaatcgtcatcatccgagatgtttttccacaaagacattgtgaaatgacgcgcattcggcaagccttcgaccggagtcatttgaagaaagttgcaggagacattcagaaaggcacatttgccttggccacagttctctccgaagcgatcttgaccctgaaaacggcacaaattgttcgtaattaacaatatttgcggatgaaaaacactgaccgcacgtctctcgagggcaacaactctctcatcaaaggcacaaccgtctggcattgaacacgagaaaggaagga

SEQ ID NO: 22135 - DNA, 913 bp, Heterodera glycines
taatccccaatttccccagctcttagggtaatggaaaaaattttgaagaggctctccggaccggattaccatcggggttccgaaataaaaaattttcctaaaaagaaatacccttttttttgggaattaattcccaatttccccagtttttagggtaaggaaaaaattttgaagaggctttccggaacggattagcctcggggtttcgagatagaaaattgtcctaaaaagagataaccctttttttgagaattaattcccaatttccccagcttttagggtaatggaaaaaattttgaagaggctctccggaacggattagcatcggggttacgagatagaaaattgtcctaaaaagagatagccatttttctgagaattaattcccaatttccgcagctcttacggtaatggaaaaaattttgaagaggctctccggaacggattagcatcggggttacgagatagaaaattgtcctaaaaagagatagccatttttctgagaattaattcacaatttccgcagctcttagggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagccatttttctgagaattaattcacaatttccgcagctcttacggtaatggaaaaaattttgaagaggctctccggaacggattagcatcggggttacgagatagaaaattgtcctaaaaagagatagacagttttctgagaattaattcacaatttccgcagctctta

SEQ ID NO: 22136 - DNA, 1700 bp, Heterodera glycines
  misc_feature (5)..(5): n is a, c, g, or t
agttntggtctcggcatggcccaaaaacaaaatttgaacgactcgtggaggactatcgatggcgcctgatgggccaggacagccaaaatgggctcaacgatctgatcaaagcgttgcgcaactcgaacatcggcttttttgatcggcactcaagtccatcggcactgaaaattctgcggcgagttgactgatgcgcaaattggtccccatcgaactgagtacctctgttcttagaggatgatgtgacattttgatcagttgcaattcatttacatgttcatgttttttgcaatagcattattatcatgagaattttgtatatatcttatatatataaatatattttattttaaattatgtaaattttaaatgtttttattttttgaaatattccaattaaaaaaaaattaaaattaaacgctagggtttaaattttgctttaatcattcgaatttatgacttttatagaaattttatggtctaatttacatttatttaaacttttttatcgaaatcgtttcttaattatcaataaattaaatagtaattaaaaaatgtccaaaaacttttatgtttggttttaatttaattatttttccccattttaaatgctttctttcgatacaaatacatttttccatttttccaatcactttttccaataatccgatcacttttgtctgtgtcccaattcattttttgttacacagtcagttccgtgaccaccgatcgcaaagtgaaagcgtcaaaattgaaagggacagaaatagtgcacagaaaaaatgcgaggagagaagcaaagagcgacgaaatagtgcagttcggatttagactaattgtccatgggaaaatcgggggattccaatttagaagttagaaattttatttttcatttattagtacatccctttgtttggattctatacatccctttgtttggattctattccatttaataaggttgatcgagagtctcaatgaattttcggtttttttttgaggggggggggaggggggtctgtcttaaattttggccttaatccccaatttttccagccttaattctcggggtttttttttgggtctcagtctccactctcgacctaattcccgggctcttcagccataagctcaaattttttcatgaatctcagtcttaaatttcggcgcctaaatcagttatcggtccatctcctcgttttggattctattccatttaatttttttgtggggggtctcagtcttaaaattcagcgtaaattcccggtttctccagccaagaattctcgcggattttttttttggagggcgggggtggggttggtctcagtctccactctcgacctgattcccggtctctttagccacaattctcaaaaaaaaaaattcgtgaatctctgtcttgaatctggagcctaaatcccccttctcggttctcgagtctcgggaaaattctactttctagtctttctttaattattccaattttacaattttaaacatttcttttttccatagaaattttctttcgtatacaaaaagtaaaagaaaaaatggatgtgcaatttttcattatttttattggtccaaatgatggaattgtgaattgaatgaatgaaaaggaatgaatgaatgaatggaaggaatgcgcgaagcctgggggagaatggcgagcaaaagaaatgaaatcgactcgatca

SEQ ID NO: 22137 - DNA, 1455 bp, Heterodera glycines
  misc_feature (15)..(15): n is a, c, g, or t
  misc_feature (29)..(29): n is a, c, g, or t
tttcctaacataaantttgaacaaaaaantcggaaaatcctaattttaaatttttgttcgagttcgggattagaaattggtcaaaatagatgtcaaattcgtgatcagcgacctttaaaacccccgggaccaaattttcacggttttctatcacaaaaattttttgcaaaacaaaagggtccccctattgtttttgataaaattcgaaatggacctctttttaaatagcgccgtgatgctcgagacccaaaaaacgacagaaaattaaataaagttcgatttttttttgtcgagcagcactttccccccccccccccccccctcgccgtgtgaatgccatgcgattttcttttattgggtaagaagaaaatgttcattggtgcactcattttgtcaattttggcaaattattacgttggctaatcaaaagaaattcgaaaaccaaatgaaaatttcggttgtactgccgcacacacaaagtaaaaaaatgtgccaatgatggcgtgcgaaataaaaatcgcatttgggcctaaatttcagcggattgatcatcgccgaagggcatgttcgaattgcaaatttatgcgttgggaacgtaaaacatgcgtttttttcttttttaaaattgggtgtgcggcagaatggtaaccgaaagtacgaaccgaactacaaatgaacagattttttatttatgcattcgataaattataattgtgaatttacaaatgtcaaaaggataaataatgcgaatagacaacaaatttaaataacaaaaattatgatgtgaaatgagatgaaagggagagcaaatggcgaagaaataatcgtcgaatgaattgaatttaagtgtcatcaataatttagtaaaagtttcgctacaaaagggtaaatatttcagtgactgaaagcaaaaaatgaaagtgagaagaaatttaataattaaagtgtttaaaagtgggtaattatggtcatgtccgtttcaaggatttctgagttcgttgtttttctcggccccaattcgttcacaaatttcgtacatatattcggagaaaacggagatcagactcagttcttgttcggattcacctcgcaaaaatttaagcaggaaaacgtgactttcgggaaggatggaatagccgacgatggcggaccatttcagaaaaagggtcctcgtcttaaataaacggacgaacaatgggaaaagtttggcataaaagcaaatggaagaaaaccgaaccgaattttatagaaatgttaaaaaagaagcatacataccttttgagtgtcctcatgttgcactttcaaaatgatggaatgtgagctaacggacattgtggcaacgccgccctcgtcagaattgggcacttcaaattgacattgtggaaaaacaacgctcgaatagccgtccaattggcgtggcatttccaggtactaaacataaaactctaaatgtga

SEQ ID NO: 22138 - DNA, 2194 bp, Heterodera glycines
gcaatcatagaaaaatgtttgataattattgtttacttaataaagtacatagaaattgaaaaactcaccatagaagagataatctgttatagaagacaattgagaaattattagtgaaattaagatttctcttaacagggtaggcgaaaaggactgcaatttgttaaaaatattaatacagtttagttccccgtttttagcatagtcgtttagatgtgatcccagtgcaattaagaaagtaggtatgaatgcttgggaaaattttgttgtttaaaacagagcaaatagagcggtgtgcgaggaaatgcttatcgtttaaagtgggtattgaagaaaaatcgacaaaaaatttaatgcgctccaattgcatgggcgcctgtaaattcgaaaccagcacaaaaaataagcctcatggcaaaattccagcgcaattggtcggggctatagccatggaattaccacaaatttcgacgacattcaagactgctttttgttaaaatatgaacacatatttaaccggaaataatgaaaggtgtgtgcttgatcagactttatcttctctatttgttactatcgattgcttatagaaaattgcataagatttatacaattaataaaattacaaaaaaaaattgtttatttaattgaccttttccaaaacataatgaaaataaacaagcctatgattttttaaatgctttgcaatcatagaaaaatgtttgataattattgtttacttaataaagtacatagaaattgaaaaactcaccatagaagagataatctgttatagaagaaaattgagaaattattagtgaaattaagatttctcttaacagggtaggcgaaaaggactgcaatttgttaaaaatattaatacagtttagttccccgtttttagcatagtcgtttagatgtgatcccagtgcaattaagaaagtaggtatgaatgcttgggaaaattttgttgtttaaaacagagcaaatagagcggtgtgcgaggaaatgcttatcgtttaaagtgggtattgaagaaaaatcgacaaaaaatttaatgcgctccaattgcatgggcgcctgtaaattcgaaaccagcacaaaaaataagcctcatggcaaaattccagcgcaattggtcggggctatagccatggaattaccacaaatttcgacgacattcaagactgctttttgttaaaatatgaacacatatttaaccggaaataatgaaaggtgtgtgtttgatcagcacttatcttctctatttgttacactatcgattgcttatagaaaattgcataagatttatacaattaataaaattacaaaaaaaaattgtttatttaattgaccttttccaaaacataatgaaaataaacaagcctatgattttttaaatgctttgcaatcatagaaaaatgtttgattattattgtttacttaataaagtacatagaaattgaaaaactcaccatagaagagttaatctgttatagaagaaaattgagaaattattagtgaaattaagatttctcttaacagggtaggcgaaaagggcggcaatttgttaaaaatattaatacagtttagttccccgtttttagcatagtcgtttagatgtgatcccagtgcaattaagaaagtaggtatgaatgcttgggaaaattttgttgtttaaaacagagcaaatagagcggtgtgcgaggaaatgcttatcgtttaaagtgggtattgaagaaaaatcgacaaaaaatttaatgagctccaattgcatgggcgcctgtaaattcgaaaccagcacaaaaaataagcctcatggcaaaattccagcgcaattggtcggctataagccatggaattaccacaaatttcgacgacattcaagactgctttttgttaaaatatgaacacatatttaaccggaaataatgaaaggtgtgtgcttgatcagactttatcttctctatttgttactatcgattgcttatagaaaattgcataagatttatacaattaataaaattacaaaaaaaaattgtttatttaattgaccttttccaaaacataatgaaaataaacaagcctatgattttttaaatgctttgcaatcatagaaaaatgtttgattattattgtttacttaataaagtacataggaattgaaaaactcaccatagaagagataatctgttat

SEQ ID NO: 22139 - DNA, 1342 bp, Heterodera glycines
gatcaaatttttaaacttttatatgaaacatttattgcaggaaatgacaaatcccaacctgggtgagcacacatttcagataagcttcctatcattatttcttagaaacaactaataatctgttgaacagttatttcaaaataaattcgaatatattagcttattatgcatcttcagtgtgcattctaaaataaaatcattttttgttctaattttatgatttatttgttttctgttgactaaatagtcggttcttatagcaaatattaatttatatttgcgtagcttcaaatgagcattctgccttcaatttcgaagggaagtgaatttttttataataaattgatagagagcaaaaagcacaattgtataatattcaaaaaatttatctatgcatttgttgaatgttcctaaacccgatcaaattttttaaacctttatatgaaaacatttattgcaggaaatgacaaattccaacctgggtgagcacacatttcagataagcttcctatcattatttcttagaaacaactaataatctgttgaacagttatttcaaaataaattcgaatatattagcttattatgcatcttcagtgtgcattctaaaataaaatcattttttgttctaattttatgatttatttgttttctgttgactaaatagtcggttcttatagcaaatattaatttatatttgcgtagcttcaaatgagcattctgccttcaatttcgaagggaagtgaatttttttataataaattgatagagagcaaaaagcacgattgtataatattcaaaaaatttatctatgcatttgttgaacgtttctaaacccgatcgaattttttaaacctttatatgaaaacatttattgcaggaaatgacaaattccaacctgggtgagcacacatttcagataagcttcctatcattatttcttagaaacaactaataatctgttgaacagttatttcaaaataaattcgaatatattagcttattatgcatcttcagtgtgcattctaaaataaaatcaatttttgttctaattttatgatttatttgttttctgttgactaaatagtcagttcttatagcaaatattaatttatatttgcgtagcttcaaatgagcattctgccttcaatttcgaagggaagtgaatttttttataataaattgatagagagcaaaaagcacgattgtataatattcaaaaaatttatctatgctgtaatggctgatcgaaaatagctatgggagctgaaaatgctgtttgcgcaaaacaacaaattccaacatgaaggaaagatggccccataaacacagtcatccctcc

SEQ ID NO: 22140 - DNA, 1166 bp, Heterodera glycines
tggtgtctttgtcaatctattattttttgaattgaacacggttgcattcaaaatgaaagtcggggtcagttcggcgcgggcctttccggcaccgccaaatttgaaccaactaaattttttgtttttgaattttggagcctaataaagagagagagagagagagagagaaattattgcatgtcgaacggtttcggatgaaatcaattattttcaaaaattttgctttgcttaatcctatgccattccattacaattttttcttttccatgcacagattgacgagaactacaaacatttccgcacttccaaggggcttccgccggtcaattccagcttttacgctccatcaatttctgtaaatttctttttttttcccccaaaaatttcctttcccttcaatcgctccgtcaatttttagcccctcttcgttccaacgtcgtcatctctttcgcccagcaagcaactgaagcgcttttcatcaataagtcgtggcggtgacggcacaaatgccaattattttggtcgtcgtctcaatgcgttcaaattgggccgtcaaatggtcggcggtgtgccaagcatttcgttgcttgcccaattgaccggcggaaatggagcgcccgcctttctcccgcccaatgagggtggcgtgctcaccaaattgcgagcattggtgagcattgttttcatggatttaaaaagcagttaaaattgggatggaatcgatttgaaattaaatatttgttttcgcaaaatcgcatgttcccgaagattcgtcgggaaatgggaatttaaaatttcagccggcgacaacatgggcgattgggtgtttgaattggatgcaataaatacagtacgcctccatccgacaaaaattttaaaaattaaatttattttcattttctaaaaattgtcggcgagatgggagggggtgggcaaacgaggtaaacccgtcagatttgcgtgggtggttggatgggatgtctgaacggggtgcactatagtaccctttccccccccccctccctcttcgacaaaaatgtttaaaaaatcattattaaataacactaggaaaaatttttattttctaaggggaggggggggggggaacgagcagttcagttcccctcatattgagtcaattagcttttcttcacttaccatctcat

SEQ ID NO: 22141 - DNA, 2302 bp, Heterodera glycines
tgtcttatgcgatgaactctgggtacttccgtgttttgctacccccccccccccccctcgaaaaatttttaaaaaaatcatatgctaggagttttcaaggtcactctgactatgaaaatggtgtttgtttttcgggcctatctatgacatctagtcatcgatttaataaaaatatctatgattttttgaaattaaatatccaactcctgctgagctttaaagctattaagatagtaaaacaatagccattttcccgttctagcaaaaaaatgtattcaccccccccccccccccaattccatcaaagagtcgactgtttcatcattgaacaataaactatggcatgtaaaattctaaattagaaagggaatacagcatcaaaaaaagagaatcgattggaaataaagataagtgaaaaaaggaacattatggaaaaaatcgatgcgataatttccgcttttaaacacaattttggaaatatcaagttaaattgagagaagtttttctctcaaatttccttactatttttctcttctctgctcgccgctaaaaatggtagcagcgacaagtcagagaagagaaaatagtaaggaaattgaagagaaaattttatttttttattcaaaacaatttagtgattaaaaaaagattcagacttattttaaaaataaatttgtaacatttttaaattaaaaaaaatttactgcattccacattgaaatttcttcacggatttgcaattcgtcgcgttccgaaatttcgcacaacatttgattagaaaaggtgcaacagtgcttaaaagaggtacaaaagtgatttgaagaggtacaataatgattataagatttgatgtgtatgattattgaatttttttgaaattggaatgaaattatttgttggaaaattaaaatgtaactacaaacgaaattttgttgtgcacggacgggcgcttcgcgcccgtttttaaattttgttggcttggacgggcgcaatacaacagtgatgaaaagaggtacaaaagtgcttaaagaggtacaaaggtttataagaggtacaactgtgattaaaagaggtacaaaagtgattataagatgtacaaaagtgcttaaagaggtacaaaggtttataagaggtacaactgtgattaaaagaggtacaaaagtgattagaagatgcacaaaagtgagtaaaagaggtacaaaagtgattaaaagaggtacaaaagtgattaaaatttgaacaaaagtgattagaagaggtacaataatggtttaaaatgaaattaataagaaaattgtattattggatgtattataaatttatcaaattaaaaaaatccttttacttattaaaaataaagttagaaatttataatatagaatatttaatgaaattgaaaggaattaatttctcgaaaattcaaattaaataaaacatttattcatcagaaaataatttaaaataattaataaaacaatattaaattaaataaaaaattaaataatttaaattaaaacatttgttcaccaaaataatttaatttaaattaaaaatttttatttattattaataatacaaaacaaattaattaaaaaatgtaaaagtaagcaaaaaatgcatagaaaataatgtacaccgcccggatccgaactcccccccccccctcaaaatgatgtctcagaatccccaatcacacagggattctgagggcttaacgatgtaataattgaaatctgatcacgtattcgtgatcagcggcccaaataaccactaaagacatgtttttggaagatttttggtgaaaaaatttctcaactcaaaaatcatgtgctcccccctttggtcccgaatcccaaaatcacttttatttttatatcttttttttaaaaagggataaaaatgtaaaataaaatttatttggtagagcaaaaaactgcggatttttgtagtattttatttttccagaatgtcttttcagaaccgagttctgaatttttttctgaaaattcgaatttttccagaaattctggaataacttttttccttttttagatagaaattccaaataaagtccataaaattctcccgatttttctctatttttaaggctttattcctgtaaaattgatcaatccttcgatttgttatgaattttcaaatattaggccaaaatcccgagggccaaaaaattgccaaatattttcgaatttttaaaaaattctaaaatttccaaaacttaaaataaacattatattcgtattcagcacctccaaataacccagaaaaaatttttcacaccctt

SEQ ID NO: 22142 - DNA, 1669 bp, Heterodera glycines
  misc_feature (902)..(902): n is a, c, g, or t
ccccccccccgctctcgtcctcccccatttggacccatttctcccccttttgctccccaagtgcccccccaccctctttttgcaggattatttttttgcccatttttctctcgattatttatgtttgtcgttgcagtgcctcaaccagataatgaaataaataaagaaagggaaatgaatgattgattgacggagggagggaatttaattaacaaagggatttatgcaattgtcattgggacaatggtgcaaaagtggcagagaaactaatgggccaaagctgaaaaattatagttcgacaacagtcattatgccgaaggaggaacgggtgtcccccccatccaattttgggagcgttgtgccaattttggcacattggaatgccaagaaaagaattgccaaatgaagaaaagcttccgtttctgtggtaatccgaaagcatttttgtcgactcttttttgagatgtagcgaaagcggcaaggcggtgccaaattctgttggtgttgaagatgacaaatgtaatgttagagactgatgggggagggagattatgttggcattggcacttgggggtatttaacacatcattaggcaacggaaaaacctcaacagagggtgggcacttccaaaggcttcttcttcctcctccattttccgttcgttcttcctcagcttaatggtggtgccattctctgctctccctggccctcccaatgctttttcttttttggcttttcctctccttttggccccttttgtctgtcccaatttgtgtaaaacggacacaaagcaaatttgcatccattcattggtcattcgactgcaattcctccctctctcccctccgcccaaattgaattggcccatcatccgtcgctgttgcaatgttacgcccccggcncataaaattgggtgtcaccgtttttacccgtttctgccacaattcccattcactcaacgggaattgatagttggcaaacacaaaattcatgcagaaaaagtgaaaggagcaaaaagtgccaccgatggaggcggaggagaaaaaagaaagaaaagcaggcaaattcagaggaattttaataaaaaatttatttgcattggactgacactttcccccaatgggaaaagcaaataaaaacaaacacaaaaaggccccgccaccgctcgaacttttttaaaacagaagcaaaggcaacaaaaaacaaacaaacatttttgggccgtattatttccatggcatcaaatccaatttttgtggcaatggcggcgccgtgtgggctttacgtttttgcgatttaacttacgttttcatgcgtttccaatgtccgctttgagttcgcccacataatccccgcaccccccggggggaggagagatttgctaattggcttagtaagtgaaggccaacgaaaaggaatgacggcaaaaatgtccagctgacggcacaaagtgtcaacgcagaaagtggaggaaatgcattcgagaaaaacacaataatacaatggaagagaatacaaattattgagattcaaaaaatattaggctaaaaggaaaatgaatgaaacgggcacaaaattgccaaatcacaattagactttttgatcactttcccttctttgactgttcaaacagtttgccgctcgtcaaagcatcgcaaatgcgtcagct

SEQ ID NO: 22143 - DNA, 1942 bp, Heterodera glycines
ctgaccgggaggttacacgccgagaatgagcggggggcgtggtcgataagactgatcaaaaaggagggcgaagacgcggttcgattctccgccagaggctaaacagttctgattaggctcacttttgttcctcgtcgacggatgtgttcagtgtccccacggccgagccgaaacgaacgttcaattggtcaacaatttcccttccggcaattggttcagcggatgcgacgaagaacggaaggtgatcaggtaaaagtgatcaaattgtgaaaaaagagatgaaaggaaacagagggaaaatgatcaaaaaatacgaatgattgtgtcgatcggtagcaaagtgatcggtcggagtgaaaagccaatctcgaatgccagccgattgattagccattcaaaaaagacgatcagaaccgaacttaaaattcttcatcactactcaaatatgtagctatcactttctctttttgagttccgtcaatgtttcggtgcgcgactcttcttcgagggacggggtcgaaatggacggcactttttcgttgggtggcatccttcggcagagagaatgcggcggattctttggcattggcgggggccgcgagggcaatttccaatcgctgatgctcgaacttttgcatacgtaagtctttttcgtgtcaattgtccatttattagtttcgttattagctgcggacgaaaaaaggcaatgcttttgaaagtgagattaccaaaattggacatttcggcgataaatgcgcgagggaaaatggcagaattgcgcggcatttcgatcgatttggacatcagcaagggcgggtggtgagcatcttatattggtcgactaatagtgccttcttgatataagggacatgcaatgggtggactatgagaaggttcgaccaaaacagacggtgccggaacagccgcaagacgaggacggcacttttggggggaggcgaacgatggagacgcaaaccgagccaccggaacagaaagcggcacagcgaggagaaaaagccgaggaaaagcccaggggtcagtggcaagaggataatcgaccgcacgcagtgatttgactgtttgatcggttagccgacatttgcggaccattatttatgggttgaactgtctaaaaaacaaaaaaaaaataaatttataaaaattgagtgaccaaattagttttttgtgatggttttagaacagcaaatatgggctatttttgggaaaaagatagaactatttttagtttttgtttgttaatttaattgtttggtatgccatataaaaattttaagctctcggttaaccaaagcatggaagtgaaacacgaaaaaattttccttggtataaaatcctgaactgacttttatatgtattaaaatagcaaattttttcgctaatttcactaaacgtgtagaggagaagcaagaaaaaaatttacacttgttttgggacttctaagataaaataaaattctccaattgaaacagatcgccttgcatcagcttaccttcactaatttcaattttgggagtatttaattaagtgaaaattaaaaaaaaattattttctttattttgacagttcaatcgggaaatagtggtccgcaaatgtcgcactacgtcagcgtcacgactaattcttctttttaacgctcctattcgaaccttagaaatccctatttttgaatttctgcccaaaataaattttgcccttacagtctgttccaaaattatagcgccaagaattttgttttttttgctgcttaacctacttcccatggaccaatcgatctgaaatttttatgtggaaatgacgcattttataacgggccaaaagcctaaaatttttaaaatttgtacgtagtatgtattagatattatgtatttaaaaaagtactcatatgcttcctcccgcactaataagtctgtctatcaaagca

SEQ ID NO: 22144 - DNA, 3519 bp, Heterodera glycines
  misc_feature (1268)..(1268): n is a, c, g, or t
  misc_feature (1275)..(1275): n is a, c, g, or t
  misc_feature (2603)..(2603): n is a, c, g, or t
aaaatcctcatttcccaaaaaatcttcattgactacaaaaagccacaaaatgaggataaatcctcagatctggcaaccctgttcatagctgttctaaataaattaatttgctataggccgtaaatgtcctgcaaaattcgaaaattttggttatgattcaaaaaataaaagccaaaaaactttggattttagccttaattttttgaaatttttcgaaattctgcaatgccgggctaaaatgcgtgcattttcattcagttggccggcaaatttcttctgctacaccagccatttgtgatggattttacgacaatcgaagttaattatgtgagaaaaatgccatacttttttccattaatcatttttttctaatttcagaaatcgccgttttttgccctccctttttaccactctgagcctggagtaaaaaaggaatcctgggccactttccatgtcgaatttttcgacccaccggaaaatgagtttaacatttctcttctgcacgactcacccgaacacagcgaaaaaggcaagacaaaactttgaaaagctgagcaattaatggattaataaaagtaatttgtcatcagaagctctttgtcgccctactaaaattttctaatttttttttcaattttgtgatttttaaatgtaattcatacaaaaaataaggagggtgagggccgactacaagggggcaaaaatgggagactccttaccatcgttcaaccatttctttatacatatttatttattgtcgcgaatatgcgtatattggaatataaatatatttttataatttttaaataattttattttaattttataccttttttttttgttttcagtcggtgccacggtaatgggaatgaatgtgaagccgaaggataagcgagtcgacgtcattttttggaactgttttgtgagaaaaatataaaatgttttaaatatttataataaggaaacgatttttagaaaaaacttccgggaaacaaagacagttgcgatgagacggaaacgaaaagttacaaaaatgaaaatcttggcaaagcagccgaatttcacatcgaagtgctaaacgacagtttttctgtgataatcaatggggatcagaagaagcctttggagtacaacagcacattgccagtttgggcaacaaactttttcagggtgagaaatgagaaaaacggagttttacgaaatcgccaggtttaaagactcggaatagacccggaacccgtactgacaaatgaacattttggccggtntagagtntaaaaatgaagtgaaattcatattaattttttagaagaaatatgattttatatgagaaaaatagagaaattacattaggaaaatattgattattttatttaaagatttttaaaatttgctttctttgaccaataatgaggctcgaatttttaattatttaataattatctaaacaaatttattttgaaatttttttcaaatgctcgaacgacccattctttgcttaatgataattttcgtaaatttaaataaaaataattgttgtttaatttgcattaaattttatttattttttataaaggttgaaggaaatgtcagactgttggggaggccactttggaaagaatgggaagtcgtaagtgcacaataattgcaaaattaaatatattttgtcattttcattcaattttaagtatggagacgaaaaaggctactttcacaacttttcaattccattgaaaactttgctgaattacggagaccaaatcattctgaggacactgatcattggcagcgagacggaattcccgcaaccgtttaacattacgctgttgcacgaagcggcggaatggaacgaaaaaagtcagtctatggcacaaaaatggaccaaagaatggcattagcggaattgggtcgattttgttaagttggcgatgtgattttgcaaatggcattcacattcggagatgatagtagcccgggcaaagcaaatcaattcatctgccgaaatttcatacacgaggtaacaaatttatgttggcaaatggtggccaaaaaattgttaattaaaatttgattaattattatttatatatttatttcggtcgaatgattgagtaccgatgatgaaaggctgtttaataaaaattcacgaaattattttcatacaaattttaatcagaacataaggcataaagaccatatttttgggtcgaaaatctgaacattttgcgaaacgccgcagggaaaatttgagtgtgatttgttaacagattttgtcaaaaaatgaccaaattttgcgttaaactttaaaatttatagataaaacattataatattattattcggtccataattttttttttcaaattgagcccaattttattaaagcttaattttcatgaaatttcctcttctgctgacggaatcgaactcatcattcaattttcattgcctttttaataaataattttaacactttttaatttttatgaatgttttatacggcatttttaatagagaaaggaatgggaagacttgacaaaaatacccaaccgattgaacaaatttggccaagagttcacgatgaagatcacggccaacacggnatcggtttgacattgagattgaaactctggccactatggagaaaatcgaatgcaaatatccgattttggacaatgtgcaaattccaccgtgggcaattgacaacattcgggtaaaaatattcacgggctcctaattgaaaatgaatatttttgtaatgatgtagcttttgggaaattttgtgctttttgaaatcgtccaaaaaatacatccctttttaatcaaaatctgtttttaaaaatcgcattacaaattccaaaattattcccggcaacgcctttcggcacctctggaccattccttcccagaaatttttcaaaaaaatacagctatggttgaaaaaaatttaacaacgttttttattgctcacgattacgtcagtaattgaattttaaaaataaagtttatgtagccttaattattgtaatacaaaggtcaaaattgtatatgaacctcgttctggattagtaatactagtccccccccccctcccgccccaaataaactagcttatcagtgaagaaaatcaaagactctaaatcttgacgaccataatcgtcgagtgtcttcaatatttttagctttttgtgttctaatcctttatgtgtttttaataattaaaaattgcttctttaacagtttgatggcgatgagttcagagtgattgacttcaacatatcccatccatcccccaaggctttaattacgaatcggatcaattacatcgcacaaataaaggtaaaaggaattgggcacttttatgttgttgttatttcaattaccacaaaattgttaaattcgaagaccatcttttaaatgaaaggtcagtcggaactcggaatcaaatctcccaatgttgagtccttaaccgaattcctggattctgaaacgctcatattccctgacatattataaacc

SEQ ID NO: 22145 - DNA, 1818 bp, Heterodera glycines
  misc_feature (1584)..(1584): n is a, c, g, or t
  misc_feature (1593)..(1593): n is a, c, g, or t
ggtcgtgattgtcaaaaacggcaaataattgcccaggggcaacaacggtgcattttcttttgtttaaaatccaaatcattttcgcctcaaaaatcgagaccgaaacgccgtcctcccctccccccccgtaggtattcgttctccaacgacccaacggcacacgccgaagtgacggctcttcggggggcaagcaaagtgttggacagcttcgacctgagcgggtgcataccgtacacgagctcgttacccatcgtactcgtaaaagtgattactcgtacccttttcgctaatttaaatttaactttctcttccttcaccctataattgcttatccattttccaaggtcccatgtgtttgggcgctgttttgtggtcacggattagcaatgttttctatgctgctgcgcctaccgatgtttttccctcttttttattttgaatttttcggaatgttttaggccgcttcggtcggtttcgatgatcagaatttccacgaatttgtctctaatccgaaggttaattatttttatttgcatattttgcaattaaaaaattcagaaatacgaaaaactgatggcattggaacatttgccagtcgaagggcatatgaaagtgttcaaaatgtgggaacagagggacgagaagagaatgtactgacaaagggccaaccaatttattcaatttacatttctcatttgttaatacatgtgaatagtaaataaattggaaatttaaattcaatttaatgtcaattttccataaaaaatttttaaattccatccaaaatcaaacattaaggcaaatttagaattcgctatatctcggtttatttaccggactatgtacaactaaaaatggaattttgaatccaaattctggtccacaaaaaattataaaaccgtaatggaaggatagaaattcattttgtatcaaataaatgtaaaaataatggatttaaaccgttttgcaaaattttcttatttttggtcccaaaatcttatttttgaccagcggtgtgattatttcgaaaatttttgatcgaggccatgatattatcacatacatataatatatatttataaaacgatataacaattgtgaggaaaaaagacaaaaatcacaaataggcaaatgaatgaatactgtataaaagatctgctaaaattcttacatagtctaaaaaacacatgtattcttatatcggagatcagctattgccattgagaggagtcagcggatcgatcagcagaagttgctccaaagtctgcacggcgccctcgtcaaatttgtcgagatcgaatgccacagtacactcatccgagtccaactgcaattggtccggcatacggtccatcaacgcatcacaacagcggaacagcagctgatcgtcgcctgactgttgtgcgttctccaattcgcgcttcaaccgaccgatacgaaccattgcgattctgatgaggtgaagatttcgaaaacacatcaatggttttgaattgtgcttcaagtccagtttatgcgtcgcatcgacttttatgcgtccaatcaaattttttgtctaatttcagtgcatttacaattccccgncattaattnccctatttttacaaaattcctcaaaagatcaaactatacggggtaatttaatctcatttcttccaaaatatgctgaaatatttttgtgtttccgtggtatcttctgaacatgtactggaacaaatatgtcggcagataagtgtcggagagaaatcttccatgcaccccaagttgcctcaatgccctgcgtatgcacttgccggtcttgggggtctacaaaaaaaa

SEQ ID NO: 22146 - DNA, 1154 bp, Heterodera glycines
  misc_feature (1062)..(1062): n is a, c, g, or t
  misc_feature (1114)..(1114): n is a, c, g, or t
gatagagaatgtgtgcttttacctgttttgaagctaagtcggggatctgacggctaatatgagaataaagtgcagttctctctttaaacgaactgattttatggccactttctataaaggcgatggcggtcgctgtatgaccgtaaacccagttttttgtatagaaaagggttgtccaaattgcaaatggatacattatctgatttatttcacaacgccaacacgccgttgaaaataaaaacacaagttgcatgtgatggcaaaagttgtgaaattcaaacgcattttacggccatgaattgccgggaagtgaggcgatcaaaattcataatgatagagaatgtgtggctttacctgtttcgaagctaagtcgggtctgacggctaatatgagaataaagtgcagttctctctttaaacgaactgattttatggccactttctataaaggcgatggcggtcgctgtatgaccgtaaacccagttttttgtatagaaaagggttgtccaaattgcaaatggatacagtatctgatttatttcacaacgccaacacgccgttgaaaataaaaacacaagttgcatgtgatggcaaaagttgtgaaattcaaacgcattttacggccatgaattgccgggaagtgaggcgatcaaaattcataatgatagagaatgtgtggctttacctgttttgaagctaagtcggggatctgacggctaatatgagaataaattgcagttcgctctttaaacgaactgattttatggccactttctataaaggcgatggcggtcgctgtatgaccgtaaacccagttttttgtatagaaaagggttgtccaaattgcaaatggatacagtatctgatttatttcacaacgccaacacgccgttgaaaataaaaacacaagttgcatgtgatggcaaaagttgtgaaattcaaacgcattttacggccatgaattgccgggaagtgaggcgatcaaaattcataatgatagagaatgtgtggctttacctgttttgaagctaagtcggggatctgacggctaatatgagaatanagtgcagttctctctttaaacgaactgattttatggccactttctataaggncgatggtggtcgctgtatgaccgtcaacccagttttttgt

SEQ ID NO: 22147 - DNA, 1390 bp, Heterodera glycines
tttagcacacccagcagcaatgccacgcaacaacgaaatcaagggcgcatcagcagttgcggcaccactgacaactgtttcagcaggcaacaacagtgcaaaaaacgttcactcaacaacaacaacaacaacaacaaccatcacaactccaacaacagcaacaattcaaatttgcacagcaacaacggcacatggatttgatggcacaacaacagcaaggtcggcaacttcatgccgcaatcgctttacaacaacatccagttgctgctcaagttgttacagatggttgtgtttttgttggtggtcagcaacttgccaatgctgcaactgttgctgcttctgcatcagatagccgtccgacaacaatgcttcccgtatcgacggcggcggcatttgcacaacaacaatttattggcgcaaatggattgcaacatcaacaacaactacagcaagattttcaggcagctacagtataccagcatcatcaacaacagtatcagcagcagcaaatgaaatatcatagtcagcatgctgaagcagtacaacagcaacaacaacaacatcagtatggacgcgagggagctgttgcggctcaagcagcaccggtatgtttagagatcggctcgatcaaatttttatcataaaatgtctcccaaaaaataacggaatgccaaattcaaataaatgccattttttattttaaagcagcaaatggcggtagacaaagccgaacaacaacaccaacggcacctgcaaaggcacatgccaacgatggtgggaccaccaaagagtgcgccagccatttcaacaatgccgccccatcagccgcacttttggcacaatatgccaccaccatcgcagcacagcgagtcagttcagttccacattcattggtcccgcgggttttcaaaaaaaggcaaaatccccccccccttcgaaatcaaaatgccagagtataaaaaaaaacttagaaaatttccaagttggatttccaagaccgcaaaattaaaaaaaaactcacagttccttattaatagtacagtaatcattcaaggatgggcaaatttctatgctctcctccaccatatcctgctgctgctggtggtggcgttgtcctccctctgcatgcatacggtggtgcaccatacagtatgcttcatcatgccaacgccgctggtggtgccgccgaaagtggagggaaagaattgttgtttttgcaaaactctccggcgatggcaccgccgctgccgattacggtgaaattagaagaagacggcggaggagacggtcaacaacagaagcaacagcaaaatgatgaaaaagtgccgcaaaagaaacaacagcaacaaattggcaaatgccaaccgccgaaaagggtgggcaaaatgat

SEQ ID NO: 22148 - DNA, 1848 bp, Heterodera glycines
  misc_feature (1829)..(1829): n is a, c, g, or t
actatcttacatgcccattcttcagttctgattcaaaaaaaataggggtatagattcgctttcgttgtgatttaggagtgtgagatagattaactgcaatagaggagcatccattgaatttgggaagaccccaagtggcagcatgaaaagcggtttgacagattagtggatgttcaggaaccaacaattgatcagcgttagtactaattagcattgaggctatgagtgtcaatgttagcattaggatgcggcttaattgtggtccagtagtaggaaatccccaatttgaaacttttagaggaggaactgaagagtcaacctcattagaagcccattcagaagttgaagattgatcattaagatgttcttccggcattagagcgttgcaggcattgtgctgcatattcgatgaaattggttgatcaggaggcagaccgtctcgtacattcatcctttgaattagttgatcagctaaggcacttaaatcaacagtcacgttttgaggattggaagatgtctgaggtacgacatcattagcttggaatggataattaggctgtaccatgttaaccggggtgtaataggtaggtctatttgagttgttattgggaccattcatttgaaattgtgagcgcctgtccctacagttgtacgcaacatgtcccaatctaccgcagtgatggcattttggacggccagtccaattgcggtcccctcggcctcggttcgaccggtattgattagccctatttctttgaaattgaggcctgttggattcaccgtggttaccccgaaaatagcctcttcctgaaccatttggttgattattttgtgtttgctgattaacctgacggttattcgtatatctttgtccagcgggtgcccatgaattcacattggaggaagaaaattggttagtacgataacccgattggtttaccggagattgggttatagcttggacagtgaatttgagcgggtccaaaacgttattttcattggtattagtcaaaagaagttctaattcttgtgcctgggaaaacacagcctcaaaatcttggttcttagtgacaccagtcagtcggataagaaaggttaaattgggcttgaccctttccaaaaattcatcccttagtcgtgactgtatttgtgcctcactttgaccggcacacacagtagtaaccaatggcgaaagtcttgacaaaaattcccggactgtttcggtttctcgttgtttgcatgtcaccagtgccctttttgacatttcccggcgttcaggggaatctaatttgtccctaatggcatttaatgccttatctacagtgtcctttttattgtccggaagcttatcaaagagctttctgatttgcccttcaagagaaaatttgagtcggcctaatttttctttttctgaccatgttgtgcccgcataatccaaaaggtctctaaatttttgggcccagttatcgaaagaggtaagattttcatccctgcatgccggaagttgactagcaaatgggtccacagttgtcaaaacgtttagaaattcgtcttcatcgtcctcttcttcaagtaaccccacgcggccccttagcaccacagtggcattcccgttttgtgataatttatcagcattagggtcatcccaattctccacttggctttccagagattcaactttctctacaacttggtcaagtcttgtggagagagtgtccatgttagcattaaccgttacagatacttggttaatggcatctgtattttgtacagctctgcgattattactcttagacttcggttagcggcatcctctagacgtacagtgncttggtatactttttctac

SEQ ID NO: 22149 - DNA, 1787 bp, Heterodera glycines
tgagatggcaaattcaaaaaaaccctttattaaaaagttaaaggtacaagatatggcccgaaaattgttagaaaatctttttgctccttcctcagaattttataatcattcctggtgcggtttatttagcaaatttatacaaataacgcgtatttcattaaggaaagtttgcgctaatcgttatcaagactccactagcaaaatgctgcgttcgtattcaagttatctctttcttaggcaattggaagatgacattgattttgatgcaaccatgcataagctctacgcgggtcgaggatgggtccccaataggtaatcggatcggtcattctaaaatattccttctgatcaagtgttttttgtttttgtgatgaaataaactgatgtgtttcttgagtaaatgtcatttaagccgttaaaataaaaaggacataaatgtgtcttgtgcataaaaaagagaaacatatatgagtgggtgagtttaaaaaagacactattgtgtcttatacataaaaaagagaaaaatatgagtgggggtgggatttaattttttgggaacgtatatatacattagtgatattcagctctgtcttagagctcgaggtccttggcatcgaaaatgagcccttcacgtcttgcttctttcaagaaaaccatgaagctttgtttggtgtagggcataaagcgaccagcttcgatgcctgactcgaattcaacggcctcagttccttcaggagcagtatttgtcgtcagcagaggattctaaacataatgattccaacaatctttcaagaattcatggaacaaattatgagacacattttcattgtaattctaaaccgcaacgacatttgttactcaggatttgtgagacagatttatgataataatcatataaggagacacactatcctttttcctaatactgccccgaaatgctgagaatgaataatgtgtcctttaatgtatatttaacatatatgtgtctaacaagcggttccaattgaatgctagggcttgtgactcgggctcgtgattaataagttccttttaaaagcatgcagactaaccgcaaggaatgacgctgcgtcacacagaacaatcagtgcttttcggtgaagcgaaaacatcacattaactcgaccattcttccacattcgaagtgtcggatgatatgaatcggccagaaaaccaagcgtagaggtgttattgcggccaactttaatagggtattcaaatgattttgatcatgttagtggacacattaaagtagctcactttaatggacacattaatgtggctcacattaatggacacattaatgtggctcagcatttaatgagacacataattaagtaaaaaatttaggatcaaaatttttaataatcggttgtgactagatttaaaaaaaatatatgtctctttaaatttgtttataaatggaatgtgccttaataagtcacaaaattgtcttaccagatactatcacgtagtcgaattccttcccctgtgccgcatcgacagtaccaaccaaaaggtctgaatatacacgacgatccaagggaacaatgagttcaggatttgaagtgcatgggcacaagaaatcagccgatgcggcagatgtttcattcgtgccaaccacaaaaactttgaaaagttccaatagctgggctaaaaaaagataatcatgtatttcagttgattagggacatattttaatatacaattcgtctaatgataaattaggaacttttttatggtgtaataacagcaatgtctgtcatttc

SEQ ID NO: 22150 - DNA, 1443 bp, Heterodera glycines
ttttagcttgttaggcaacttcgcggcctcagtcgggcgcttcgcgccggtttttcaatttttgttggccttggacgggcgcttcgcgcccgttttttaaattcgttgaactcatacggggcttcgcgcccgttttttagcttgttaggccgcttcgcggcctcagtcgggcgcttcgcgcctgtttttcaatttttgttggccttgtacgggcgcttagcgcccgttatttaaactttgtttacctcaaacgggcgcttcgcgcccgttttttagcttgttaggctgcctcgcagccttagtcgggcgcttcgcgcccgtttttcaatttttgttggccttgtacgggagcttatcgcccgttatttaaactttgtttacctcaaacggccgcttcgcgcccgtttttaaatattgacgcggcattcggccgcttcgcggcctcagtcgggcgcttcgcgcccgtttttcaaaatttcttgaccttatagggattataagaggtacaataaatggtagaagaggtaaaatagtgattagaagaggtgcaacagtgattagaagaggtagaagggtaattagaagaggtacatcagtttaaattttatttttttacaaattcaatgtaaattgaaacatgatattctttaattttttattcaaaatttaaaaattatttttaataaaattttcaccaaaaaataatttaattcaaatgaaaaatttttatttattattaataaaattaaaaatattttaaatgaacaaaaattgaaaaacagaaaataaatggtagaaaattaatgtacaccgtccggatccgaacctgccccctcccccctcaaaatgatgcctcagaatccccaatcacacagggattctgaggtcttaacgatgtcaaaagtaaaatctgatcacgtattcgtgatcagcggcccaaataacccctaaagacatatttttggaggattttgggtgaaaaaaattttccacataaaaaccatgtgcacccccctttggtcccgaaccccaaaatcacttttatttttgtaacatctctcaaaaaagtgataaaaatgtaaaataaaatttatattatagacagaaaaattgcggattttttgagtatattatttttccagaatatcttttcagaaccgagttatgaatttttttctgaaaaatcgaaaatttccagaaattctggaataactttttttcttttgaggatagaaatcccaaatagaccccataaaattctcctgatttttctctatttttaaggctttattcctgtaaaattgatcaacccttcgatttgttatgaattttcaaatattaggccaaaatcccgagggccaaaaaattgccaaaaaataaagaatttttaaaaaattccaaaaattatgaaacgaaaaacaaaggtcaaattcgagctcagca

SEQ ID NO: 22151 - DNA, 2503 bp, Heterodera glycines
tttttgttggcaagaaattgattcaattcccgtgccggggtacacccgaagagtttatttaaaaaaaattttttttttttgttgctccgactcaaaaattttctgtccggtgtaattttcctaactttttggtttaatatgaaaaaacgggaatttttagtcattttcaacgaattgacgtcggaggaacattttacggtaatttttcaaaatgccgagtgaatcttaaatttgttagtgggtattaaatttttcaaaaatttgcatttttggaaaaaacatcaataactctttggcaaaccatgtgtttaaacattgtaaaaacaccattgatgagagtttgcaaatttgataggccaaccacgccgaatgggcaccaaatttcgccaattcccgaggagaacgacgagttagaccaacttgtgtctgcactggtcgacaaccacaaccagcaacagaagcaaggcacagctgccacaaccgcctacgaccagagggcggtgaaaagtttggtcacacagctgcgcgatgtcatcgcccagtgggactgggcccaagcacggcacagacacgtggccaaaattgtaaaactatgcaatttgaaaaaaaatgaaaaatttgcgtggtagaagcaagggtgtagccagacccttggcttcgggaaggggggggggctgaattaaaaattcgattttaggggtgtattttttaggaatctcgagttttgagaggtgtatttttacaggattttctagccgtttttcgctaaaaaaaattattttttttgagtattttgaacgccaaaatgacgaattgaatgccaaatgggagcagctgaacgcggaggtggccaaattcaatgaaacaaaagcggacgaatgggcacagattgccaaagtgcgtaccgcactgcgtgcggagcgcgagaagcgactgggcaaaaaggaggcggaccgaatcatccaactggaaaaggaggtgaacagggaggcaattgggacaacaatttggagccggtttttccaaaaaccaacattttttcttggtgctcaaaaaatttacaatttttgcttggatttgacttatttttttacaaaaattttcaacttttacccccccccccccaatttcagttggccgatttcaaggccaaagatgcgcgtgcttctcggttggcctccgaattgcgcacccaaaaccgcgagttgcaaggcgttgttcgggtgcgtgagcagtcgtacaccgacaacatgatgaggctcaaacggctggagagtcagctcgtttctgctgaggtttgtttgcacctgttttttttgtcagggtttattggtcttacgaaaccctgagaaatccaataaattaagcgctggggtgaaaaagcaggaattgttagcggttttgcgccaagaattttttgcaattttcgggtcaaatattcaacaaaaaaaaaaaagcgaacaattgagtccggcggtgcctatgggcgccccctccccgagtgcaccgcaaaaattcgcgctgaaattacgccgggacaaacttccgctgccgaaatatttccggcgacgaaaattagtcctgttccagaattcccccctcactttccgtcctgtctgcggttttactttgaatgtattatttatttgtttgtttgttttaagcaagaaaactccaggctgcgcactcggcttaaactgatccgacaggaaccggcggcaacaaaagtgccgcaacatccgaaccaccaccagcagcaaaaacaatcacaacagcagctgccacagcaacaacatcgtcatcattcggaacaacaacgcggtgtcactttctctacggctgcccctgctgtgtttccgccatcaagttcaagcagttcaacaacaacagcaacaaccgtctcagctggtcgacagcagcagcagcaacatgtgcgacatcagcaagttggtgtttgaaaaatggaaatttgaatcttaccaaaaacccgaaggaaccaacaagcaattttcactgggatagcaacgcttgtggctgtgttatggcatcgcatgggacagctgctgagaatgttcaggtgatggtggtggtgtggtggtcaacaaattgaacgcgttcactccctcccactcccaaaattttatccatttttaatcgacagattgactatttgcatgacgatcgtgtttacgaagtgcgaatgccccgtgggcattcaatgcgttacatgttgaccggccaccttgacctgcgctgggccaacggcgatcggacactgatccgtccggatggcgaacgtcgcgagctgtacagcccggaaaagccgaactttggcattgaaatgtaatggcagtaaattaaaaacagcgtaaattttttaattttcagtttcctgccctcgggggtcgcctatcgcctaaacgctcagtcgcaatggcagcgcgaggaacttttaaaatgcgttaacagttctttttgccgtaagccctcctgctggttacgg

SEQ ID NO: 22152 - DNA, 1282 bp, Heterodera glycines
aaaagcattggcccattcgcctcaagtgcacgtcacagcgcattggctgttggcctcaagcaaaagtgaaaatgacattgttttggtgggtgttactaaattaaaaaaaaaattttggcgttttgttttatgccgccaattcaattttctcgcgacaggttggctatttgaaaagcaatgggctgcacaggcgacaacgaagcagcagtagcgatgtccgcttcattgagcatcgggcaaaaacacgtgtgccgtcggtggaggagccgaaagacgcctgggagtgggtttctcgggtgcaccaaattcccccactcgaattatttttaaaattttcagacagacatttttaaaaaaatcaaaaaattttcatattttcagtgatttttgtaaaaatttttgaaacttagtaatagtcataaaacttggtaaaattgttagagaaattgaaatcttataaaaaatttgttaaaaaaatttttttttttgaaaaatttttggtttttccaaatgttccggggatgaagaaacaatgatgtgggggggggggggggggggataaacgagctgctcccggtttttcagtacctaagagagtggagactgatcagtgatcattttcatttattgaccagaggttagtgactgatcagtacactgatcagatataattgccgaaaataatgctgtccggactaagtgaacgaaaacaaataaatttcaattggttatgtttgagaaacaaataaagtttaaattgattaggtcaaaaaaaaatcttattaaaactaaatcactatatatgcacattgatcagcagaaactttgcttgatcagggaactgaatttttgaattgtttgtgacagggctaaggtgccgaagagtccattaatgacatcatcttacaagcatcgcaaagtgtccaagagtcaggaacggcacatcacttcaaacaatcactatggactgatcgattttcgcaagagattggaaagggttggcatttttctaaaaaacaaagatgccaaaatttgcaagtgccaaaatgagtttttgggaagcaggtcaggaaactcgagcgaaccgaaggggacgagggaaagtcaaaaatggatgaggagcaatcaaacaaggaacggaatgccaactttggacaaatggaattagtgccaaaaaaggcggcattacagcagcaaaaggagccaatcgaggcgatgatcatcaaacacagaaccatggcggacgaagaggaggccggcacggggatggacgagtaagttt

SEQ ID NO: 22153 - DNA, 887 bp, Heterodera glycines
aaaaaatagccaaattatggtataaaaatttgtctaattgcaaatttttttagcatttattgttatttttaaactttcgcctctttcccgtcccattaaaaaactgaccaacgaccgatggccgttgccaattgcgccaaatgcgaacgacggacgtccgtcgcccgcctctgtccgctgttggtgctcctccgcctcccactcgtcctgctgttgctccgttgtcgcccgttcctcgtcccttccgtacatccattttcggcacaatgcataaactgactcgggctgggccgagtcgcgcagtccgaacgcctttccgcgcagctcaaacacaacgcctgtgccaagcaattttaataaaaatggtagtgaaaaattaaatatttaaatgatatactaaaagtcgtaacataattagaaagagtttgtctgtaattatttcgcaacttctgatgatttatttggatagagtaaatgaaaacccttttaaacctggcgcttaatttatgaactaatatcaatctttatgtctgtgacaacaattttaatatgctcaggccgaatatgagttttggtgtaggtatgaaaacgacatttcagataacagagagtatgctctatccaaaggtctcagatatgcagtggctaactcacgcttttctcgtctcatccttttgccgccgtactgttttcgttgctgtcttgtgccatgtcggtcgtccaattcgctgtcaatgtccgcctcttcactgcacgggaaggaacgataagcacaaatagttttgaaacattaccattaaatttaaaaatcggctcataatcgaaagataggtcaaacaaccaattcccaatccatcgctggctaactaattagtataatttcaaat

SEQ ID NO: 22154 - DNA, 1671 bp, Heterodera glycines
  misc_feature (1537)..(1537): n is a, c, g, or t
  misc_feature (1640)..(1640): n is a, c, g, or t
  misc_feature (1656)..(1656): n is a, c, g, or t
ttttgtgaaaaaggcaaaataagacaaaggtacaacaataaattcaaaggtatgtaaatatgtgtatataaattacacaaagtttcatcaatgtccagggaaaatgaaattgttttttaaacctaccaaaatcagaaaaaaactttgacaattcatagaaatgtgacaccctgaataaaatacaaagtccgaactgaaaaactgtaacgaaaaaagcataaaaatggtttttctttctgccggactcatcattcttcaggcgaatcaaagagaaaacaaaaacaaatacatgaaatgattaagcatttgatcctcagtcagtgtccgaaaagatgaagccggacaattctgcgtttataatctcccgctccaaccgtttcctctccaatcgcttcactggcttctcataggtgtagtacagcacaaaacgggtcagcaaagcaccggcggtgaagggcaatgcggcaatgtaaatgaaacggacggtgactagaaaaaaatgataaaattaatgattaaaatggagagagcttttttgtgtcaggttaaggaaattcagcagttgaaggagcaaaatataattcaggcaactgtttaacatagcttttaattattaaatccaaattgacctataattttttaatgtatgccctaagtagtgagagagatatatctgggttttcagaggcaccgaccgataactaggagttgatttaatttaaaaaaacgaaataaattttgttttttttttgttaggatttttggttcaaaagtttggataaagggtgttagattcacaatcatcgaacaaataagttgcagataaatttagaaaaataatttttatcaaaaaagatcatccccctatggtcaaattagagaacacgtttgtttgctaaacaattgttaaaaattaattagaattattgagggaggcaatagcaatgcccctaattgaaatagaatggccgtgcccttccgaaaaataagttttcataagtgctacctctgtgtagaatgtccaaccgacggttgctcattacgcgtcggtacagcggccgtacagtgtcagaaggcaacgccactttattcgacattattatctttaatagctaaaaaagttaattaaatgtgaataactcgagaacggaccgggccgggcccggtaccgggttttaccgggcccggcaacccggagcggcgatttttggaaaaatccgggttgaccgggttttgagaggccgggcccggaacccggttgcttctgaaaatatcagtcaggcccggcagatttggaaaatccggtctaaaagaattacctaaaacatttgcattttttccgggacaacagaaaagtaggacaaaaaacacaatgccaacctagtccttttttgcgcgttaattcaagaaacaatgtattccttctcagttctccagggaatttcgactcttcaaactcgaacagtcctattaatttgtaagtagggttacacggggcagagtaccgactggagtcaacacccggataccccctggngcccggtttttgttgattcagcaatacgcggattcgttttttgtccaaatacccggacccgtgtcaccctgctattatgtacaacctattgtacctaaatttnggttatttaccctttnttgctctaatcataa

SEQ ID NO: 22155 - DNA, 1221 bp, Heterodera glycines
  misc_feature (114)..(114): n is a, c, g, or t
atgccggagattgagtcaccgagattgaatgctggtgggtgagtcccagagatgaaatgctggtgggtgagtcccagagattgggatgccaatgaaagtgggtgggttgagtcncagtgtttggaatgccggagatttgagtcccagagattgaaatgttggtgggttgagtcccagcgattggaaagcctgagaattgagtctcagagcttgaaatgctggtgggttgagtcccagagattggaatgacattgaaatgctggtgggttgagtcccagtgtctggaatgccggagatttgagtcccagagattggaatgccggagaattgagtcccattattggaatgctggtggcctgattttcagtgatttgaatgtcattgaaagttggtgggttaagtcccagtgtttggaatgctggagatttcattgtttggaatgtcggagaattgagtcccagagattgaaatgctgctgggttgagtcccagtattggaatgctggtggcttgattttcagtgattggaatgtcattgaaagttggtgggttgagtcccagtgtttagaatgccggagatttgagtcccattgtttggaatgccggagatttgagtcccagagattgaaatgcttgtgggttgagtcccagcgattggaaagcctgcgaattgagtctcagagattgaaatgctggtgggttgatttttagtgattggaatgtcattgaaagttggtgggttgagtcccagtgtttggaatgccggagatttcattgtttggaatgccggagaattgagtcccagagattgaaatgctggtgggttgagtccaagtattggaatgctggtggcttgattttcagtgattggaatgtcattgaaagttggtgggttgagtcccagtgtttggaatgccggagatttgagtcccagtgtctggaatgccagagatttgagttccagtgattggaaagcctgagaattgagtcccagagattgaaatgctggtgggttgagtcccagtgtctggaatgccggagatttgagtcaccgagattgaaatgttggtgggttgagtcccagagattgaaatgctggtgggttgagtctcagagattggaatgccaatgaaagttggtgggttgagtcccagtgtttggaatgccggagattgccttacagagattgaaatgttggtgggttgagtcctcagcgacttgg

SEQ ID NO: 22156 - DNA, 1739 bp, Heterodera glycines
  misc_feature (130)..(130): n is a, c, g, or t
aaatttgtgacagaattttcactaaaaaatgatcaaattttgtgatttttatcatttttctaatgagaaataagagttttggcgcgccgctgagaacagtttttcatcaaattaccaaattttgcgattntgggccattttctaagaaaaaataggagttttgggggcgcggcggtgccgataggcgccgccggggggaaaaaatggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaaatgcgaataatgcgaaaggcgaaatgcgaaaagcgaaacctcggcccatccctggagtgtttgtcgtgcaaatagcgcagtgttaaagcgctcactgatgctttctttatcatgcgggttcagtcccgctcgtacgcagtttttttaaattattttatttttcaaaaaattttaaaatttctgtctctttcaattgtttttatctcagtttaatatcaaaattaattaatttactcaaattgaacaatttattttaaacatataattcattactaaatattaaattttgtagcaattttttaatctttttataaattataaaatttattgttgatcatttgcatgcgaatataatttttaaattaaaaaataaattgggcaatttttagaccatttcttgttaatttatcatctatagtaactaccatttaattcttttaaaagtgataaaataatcatttattcgaaattcaatcttttagcaatttaaattcattttcacatcattttaaataaaatctagcgttttaaaacaaattttgctgacagattgtccactgatagattgccgggagccatcaaaaatattgaattaccgaacgaattatatatacccttttagattttgtctgaattataaagttatttatattttctgggtcggataaccattttctaacattttccttccgagccatattccagggaatcaattttagatcaaaaagttgaaaatgtttggttttctcaatcctgagttaatggctcgaaagtgatcattgaggatcactgaccgaaataaccttccaacctgtatttttgatcactgatcaaaaaggatgttttttttaataatcggaacccgtttttcccatggtttgatcactgatcagaatctgtggtttcgattactggtttgaacacttttgtcatagtggttttgttgttcgtgatcagaatccacagtttgttactaatgattggaacccatcttgaccggatcattgaccaatagggctttgtttttaggcaaatgtctaaaatttctgcgaaaaaccaataaaaatatataaaaacatataaatccgttctctgatcataaggcataatacaaaaaagaacaatttttatgagcacgtcaataatttcataattcaaattgatcgacccatcgcttctccagaattcattcattcacttctactgatcagtgatcactcgggccgagcgttgcgtcaataaacccaaaaataaaaacgcaaaaaattgaatttttgaataagacattcactgaccgatcgccgatttcgttctcatcataaatttcaatgtcaattttgttccactgataacaaattcgccaataaaaa

SEQ ID NO: 22157 - DNA, 1946 bp, Heterodera glycines
ggggcgaattgatcagcgtctgggccaaaaaagtgatcgcaatagaagatatggccaaaaaagtgatgacatcggaaagaaagagccaaaaagtgatcgctaaagaagacaggaccgacaattgattcggtcggagtcagctaatggcggcagagccaaaaaagatcggccagtgatttctccaagttataaacaattttcaaagaatgaggatgtattttagccaatataaaaattaaaataaataagctaatttttagtgtggagctttttcttttattttctttttaattattttttatttaaatcaatatttttaatatttgtaccaatttcctaatcattatttttagcctatcaaaacattaagtagaaaatgaaatttgttctcctcccattgtctctcttctgctgcttcgcttttccgtgcatttgctacggtaattttaaaactttaaataattaaaatataaatttatttcacagggattcattgcaaagttggaatgtacgacacattgggcaatgctgcgattgttatttctgaatgctggatggaccagcacttctgttcggccatcggttgcgcaatcggtgggccacaattacttaatcaacataatttgattatataattgccacgttttaggcactgatcagatcacagttgtgtgggcttgtgagcagcaaaatgaccccaaagtgctcgtcaaaagaacatcattcaaaaactatacgtgctttgcaaagattggccagaagggtgccaacatgtccaatgaagagtttgctttccccgagttggccgaattggtcaaatgaatggtaattagccaaaaaaatagttattaaattaaaattagaaaatttccagttttatcgacagaaagtgcgaatgattgtccaacggatgtttagtcattttctaaccgtcttaaaatttatgatccaaaaaaatttgatcgaattcttctaatgtattgtatttgatagaataataaagtgttctttgacgtcgttccatttgaatttgaaaattttcggaagcgaacaaatacctaaaaataaatgggacactgaccatagaaattgcgctccaagtgcagctcgaagccgctgacccgtgcgattgggtaggacaggttcagcgacgggctgggccgtccgccggctttcacgcggcccaattgggaagccaaagcgtccttttttaattttgcattggcattatgaaaattgtgccaaaatgtggcccaaacccgtaaatagttgatggccatgtttgcctcgcagaacgggccacaaatgtccgagtagcgaatggacttaaaattggtggaataaatgggggaaaaataaaaataaattcttggaaaatttaaagttagggataattatgggattttggaattttactttatttccgagtaattgtataacttcgagatttggtcatcattccgctcaaaaagttttcggaaaattcttagagcttagagatcccggaaatatgcatttttggttatggccaatgcaaaagcctgcctaatttactaaagaaaacgggctcggaatcgggatatggattagtcatagtttatttttaatttaaaaaattagcctattcaaagaaaatccaattttgctggatttcggggcccatggctttagaaaaactttaaaaacgcggactaatttacattaaaattctaccaaattttttgaggtttgggcctttggcatttgggtgaaatttaatttgtcatattttggcactttttaactgctttttcacctgtcccccaacggtggcggaaatgttccggcgcaaaaagtcgtgcatccgaacgcattcgtccagccagcggagccggtgcatgctgtgccggtcgcgcgctcgcagcataagggtggtcagcaggggatcgcctggggcattttgtgta

SEQ ID NO: 22158 - DNA, 1079 bp, Heterodera glycines
aataaaaattaccagctattgaaatgcagtgggcaagcacagcgagtcgcttaaatgcacacctttgacacgtaaaatattccaaaaaaagagatagtgattttttctggattagaccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaaaattaccagctatttgaaatgcagtgggcaagcacagcgagtcgcttaaatgcacaccctttgacacgtaaaatattccaaaaaaagagatagtgattttttctggattaggccggagaaataaatattaccagctatttgaaatgcagtgggcaagcacagcaaaggctaaatcaccccttgacacgtaaaatattcca

SEQ ID NO: 22159 - DNA, 2104 bp, Heterodera glycines
cccttgcatatttttatcaatcaaatttatttgttagctgtcacattcatcggacggtgttgaaacatgtcttgaacaatgggatcacttcttctccgcccaattcgtctccatgtacacgtccagcttgttcgggctacagtactgcctaccgttggccgtcctgttgatcacctacaccgcaattggctgcaaaatgtggaacagtggcaaagtgccgggcggcgattgttacatacaggcgcgcactagccacaagatgtacgaaaaggtacggtaaaattgtgcccaaataattatgataggtagtattcattacatacagtatgaaaaaattcagtacatacaaaaatacagtaaccgactttcaagctaaaaattgtacaaaagatacagaccatcccaaatagtcatgaatttaatttacacatattatagtattctcaataaaaaaactttagaggaaggcatactgtagatatgataatataacataaaaaacacaactattacagtacaacttaacagcaaacagtaaaacataattccatatttttattattctaattaactaaacagctgttaattacaggactcgaccgcaaccccaacaagcggacgatgctcaaaggcacgtgtgctcagcattgaaggcagtccgcatactgtagatgctacagtagcgcgacgacgaagttcagcccaacgggcaaatgttgttcaacaggacaggaaggagtctgtcaaaaaggtggagattgatcagcaggctaaattgtgatggggctttaaattgtgatcggaagaagccaatttttggaaaacgaacatacagtaattttttgtaaattttagctgatcccaatggtactgttggtcagtgcactgtacgccgtctgttggctgccccaaaatttgttgatgaacatttttgttacgtacgacccgtccattctctctcatccgtacattctgtacatttggtgagttttcaaagatcattacagtactctgttctattgtcacctaatatttactggcatacagtatataagtaccgtattcaatttttttttgttttcaggtggggcagccattcccttgcaatgttccattctgcggtcaacccattcgtgtactatgtgacaaatcggcgcattcacgcagcagtgaaggtaccatattcacattctgtacagtacctcatataattatgatcgatactgtactaaaaattacacaactttttatctgtactgtgatacaaaattaaaaaaaaaatctaaggcactaacttggtactgtatgcggtacggtcggtactcgaattctttctcccattgaattatatgatagcaaattaagtctaattatttcctcaaatttacagcacttgctccgctggatgccatgctttcggaatgcgcgaaatttggcactggccgagtttgatgtgaagaagcggcttgcctcctccttccgctacacatccgcggatcaccaacagcagcgccggacaacactgtacaagaccgtatcgaacagtttacattaggcgcaattttgatggcattttgttcaaatgtgatcactgatcagccccggggtatatgtagacaaaaacttaatttatctgattttttgctcataaaatattgttttttcgttttgtgttcgactaattttaggtgtactttagaagtggtcccgttaaaaaaacgcccaaaacgtgttccaatcaatctctaaggacctctaatcatcgtaaaaaatattgccgaggtgcggaaaaatcaaaaaaccggtttttgagccggtttaaatcacgaaaaattgcaccaaaaatcagccaaaaacccatttaaattaaaaatttccaaacaaatttggtatcattcgaaagctcttgacgagctaagtctaaaaatttgggatggagttaagacgaggccacctgagcactggggcaactgagtgtcccaatgaaaatggacacttaagtaacaaagaaataaaggatgaacaaaaataatttgataagctaactttcgcaaaagggagcatgcgaagacggagcaagtataaagagagacggagggcggag

SEQ ID NO: 22160 - DNA, 2521 bp, Heterodera glycines
ctattaaggtttgggtctgtctgaatttctactccccatatattctcgtcaaatttattttttggcatactgttaaaactttggggacacaaattcaccatggacaatacaggggaatgtgaatgataatgaagaaaagcagcggcgctttacatgaaaatttaagccccatttgccatgcctttgaccgtttgttccgtctcaaaatttaatccccctccttcctctttaaaaaaaggccagcgccatttttcttgtccattctttacccgttttaatcccaacgaccaagccatttagggcacaaattttaataagcgaaaatgccatcgtattagggaaggaagaagaaatgaaaacaaaagtgacgtgccgccacacttggcaacgtaaaggcacaaaaatcgttgtacgatacggcggatgaaagataaagtccccgccggaaacattatcgcaacttcggcacttttgtgccgatgccacccatcaaccaccacttgtttattagtagggtcattagttttttaattgaaatttaaaaccaaaaatggcgatctaactgaaaccgacatcacccacctttttcaatggtggcctctgcagtgtcaacgacggcatcggtgccatcgatgacgtcgacgaatgttgtcccgttttttgtggtttcgttgatgcgcccgtagttgtcgtgcaaatgctgctgctgctggacatggtcgaggacagtgtcagcgcgtcaatcagcggagactcgttgctgcccgtgctgttggtgtcgccggcgatgattgtgccaaagttgaaaatgcggcgccgcgtgcgtggcacagtggcccagcatggactgttcgcgctgttgttggtgttgttgtactgctccgacttgtcggccgcagtcgactccttggcgcgcagtgacgacgacgacccgttcaacagcaaatagtcagcggcagcgcccggcgacgcaacgcccgagtccacggaggtggccggagacgaagcggcaaccgtcacggccccttcggcaactggcgatggtttgaatggcggcattgttgctgtagctccgtcgtcttcccttccatcgttggtcgacgggggaggcaccacaaagtcggcggttttgccattgatgttctaaattttgaaaaaaaatttcggattaatcccatccccatcatcatttgattactttctcgtcgtccttttctgacgcaacagttggcggtgccaaaggtgaaggcggcgcgagcagttcagccgcagctattgcagccgaagcggcggcggaatcgtccccaccggcgcgtccattgttggcaccaccgccaccatcatctccatgcctgttgttgttggcattcgctgctgctgatgtcgccgtcgtcaacacgctcaacgaggacagtgaccttggcaacaatgccgtcgtcattggagtgccggttccgcggtcgctgcagaattttggggagtcgccgttgccaaatgccgcaggcggcaccgcgttgggcgtcggcgatacggtgaaacgcgagatggcgccagtgatggcattacccgcagaagagggagcagtgacggcagcagagcgaggcttggtgaagagatcgatgggagacgaacgagcggaaccctttgggaaaaatgggtaaagcaaatgcaaagacagaatttcggaaatttattttctgtttttggcatgcaacccaaatttgcaacataaaaaataccaaaccgtttcgaaacagaccaaaaagaaaattttttaggaaatgtcaaaaacttagcgacgaaaaatttcctgcgcaccgaaaattggatgtgtactgagtcggcggcgcggaacagaatgcacaacggcgaccgcttggcggtggcgctgttcaacgacgccgcagcggcagccattttcagcgaccggtccaactcggcacgcaacagttcaacccgttggatgcgctccacgatggcaccaccgccaatggcactttgggaagaggatgacgaagaggtggtggacgaagaggacatgatcattttgagaataagtcaaaggttatatgggggaatgaatatgtgttgtacttctaatttatatgctaacctgaaaatggagaaaacattgaaaatggcattttttggaaaattggggaaatgaaatttaacaatggcaataaaaatgtaaatgaaacgcattgaaacaggcgttgttttaaggggtaagtgcaagtaataaaatatttagcactttccaatgcaatggaaatgtttagaaaatgtggaaaggcgtggaattttccaaaaaaatgacaatttttttttgtgtttaatttggaatggaaaaaatgcgcttaagcgtgggaggaggggatgggatgggacaaaaatatgtatgtacctaaactcggataaaacaaataaatttgtgttacagagatcatccgacaattgggggggggggggagagaatgaggaaaaatgaaaaatgggtgtcatcacacgactgaccact

SEQ ID NO: 22161 - DNA, 700 bp, Heterodera glycines
  misc_feature (109)..(109): n is a, c, g, or t
  misc_feature (112)..(113): n is a, c, g, or t
  misc_feature (115)..(115): n is a, c, g, or t
  misc_feature (126)..(126): n is a, c, g, or t
  misc_feature (198)..(198): n is a, c, g, or t
  misc_feature (589)..(589): n is a, c, g, or t
gaagcattttccgaagaaaacataacattctcttattactcacaaaacaaaagggaaaagcccattttaggagaagttaagcaaacaaaagggggggggggaggacaanaanngnggacaaacgcncagagaaaagggagggaagggcatcggacagggaaacaaacggaacggcacacggaaagaggggaacggcancagtcccaagggatggcatccgatcttcctcatccctcaaacagactcccatctaatgcatttccgcaggatctgctgctccccctttttgcccccgcccgcacaattccatgccaatttcggtgttgcctatcctatcttcgtccattttaatttcattatccctttgaggcttcccccccccccccccctctaaactctcattcattcatccatcttattcgtctctttcctccttctcctcctcacatcccacccattccattcaccttattttctcaactgggtgccgtggtattaatttgccgaaattaaaagcaaagcaaggaaagtgttgttttttgaaaaatggaaatttaaacgcgggagagtgaaagtgagtgaggggggnagggggggagggggaggtgagtcgaaaaaatacttacttattctaaattttacaatttaactctggacctgatcaaaattttctacatactgtattaaaatctttgtttta

SEQ ID NO: 22162 - DNA, 398 bp, Heterodera glycines
  misc_feature (298)..(298): n is a, c, g, or t
  misc_feature (369)..(369): n is a, c, g, or t
ggggggggggtgccaattggaatttgtcggaggaattgaaatggcacccgatggatgggtggtagggccaacccatccataagtcatattctcgcgtaaattgccgagtcgactgacgttccctttttggttaaatggtagcgcaaacattgattggccactcgctgttttcccaattcgtcattgtctaaattggtcaatgaatgaatgagtgcctttctctgccttttgattcccgcccccttttttgttgtgccttcgtcccatttcaatgccattgatttgctttccccccccntccgtccccaatgatttgtgccctcttttcagcttcgttcctcttcaccgaagacaagatcagtccctgtntcttcttcactccattcactggacctgca

SEQ ID NO: 22163 - DNA, 1660 bp, Heterodera glycines
tagcaaaaaatttcataatttccatcatcaaattgtaataataaacaaaaatttattgccaattgaaaatgaaatcatttattttattagttttaatattatttttaatcattatatttgatcaagatgaatcattgaagaaaaagttgcaagaaaagtcttttgatgaaatatttggagaaaaatggcaagaaaaagaagaacaacaacgaaatgaggagaaaataagagaaataatcagaaaattttataaaataaaagagaaaaataaaggaaaaaggaagaaaatattcagcaaaagaatggaataaaactgatggaaaaatagcgaaaaaattggggacaaatcgaagtaaaatttaccagtggatatcctccctttcctatgctggggatgctgggatagcacataggagaaggcgcgcgtcggcgccttacagtaggagaccggtgctggtgatgtgcgttatcctatggtgttgtactgtaaagtgacgcgatgtcctcttctgatacaacagaactttttgtaacccgatacctaaatactataattttttttttgccgatatttccattagtattttataattaataaaaatgttttattaagcaattttataaaaatggaaagaggatgaaataaatattatcatcaatttgttgtttttttcttcacaatgtgtccatgtttggctatgtgtcacaatttattttttgctatttggtccttgttcattatgctagttaattaaattattaattaaaataaaatagttttttaaataaaagcgagcacctgagacatccgttgcaattatcgcaattgtcagtgaattgttattttcatttttgccgcattttcgtccatattttgggaaagaaatatttttattaattaattatttaaaaattttgattgaaataattttttaattttatttttaattttttttcattaccaaattatttcttcaatttcctaattatatcataaattaggcaaattttcttgctaatttcggcgagatcagaaatggcacacttattaattaggctcattagatcctttaccttgacactaaaaatgagttggacagcatttacgcacctttgacaccgactcttccgacagatttgaagttgatgacgaaatacgattaattttttcaaaaaaatatgtttatcttgagaaaatgaataaaatatttgaaatatttaaacataaattgtcctgtttttgcacatttttgtcatggttttggtcaatgcaaagcttttcattttttaatggatcaaagattagcgtttctattattttcgtgaacagcaacatttttcatgataaaatattaatttgccattttacacaaattttctgatataatgaaatttcataaaatctctttaatttttctaaaatctctttacattgtgaatttattttatttttattgaaaatatgtttattattttcgaatgagctccagtagaaagtaataaaattttatttaatcattaatttaccaattgccaattattttgtcattaagataaaattattattattatttctttgcaattaaacaggatttccttattttattaagtaaaataatgatttattcagttttgtaatcagaaaaaaaatcatttaaat

SEQ ID NO: 22164 - DNA, 1550 bp, Heterodera glycines
  misc_feature (1431)..(1431): n is a, c, g, or t
  misc_feature (1536)..(1536): n is a, c, g, or t
gtccatgaggggcaatttggcactcttttttccgatttttttccttcccaaatatggcagggtgggatccgcaactgacggaataaattaaaaaatatcatttccggatattttgccgtcagcagtgttgaccggtattgttgatgccataaatctgacggtccaacacgatggaaatagctgcgggtacttcgtgtgcctgtatgccgaatcctggcttatgaacaatcgcacatttgttctgcctgatttatccatcaattatgaaaaaaagcgcattttatggcacattaacgagctgtatggctctgataatgtgccatatcatccaagggaaggggtgccaactccttgcccaattgtctatcggcatacggatgaagcgcagtcgacatccaaggccgctgagctaatggaagttgatgaacatgatgatataatgatcatcgaaccacagacaagtggacaggcagttggtgccattctcacccaagctcaagtggccggtgaaaaccaagctgacacgcttggtttggtgtcggagtcttgcatcccgcaagagccaattgcgcaggcagatgatgtaattttcatcagacctaagacgccaccaaggcgatcactgcgcgtgcaaaaaaggctttcagcttctgttagccgttcgccttcaccggcgccaaaacgacccccgccagcaaattcgctgggaatggcaacgccgatcacacggcgttgctctgcatttcacaaggggtggcaatgcgctgcagcagcagccaaacatttcccggaatattgtgactccgggaaactcggtgacaaaaaatgcgccgattgcggtgcacatctcttctcacatgaagacagtaacatttgctgccggaagggaagagttgtgctgccaatgcttaacccgcatcctgatgagctcaaagagctgattgtggggaataagcaatcccgtgaagggaaagaatttgtgcgacacatgtcgcgttataacaacctgttccaatttgcgagcgtttccgctggcaacaaaccaagccctgctggcggtccgatggccgttattcttaacggagaattccatcgccgcataagcagcatgcaggctggtacaactcagattcctggctttggccagttgtacattctggacccagtcgaggctatggaacagcgtcgaaacaaccccaggtttactggggagaaaatcacaaacgaagatgagtttgtgcagggtcaccagctaaatgagcagactcttgagatcttagaaaaaatgatccaagtgcatcatcctgctgtgcaggcatataagcaggcgcgtgagcagctcactgagcttctccaacaacaaaatcaggaagagcttcgtttcttccgcatgactttgttggatagccgcagggctccagctggtcttanagacccaaaattgcacccacaccaaataatcaccccttctacgggtgaagggatgttcgctattcatgcggaccccactggtgctcctccgccccaagaatttgngtagagaacaaaca

SEQ ID NO: 22165 - DNA, 2309 bp, Heterodera glycines
atgcaaatatggtatcattggaaattcctatcattgctatccaatgggatgctacttatctgttgaaattggaatatgacaattttatacgcaattatttttttcaaagcatgatgggacaacacttatgaccatgactgtatgtcctgaatttgaaaaaaaaaacttggtcaacctgaatatacatatacttctgaacaattctaatgctaaaaaacaggtactcacgcgaaaactgaataaaaattttgtatttggtaaattttgtccaaaaatttttacgttggaaaattaccggtttttaccggtaccggtaccggtaccggttgaaaaagttggtaccggtaccggtaccggtttttgcagtaccggtcagtaccggtaccggtttttttgcaattaccgattaccgctcaactctaaatataagttgtggcaaaaagagtaattattttcatacaactttttaaagataaccaaatttgttaattttttgcaggctaatagagaaaaagcttggctatcgaatgatggatgctaagaatgtaaaatgtgattgcctttaagcaaagttatgccatgtttggtcgaaaaattagctaaaatggcggattttacgaaaagacctagcaccttttcaagttaccgggcacggaaccggtttcgggttggtaaatatttaaattctcacgaagtgattaatctcgacggtaaattcggatgagcctattttttaaagaaaatttaattttatgctattgaataaaaacaatatgaacatctaatttccatttgttatcactagggtcgcaacttttagtgaaaaaactttttttttgctcaattgttttgaagaaaggagctcaaaaaacgtatttctgcgttgcgttaaaattttttcatttggacgtcacttttcgtcactagaaatcactattttggcgttttgtcactattttttcactatttcgacattttttggaaatttgaataaatttaaatttcttattcaaaataagcaaaaaaagcgtaaattttttttgggcagatatttagctaataatgacttaatttttgctttatcttgttttttttcttctaaaatgctttttaacaccatatttagacatttttgaaagttttattttaatttaacgaatttgaagaaattttgagaaagtttttttttcatatttttgcacttttatgtccatatttcgcgattttttgtccatatttatggccatatttcatgattttatatccatataattacgaaccttattgattacatttaaacaaataaagtcaaaccttttttaaagaaaatttaggttacttactagcatttacaaattctttttcaaaagaaaattctttaattaaattgcgaaatagatatttgtaatgaatgaaataattcattaattgtccgatcactttcatttttcaccattcattctttgtttgcattacttaaccacataatatgagtagtggagtcgcttaatgatgaatgattatgatgagatggccaaacaaataatttgtataaattttcggctagaatcaattacaatacaaaacaaacaaaaattgcccaaaaatggaaaattgtcgattttatttgtgcgcgaaaattgctttgtggacaaaaagcgcgcgacaggaaaatccgacaaaaaaaaattatttatttgtccattaccgcaattatcagcagacagcaaagcactatataaattggtgaatgtgcggtaaaattaatcaaaaaataaattcaattaattaattaactaattaattttgtctcgaaaatggcaagaaaattcatcggattgttgttggtgctgaagcttgtgcatgcccagtgggacggtggcatgaacggtggtgcaccgatgggcggcggaatgggtggaggaggtaaaataattaattgatttaaataaaataaaaatatagttttaaattcagtccctcttttttttttattaaattggtcatttcaaagtttatgcttttaaaaaattttttaggcttattattaataagatctaattaattaatttttataaaaaatgtgaatttttttttttttggtcaaattcatagattcaaaatattttatcctttaggaataaataaataattttttattaaaggaatgggcggcggaatgagtcccggcggcatggatggtggtggcatgggtggcggtgagatgacgccgatgtccggcggtggcggtggcatggacggtgggatgggcggtggtggaggcggtggcatgatgggcggtggcggtg

SEQ ID NO: 22166 - DNA, 1874 bp, Heterodera glycines
agcggcacaggttggttaaacaattgtaaaaacaaattaaaagttttttaaatggttaggattgtctcaccgagtctcagaaagcgcttgaggatttggacaaagtgcagacggacttgacaacttaaatgaaccagccagcgacgaaaatataaaagtcgagcagaaatacaatcagatgcgaaagcccttcttcgaaaaacggacacacttcatcaaacagataccaaatttggggtgacagtggtgagtcactacgagcaattgcccattttataatgcattttgtcagttcataaaccatccacaaatcagcaatatcctcgaggaagaagaggaagaatgcttgcactatttgacgaaagtcgaggttatcaagcccaaaacattaaatttattactttcatttcaagattgaggaaaatgaagacatcaaggccggttataagttgaaagtaattaagggacagacgctgaaaagttggaccatcaaaacaaataaattctttcatttagttttctttcgacccaaatccattcttcgagaattctgaaatagtcaaagaattcaattggactgcagcagaaccgaacagtgtgacaactgaaatcaaatggaagcaaggaaaaaataaagtaagtattttcttgaaaattggctaaaaataacaaatgttcatttttggacaaaacttgtcagaaattactcaaatttcaaaatttttcctggctcggactcccaggtggggggatatttcgtaaataaattttgaccacccccttgtccgttataatccctaatgaattttgaaatttagaatctgggtttacttttgactcatccggttacacccctgacgtgtaccaccccaactttgagaatttaatcatatattcttttaatttgcgcttcgaaagttttcttacaaatcatttacattttcagttggctaatgggactggaagcgaggaacaaaccttcttcaagtggctttgccagaacattgaacccgtttctgatgaaattgccgaggcaatgaccaaatgctccttttgctttgttactcaatttccttatgaaggtgatcaaagacgacatttggccaaatccgctgcaatattttcttgcgcctgacgtggaagcactcgacgatgaagaaaatgaggaggaggacgatggtggggatgaggaggaggaagaggagaaggaaggggagggccaatgaagaggaacgaagtcccttcccaggagaaggccagcaacggataaatccatccaaattgcattttgttcaattatttattcgttctcataattaccctttgttatgattttcctattattacaaggataccttctcacaatggcatttttaatttgttgtctaaaattaataaactttttcgctttttaatgcatgaaaaagacaattttgcacttattccttattaatggagcacggggatttactctgatgggcggtttgtccattctttggccatggtattcgaaacgggccagttgcgtctgagccaagtttagagcatcataacttttttctttgttgaccaaatccaacaaaattggtatcattcgaagctcttaacaagctctatcggcttcctaaaaatcacaaagatacataggtatactgacatataaaaaagataaattaaaatatgcaaaaattctgactttttggcagtgttcatgtttcaacttttttataagttgttcaatcgcttagaaataacttatcaaaagcttctaaacatgtagagctttcgaatgataccaaatttataaaatttggccagcctgaaaaaaagttatgatgtattaagcttggctcagacgcaactaacccctaccg

SEQ ID NO: 22167 - DNA, 1268 bp, Heterodera glycines
  misc_feature (66)..(66): n is a, c, g, or t
  misc_feature (71)..(71): n is a, c, g, or t
  misc_feature (79)..(79): n is a, c, g, or t
  misc_feature (82)..(82): n is a, c, g, or t
cgagccagtcgattttatcattcataatcctataatacaagcgtactacctagcgggggatgcgcngaagncgctgacnccngctagttccttaataattcttttttgatcagttggcgaaatgtcagttggcgaaatgaatgttttggctgagttggcgaaatgaatgtttttggctagagaccggaaatttcaaatttgcggatcctgttgcaggattggaattcaaaattttttacaggacaggatccggcaggattaatcctgcaaatcctgcaatcctgcatttaaaatctgcaggatcctgcgcaggattgcggattttatgaaatttcaaaaaattctgtattaataaaaaagtctttcaaagtaaaaaaagtattcaaatatatttttaaaccaaaaaatgatgaagatgaaaaattaataagttttttgcttacactccaagcaattgactgaatcttctttaatgcgtttaaaaagaccgatttgccaaattgggtagctcataataatagcttaaattaaagtaaaataatttttatttaaatttctttgcaaaaaagccataatccattatgtatagggatgggctttttaggcacaaaaaatcgcgaaataggcacttaaaaaggcagaaaaatcctaaaataggcacgaaaatagtaaaaaaaaatttattaacgctttttaggtagcaaaacacataaaaaattcaattgtataaacttttttcgaataaggataagtttttaaacgaaaaatttttattaagaaaaaaatttttgaaaaaagaaagtttctgaatatttggcattctatttttaaaaattttcaaaaaatcaatgcaggatcctgctgaatcctgcataaatcaaatttgcgggtcctgttgcaggattggaattcaaaattttttacaggacaggatccggcaggattaatcctgcaaatcctgtaaatcctgtattttcaaaaatatgcaggattgcggactgtgatcctgcaaaatcctgcgcaggatcctgtcctgcgccggtctctaccaagcactaactaaccaaattgggcagaatgcgctgagcaaacggtcaagcccaatcacaaggatcagtgaataaatatagaaatttgccaccaatggcacactttggatgacaaagcattggaagagtgatggacgaaaattgggcagaatgaagacgagaagcggggtgatgggactcagataggcaagcatcacgcagactgcgtggccgcgatca

SEQ ID NO: 22168 - DNA, 1254 bp, Heterodera glycines
gagttattagtgcccatttctaggcttttatttttagcgcctaaaaaacctaaaaaattttgaaagagcctatttttgcctattttggcgttttgccgaaaatttgttaacaaaaatgcaataaaaacaaaaaaatacacccctaagcagagattcaaaaatttctgaaaataaatccgctaagaaatgaacatcttctcaaaaatcgtgtttaaaaattttttttggacaattttttgaatttaaaaaataataatgtaactcaatactgatttgacttattttatttttttttattttacacccctaaatttgagactttttagagcctattttccattttttggagcttattttgggggttttttagagcctaaagcctacctattttagcggtttttaatgcctataaattggagcactattatgtacatatatatcggctcccggtaaattggacaccagaaaattgcacactagaatactggacaccaatggaaaattagacaccggaaaattggacactatttgataaaaatacatcccagtcacaacaaaaaggaacttcaagttttatggctctgaacttgagctcccagtcacaaggaatgatgatgtgccttcaggattggttacctccgtcggctcgacttttaagtgcaatgaatggtgcacctacttcctcccttttaatggccccttgatgaatgatgatgatgggatacgccgtggcggggattgtgaatgaataataaaatccgctacgccaggagggatcgaacttgaagttcctttttgttgtgactgggatatagtccacttggccgagtggatacatcccagttacaacagaaagaattggatattgataatgacttcgaggaactacaacaaaatgaatttgtccgtcctgtaatttcaccccagcccgaaaatctgccagccaaacgacgaatgtcattttttgaacgtctgaaaaatattacaggcgcgaacacaaataaacagggtgcttttttgtctcttaaaattaattttataataaattttaggcctccaaacatcgcaagacgatgacattgaaaaaaattaaagaatttctttcgatggaaattgcgaacccaaaagcaaatccgcttgatgaatggaaggaaattgctccgcgatttaaaatccttgcaaaatttgtggaaaaatatctctcagcacccaccaccagtgtcccgagtgaacaaacattcaaagtcgctcgtg

SEQ ID NO: 22169 - DNA, 1506 bp, Heterodera glycines
  misc_feature (1439)..(1439): n is a, c, g, or t
atgtttagaagctttttctaagctactgcttctcgactatacaattatcaaaaaagttatacactgaaaattgcaaaaagtcgaaatttttgaagttttttcttaataaaattttttctaggcttgaaaatcctttcgatttggtaaggctaatagagcatgttaagagctttcgaatgataccaagattgttggatttggatgccaaagaaaaaagctttcgtggaaaaacatgctggcgcccaaacgagcgcgcccaaacgtgagcgcccaaacgcgcgcgcccaaacgggtgggtcccattcgaacctgggaccccccattttttaactaactcacagaccactaagacgaaaaatccaacttaattgtacttggagcccaaaattgaatcgccgtgaatagagatcgattccgatctgccgggccgaactgacattttcaaaaacgaccggtttccgggtccggtctctcaaaaagcggtcaaatttgatttttccaaaaatcaccggtctggtttccgggcccggctcggtttttatttttagtgcctattttagcagattttttagagcctaaaaattggatccctaataatagtatgccgtctaccgctattccaactgcgaccattctatttttccaagatgaaatagataaagaaccgaaaaaccgtgactttagcagagttaaagatgatgcattctgggcttttttacgtggatatcatccgctggacagtcttcgaaaagtacgttagcttagggctctatctccaaagtcccgaattgaaaaagaagggaccgagtttggcatcaggccggtataggattaccggaattcaaagcccgattttaaatttaggtaaataattattggaaattttcacaattttgaaaaaaagcccagtcgaaattttgacctggcccgggatgtccggtaaaacgggctttttttgaacgggcggaccggtcaactgtcaaagcccggtccgggtactttcaaaattccggtctctaataggtatgatattgccctttgccttcaaaaataataaccttcagcggagattggaacaaatcatcgatctgattcaagaatatggtgtgagtaggccacgagatgtgggcaagtcaattttgcttaacacgctcaatgaatgttaccgcaggatttatcacattaatttgtttaatggaaaaatggtgagagtttcatattaatttctattaatcaacactaaaccctttttccagttaactgcaatttttgggacccaaactggcaacaaagatctcgacgtgttcaatttcatacggaaatggtgtggcgcaatttttcgagcagaacagcaaagcggccattcgatcataagttatgtgcttgaggattatcctggtgaagcaaaggatatttttgtaagattttacataaaatanaagcagaattgtcattcattttttcatctttaaggtttcatcccgtcctatttatcactgcgatata

SEQ ID NO: 22170 - DNA, 1130 bp, Heterodera glycines
tatttttctttttacaattacgccagctaaatttgacaataaggcagacaacattttttatatcaaactatgtagtagtgtgccgtcagttctgaacgcatctgaccccaaacttacaagtaaagacattaaatatactgtccccataaatttatgaattattttaaagctcattttattttaacgagtcggattgcacaagtcaatgctggttggtttctttattacgttcaccgcgaatttttcgcatatggtccaaatctatggcgatttccaacaattatccttaaccaaataaatcctttcgttctgttctaaaaaggcccgttactttaattttgtatcccggtaatatttcgtatttttctttttacaattacgccagctaaatttgaaaaaaggcagacaacattttttatattaaactatgtagtagtgtgccgtcagttctgaacgcatctgaccccaaacttacaagtaaagacattaaatatactgtccccataaatttatgcaattattttaaagctcattttattttaacgagtcggattgcacaagtcaatgctggttggtttctttattacgttcaccgcgaatttttcgcatatggtccaaatctatggcgatttccaacaattatccttaaccaaataaatcctttcgttctgttctaaaaaggcccgttactttaattttgtatcccggtaatatttcgtatttttctttttacaattacgccagctaaatttgaaaaaaggcagacaacattttttatattaaactatgtagtagtgtgccgtcagttctgaacgcatctgaccccaaacttacaagtaaagacattaaatatactgtccccataaatttatgcaattattttaaagctcattttattttaacgagtcggattgcacaagtcaatgctggttggtttctttattacgttcaccgcgaatttttcgcatatggtccaaatctatggcgatttccaacaattatccttaaccaaataaatcctttcgttctgttctaaaaagcccgttacttttattttgtatcccggtaatatttcgtatttttcttttacattacgccagctaaaatttgaaaaaggaagaaacattttt

SEQ ID NO: 22171 - DNA, 1934 bp, Heterodera glycines
gtagcctaattaaaattataaattttcgcatacttctgaccgaattgcgcgcaacttttaaaattcaaaatcgccgcataattagttactttttgcgcggatttcatatggattgtaataccgtagccaaaaattttgtaatccaaagagatgctttatacggtatcaagtcagtctagaaacacataagaaaaatggaattggtaaaataattttcaaaaaattcagctccccaataactgaatcgactcggaccggaccaaaatggcataagcatttaaatgggtaaaccgcaaaatgtcgccgccgaaatttaaaaaaaaaagttcgaacttagaaagttaaatttctgtttgaaaattaaaaaaaagagatttggcagcggcgaaattttgtctcctccccatttaaatttggcactaatttaaacgccaaacaaatggccgcgtcgctgcgaccttttccaccgccgcctcaagtttcctacggtacagctcgatcagcttgacgcgcttgtagttgtgcaggaatgtgatcgtttcgtccaactcctcctgctcagctgcatccacctcaaaaagtgccaaaaaatgacgaaatgccaaaaaaagttttgaatttatgctacaatagcggcgcacctcggcggcgctggcgccgttttggcgtgccaatcggcagccggcagcgccgcccgcgccgtggatcggcactagcgagaaggagcgtttcttgcgcaacaccatccggcgccggagcggtgatgtgccgctggtcgccgtcgcgagttcaagcggccattccggctccaaaaagcagccgcgtttggtgacgacgctcgtcgacggttgcgcgtcatccgcgactccgccgccaccacctgctgatggtgtgggttttacagaatgccaacatggcgcagcgccatgccaaccttcgatggagatgcgtggcaacggtggcgacagtcgcggccgatttgtcgcggacgcggtggtcgctggcgccgcagcaatcgccgctcgcggcgtctgcggcggcggaatttggaagatgcagtcgcttgtctgcgccagcagattgactaattgcaggcgctgtggcgagtcggcgcggcccagcggcggaggcgtcgacggtgaagcggcggacgacgacagtcgccgctgcgacgccggcgagaagtcgaacgcggcaccgtttagtagcggaaagagcatgcgacgatacggggcccggcattcgccgcagtcgttttgtagttccgcgtcagcgtccgtgtcgtagtcgccgccaccgttgccgcccatgacgagtggcggtcgcgacggtacgttccagcgcgggggacgccgcacttccgccgacccgcccggcgactgttgttggtgctcaaaactgaaggacgcgtgccgtacttccgcgctcggcgtggaccaggcgggcgtcagcaactgttgggaggagggcgtcaattggcgagtgtcgcaaacgccgccgcccgttgtcgcgttgccgccgacggtatcacagtcgcgtgtcaataacggcgtcgggtcgctgtacgccctcgggcgaccgacagcggcggcgagcggtcgcagcagtcgctgctgctggtgcagtcgctgaagtaaaagttgtcgccgttcggcgggcgaccgttgctgctgctgcatgttgcttgacgcgcaaacggtgccggcacgcttcaccttcttgaacgacttggagaagtcgagcagcgcgcgttccgggtcctcttgctggcgtcgcagacgccgcgcgttgcgcgcgacaacgccggttgggccgccgaagccgcgcgtctgttgttgttggtggggtctctgctgcaactcgatagccgcttcggccgatgcgtcaacgcgtgacgtagacgagtcgcagagagcgactcgtgtacgcccaaa

SEQ ID NO: 22172 - DNA, 1825 bp, Heterodera glycines
  misc_feature (9)..(10): n is a, c, g, or t
  misc_feature (20)..(21): n is a, c, g, or t
  misc_feature (1809)..(1809): n is a, c, g, or t
tctagagtnncggtgaaatnntgaattggaaataaaatgccaaagcaaaaaaacggagcacggcattttacacagtatgaaatcaacccgtggatgaagcggggtacggtagtggacgaacggaaagcgatggaccaatggacgcaactcaaaagggccattgagggggagggagtcgaagtgagtaaaacgaaagcatagaaaggcacggggaaagcccaactgaatattgttgccccttttggtgctgacgctggaccaagtgaacggactgccggacatggtcttcgcctgcaacagcggtcagtccgcacagagacggcactttcgcaatgccaaaaagcgttaaatgaaccaatgaatgaattccaacaaactctttgccaggccttttctaccgcaataagctttacctttcccactttcgccacgctcaacgaatcggagagcagcggcacttcgccgacttttacaaagggctcggcttggagctgtacggcgccgattgcgcggaagtattcgaaggcggcggcgatgcgtttttctccgacgagcgaacgctttgggccggctggggagggccgaggacgaacagaaaggccgggcaaagccaacgaatgcatcgtgacgagggatttcggtcactttaggcctacgaacacatccgaaagatgggcgacttcgaaacagtgccctgcgaattggtcgacccgcgcttttaccatttggacacgtgcctttgcccggttggcattgactcggcggtaagttttttggcatttttcaattttatttcatttttcagctttggttccctcccgctttttctgagaacaccaaaaaagaagtgaaaatatttcgatattcattacttttacgcgttccaatttatttaattattccatttttaattaatttttaggttttttaatcccccccccccttcttttggtcctacggcgtttgccgcgggcgatcgcagtttcggagaaagaagcaatgacgtttgtgtgcaatgccatcacaatccgacgccgagtgatcagtccgaagggaattagcgaagaaacacatgcgaaattggcctctattggctatgcagtcaaagaattggaaatgggcgaatttatgaaagtggggagagggattttaaatggtggcgatttaatcttttagtccggtggtgcatgccaatgtttggtgatgaaattgtgaaataagggagttttagaaatcaacgaatctaacccagccacatgttgtcttaacaaaaaaattttcatttacttaaaataaaacgtaatatgtgcaccgccctgaagaaaacaatctatttgattggatagcaagcagatttaagcgcacaaaatcaaagatcataaaaggcaagcgccaagtggcaatcccaaaagttaaacaaaaattaagtttgaaagaataaataaaagttgtcgaaaggcatggatcaagattatgtcagatcaaatcaaaacaaattacccgagatcatcccatccttcatgcattaaagcgagtgtccgcgaaaatatgtccattgtagcagaggcgtctgttcaactgctggtagtcgatttgctggttctcggcgcgcgggatatattgtggagtgctgcaaaagcaagaaaaactcttaaaaggcagttaaataataccgcttcaattccccaaaattggcacgaccacgcttagccaattctttagcctgacgaacaggagttggcaaagccggagccagcgtaacaatttgccagctgcagcagagagcaagcaagaaactacaaaaaattnagttgtgtataatacc

SEQ ID NO: 22173 - DNA, 1663 bp, Heterodera glycines
agtcgatgacttattttccagatttttataaaatttaattatattttttctgggcatttcatggatttttactcttgtggacatttcgtggcttggacactttgtgggtcagcggtttgaatccgtttggtgtgtacaaattaaatacaaaagtggaaacaaagcaaatcaatcacaccctttgcttttttctcaaatcactcatcaaaatttgtgccttttgtgtcacatttctccaatttctcattccctgccaataattccttctgctgtttttcgatcacatttttcaactccctgaataaatttgattcttcgccacacaaatttgaaattaattgctccaaattttgcatttttaagtcattaaaaatgacaattttccgtgcatcattcccctcaaggctcaaaaattcttccaattcgcattctccatttaaatattgcacaattccttttgctgataagcgtttgtccggctttagttgaagcacattctgaacaaatttaagtgttttaaaaagggtctattccattttacgcgtccaatcaatgaccatccttagcttcttgtgccataatttttcttaattgatcaatgctaactttttgatatcaaacgaatgcttaaagtctgtcacaagaaaataacaacaaaaaaatgttgacattaagaaaaaagaatccgggattcagtattttttgagtatattaaagaatatttttttgtgtctgtttgctttaacccagaatttagctatattcagaaaatacacccctaagaattgaaaatttttctcaaaaattgattgccaaaatttaattttttttttcttgataaaaaattttaggtttaaaaattttccttattcgaaaaaaaaaatttaaaaaccatttaaatgaccaaaattaagttttttgattaagttttacgtgttttgctcactaaaaatacttaataaaaaatttttaaatgcctttttcatgcctttttcgggattttcgtgctttttcccaattttttatgcctattaaacatttgtgccttttttacgttctctaatcataagggaaacaaaaaaacacccttaaaacgaaaaatattgagtaggaattttggaaaaaattgtttataaaaaatgtaatttaattgagggaacaaaactataaaagaaacattcaaatttattatcagggaacggatttatatgtttttacatattttttttgcgcatatgccatcgcatgaaaagctcaaaaatagcatttttacctgttttcctttcaatcagagcgagtttttagcaacataaaaaacatattttgatagggtgactgaacatttgcgccccgaacatttgcgcccctacatttgcgcccctacatttgcgcccctacatttgcgcccctacatttgcgcccctacatttgcgccacgattgtgaataaaaaatttattcatgaaattgccttttccaagagctaacgggagtgatttaatggaatatgcatgattttgtccttgaaatataggacgcactaataatggcctataaggctttcactccagcttcaacaagcgattttcggctcctaatccacctttgccaacgtaatttaagataaaaataccaaaacaattaaaggtttattagtcgaatca

SEQ ID NO: 22174 - DNA, 1489 bp, Heterodera glycines
tggtaattttggatcattttggtgagcaagggttaattttggtgaatggtatggtaacctgttaggagtcgaagatttggtatcaccggcacgatattttggggtttttggaggagggacttcaccagcgatgcatcgtgcgatgtctgcatcaattgacttttctcatatcgaattgtgttgatgaagcggaaaacagttgatataaacaagcaaaagcccgttgagtgaaaaaaattagggtttactttgcctgaagctataaaaaggcggtgccaaactgaagtttcgctttgtttttattttctaattgggatattcatttatattgtagctaaacatagatattttaagtttttccttgtttataattgacaaaaaacattttaagagttatgggcaaaaacagcttgccagactaaccgacccttctgatctactggccagactaaaacggccagactaaactgacccggtccgtaaattggtcactcactcttctctcttttttacgcattttcaacgtgattttttcttgacaaatacaaaaaaatttaaaaatttccatttttaaactttggcactttttaaccctttaggcttcttaaaaccctatgaaattctgttctttgctgaatttccgccgttctcctcctcctccccctccgccaatgcttacaaattctgtccctattgatttacgcttttacattaattttaattcggctgaaatgtctttcgctttaatttaatttttcatttcccggctttttctccattattttgcccattcgctgtattttctttatttaacattctctccccccctttcgctgcccgcttttatccgcttttctgtccacactttgtctttctcttcttcgtcttcttcattttcgtgctttttcttctccgttttgttcatttgtccgcttcatcctcggcggggcttatccccccccccccaattttcgatctgtcgcccaggaaccacctattgtgatgctttgtcccaattgttcttccaatgcttccggtgacgaatacaatgaactaaattaaacgcaaaattccaaagttcggataaaaatcaaatgctttttgtaattgctcacccaatggaattagagtcactatcaagtgcaaaagtacacatagtgacaattgttgtcccaagtgtaatctttatgctggttcacctctttctccaccataattttactacgaatcattatccaatgatcataatcgctaaagcacaaaaagcgaatgtttgtctaaagaattgggcaaattacacaaccaaaaatgtcactgatccggtgaaatagtccgtgctgattgaatacgtaatccacaagtgcaaatcaatgcctcttgtatcaaaaatgtgcagatgtgaacgaagagaagcgttgacgaagagatcaatgtcgctgagaaaatggaaggaatgattttattgccataaaggtttgattattaatta

SEQ ID NO: 22175 - DNA, 2067 bp, Heterodera glycines
aaaataaccaaattttgcgcgcaaaccttatattccctccacgatagtgacattctgccataaaatttcaaaattttctatatatttaagaaataagaacaaaataagaacaatagcccgaaataaggacaaatcttacaaataaggacatttttattttgtaagatttggaccctccaaataaggacaaatcttataaataaggacagatccgagccctgtgctaaaacaaaagtctgaggaggaaaactaaacaattcacaaacactaaattaagaacaaaacgccaaataaatttaaaacataaatgaataacgtattatcatcagagtgctcagttttcagcacacaaaaaaacaccaattaagcactgtaaacagcaccaaatttttccaaaataagcatgaaaaaagcacaaaaaggcaacatcagcacaaaaaattggaaaaaacataaaattaagagattaaaggcaccaaaaattgaaaaaagtcgtcaaaaaaatgtttatttgctccctgattataaaaaacctccaaaataggtgcaaaaaatgctaatgagatacataattttaaaaaatcaaaaccttgtcaaaaaaataaataaataaattttggagatgaattatttttgataaaatttttcatttcttaggggtgtatttttcgtttttattgtttttgataataaattttttgaaatgctgaaaatattttaaaaaattgctcaaaatgatgaaacagcataaaaaagcaccaaaatgccaaatcagcacaaaaatcaaaaaatcgagaaatcagaaaaaaagtatgaaaaaagtcgactggaagcctaaaaccaagttagaaatgcgtttttcatgcttattatcacgccccaagttagcaaaaaaaaagcatatgttgcaaaatgagcactctaattatcattcccctaatattttataacatttgttagaggttcggatccgctcgacagatattgaattattttgattttcttcaactattattccatctagaatatttttattagagatcggaccggtcggttttttttcagttttttcggtatttttcggtttttgaccgaaaaaaaccgaccgagaaatttttgactttttaggtttttttcggttcggttttttaaccgaaaccgaccgaccgaaataatcaaaaaaccgaaacaaccgaccgacttttatgaaaaaccgaaaaaaaaccgaatcaaattggagcgatatacctgttaataataataagtttattgctttttttgtgctctttttaattttgaagaatttattgtaaaatattttctgctattttgaaaaaaattattaacaaaaatgcaagaaaacgaaaaatacacccctgagaaatggaaaattttatcaaaaattcatattcaaaatttatttatttatttacttgactacatttttgattttttggctgcctttttcaattattttcccaacttatacaccattgatagagcttcaatagcactacaattttactcagaggtgatctttctctttttctattgataaaaatggtttattgtttttttgggaaaagataaaaaattcaaaaaaaccgaaaccgaaacggtataccgaaaatttttcttcgggttttttcggctcggtttttttcggtttttaaccgaaaccgaccctcttgtccggtctctaatttttattcagaaaacgagaataagttaggaatctagaaaagatatattatcttccttgctatattttttatggatttaagaaaatttaaccattcttatcgtttttcgaaacttttagattttttatgatcaatattgaggtcgacaccaaaaaagccgaaaatttacaatagcaaattactatgctcttaaaactggttttatagtgatttgaacacttcagttagaaattccctgttgagcaaaagagaaataaactgggagcacaacttttaagaattaagagctcaaatggaatttattggaggaatttccatattggaatggtgcatcaaagcatagagataaaactgaaaaaagaga

SEQ ID NO: 22176 - DNA, 2208 bp, Heterodera glycines
atcatagacataagaatcacagaaaatgcttgactgctccacacaggacgcgagtccaatctgaaaaaaggttcgtccgcctctttagcattttcgctttacccacgcgcccttttgcggcagaaaaagaaagtaattgagagagaacaccaaaacggaagagcaaatgctggccagcacatagcataacaaagtctgcttgttttcttcataaatttggcgttgtccgcgcgtcgcccgcttcgcacttttctgctggttcatttccttgcaatttgttttgttacggttttaaataattcaaaaaaaaatcattgggagatccaattgcaaaacgaatgaaagaagctcaaaatgaaagcatagaacaccagtttatccgagtcatattgagggcaaaagctgaaacaaaggcgaaacaaatcaaactgcgcaatcaatggaaattgtagaggaaaaagaacaacaacaggttgcaaatgtccacgagagaacggcttcagcacttcaatgcaaaacaagacggaacacttcattcgaaatgaaaaatcccccggaagaatttggtctcagaatgaagcagtggttgaatgaattcactgggtcatcgtcggtctaaagcaaagaacagttgaataaataaaccactgtaaaggacaccttaagctgaccaatcaccgtcaccaaaattgacccatccggaagcggctgactgtcagtctgaagttttattggttaataaatttccaaaccgaaaagaatgaaaggcaaaagactaatttggagaaaacctttgtaatcccatgttgaatcgttcggaaaggtagcgcctaaatataaaaaaaattaacgattaagtaaacataaagcaaaaaacaaacacttactccatatttgtccaaaatggcctgtcgacctttcacttggttcccctcaaaagtcataaaagagtgttcagcatcatacaaatcatgaaggccgacggtgcgagtcggaccatcgggcacatcaaatttggtgtaaaagtgttggacaaaggcctgcccaatggattcatagttgggattgtaagtagccatttgatatggttatatgtaactagaggagcaaacaaatttagagacttagtttttgaaaaaatggaattcttaagaaaaatgcaccaaatttgtggaactcgacaagtatcattaaagcaaaatgcgttttatggaaatcgcaataggtgcctaaatatgtagacaccaaaatgtcaatccctaaacgctatttcggaagccaatttccaatattttttcagccgtcggaatgccgattttcgaaatttttgcaaaaaaaaaagccgaaaatttacaaaatgttcccttgtaagttttgatcaattgtatattggctattaaaatttttgaaaagaaatttttttcgaagcaatgttaaaaaacaaaatgacgcacaagacatggacggtaaaaaacgaaaaaaattgccaaaaaataattggcgtaaaacaaaacgccaacacacgcaaaaacaaagtatatgcacttacactggtaaatgccttttttgtattttttattttgatcagccataacacgcttcattcccaacaaaagtgaacaaatttgatatctaaaaaaagattttgaaaaggagaatctttttctaagtgaatgctaagcaatttgacatctcagaaaaaagttgtgatactttcaaatttttatcacgttataactcaagtcctaaactgctgttttcaccaaaaatgctaaaactattaatttctctattaattctaaatgtcctaagcgattttgtacccttataaccaaaattattagaattttcgaatttatgtttttccatgtgttagagacatgaaaatagtacgccaaaaagagagaaaaagtaatgcattttcatgttttatatatatcttttgaaaaagtgtataaaacataaaatggctgcattacattatgcagaatttttttctcaatcgattgcaaaatttggtgcaacttgtatgcatagaaaaaaagttatatggagagaagtaaatgtagttttttacattattaagaatgaagagatagtacgtaaaagtgagagaaataaagataaaaagtaaatgtgactgaacgccaattttttccataaaaagatttattgtcgctttttttttcttttttaccgtccatgaag

SEQ ID NO: 22177 - DNA, 2454 bp, Heterodera glycines
  misc_feature (138)..(138): n is a, c, g, or t
  misc_feature (148)..(148): n is a, c, g, or t
  misc_feature (178)..(178): n is a, c, g, or t
catccctttgatgttgccgccctgttggattttaatttacccaaatccgttgcgggtgttttttttcacccggcgcccgcgcagcgcgcggggaaggtcatcaatcatccaccttgtcacaatgtgacaggtgaaganaattcaattnttcttttgcaaatttaaatctttttgatcncaaacccttttgggccggttttattttctcaaatcctgagattttttatgatgggtttttcggatcctgaaattgaaaattcattttgaaaattagccaaaaccgtgcggtttttatcaccttcttccccctccctccccgcccgtccggcgatgcgatgccgccgccgcgaaaagtaatcgataatggaatttggaagaagtgcaaattaattgatattggcagcaaataatttcgattatgaattggacaataaaattacgatttaaatccaatttaaaagtaaaatcaaagaatgaataaataaattaaaaaactttttcaaaagtaggtcacctgtcaaccaaaattgattgatgggtttttatttctcttccattatttccgggttccgagcgggtgtttcgcgcacaaacccttacctatgggaggggtgcagctctttgaagttgccgccccggacattttcccgcacaatcccaagcctataggaggggtgcgtgccaaccgaaacctatgggctgtttctttgaagtctgccgccttgtggattttaatttccccaaatccacgcgggtgttttttcactccgggccgcgcagcgccgcgggaaggtcatcaatcatccgtctgtcaccaaaagcgacaggtggaggaaattcaattcttgcaaattaattccaaatctttttgctcgcacgcaaaccttttgggcggttttattttatgaaatcctgagattttttatcaagattttttatcctgaaattaaactattttttaaaatttgctaaaaccgtgcggttttttgcatatcttcccttcgccgcgcagcgccgtcatcaatcatgaacctgtcactaaagtgacaagtaattttcaaaaattcaatttttattttgcaaatttaattccaattcttatttatttattttggattttaatcaattatttgatcccccgttttccaattctcaattatttttgccacctcccccgagctcgtaaacctcgcgggtttctcgcgggtgtttcccgcacaatcccaagcctatgggaggggcacacaaacttttgaagatgccgccctaaaattccattccccgaatccgagctggcgtttaccgcacaaaccggttctatgtgaggcgtcaaacttttgaagatgccaccaagatgcaaaacctatcggggcaaaccgaaaacatattagattccctttgaagttgccgcccacataaatccgatttccccaaatccgtgcggttgctttttttttgcacatccctccccgcgccgcgcagcgacgcggaaggtcatcaatcatccacctgtcaccagagtaacagggggaggaaatttgaattcgttaaaaaggtgctatttttaaagtacccaaaaccgtgtgggtttttgcatttccttcccgccccgacgatgaggcacaatgcaggcgtcgcgcaaattaaatcgataatgaaattgtagaagttcaaatttaattggtaatgcagcaaataatgccgataaataaattaatgaactggacaataaaattaattatccaaatccaatttaaaaacaaaatcaaaaagaataaataaacatgatgaaaaaaaacttttccaaaaataggtcatctgtcaataaaatatgattaatgatttttagtaatatgggccaaaaatttttttaaaaatctttgattgataggctttccgtttttgaaacgctttcgcaatatggacccatttttgaaatgattaatgagttttatcctttccaacacaatgtgcaagtgacagacccaaaaccgagcgggtaccggaatggcccctccaaaatccgaaacctattgaaggggtattttcctttgaagttaccgcccgcttgcgggggcggtattttcttttgaaattgccgctacgtgatacttccccgcaaaatcccgagcctattgaaggggtgtttccctttgaagttaccgccgcgggattttctcctaacctattgaaggggtgaaatccgttgggtgatttatgaacaggttcacaaatcaaagatattgtattagtttaaccctttaaagtcgccgccacgcaaatccgatttccaaaaccgtgcgggtattttttttgtctccatctccctctccgccggtgcgccatgaagtcgccctgccgagcaccgccgcggaaagttaatcaatcattcccctgccacaaatgtgacatgtgaaaatactttcaaccataattcaagttcttatacatcat

SEQ ID NO: 22178 - DNA, 1570 bp, Heterodera glycines
cttccctcctcctcttcccatcgctcgctgtttacctttttgaattagcattttcctcctccctccccctccccctctccccacaaatgggaggggaatggacagaaagaaagcgatggcttttatgggtcaaagcaagtgaagcgagaggcactggatgagttgggggggggggagagatggttgtattccttcccacattaatcaaagccgttctctctctctcccattcacaaatcactttggtgaccaaacgagaggagcgcgaaatggcaatcaaaaattggcaaaatggcggcatgaatatcatgaataaatgcatttcaaaacttcaatcataatacatttgtctagccaagacaacaagcagtctgctgtttgattggttgcaaagcaaacatgtgatcgggaagactttgggtacataaaataaatttctttccatagaaaccgaaatcaaaacattgtgccaattaagtaagtaaaatacggtatttttggcaaataatcttaccaattaccaaaagattctctaccacatccttattaattcatttgtatatatgtaaatgaatgttgctattattctgctgatgccatttggcattttttccatttttaaatttttatttcatcggccgttgtctcattcatttatcgtcatcctcatcatcattcatccgttctctctcacatccggtcattgttcgttcgtcgcgttttcatcgttcgccaagtgcacatcgccaaactctctctctctctctctcttccgccaaatggcaatttattatccgtttttttcttctccttaactggacggacggacacacacaatttgcgttcattttgagcgtcacctttgctgctgccagccgccaatttgcccacggtgaaagcgacgcaaacagtgcaaatgggggggggggggggtgggatgattgatggctaatgatgtgttgtgtgcctaaagtgcctagttatggattttccgaaaaatacttcactaaaatgaaatacaaatcgaaaacacatcccctaagaaatgacccagaacagatttcataaaatacacccataagatttgaaatatatatttgtacaaggatcccaaaattaaatattttatattaataaaaattttttgaaattataatatgcagattttcgtgcctctttgaggattcttgcgacaatttaatgactatttcgcgatattcagtgcataaaaaaggaaaccctagctattgtaaatagaaaatctactgagattatacataatgactgcatagacaagatttcagacacttgtttggtaacattcttattatcattttttcttcccccacgattgtcgccaggcatgttactcgtaaatgacgatgtttatggctgatatgcggattttcaaaattttgatatcgatactcagctcctgcctaataaatggattggtaatgaatttaatattaagaaagatgactctgtttttaaattaccctgttggttaaatttggttaaaatgtgccaaggggttcacattttgaaattattgatataaaagaaattg

SEQ ID NO: 22179 - DNA, 2139 bp, Heterodera glycines
ataatggggaggggcataacatgctatcaattaataaacaaatgcaattagactgacgggtgactctgtcgccataaaattttcaatttttatcctactaggcccgtgcataggagagcatttcggaaatacaaatggattttttgatgaaaaatcgggaaaccttacttgccaaatctaaggcttattcgtaaagcaaacaaagacaattctataaaaaatgagttcaaaaaacaactaatttttaaacaaagaatcactctgagattcattatttttttcgggtctccgatcacattgaatatatgaacgagctggggaggcgaccggaaaatgcgtcagtggaaaatgcgtcagtggaaaatgcgtcagtggaaaatgcgtcagtggaaaatgcgtcagtggaaaatgcgtcagtggaaaatgcgtcagtggaaaatgcgtcagtggaaaatgcgtcagtggaaaatgcgtcagtggtttccgtgtatttaaaatgattttgaagaaaaaccctaatttcgaaattttgactttcgactctttttcgaattcgggttcggggttcaaaatttagaacgatatatgattttatataatttcatgtaaaataatttaaaaatatacaatttgaaattgctttgtcggtgctttaagttttagtttaattgttttgctatcgaatcgaccgaaatattttattctaataatcatttttttcaattatgaatattttttccaggaaaggggccggtttaaaaactttgacccgggcccgagcccggcttttctggatcctggcaatactcagacacagtttttgtccaaatgcctgggcccttgtataacactagtgatacttttttctgaattaaaaaaacaaaattatgttcaaattttaatgaaatatatggaaaagtcatcatcatcattatcaatcattttacagtaatggaatttgccggatttataaaaaaattgtaaaatgccaaaaaataggggggggggggatttatcttcatcattaattataattcattttaaatcaatcatcggtaacatcttcaatcacatcttcagcattatgctacttgctgctgcattagacagcttggacaaattggacgggatggcccgtctcggccataacattggccaccaaattggcattggtggcggccaccacctcggtgaaaatcattgacacggagccgaccaacggaattggcacactgtgccaaacgcccgggttcagccgaggtgcttgccctgaaaaacagcggaaaacatatgtgtgccggacgccagaatgacaatttagacaaccaattgtgcgcccgattaattggtgccaatgaattaattaccaaataattaagtagcacttattaaataattaattaattgccagacagaaactgcaagcatgtagaaaagaacgtgcaaaaacaaagtcccgtcatttaaatagattcatagccaaatatgtggaaaatgccgaaattaaacccaaatatataaaaaaaaatttttgaacaaattcttgagactttaaccttaaactttttaagaggctttttaataaccttttggattagccaaattcagagcccttaattaattagtaaatattacagaaccttaatcggttaacgaggcataaaaaattcaggaatttgtcgcctcgaaataaaacttactcggcaaattaatgcctagacccaaagtcaagtcgagaatcatggtcttgggactgaccatctctgaagatgaacgcctgcagtgtctggtcaatgggttcgcccgtctgcgtgtcggccaatgcgacggccattgcgaaggcgtcggacaggtcggagggatgcaaatagaagctaatcaagcgagaaacaaaaatcaaaaattttaatttaaaatttgcaaattgctctttgacctgccatccgggcgtgccatcaacgactgaattccaaatttgaaaataattttaaaaaatttttctggtgggggcggaggggggggggcaagaaagatcccaacggaaccgaactcatcagtcccatcggattgggttgaaaatttaacggtataactatgaaaaagtggtaaagcggtagaggaataccgtaaccaataata

SEQ ID NO: 22180 - DNA, 1278 bp, Heterodera glycines
gcaaaggaaggacaaatggcaaatggggacgggagagggcaaatcgatcatttggcggtgggaggggaaagtgagggaaagtgaacggaggggaagggaagggaagggaagggacagttggcaacaattggcaccgcaaatcgcacaattaaaagggcatttcataaattgacagattctctttgcattatttacaattaaattacaatagaaacgaaaaaggctaaggcatttggcgcaaattaatggacaagagatctcagcgaagcattcattcactcattcattcgttgtccttcacttcatccaaagtttgcatttggtcgacccgttttttaatctgcgatatgtgcggcctttccgagggccgtattaaaaccatcgattggatcagttcggcaatgtgccgatcaactctcaaaaataggctttattactgctcgcttaatgagattagaacttacggcaccgccgtgtcgaagtttatcttcgccgattgtaccgccaaagcgacgctgtcgcccctttcatgaacgccgtcaaaaggcgagcgaaagtaacacagggcgaacaacacacagccgagagactgaagacaaaatggcaaattgggggggggggagtaatagaccgattaatagtagtcagtcgttaatggcatttccgtccctaattaattggttttaccaaaaccaatggcacccacccaaatgtccacgctttccccaatcatcgctccaatttcacacgtgaataactcaggtgctctataaggcctaaaagtaaacaaaaagttcgacttccgccgttcgtttttggtactacaaaatgctcacattgtgcaaagttcggccgcctcgtccaaaatgcgtcggctgtcgcgtgcgtccaaaatgcgcagcggacactcagtggccgagccaaaatcgatcagttgcaatgtttgggggtcgctgaacatcaaattggccggctttaagtccctgcaaatgatcttcgcatttcaaaaggaaggcattgagccgaaaaatgcctatgggcaatgggcggacgatcggaatggagcacttcgatggcacagcaaatctgaggggggaaaagcggcgaaaaatgccattgggcgagccaagggaatgttttactttgtcgaacagaaaaagcactctctgctggtcccatgtaatcgtggtctgactctctcagacaaagtcgtcattcaaactgccgatctggcaccggaaaatgcatttcaaggaaaaaaggggggggggggggggg

SEQ ID NO: 22181 - DNA, 1483 bp, Heterodera glycines
attctttctctttccagacattgtcacttctttcctccggctgagatctcctcgaagttacgtcggttcccttcgggcagcaccaggtattgcatgtgcgcgtcacaggtggcctttgtcttctctgggattgacacaacaggcacaagtgctccatacagtgccacttgacccgtgattgtgcagttgggacgtattttggcccctctttccagtgagatgaaggccatccctcctgccaggccgccggatggcccagacctgttgtagccggcctttacttaaataaacaaaaatttcaggtgcgtgtgctcttcgaaacatggaagagggaacatttgaacggagtgctgcagcaattaagaggcatgaaaccaaggaggtcccaggattttagttttttggtgggggaagaaaagggtacagccttgagcgacctttttgcttttcatatcaccgtttttgtaatcacaaaggggaataaatctcattttacaattagccgaaaattgagtttttttcttcgccaaattttaattaaaaaaaaaggcaacgcttaaaataccaaaaaaaaccaaccatcgacaccacattcagtggaggcgcgcttggtccaaataagtgttcttctctttgcgcattaacactttggcggcgccgtatgcattctgctgcgaacacaatgcataagtgtcgagagagccgccaccgcccgtgaagaagcaggttcccctctctgagtggctgttcaaagggtcggcttcggccacctcgaagtacatcaggccgccagcgcttccgcttcttgccaagccgacagaaacgccaaccatttttgcacagactacagtttttttataaaattcaattttacattttaaaaattttgttttataaagttgccagaaaaaattatgaattttttcttaaattttgtcttcttatctagatttacttgtaatcatgtaagcatccaaccgcttaaattcccctgtgtatattgcaatttttgccagaaattttcgtaaattttttgatagggaaacggccatagggaaacggccacaggaaatggccatagggaaatggccatagggaaacggtcatagggaaatggctcgatccccttctaaaggggcggaagcaacttgatacaattttaaattgttcatatgatgtaatcccaactttgccgtctctctgtgattggcagaaatcactagccgttgttggtttgctgggggtgcacttcatttcccctgtcgaaccacccctccacaataaaaagcaattcttgacaaaaaaattttttgaaaaaataccataaaatttcaaataacgctagaaagcttcaaaacaatttgtttagcggcggaaccgatgtacgacaagcttgaccaaatttgtcgctgacacggaaagcaacgctgcaggccattatccagggaggggagtggggcacgtgcaaactccccccgaaaat

SEQ ID NO: 22182 - DNA, 1908 bp, Heterodera glycines
atgatgacgaataaaacaaattaataattttaaaatatcttccaaaaataaaatcttttggacggcacaataaacaatcacttagcaattgattaaaccaataacaactaattaatcttttttgttgttgctaatttgataaattttgttgaacgactaagcttactttggtgcattttcctcattttggcgttatgatacaaaagataaaaaatataagataagctaaccaagccaagaatgcgctcaattttttgccgatttaacaaactcaagtctgagaaaaaatacgttagacaaaatctattcctgctttattcattcatatcgcatgcttaatgattagagcccggaaaattttctccgaacatgatttagagagacttattagcacctaaaaactaaaacgaggggggggggattagcacgtattttggcagttttaaattttagcacctgttttggtctttttccataaatttcatagcaaaaagcaataaaaatgaaaaatacacccctaagaatcgatcccaaaaactttaaaaaatatatccctaaaaattgaccaaaatttcagaaaatattcccctaagaaatgaaaaattttccaaaaaattcgttctccaaaatttatttatttgttttcttgacaagttgcaattgtgcgggcgaaattgataaaaaaatgattcacttttgtaattattgtgcattaagacacaggattttccaatttttagcacctattttgcactttttagcacctattttagtcctatttcagcatttttagcacctaaaaacctagctctattaataatattacgccaaaacaatcatagtccaaatcagaatctttctactccaaatcagggttggcacgtttcaacaaaaatgatgaaactgaaaatacgaaagtaccttatattttctttacaaaaagctaataatattcactttttgacatttatttctgatagaatgacacaacttaggtgcgcattgtgcatcggctataacaatagatccactgaatagatgctcaagagaaaaaatgaataattattcccaacgaatcatgtgaatatgaaccataactcgagtgaaagaagcccctaacggaaaaggagaaaaaaagtgccaaaagcaaaaagaataatgccaaaacggacttatgtcaaacggaaggcgatggtcggacatacacctgaaaggagagagaatgagaatgagggaaggggggggggcgggagaagcactggaggacgaggtcggctggcaattcgcggctgatgttccaaagtttccgctcggggggaggatcaatggccaaatattgttggtcttggcacatctccaaaatgataaatgctttcttatattttcttgcttagacttcggtccaccaacctgcgcaagcagttcgagctgatgccgataatagtcgatcatttctctgtcctcctctcggcacgactcggcgcatgccaccaaagtgcgacagttggtgccggcgtaattccaacagacgaacacttcgaatttgcgctgaataaaatggatttaaaaggcccaaatcgtttgatcacctctttgtccacttttgctcccattggcttcatcatcgtccgcataaaaatgtcgcgatttcgttcactgggaaaatggcataaactctcgaattcgaattaaatttaaaataattatttatttcagcaggtggttacttgagcacggtgttgcaaatcaattcttgaatctttttgttggcctcccctcggcacatacaaaggtcggccaaataagtcagaaaacggccgcttctgttattccgcttaagaaggaccaaaaaactgacagaaaaagacagagaaatgagagagagagagagcgagagagagagaggaa

SEQ ID NO: 22183 - DNA, 1498 bp, Heterodera glycines
  misc_feature (1429)..(1429): n is a, c, g, or t
ttttctttcttcacaattcacattattcatattaagccccccaatattaaaggattaaaaaaaattatactgtatttattgataataagggatggcaaatttaggcaaatgccatttaaatgagattttaagcagttttaactgttatctttttatttttcaaattaaatatttaattcttagttatatttttattttggtttatttaaataaatattctcatgctggtattcacaatgctaacatccgtatgaacaatgctaaggtaatcagcgtttttataaattctaaggaattaatctttttaaatttatgtttcagttattttatgttatttggttttttatataccataacgagatggtaatttcattcaaatgagtcatttttttgttgctatattaaggtacaatgtttttccagtttttataattataatttaagaaacgagaaaaaatataattaagaatttaaaaattttataataacatgaaatttttttagaatttaccttttggatttttctattatatatattagctgtttttataagtaattgtttttgtttatataaaaagggatttttaatgcgctttttgttggctactaatattttacaattcatataatttttaaaatttttaataatatttatttattctttataatataatttatgcttattctaacaggctataataatttaaatttgcagtataagtaaaaattattttttgtaaatttatttttgattaattagcaaaacaatttccttttttatttcattaatttattcaattaataatattattttttcatattgtatcaatgaaaatgattcatgagtagttttaatatttttgtgcatatttatttttctattataatttataattttataaaatattatttaattatttggaaaacattatttttatttttcgaatgaaatttttttagcaaatctaaatgattcatattttattgagttctgaattatttatttattttttacaggattttaccggcaaatttttgcaattagtaatcttatttaatatttttatataatttgtgatttaattatagatttttgttttatttgatctcttgattggagatcatcgccatctcgcacattaggaattttgttctttgctaatttatttgcttattattattttaattcttaaaattttttatgttcaaaaatatttctttataataaaggggtaatcattttccttttattatttatttatgattttgccaattcaattttgtcaaaattggttttgcaaattgtcattaacttatttatttaaatgaatattttgttttttttttatgtttcgcctgtttcatatatttagttgctttttgattttccattttttctcattatcagggaatgatttatatttgctanaatcgccaaatatttacatatatatgtgccaaaaaactcacaaaatatgtgctaaaaattttaaaaaaa

SEQ ID NO: 22184 - DNA, 2196 bp, Heterodera glycines
ccgtcgcgtttttgcgcgttttgcgacttttctctgctcaacccgccccggcctccgtgtccgttgtcgtgtcgccaaacatggcaactgaaaatgccataaaaatgagtttgtttggtataattgcccttgggcacctgcgtttttatccgcaaattccactcgctgtgtcgtcgtccctttgtcctgctgagtcgtccctttgtcctgctgagtcgtccctttgtcctgctgagtcgtccctttgtccgcttcttccgccgttttcttccgtccttcccttttttctccatggtcttccgacaactgtttcttctgctggcgatttagcttaatcgccggcgacgcattgccaaaggaacgcggaaaaactgccgaggggcgctctcttcccaactgattttgtcagttatttttgaggttaacaacgaaaattaaataaaaaatatatttccttatttaatttaaaaaaacgctttaaaaatacaaaattttttcgagggggacgaccatctgctctttccatcgaaaaaattataagtcttttgatggaaatcatagaccagacgatgatggaaaccccaccgttttgaactcatcaaaaaaacataaaatttaatttaacccccccccccctcgcaatcttaagaattgccaaaaataattcacgttaaaagtgtggggtcgcttcagaatgccctttctcggcggtgtctccgccactgtcaaactgccggtactgtgccgttgctgtagcgaaattggcagggaaagcgtagcggaggggccggggggagaggagaagttcagctggggattggaatggcattgtccacggtggtgaagcgaagtgccgcccaatttgttaagggcagacgcaccgccggtggtccgatgggaggggtcaaaactcaaatagccgggcaaattggtgacactcggcatttcaaaaaagctcttaataatatgtctgtatgaaacgaattttttttacaataatttaaaaaagtcagatttaatatagtgaaatttttttaaattatttccaaaaaagttagggacaaaatcattgagtctcgatttttaaatactagaggatttagaacttattgttagctcaatatcaaaattgattaattcgaataaatttgagctaagtaattatttaatattctgtaaattaaataaaataataattaaatttaaattaaaatattatttcattattctttttttaacaccgacgaagaataaatattaaaaaacaaaacaagagaaaagaagcgattttgttgcttaaacttcagacgtttttctgctgctgctgtgagtttctttctcattttgctgctctttgtaatgtgaggcaatgaaatggagaatgccaacccaacctcaacaatcagtaagcaatcccaaaacaaaactctgaaaataaaactgacaaacttttgctttccgaagcactttttggaacggcaactgacggaagggaaggcaatgcttttccttttgcttttccttttgcttacgtctttcgttattaatgaaaaggtgcaaagaaaacaaatgagagagtgaagaagacagaagtgatgagacgtcaacattattaaatgcttaattaatgggctaatccggagaacacaaattggtggcattaattaatttcactggcgaaaagcatacgctaatcccttgaataacggacgaatgaaccgaaagagagagggagagagagacactttaacaaagaaaaagagacaaagtcagtgagaggaagggaaagagagtaacgcaacgagggacaaatgacagacggcgagagggaggacagacactcatttggccatttgagcaaattgccttttggggttggtcaaaaagggaacaacaaaaagcattcaaagaaaagctcaaaaacaggtcaaaaatcattgtgcgtactcattggtgggcgtgggactgactgatacaacggcaaaagcagtgaatggcacgccaattggccaaatgccacgcgaagggtccccccccctctcttcccattctttttcccccactatttcttctttctgactggtcttcccccctattcctttttggccgttatttcccttttctcattttcccttcccttttcatccatcgcttcttcccctctttgcgtgccccttcgtccattctctgctgctg

SEQ ID NO: 22185 - DNA, 685 bp, Heterodera glycines
caattgggtggtattatttactctattcgcttatgtctttttaccttgaactttgcacctcaaaaacttattttaatctctcaaaagtccgaccaaatttttttcagccgaattacgcgctgaaggaaatgaagtgctctgtctggagacaccgccgaatttcagtgcagttggactccattaccaacgcttcgatcaaaccagcgacgaagaggtcatccgctgcatggaaaaagccaaaaattggagcgaaagtcggaagaactaacaaagtgtattttacacggtcaatttttgtctgacccaagccccacgagagtatttatcatgtgatcacatccttctctttgagaatcacatttaaattgtgccatattcggcattacaaacaataattaatgaagttaacattaaaagttaaagaattctatcaatgttgtttgtacatggattatattggcaaaaatcaagaaaatataagggtttccaaaatcatatttctcaacaaaaaataggctctattgcagttttacacgaccaaaattaataattttttctagaagcatccgattaaaaaagtttttttgaatttttctggtcatatgttttgaaacatgaattatttgaaattttgcatgataagggagaactcttacgtctattaaataataccgtctttttaggg

SEQ ID NO: 22186 - DNA, 1366 bp, Heterodera glycines
aaaagaggcgcccgtagctcagttggttagagcacggcacggattgctggggtcgtgggttcgagtcccaccgggcgagttaccttttatgttctacaaaactgtatccaggtctttttgttgcagtttagtttcctatttcacgcttttcaaagaatttttgtcagaaaattaaatgaatttttatttacttatttttggattttcttatatatacccttaaggtaccagccataatcatgataatgcaaaataaactcaaaaaaacaaaaaagaataaaaacaaaagaaatacataatttggatagaattttcaaattaaatatattcgtaatagaattaatctttaaaagaatgttatttatatcactgttttataaattcaaaaaacatatccagttatattataaatttaatgcgagaaaaaaattgtgcataatgaattataaaatttttccaacattctttttttcaaatcagtgacaatgagacaaggatggataaccgatgaatcttctaataaaataaatttaggcgacggattagtaaaataaaataaaataaatactttatttaaatcgtagttattatttttacgattttaataccataaagcaaatatattaatgcgaaaataatgggttttttctaatctaataaatacagaaattaacttattaattagaaagcaggaaggtgaatgcaccacagaaaaatacgaaaatttacttaaaattttcttaaaaattatattttatttgcaaaaattggcctttttggtgaaatttgttaacaaatcagtacctatagacaccgccggacccacacacctccccccgtagccctaaaatttttttggaaaaatgcactgcaaaaaaatgttaaaaatgtgattgttttatccagattacactgaaatgtataatctgttaatttcctccgcaaatttttaaagatgataattggaggcaaaaaaaagaaccgtcctaaaaattctattaaataactttaagattaaaaaattttcagtaagattccatatcgtaaagtttattgtttcttaattcaatgttaattgctgcattataaatcaaatacatttgtagatattatcgaataaatatcaaaaaatatcaatattaaattttattaatattataagtataacacgaaaaagaatatagtaattacaataaatatataatttaaattgtaataaatatgtaaaaataaaataaaagtatatttctttatcaaaaggcaaatatatttaaacaatttaaaaaattgaaataaaccaaaatttaaaatcgaatgaatttttttataatcttctgaaataatcaaagcgtcaaaaatgaaacat

SEQ ID NO: 22187 - DNA, 2119 bp, Heterodera glycines
cccatagcgttgcgtcattgaggtcaacggcaagcccaaaatcggccactttgacgatgccccgttcagtaagcctgtgaatgagagttggcaggaaaaaaaatgaaaatattagcagccattttttaatctgaatttttatttcatggacttgacccataaattttctatagaaacaaagcaaaaaaattcagcgaacaatttattatgtaaattaaaataaaaagggctttggcaacaaaaaaaaattattggattttttcggaacaaaaattcaaaagggcttttagtcttttgaattttctatttttaaaatttcctgatctgaattgcccttggatatggtagacaaaataatacagtacatgcaattgcgcgcggccaggtcacggtgcacaaagccttggtcggccaagtaggccatgcccgtggcaatttgaagggcgaaccatgccaactccattaccgtaatcacctgcattgtgtttttatcgtactgtgcacatttgcaaaaattgctgacaactcataaacaattattgttctgctaatttaagaagattttgtccaaaaaataaatttttaaaaaatttattatggcccagggtcgggttgtcactttggcgccggacaatttggcgccgccaaatttaaaatgttctaacttttttcatatgcagccaaataagacaaacttaatgtcaatcgataggcctaagagttctcgattagcctgcataatttcaaaaaataaccttaggttacaaaacaaattatggcgcgcgacaccaaaatggccaaaaaaaccaagtttttgagggtttttggccgtaacttttttaaataaaaatgttatagcgtttggcgccaaagtggctggcgcaaaagtgggcgattcccccatggcattaagaaaaaataataaatttcttagactgctaaatgttttctaaaaatgcttttggcactcgaaatgagtcgccgacgaatgtccgaaggtcgccaaagtgcatgaacggcatcacaacggacggcgcagcggcgccgtcgtcggcgggcgactgggccaaaaatgagacgccataaatgcgaagaatctgttgcatgaaaatgtccgttttatgaagtttatagtctcgtctcgaactcggactcggacgacccgaattcgataagtattttaccgtacgaaacgcaaatttcgggtgattttccctgcatataatgtactgtattcaatcaatacagtagtgtaaaatcgctctgcttaatgaacaaacgaacgagtgatgaaacctcattcattacttgagccaattacgtaattactggttacggatttttgcgattttcccgtaatttttggtccgtaaatggaatttttaaccaaaaatccttaaaaaattattgtaaaaaatttttccgatgcttgaaaatttgcattttttattttcagttattcatagttttgcaaaatttttgacaaatttcttaataaacttcactaaaaattctctttgttttcctacaaagactcaaaaccgaaattgcagaatcaaaaattagcatctttttgacaaaacttttaggaaatttagaaaaaatgaataaaatttctaagaattttttttaatgaaaaaatgaatacaaaaattaactgttattaggaaatgactttttgtgaccattttcaaatgatgtaattacattttttagtcaatcttatggatattttttaattgcttcgagaaaagaaaaaattgactactgtttaaaaaaattccaatttttaattacccccccccccccttcctctcgcctaattaattaattacatttcgatggcttaatcgcctcatgattgacgcctcgcgcaaaaactgctcaaatgtgtgcatgttgttggcaccagccttcagcgttttgactgccaccggcacaatttggcccgaaaatgggtcggacagttgggcacggaacacattgccaaaatggcctggaaatacccaaatttgaaacaattaacgtaatgtcatgtttaaccgtctaaaaaatcactgtaaataggggttttgatcatattaagtcgaagataatgataatgtggaaaactgattca

SEQ ID NO: 22188 - DNA, 1415 bp, Heterodera glycines
aaaaaaaataccaaaataccaaaatacaattttttgttttaaaaattaattttttccggagagatccgatgaatattttttaatatttggtagtttattttatttgaaaaattgtttttatggaaattttatttcatttatgaataaataaatgtataaataaatggccatcaataatcaaaagaaagaattttgtattttttttaaataattttgagaatttttgataaatgaaaatattattattatattttcttttattttcaattttccaattaaatcaaagtgaatccgaaaataaaaaattgcaacaacaaaagtcatttgacgaaatatttggagaaaaatgggaagaaaaagaagaagaaaatttggaagaaaaaagagaaaaaattgaaaaatattataaaataaaagagaaaataaagcaaaaaggaagaaaatattcagcgaaagaatggagtaaaattgatggaaaaataacgaaaaaaattggggacaaatcgaaacaaaatttataaatggattaaagaattggggtttttggcataaatcacaaaataattcagacaaaaattttgttatttacggttaacaaacagattttttagtcaacgaaaaaaatttaataataatttttgtaattacattaatcattatgtcctgatttattaattatatttgccctgatttccggaaattcaacccgaaacattgaaaatatccatttttcaataatatttttgctttgacaatcaatccaacgcaataaattatgcggccatttttgtatttatcatattttattaaaattaatcgtataaataaaattaattaatttctatttgaaaattaaaaaaaaaatgaaaatttgtctattattattttcaaaatttttgttggatttaaggaaaatgaatcagaaagtttcataatttattaaattaaattttttttagtcaaattacaattttaaagacaccttttttataatttgttaaacaagttgcaataataaaaaaatgataaaaaaatcatttccactaaaatttaatttcattatatctttttcattgcagttttttattttctatttaattggaataattagggtattaaaaataaaacaaaataataataataatttcattttctttaattattttcttcaaattttgtataatttttctttataatttctaaaatgtttaaattttactcatccaaatcaataataaattctcattttctcattaaataaatatttattattaaagctaaaattttccaatttccggcatcaaatccattcaattttagctaatattatttattgccaatttaaaagagttttacttgttatttaaaaaaattttattttttgtaaacattaaattatttagatagaaacattg

SEQ ID NO: 22189 - DNA, 1616 bp, Heterodera glycines
  misc_feature (64)..(64): n is a, c, g, or t
ccccccccctcgctggccccctttgcgagcgaggggggggggggggggggtcgacccccttccncctaaaaaatgtatgaacgacacacctgtgccttacggtagatggccttcacattgtttggctgccgctccaacactttttcacaatgtttgatcgtctcaattgggtcgcccattcgcaagtgggccaacgcactgttcaactgtgacaatatgcatgcggaaattttgtagaatttttttatttgtaaatattaaaaaagtgcccgatatcatactgtacttttgtgtctgacaccgtcaagatttaatttatttaatgccaaacaaaaagcagacctgtgccgcaatgaacatctgttcaaattttgccgcaatttcatctccgcctaaatttggaaaggaagagcggttaccaccaaccatatttccaccgattacagtagtacttgacaaattttaaaatcttgggttttttataaaaaattcaaaaaaatgttttggaattttttttttgaaatttaaagaaaacgttttttaattttttaaaatttagtgcacccatcaaatttgaccttcctgtggcgctttggttggctttgcaaattccatcatataaatcactgtgtcgtatttggccagtgccaatgcgaatttgccctggtgcaaaaagtcggtgccacggtctttgtatgccttcacacggtccaacttttcctcgtcagtcaattcccaagtggccttgacctgaaagtgtgaaaacccccaaaaataacataattgtacaaataaatacaaattaattagtgcaattttagctaattattaattgtgttcgcacgggaaaatttgtcagggaaattcccccgttttggaaaaagcagagaatgaactcgtttttcgattaaagatggaggaatttggtacttttaacaaaattataacgaaaaatcccaggttagctctccgttggcaaaactggggattttttgcatgcttttgcccgctggcgtttttctttaaaataaattagtaaggcctggagcggaaaaaaggcctttgtttatgctcaccttttcataatccttgaggtgcagcatgaacacaatctcttcgtaaatgcccaggccgagttccgcgggcggacatttgccgtagccgaatttgcccttcagcgtcacacgactcttttcaccgcggtccatccgtttcaacgccctgccggatgaatgagaaatttaaaattcggctaataaataaaataagaaatttaaaagtgggtcatggaaatggccgggagttgagtgcccctcattttttaaaaaatttgaatttttttttccggcgacgatttggggtgtatatgctcttggcttgaatgtccccgtttcaaatcaatcccgaatcgaaaaaggcacaaattcgcaccggagaatcggaatatgtggacagtcaaaactgggagtgttagaaatttccaaatttggcgttttctcttgccctcctcccccacttgtccactccgtccggcagtccatggtcaaggccttcgcccagcacatagtccaaagaagcgtcgaggaacacgcggccgtccgtcgttgtgccaaccg

SEQ ID NO: 22190 - DNA, 2890 bp, Heterodera glycines
ctcttagaagtcataatggaatggggtggggtgaacagccaataaacggacagagaaattgagttaaaaatttgaaattttttttaaattatcggaaacaaatttaaaattaatattttataaaattaaaaaatctgtcccgtcttacctatttacaaaaaaaaatgtgagactatttctaaaccaggaaaaactttgacgcaaaatttctgaaattaattaatttattttttaatttaaaagaaagtttacaaaaatatctatattatttttcactttaaggcttctttttttgaaaaaaatttaattgccctttggttaatttagcatcatttcttatccctgcaattaagtgccattattatgccattggtaagctctcgtgccaaaaccacctgggcctggataaatttttgacacatttctacccaaaaaaaggtggcttgttcaccaccaattccatgaggagcaggtaaaaatccattaatgggcagtggacagataggtcatccgtgggttaatccaaaccgggaattggtgccttagtccaataatggcttatccgaaaattttggcactttttgtaattcaaatcactcaggtgtaaaaaatggaacaaaaacaaattctttaaatttctataaataaattttaattttaatgaaacaaaatattttttattaaaaaaaattactaacgtacatattgtagaaaataaaattaaatcggattttttaaaaacaaattttaaaatttgacttttaaacaaaaacaataatagttttattaagtaatttaatttgaaataatttaagataaggttaaacttcacagattgttttgtatttctagaaatttaatttatacaaagaaaaatttattcaaacaaaaaaatttttcgtcattttaatcttccatttcaaattttgcaaatttcccccccccctctccaactgaaggattaactccattttctcaattatttgttcaagaataacgaacttccaaatccatcataaattccattcatcagcaagcaagcaaccaaacccaagagcagttttgcctcttccactccccccccccctcgaaattcatcattttgtccaccggggccatttggtgagtaatctgagccctcccccccccgcgccggccaattcccctgcttctaatggtggtggccaatttcctcgtcttcatcgctaaattatagccccctgctcattttcgtgtccgttagtccgttgccccccgggcgatggatgccacgccatgatgaaaagatacaattatttgtggaaaaaaagatgatgatggatatatgataatgatgaaatcggtggggtgcaaaaaatggctgccattatccattattaaatcatttgtctccggatgaattgagtcgggcaaaaaaaaaagaaattgcgcaaaaattgcatgttattcttttgagattttttaactggaaggcgatggaagaaaatgtgatggaaaattttgagtgtgaaagaaaatgagagcagcagaaagtgagagagtgtattcattgatgagacgcaaagaaacaaagatttgaaatggttaaaattaattaatgaattaattaattaattaattaaaatgtcagagtatggtcggagaagtgaccgatctaaagtgcactcaaatttttaaataaaacccgaagagggttgggcctctaatcgaaaaccctttcttaaatgatcagaaattaaattaagtagttttggacagattttcctttggtaaatgaacaaatcttgggggctaatcgatcagcataattaacacatcaaattcatcagtttagtaccgatctcgactagcaaagtgttcatcactgtcgaatgatcagtctcatcctttggcctcctgatcacttaatcacactcaaattgaaaattcattttgccccgatctgatcaacaaaattctgcaaccatactctgacagtttattccgttataattacggtagtaattgattccaccgtatacctggcctgcatcaattctttggtccgattgtttgcgcattggtctgtgatgttggtcagtctgttcggattgcactcaagcagtgtaaagcgtccaaaatttgcttcatggatgacaattccatgttgggccggacaatgcaatgaagcgagcccaccctcacacacaacaattgtccctggaaaaaataagaaatttaatttaaattaacataaatattaatgttaatttaaataatttacaaaaaaaaattaatcgaatgtgaaaagaatttaaaaatagttgaaaatgaaaatttaagaatgaaaaaagaaaaaataatgcaattattccaataatttaataataaaaaatgtatgttttcaaaataattaatcaataaaatactaaaatagctaaattaataaacaataaaaaatcggctttatccatcattcatctaaagttttgttattttattatcttttaattatttaaaatagaaattaaaaaattaatattttttttgtgatggtatttaaattttcttttaaaataaaaaattattattttttattatatttctttaaatttaaaattaatcttttgatattaattttcttttaaatatattaaaaacgaaattagaaaatagttttttctttaaattttctcctttttttctttttcgatacagtaaacaagataaagtcaatacagtaagactctgagcatgccattgttaaatttccgtccaaaacttttcattatagtgaccccagcgccacacccttttaagttcaatggaaaggtgccccataaagtaccgctgctgtgctgaagatccctcgcaaaactataattatttatttgcgcacgtatcaaatttc

SEQ ID NO: 22191 - DNA, 2741 bp, Heterodera glycines
  misc_feature (28)..(28): n is a, c, g, or t
atattaacattttattaaaaatagtatncatgtttgtaatacatttaatcaaagaaaaataacaacaaaatttattcaaagcaaatgtctttgaaatgttgaaattttttctacaaaaaattacttaaaataaatttcaaaaaacattccaaatttcaaaatttcacttttcaattattccattattattttaactataatcaaaatggttatatttcattatttggaactcgcttttttgatttatatttatcttttgcacatggccaacaaaccaccgacaatcataggggttaaaaatcatgaaattaaaatgattaattttaaacatacaattcacaaaaaacccataaataacaaatattttaaatcgaaaattataagcataatcatgtaaacaatgaaattgtttcaagaaactaaatataaataattaattaaaatcatttatagaactaattatgtgaaacatttatacaattatttaggcaattgatataaaaataaaaagatggaaaaaatagaagattaaaaataaataaatacaatttttatatctcaaaaatattttttaaaaagataaaaagaaatgagagaaattaaggttttatttttaaatttattcatatgaaattaaattacatattaaaatattcatagaaaaataaaattaaacaaatatttgaaaaacaaataaacagaaaaagaaaataagaatttggcaatgaaaaatttattttaattattagcaaaaagaaatattaattaatttcatacctccataaaagttaaaaataaattcagattaaaacaaaattatttgcattacttgtgaatgataaaaagaggattttggcattgtcggatcatgaaattttacaaaaaaaaataatttgaaaaaaagataaaatttaaacaaaaataatttaaataaattagttaaaataatcacaaaagaacacaaataaaatactatagtaatgcaatttaataaaaaattattatttttaaataaaagagaataagttaaaaaataaggaaaattaaaggtttattcttcaaattgaagtgcagccaaacatcggcatacaataaaaagtgatttattgtttttataaatcatcataaatacaataccattaaaatataaacaaaaaaagaaacaatcaatagaaaaaataataattttcttatattaatatatatatatttatatatataatatatatatacgaataatattattagtgaaatgaaaataaaatatcagaaatgaaaataaagatttatataattggtaatattattaatatattagacagataaatatggccgagataaaacacggcgatcgcatgaattaaataaataaaaagcaagaaattaaaataattgataaagaattgttataattgaataaattttaaaattcagcaaaaaatcacataaaatttctattttttgaatattctttcatattatattgtaacaacataaattataggaaaagataattttataatacaaaaattttaaatcataaaacaggataaattcaaaagcaataattaaaatcattaaaagaatttgaacacaataattaataaaattgtcagcggatgttcgttggaaaaaaatttaaaactaaaaaaatatcgcttaaaaaatgtacaatcaacaaaaagcgcctaagcccaaaaaattacaaaaatttgaaatttttggcaaaatttcttaaaataaattttatttgtaatactttagtcatatttcagtgttttggtccattttcagcatattttactgtaaattttcatccatattttaatgcatatttttcaaattttaaaaaatttgttactttcgccccgcgagggattttttctgtttttctcttcatccactttatctttgttctttccttctctgctgctctctctctctctctctcttttccccgctttttcccctcccccgtcacttttttctctcatccgttcgttacgtttgcccacctgcaaaattggacaaatatttgagttttaaaagagaatttttggcgggtcattttttcattttgatggacttttgtgcttccttaatgagcccccccccccccaatttccccactccttaaacgattcattttattctcccaaagtttgttcctttattatttcgtatttttaggcatgtttaatcaaatgtttttcaacaacaaatcataattgttttgtgctcctcgttttcacccctaccctgctgatcatcgccattttgaccgccacaattcgtcgacttcgaatcaatctcgaaatccgagccgttggacgtgtgccgagttgcgaaatcgaaaccgttgagcgactgttctgttcgaccccagcctttccgtccgtcaaaagcaggggacgcttttttgtcagggagcgggcatgttggaatatttgaccttttgtttgtgattttaaattattttggcattatgttctcattttttattttaattttcttctcatttgttaattaaatatatgttctgttctcacttctctccgattctaaaatatttgttcttcatctcctccgacgcttttattcgaattgtataatttgatttgtttggaattgatattataaagagttttccaaattcccgctccaaaggctaaaggtcccggtcccaattaaaagcccaattcttcgaccaattccgatcgtttccaacaattattcaaatt

SEQ ID NO: 22192 - DNA, 1349 bp, Heterodera glycines
  misc_feature (1332)..(1332): n is a, c, g, or t
tgttcgaattcgggtccggggttcggcattgaccaaatattcgaattcggcttcgggattcgaaatatgtggaaattgatgtcatattcgtgatcagtgcccccgagtacttcaccgtattgtataaaacccctttttaatctttttttttatgggaccaataaaatacatgctcattaaatatgcaacaatattttttgtttcgccacttctttctttcattatttacccgcgcatattcatcaatcatttttggtgtgtgataaaaaagttgaatcatttgaatgaattttaaacgatggacaagacataagagagagagagagagtgagagatcatcaccaaataaacgaacaaaaaaaagagtcaaaacattcaatcatcaccagaagcaatcagttaaaaatttttctcaagacccggagtgttttaataaaaaaaaaacatttgacaattcactaacaaaataactaaaaaagtttctcctagacgtatgactattttcctctgaacacaaaaaactcctcaacattctcctcttattcgtgccgcgcattggtttggtttgccctgtttaggtgccgtcgccgaaccggctcaaccccaactccaccaattcctcttctgaccgggaacagttcgccgttttgagcgcctaaaacaaacaaaaatgtgtttaaaaaaatttggtttggcaaattgcttaatttctattgtgtgagcagttagtagagttgtccattctttgaaaaaatgcaaaaaaaaaaaatttatttttgccggtgcaatgtgatgtgcaaaaccgttacttttttcgtttgttttgatttcggcttaccattgtgacagtgcggattaaatagacaaagtcccggccgtaggttcgctgtgccgtgtcggtgtttgggtcactaaaaaacgtctgtttaacaaaaatgcaataattcaaccatgatttttaaaaggtgtaatacactggcagcatgaaaaaacacagatcgagatgactacccatttcaaaagaaagtttaagaccaaaaaaaatctaggttatctatttgtatttaaaaaaaaattttttttttttttttggaaattccaattttcattattccatcactctcacctcgtctccatttgcagcatttgctgggccaattcctgaatgcgctgctccgtcaatggttcaatcttcggccgaggtttcattcgcacggcggcggtgccattggcgttgtggtccaacagttgttcctaaatggtaaagcatatgactccacattttcagtatacaatttcaagaaagtggaaaccttttgaaatttgacccanaaaaatcgagaaaagca

SEQ ID NO: 22193 - DNA, 1656 bp, Heterodera glycines
gaatcagttccaccgcatcattttcccggcaaaaaaaaatcgaattcatttttcttccccctctatctcttattacctattgctttttccgtttcagttcactttcttcgattatgccactgtcagttacaataatccgatacggtgggcaatgcctttttcaccgtatcagactcactaatcaatcattatttccatttccatctgctgaagacagtctttgttcactttcgacgattgctcctccaaagattgcatttcgaaggcggaggcggcagcggaagcccttaaagtgttttttcctcttttcttttactttttaccttttgtgtttatttttagcgcatttatccccttgttgacgccaagggaattcacatgaaaattccgatgcccggctatccctactcaaaagacggtggattttggagtgggtggggtaaactaaaacccaaattatttttgcaggcaaagcgcaagtggcggaggagtgccgtcgtctcgaggaatgcgtgcgcaattgtgacgtggtgagtgaatgtctgccagattctggcgatttccgtggcatcgttcgcctttctctcagctttttctggtgatggacagtcgcgagtcgcggtggctccccactcttttggctgctgtgcataacaaagtaaagccgaccattttttgattcgcttaatggaaattaagtttgctcttttgacctgttttagttggcctttacagttgccctcggtttttccgaatttgtgatcattcgtcacggtgccaaccctctccatgttgcccattctcgtgctgctggtgaggacaccgaaacttcgtcttccgtcactgatttttcgctctcgaagaggacagaagtgactggtgccgagttgggctgctatttttgtaatgatgtgaccgccccgggcaattcgaccaacggtagttccaatttggcaatcatttgcaattgctccgttcttagacagggcacttgaccagcaatgcaccatttcacgttcgggcatttcaatgattgcttccggtgggttaaatttggcatttcgattatcaattacattatttaatattattttatttgttaggaattgccaccgaactgttggcttctgtccttcaacacgaattgggcgcagaagcgcccgcccttttggccgaagtggacgaaaacgcgagtcaattgggcgccactccgcaccaaatccgcggttttatgtcacgctttcatctgatgatgcccaccgtacgacggtacgaccgatgcacagcgtgtgggcatacggtactgtttggtttggtttactgtctttgtatttttctccatttaatttttaaaaaatgcttcattttatccttacattctctcaggtcaaacagttctaccggactgagggatttgaatttttgaaccgaatcttccaaagtcctgccgagttggagcaaatcaccggattagccgagttacagagacaagcggacgcatttcaatcggaagttatcgaaatggacgacagtgaaagcatttaaacaagtgcattaacgggtggccatcattcaccatttgcttttgaacaattttggcgacgcaaaattctatttttatattttaattcactttaaaattgattactaaatttt

SEQ ID NO: 22194 - DNA, 2094 bp, Heterodera glycines
caaatttaaaagttacggtaaacaaccaagaataattccaattttaatttacttagatattaatatatttattttaaaaaatcgcttgaagagtggctataaaaaccaaattaatcaaactgaaaacaatttttacttttgactaagcaaaataattttaaaatttatacacttaactattcgtccttaataaatcaaaaaaagaatagaagatttaaaataaatataaaaagttaaaaataaaacttaaatgcttaaatgattttcgacttttgcttttttaaggtgtattaactaattaaaacacccatagaaagcaattaaaataaataattttagaaatgaaattgaaaaaaaatttaaaaaatcttagaaaaattagatttttaaaaattgatacaattctggaaaattaggtgtaaaaacgaagtaatagatcgaatcggagcaacaaaaaattgcgagatcttaaaatttttaattgaaaaataaaataaaagtttatcttgaattttaaattcaatttgaaaaacaataaatattcaattatctttaataaatatgaaacaatgttatatcaattttaataccttatgcttttaatttttaatttgtcttatttaaaatgaaggaaaagcatggaaaattcaaatttatttcaaatttaaaaattttgataataatttatagcaacaatccttttaatgaataaaacacaatatattaaataaatatgcgatattcggttgtcgaagttttgactaaaacgaaaattttcagcacttgaagcaaatattattaaaaaatctacaaaataattaaatcattataaaaaaaacaataacaaatttttaaattattatactggagatacaggcggtaaataattcgtttatattttgcaaaaatttattttgtagggtcaagcgttattgtatcatttcctattttatttttatttatttttatttcgtgtccaattataaagattaaattataataattttctgaaagtgtagtattcaaaatgtaaacttgccaataaatggcatacttagtcgcatcaatataaacttttatgctaatatatgtaagaataaaattgaacaattttatgtttaatttatgttgaataaaattgtttcttatttcataaaataaaataatgaattatctttaatggaaatcttgaaattttttttattaaagttacataaatctcttacctaagacttaataaaaagcaattctccgaattgattatgctaactatcattacgaagaatatgtacgaaattaaatattttataaactttttcctttatgaaaattatcaaatttttgattataaaattaatatgttactttaaatggtttcttatttatgtcaaaattatttatgcttggtcccttgatggaattacattcttcatttatatttgattaaaatttatgtaaaaattggagaacacttccaacttttttattattagatattagacacttgacgattcagttccgcgggtaatagacacattaatcccgggcccgtcacttagttgaaatttttcgaaacaaaaattgcaccattcgatttctctcatcgatgggattcgaaccaaaaccgaaaacgaaaaaaacagaaaactcaaaaaattctcggtcggtcggttttggttaaaaaaccgaaagcgaaaaaaacccaaaaaactcaaaaatttctcggtcggtttttttcggtcaaatccgaaaccgaaagataccgaaaaaaacagaccggtccgatctctaataaacaatacttactagcatattaaaagctgtttttaccccgaattttttaaattacttttcgaaatataaggataacaacctttaatcttttaatacagacgaacccttttagataaactatttcagtacttttaaaaaaaaattaaactcaataaaaaatagatatattggtcaaaaataagaaaattgaaaaaaactaattcactaaataacataaaatcaataaaatttaaattcttgctattgtttaaattttctaattaatttttctgaatatttaattttacattctgattaata

SEQ ID NO: 22195 - DNA, 2498 bp, Heterodera glycines
  misc_feature (1405)..(1405): n is a, c, g, or t
tagaacgtgcatattcataaattctctatacttatgaaatgacatattcataagcatagaaaatttatatccataactacacccattcatagagctgggaatattcataaactgcattttttatgttaagccatacgtattgcattgttggctattgttgaggtgtgcgtgcgctgccccacccttaaatttgtatatgttcataaatatatatacacatgagatcgcatatgaatagaaaatttgtatacataactcataacactcatagggatgggcatgcatattcacaaaaaataaattattgattttaaaatattagagaatacgtattttattgttggccattagcgtgcgtgcgctgcaatcattataaaagcggactggtgggatatgcatataaatgtgcaatacgcaagtaatttatttatttatgaacatccttatttaagatgataacgcataaaaatatagcatatacctatctacctattcataaaaaggcatacacacagaaaatccacgtagcttatgattggcaaaattgggcaagcgcgctctttttataaaagcatagagcgagtggggaagaatcacattaaaacaaatacaacaaaatttggcatttttcttttttaaaaaattatagttcggctgaaaattaatgagtcattgggccccagcatgttttttgtagagcttgttaatagctttcgaatgataccaagactgttggatctggataacaaagaaaaaagttatagccaaaaacatgctggggtcaaacttgtggggccaaccgtggtaggaagaaaaagaaattgaggaaaagaagcgagcagaggaagagtaagaaagggggagaatgaagagcgggaggaagaggaagaaaagaaaggaggaaaagaagcggagggatggggaagaaaagaagcggaggagcgagaaaggaggatgaagagagggaggaagaggaagaaaaaaagcgaggaaaagaaattacgtagaaagagtaagaacggaggaggatgaagagagggaggaaaaggaagaaaagaaaggaggaaaagaagcggaggagcgagaaaggaggatgaagagagggaggaagaggaagaaaacaaagggaggaaaagaagcggaggaggaagaggaaaaaggaggataatgcagtagggctgtgcgagaagtgatttttaccgggaaccgagaaacgagaccgagaaatgaccccgagaaacgatacgagaacctagaccccaaaaaacccgagaaatttctcgactcgggaatcgagaaccgagaaatctaaagtgacggcatttttttgcttttaaaaacgtttttgctgtttttccaaaaaatttttgtaatttctttctgattgttaacagattttcaccanaaactgataattttttgcgttttgagacaattagcgactatttttacattcaaaatggctttttttgcgcattctttcaaaaactttttttaggcggaggaagtccggcgccagaaaattttttggtatttttagtgcgacttgataacagattttaaccaaaaaggctacgctaattttttcatggcaaattttaggtaaactttgaaatctttggggaattttgtggcacggcggtgccgataggcgccgccgggaaaattttttgggatttttaaggaattttgttaagaaaatttgttcaaaattttggtagggggtcgagtccgttttaggtcgattcttaggggcgtattttttgaattttttggcatcggaaccggaaaatttaaaaaatagttaaatcactaaaagttatgaccaccttggaactgtttatcatttgcagttctcttgttaatggatgtataatgatcataatttttgaaagatattttccttttaccacccattaaaattttattagggaaaattggcttttgaaaatttggaagtttttggaagcagttttaggataaaccagcaaattttctcaaaaagcagcacaaacattggttgtttgtttgactcgaattttttatcgagaatattgaacaatttattttcttaaaaattgataaatcaatgtcaaaataagcaaaaatgtgaaaatttcgatttggtttttttttgctaaaagtaagtaattttcaaaatgatttaaataccatacatattcagcaatttttggcagttttattttttctagtcctaataataatagtaataataatttgtgcgtatgatatgggggaaaaatgccgaaccgagagcggaaatttgaagaaaaatatgggatacaaatttcagtataaattcgaatttttaaagactcgtgaaaacacctcccctgcggtatacatgatcgctgatcactcgggatcggatttttatgtgctaaaaaatgctgaaatatgtgctaaaaagcccaaaaaatgctaaaatatgtggtaacaattggaaaacccatgtgtttttgcataaaaatcccaaa

SEQ ID NO: 22196 - DNA, 1395 bp, Heterodera glycines
ctgcaggtctagctgatttctagatggctgaaaacaaaaagcacaatgaaacggatggctgtgctttttctgtttctccctccaaatcattgtctaatcttttgcttgacgacagtccgtcggatgaaagcgccgatgaacgcgatgatcagactgacttttgtgggcagcgtcagcaggtgggataatttgacactgtgattcgcatttggagttcagttcagattggtgacactcacagtcattcgtcatttgttgccgaagttgtcgattcccttcagggggctttggaggacggttttttgagagagaatgaaaaggcgaaactgagtggggatttgctgaacaaaataaaattggaagtcaatgcctccaaattggcctacaatattcccgcagaagaagtgccgggccttctcttcactgcttttcttagtctccctggcgttgtcgacaaattttcggagttcacaaaggtgtcaattactcataattatttatcttgcatttataattatctttctccgttagatgtacaaccattggcgtggactttggaaaatgttttacagaaccacttttgctcaatcacaaatgctttttgctattgaggtaaaaaattaaaaaattgtttttcaaacgatgtaatattttttggtcttttatactacaacaattatgcaaattattttgctctaattataatttgaaaaagatttaggagaaagcgtctgattctgaccgcttccgtcgtgttctgccaaaagtgctttactttttgagtcaggaagttaaggcaatggacgatgctttaattgttgattggtactccaatttggaagaaaagtcgcaactgaagaaagaagagaaactggctgaattggtcacgtggcttcaaaatgcggaggaatccagtgaaacggacgacgaaggagaggattaaaaattgggaatggaaatggaaacacgcgaagggcaagacaaaagggaccatctttgttgttatttggtcaaaattgtttactttaatgtgatgtaataaaacttaaatctgaaattttaaattattgaattagctataaatctattggatatttgtttcgctttcattaaataataatttttgttagcgatagttcaggcgatatgtcttcagatttaaaagaaaaggaaattctgaagattttgaagcaaaaagctctaggaacagtcgctatctttgaacagaaggtaaaacgaacaatttgactgatataatgacaccactgaatttcaagggtgctttcgctgttatggtgacgatgtgtacattttggccaacgaaattctgatgagtcatgtcgctattcaattcgacacaatcagtcttataatattaagaaatttgattatttg

SEQ ID NO: 22197 - DNA, 1331 bp, Heterodera glycines
caacaacgtataaaacaacttatttttaaaatttcggtcaatttttgaaaatttatttcagcgggaaatatcacttgggagagagataacgcaaaatgagagagtgctgaactttcagtcccagtcatacaaaacgtttttcatgagaaatataaagaaaaataaatttcaaaaattgaccgaaattttaaaaataagttgttttatacgttgttggcaaaatcattgttaaaataataattattaattaaataacaacttaaatgtgaaatatggatctataccaggtactgccccgaccttagcatcacgagtcgtggcccgaaaatttgcctcagacctaaaccttcctcgtcctgcagaaaacctaatagaagatagattgatggaaatatattgaatcattagaaaatcttttagtaatctacatgaataaaaaattttaaggatatgatggaagcaaagcatgtggttcgtgttgggccatttccgctgcggcggtgctcaccgatcgaatttgcattgaacgactcaaaaagggcattcactcgtacaccaatcacgcgtcgtccttcgcttccgcgcaagacattttggattcgcatttggacaataaatgtccgtcatttaatgttgctttgcttaaaaataaattgataacaaaggttcctgttcgaccgaaagttcgacagcaattgtatggaaatggttcgccgagacgggcgtcgtcacaggcacaaattactcaatgggcttgggctgcaagccgtacatttatcccccaacaaaagaattgcctgtgaaggccaatggttgccgaaaacaatgcgacaagcaattgacgttcaattacagagagggcagagtgttcagtgagtgaaacggggaaaaagcggataattagagtacatatcagggatggcacggaattccgatttccgtttttgaaaaaagcgcgccgtaaaaaacgtgtaaattagtcactccttttcccaaaaatgttctaaaataatgcaaaatgacataaaaaaagattttgataaaatcattgaataatttttcaagcaaaatattcaaataaccaaaaacatttttgaaacaccttttactaggtaataattaaaaaatttagcctttaaaatatttagaaaattttttattatattttttattttttgaaaatttccgacttccgacgtttttggggtaggaattccgatttccgacttccgaaaattttttgggcctcggaattccggtttccgaaaattttttgatccccggaattccgatttacggaaatttttggggcctcggaatgccatgcctgg

SEQ ID NO: 22198 - DNA, 1473 bp, Heterodera glycines
  misc_feature (1334)..(1334): n is a, c, g, or t
  misc_feature (1437)..(1437): n is a, c, g, or t
tgggggcacaactgaaacgggcgaggggccgactgatgcctaaatgggccaactgatgtcagaaagaattccttacattcatccctaaattgccaaaaattatttcagaaatgaaaaacggaaagtgagcaccggtgcggacggagtttcgttcccaacgggtcaaacaagcgaaatgttacgcagtccgacctttgccgacttttccctgactcctttcacttccggcgacactttggcattcaatttggtcgctaccatcaacgccgaaaatggtattttcgagtgccccatttactctttgttcgcgtcctttgtcagattgttttcttgtcccttctttggacggttccctgtcaaacaatgagaaaaggaacagtcagaggattttttccgttcattggctcaacaacaaagagcaccgcttcatcttgagcactttgcaacttttgatggacgcactgccattttcgggctctgaaaatggcgttagaggtaacactgacagtcgatgttcggactctttgcttggctttctgtaaatttcagatttccaagcgcttcattctctgcactcgtcgacgagcagtgccggaattgccgccgcatctgcggtcgacctgctcgacgtctcccaccaccccccgccccactcagtcacatcgccaaacctttcaaaaacaatcgcagcaacaattgtaaaaacaaaaattaaaacagtaaatggcttgttacaattcaactttttcgttaaggaggaagcatcgtatgcgaaggatttgctcgactacaaattggaaatgcttcttcgtcaatggaataagtccagcgaccttttgtttgccattcatccgttggacggaagtcttatgacttggttcttattctttctcacatccgcagttccttccatgcgtttcttgcttaattcaggactctcgagtggcttgatgacgcgtggaaacagccgaccgtaagtttcgcttcgcgccttcccgacgcctttccgctggccgacgtcgcgtcaatgtcaatttggctgcacatttggcaccccttctctcagcatggctttaacgcgttgtacttttctcagcataataaatggagcagtgacgaggagaaccaacagaacccattcggttggattgaagcggttgcatgataaaaccgcatttttgctaattgagggcatttgcatgcgaataattcggggatggcggagagggacgatgtctgtctgctgaccaaacagcacaacagtcgatcgttggacctttggcgtttccaaatcgacgaacaaagcgatcgcagttataacatttttggtgtgngaagaagagcggagcctcacttgttgtcagtgcccttttcaatcgcttcggtgctccatgaatttcggctgagcgaagagcaaaagtcggacggaacactttngttggaggtgctcagcagcgaaagcctttttgatgc

SEQ ID NO: 22199 - DNA, 1358 bp, Heterodera glycines
  misc_feature (181)..(181): n is a, c, g, or t
  misc_feature (212)..(212): n is a, c, g, or t
  misc_feature (298)..(298): n is a, c, g, or t
cagttgatgagtgcggactgcgttccctgatgcaaagaaacaacacgaatatttgctcgctgcttgccgatcaaacagagaagagcccttaaagcgaagtcagcggtcacagcccgaacattcaaatgatttttacagaggcatttcctccgctttatataatttgggcgttacattcganccaccgaaattggagctgctcaattccatcnccatgttgccaacggcaaggaagaaagttgggaggaattgcgctcttacggaattgcctggtggttgaggaacaacgcaatgctgncgcaattgcatggaaagggtggccaaaaacgcatttcagaaaaggcaggagccaatggacgcggcccttttttatttggccatgcgcaagaaaaacgtactcacgcagctgttcaaagtcagaaaacattcatgggaaacttattaattgccaattgtttttcagactgtcaacgacagcagaatgtacgaattcttccgtgaggattttaaacttgaaaagtggagaaaaggcgctttgaaaaatgccttcgttttgatgagcaaacaacggtttcagcatgcggcggctttctttctgctgggcggctcactgaaagatgcaattcaggtaaaccgaggtcaatgggggtggggacgtgtccggcacttttgtgccatgatttgctcacccatccttaccttttcagaccattctcagccgtattggcgatcttcaattggcattggttgttcttcgtttttacgagtctgatccggaaagacaattcgaattgcttacggaattgctgtgcagagagattttgggctgcgagccgtcgcaattccattcgctggtcaaagaaggcaaagtgcactttccctccgccagcaggtgcaactgacaatgagacggcgaattgaacctttttgttttgttcagagaccctttcaagcggtcgatggctttttggttgataaacgaatacgcactttctgccgccacattgcttgaagagccatcgacggcacaaaacgacggcgaagacgagcagaggaggggcagtcttgtgaaggcacgccctttcctatttgactgtttttgcgttgagtgatttcgtgagtgatttcgcacatttaaggattcgaatctctgtgtggatgtcgccgccatgccggaaattttcaatttctactcctttcttcgacggcatccactcgtggttggttttgaaattcgaaatagaaacaaagagctaattttgaaacagattcgacaaaagttagcgaaagcgggcatttctacgaccagcactgagcagtttttgacttggacccaccgaattggtgaaaaactaaat

SEQ ID NO: 22200 - DNA, 2463 bp, Heterodera glycines
  misc_feature (2443)..(2443): n is a, c, g, or t
ctacccctttggaagaaatcgataaacaattgtttttaaagtaatttgcgcacataaataaaaaaaggggaatatatatttcgcattttgaaatgaataatgataatgtgaagaatgccgatgggggaaaacggtaaaagttaataaaatgctgtacaggagaaaagggcgggagtgggctgaaggaaatgcggaattgaatatgcaatcgttggcagtgagtcgtcaatgtgagtggcttcaaatactcttccgtctttcctccgcttccattcattcgtttcgctttttcttctgcggcgtgctctccgtcgaatttgcctttcgcagccttttgcttttgcgcggagtttccaaaacattcgccgcctctttcgtcgccgacgccaaattcgactcgcttttaagggactcggacgccttcaggggcgatttcagcggagaacggattgacgacggacggcgcttcggaacggagcgaagagtcttcgtgcggtagaactcggggacctaatgagatcttgtaaaaattaataaagctttgaggtccgcaattagaaaagtttcggggaggggagggcacaactcgacaaccttttttttggctttctgcctcccaaatttacctcgcgttcgtcgattgcttcgtaaacatggcttgatgatggcgactcggcacccgcctttttcaatggacatccaattcggaaatcgaagctccattttcgcactttctcctccattgcgttattttccaggcctgaacaatttaatttggtgctatgtcattacttaaaaaccatcataaatgggcgttacttaaaaaaccatcataatgaaaatttttgcttataactttgctctaaaaagaccaaatttttaatccttgctgtcattcgatagatctaaatgttctttatgagcctgtaaaatttcaaaaaattttattaagtttaaaaaagttatggccaaaaatgtacgaaaatcaaggctttttgagttcctcgagctataacttttttgaaaggttgctttcgagcaaagttataaatattttgttcgacaaaaattttcataatgtatggttttttaaataacgcccattatgatggtttttaaggaacgaccctgcacctttaatttgagaaaaaaataaagagattacttttcagccattcatccgcgtcatttggtcgcccagaaccaaacagcgatcggcgagtaacacgttcattccgctgatcgctttgttgactatcagacattgaccagaaattcaatactttaacaaaaaattccaatcataacttaaaatagtcagctcccttcgtttgctacttttaatttgccttttaaaaatataaaataaaaaaacacttatgactaaaaagcactgagtacaaggcttccgaaacaagcctcacctccccggaaaattgagaggttctggatcaggagtggagcgcgaccattaatcgcgctgagaatgagtcaaagtgaaagagaaattcagtaccacaaaaataacggaaggaacttgtggaaaagtatttgaacaaacatacaatttttgcagtcattttttagtggtccatttttggaccctctcttgctctgtggatataagtcgtagacccacattcaaaggacaattcggaacagaattttgtgctctttccaatggaaatctggcattatttgaaaaaagggtggaggttcgagaccgctttacaaaaaaacgtcaatttttgaaattttcgctatcaatatgcaaaaggtaaagaaataatatgcctacactctctatttattggttcatctctcgttaataatatgcctacactctctatttattggttcatctctcgttttttagggaagaatgttcaaaaaactatcacccaacttgatcagatctttccatggtgatcttgtacaccaaaaaaaaaacgttggaatcgggaattttcgaaaattctgggggttggaaattttttctggaaaaatgagtaggccagaaagggcaaatacaaaattgttctatattaacaaattttgggtcagatcacttcaccgcagggacttgcgaatttatcgccgaaaagttttcagtttaactgcaattcgaacaaaaaaaggatatactatacacaacagcccaattttgtgctctcagtgcaaataggtttattatttatttagtaatcagaacgccaaaactttgcaaaacttaaaattttttggggattttccctgggtttcccttgtaaaaatagaagagccgatctcgagttaaaaactagacagctaaaaaataaactgtgattcgatagaggggtacaaaatatgggcctatacaaaatttcaaaaaaagttacccacaggaaaaaattttttcccagggcaaaatatttacgaaatcacttatagtatggtaaaaaantggtacttacacgtaaaaaa

SEQ ID NO: 22201 - DNA, 1497 bp, Heterodera glycines
ctcattctatcaattttcatcatttttgcaattgcccgttcactcatttttggattttctttttttatttcccaataaatttttattttttccattttttcttccttcgttattattttcttgctaatgccaaattgtttcttccatttgataattgtccctttgcttactccaattttcttacaaatttcggcataattttgtttccattctttttgcgaatattttcttttttgtttaaattcatttgccatttcattaaatttttgtacaatttctattttttcttcatcactttttgatttatagtttttatgaatttgtttttgaagaccaaattctttaatccattgataaattgtggttcgatttgtccccaattttttcgttatttttaattcaatttttttccattcttttcttgggtattttcttcctttttgcttgattttctcttttattttataaaattttgcaattatttctctttttttgagttcatttcgcctttcttcttccttttcttcccatttttcatccaatcgcttgtataacactttataaaattaatatagcatcaacttttgtatttttcgcctccaattatcatatttaacgattttgggaagtaaattagtaaattcagtgcatttttaatctaaaaaaacaaattttttgcggcgcatttttccaaggaattttggagaacgggggatgggagtgggtccggcggtgccgataggcgccacctgaaaaatttttgtaatttctttgcggataatcgaatggatgagaacgccttccaggaatggcttttatctgctccatctccgcttaaactccgcctaacgagagcaattaaacttctcaggcgccgcaaaaatgaaataatctcgctgacgaaagtgcggcggcacgtgatcacgtgaatattcttatggcgtgagaaacgaaagaaaaatgaatgaagtgaactttggaactctgaaaattgtaactcatacggtaaacaaaataatagggcataattttcatttttcaattggttctctattttcagccagttaaaatcgcacccctttgattggttatcagcccgggcctttttgctttaccgcaatttatttctctttttttttgtctcactttttctctctcttttttttttgtttttggcctctttctctcttgtttctggcctctcattcgttcaaaaaatgcgcactgtgcccccagaccaactatgcaccgtttatcccggatggaatttgggagggaatgaggaaaagccaaggcgcctttgaccaagccccgaacccccaaacgactcattgactgttaaagatgtgtttattcattcgttgttggatttacagaagcgagaaattggaataataattgaagtctgttccataactaactgactaactgatcactggggaaggagaaaatgcgaagagaatgggcggagaaacattacaatgagaaaaggaaaaa

SEQ ID NO: 22202 - DNA, 579 bp, Heterodera glycines
aaaattaaaaaacgggcgcgaagcgcccgtcgcgtttttcacaaacttaggcctggatttctcaaaaaatttaaattttcagaaataaatttataactcatttcaaaaaaggcgctaaagaatatttaaatattcagagggggaagggttcgaacccggacggtgtacattatttttttttgtgtttttaggttattttaaacgttgttaaataattgaaaatattttcttttaattaattacactttaaaggtgtgggagcgcggttggggtggcgcggggggaggagggaggcgggtgtcgagcaggagcacaaccaacttcggaagaacaacaacaacggcaaattgatcgtcgtccgtgagttggccaaaattggtaaaaaaaagggggaaatgattgccaattgaagcggacaaatcggcagactattgtccgagggagagggaaatgtgcgcaaaattaatgcacaatgagggaccagctggaacagcagctgatcgcacgagtggacgagtccgaggacatttgtatcgcggaaggggtactattgggcagaagggggggggggagggattg

SEQ ID NO: 22203 - DNA, 964 bp, Heterodera glycines
ttctgatctacttttggtatactttgattaaaaatgatcattaatcaatctattttttagcagttttgctgataagtttggctcatcttctgattaaaacgggtatacttgatctgattaaacattttggttgatcagggtatctctttgaccccgccctccatttgtgccaatgtttttgcgcctcttaccgctcatttcgccctccggcacgcccggccattgcacctccgtggactgttccacgtggtgcacaaagtcggcaaccaattggccgtacggtgcaaatgccaccgaatcggcgtcacttaacggcttcaattccttggcaaacgattgggacaattgcggcaatttggcaacctgtgagagtgaggaagacgatcaaacaaagaaaacacattttcaatcagttttcgattgatttgaatcacgcccggggcctttccctttttagagcacacatggaagggctggatgcaactgagtttaaattacgggaatccgtaattacggcgatttcttaatttcagaaatccgttacgggggtcggtccaaaaacgccgatatctgtaatatgtaacccgtaatggggggcggcgggtcgccgacaaagggggaaagaggagaaattgtttaaatttgaacaaagtcaagaacgtcattttgggaggaaatctgttaaatattcaaagtttttctctcggcgaaagcctaagggtataaaaatttaaaaaatgattggagtggaatggcattttcgaaaattttgttcccctgctggacaacacccaacagcactatgcctggccattttccgtttggcactctgtgtttggcacaacaccttttttgagggcagcgcctcctccggtggtatgcccagacgtcggacactgatcggactcactcgattaaccttcaaacaaaaaaaatgttgttttaaaaatttgaacagaatgcc

SEQ ID NO: 22204 - DNA, 2699 bp, Heterodera glycines
tgttttgtcatttcttaataaaatgacagaatcaaagaaaaataattaagttaattaaaagctttaatggaaaatgaataaaaatttaaaaaaagttaaggccgggatttgggacaaggaaagtgtcggttagggacacaaaaaagcgagaatccgagaaccaaaaccaggattccggaacagtcatggatgtcttacagatatttgcagaaaattttgaaaaaaaattcgtgaaaaaataaaaataaataaatggataggccttgtcagtaagtctcttccaatttcagataaaaagaaaagtatttatatcttttgaggcaagcttaattgcaagaaaaattgttttttacaaatttaaatgaactgaactattatttattattttatcatttaatattaaaaaaataataactatttaaaactattttttcatgaaaatttacttcccgacgaaggtgttgctccccgacatttttagtcttttcaggcatctccaaagaattttcgataaatttccccccgatccccgattttctttcccagagggtaggggacgaacccgagattaaagcttgttttggtgttcagcaaggatggcattccgtggccccgagaagaatatataatattttttcaaaatttaattattaattagcggtgaagcaaaaactgattattctttggcatggacaccgactcagttctgcagcccgtctttatcttcgcttttgctgccgttgagcttctgatcaatttggtttgtgttcccgtgtcggccatcaacttctttctcgtcgccaaaagttcggtgatccatccgaacctcaaacacattctcatctatcagagcggaagcattctcggggtaaactgtgcagaaaatgaacaaaaagaagcgcaaagactgtgctaaactgggcaattaaaaccaaattaattaattaattaattaaatttgtaaagaaattaattaaataaacaacaaattaatttcctcctttctcttggttttcatagattcgatcattgctcaattagccttctattttctcgcttaaccccctttttcagaggggaatgtgccggttcaccacctgtctgctcaaatttgtcctgttaagtccgttggcaagcgaatcctttcaatcgattggcaccatttactcatttttcatcttcgagcgcaacacaatggcccacgttctgatcattgaacgcgttttggccacggtaacggccaaaagttatgagcgcagacggaagcccttcttcactttgggttggctgatcattgtggtcagcagttaatttttaaataattattttaacattgtttaaaaaagacttttttggagaattccgagatcaacaagcttttgtaactgtttaattttaatttttgtattaaacgaatcaatggccctggagctgatctcatgacaagatccaaatcttcaatctcacattaaaaaactgcgagatgatttactgaacacagatttatatatttttagcattttttgaattttagcacttatttttgtgtgttgcaaaaatgttaagaaagacactaaaacttgaaaatattaatttttcaaggcaattttttgatgagatcacgaaaatttaaaataattaaacaatttttttcacactagtgattaatttgacaaaattgtctaaaaatatatagaattttttttataaataaaaaatccttatttttcgaattataggcagcagaataattttaaaacaaatttaagcatattggagaataatttgatttaaaattttttttaaagcatttttcgtctagtctttagcacattttcataacttaaccgattttttaattttttcagatttccttgggccttttcaatgcaattggctacaaagaaaatggtttttccattgttttgacgaattttgcgctgcttttctccgctggcattgaattgtgtgtgttttcactgcttcgatggcacaatgaaaaagcgtactttcggacattgcacagttcgaacggacacaatttgtcagaacgataccaagtagggaaacggagccaaaaatgaacaaagttttaacagaacaccccgtaaatttaaatggaatttccctatttacgcctccataattgcttttgagcccaatttgggcaaaaacgcattaattatttagggcagctttcatttataattagggataggatttttaagggccaaaaagtcaaaagtttttatataaaataattttaaattaaggcaaacaattattcattgattacagttgcaaataattatatatatttgaaattttgaatacattttttttaaataaaaaaaaaatttcaaaaatcaaaatttggtcaagaaagaaaataaattacaaaaatttgatcaagaaaaaaaaacaaatttagtggaaattttttgaatttttgaacaaatcgccaaaaaaaggtgatcgtgtcaaaaaaaaaattgttttaagtgcatttttgttaaagaattagtgaattttccttatcacatttaaaaaaatcgtgaaataagggcgaaaataaagatgaaacgccacaataatgggcaaaaatttattttaagggcgaacatataaaaataaggaatttttaagggcgataaaacgcaaaaatttctcaacaaaaaatatgttttttcgtgcatttc

SEQ ID NO: 22205 - DNA, 1940 bp, Heterodera glycines
  misc_feature (151)..(151): n is a, c, g, or t
ttgcgccaggcgttgtcacgacgtcgtccgcgtcggtagctgcaacagcggcggcaggtgttatggcagctgctgggtttcaggtgagcaaacaaacccacacacacaaatggggcggtgggcgggcagaaggcaatgaaaatgccctccncaccccccaggcgatgaagcggctgtcaatttgatgactgacaaattggggtggtggtggcaccaagcaattagcattaaatatcacgacgatgatgaattacacacacacattggctggccctcctcccaatttggaatgtgtgtgtaaacagttggtggctgtaatctttattcagcaattctttccccctattctcgttaatttattttccttttatctttccaattatcttcccaattatattttctatttttcttccatactctctctatctctaccctctctctctctccacctcactctctctctgatttcacgtctctcgtgttcacacgatctctcgttgtcaaatcacttttgaaaattttttcttattctctctctcgtcctataaatatttttcgttaattttttatgcttaatctttttatctttctttcgctctcttccatcctcacgctatttcagcattcaccgcgtcactcttcccactctcttatgaacccgtgttcttttctggattttaaagggtcgcgtgccgaatgtacagttatgcaaacaaaggcgcaagattttattctgccattcaaacatatctatagcctcctttctgctgagcattgagaatgccttacactaaatttggccaggcaaacaaaaaatttacatagatttaaaaaaaataaaaatttttatctcaataattactattttatgttttctctcaagtcctcaaaatttgccattttaagcaaccgcgaacaaatcgttttatttttaatttgcttctggcggcaattcttgctccacaagtggcattttttaccgatagaattttattttttgcattttaaaatataaagttacccttttatttttaaattttcattttaaattttatttaattttcgtataattttaggttttttatttcatttatttttttgcctacaaattgtgcgtacacaatttgttgcatgtcccgcttcttttggcaacccaataatgggtcggctgcgcccaatgggcttaatcagggggcccaaccgtttaccgctgttgccattgctgcgggcaatttaccatcccaggcggcactgaacagtgtgagcagagcaacaaccatcaagcatttctaaatatgagcccataaaatgtttaatctccctttcgaatgatagcaattaattaatgggattaattagtcgccgtaatatgtatctgatttatggtaattaaatttatttattcttttttacctagaccgaaaatttctcatttcaaaatcgagggttaagtgatttttccttgaactgttcccgacggagaatttcgatttaatcgagaacgagaaatttctcgtctcaaaatcaaagcttaaatgaaattttatcccgataaaatttgacctttttcagtgcgaaaacctcggtatttgagagtaaagacgaaaaagcggcaaaaaataaataaaaataataaaagatgttgatagccgcctcccctccccaaactcaataatggctatggctaattagcagtcttttgcgctcaacacagaatgccattcttttaatatttttgccacgattttgaccgtttaaaattgcagcaacatctcgccagcttgcaacagcaacagcaactgctcgccgtctcctcccagcagcaccaccactcggctgcggcggtggcgcaccatcatcaccaccaccagttgcagcaacagcaacatccaaacgtagtcagcgcgttgcaggcggcacacgctgcaacagccatgggc

SEQ ID NO: 22206 - DNA, 1678 bp, Heterodera glycines
  misc_feature (15)..(15): n is a, c, g, or t
ccttttacaaatggnccattcgcttttgccatcgaaatgcgcgtcaaccaaagcatcgaaacggtcggaaagcattgccaatttgaggccgagttcaacacgtccaaataaggggaatatgtccatccaaacatcgctgcaaatccagcttaaaatgtaaaagtatggcacagaattaagaatttaggactttttcgggttggaaatccgacgatttccgaaaaagtttgctaaatttgtccaaaaaatcaacaaaatgcaatttttgatgaaaatttgctaaaaatatgcaaaaatgttatgtagggccattagtacattttttcatggttgggaaatggttttaaccctaaaattcacattcattaaatttctcacattttccgcaaaattcgcttttccattttcatttgatgttctccaaatgctgtctcaaatgatgaacccaacgattgctgctgattttcaccaattgtggcagatgaaattaagcaatggtcggcggaggaaagttttttctcgtttttagcgggcgatgccattgaaaattaatttggcttaaaaatgtatgaattaggctaattataaatagggcgtgtaattatatgaatataaaattgcgaaatatggccataaaatatggaccaaaaatcgcgaaatatggacataaaatggcaaaaatatggacataaatttttccaattgagggtataatttcccaaaagttctttaaatttgttaaatataaagtaaaaccttcaaaaatggctaaatatggtattaaaaatcattttagaagaaaaaaaacacgataagctaaaatttacttatttttagcgaaaaatcaacctgaaagcgaaattttggtttttttgcttatattgacataaatttattaatttctaagaaaatttgaatttattcaatattctcgagaaaatttagcgaaaaaataattttttgtaaaattttccggtttttaggctcaaaaaggcaaatttagctgctgggggccgttctaatagaggttttttggaaaaatcccaaaatatggacataaatcccgaaatatggaaaaaatggatatagaaatccatcctagaagcttcaaaccaagctaaaaacatgtttttcgtgcgtttcaggcctccaataatccaggaaaaaaatggatttccatataattacacgccctaattataagtcatattaaaagtatatttttaatatcatttagccattttttaaagttttacattacatttagcgaaactaaagaaaaattgagaaattacacctcaattggaaaaattttatccatatttttgccattttatgtcaatattttgcgatttttggtcaaaaatcaaaggaaaaatcgacaaaataatcatttaaataacggtaaaagtaatcatttcaaagagaaaatgagcaactaatcaattcacatccatcaatagtgtgattcaaaatgatcagacacaaataatcatttcttttctgctgatcaatgggcccattattaagacggggatgcgacatttgcggcgctgacacttcctgcgcccagtcaaaacgacatttgcggcgcagaattaatccaccccaaaaattatttaaacaattttttgattaaaaaacatttgtttaatcacactttcaatccctttcttca

SEQ ID NO: 22207 - DNA, 1896 bp, Heterodera glycines
  misc_feature (105)..(105): n is a, c, g, or t
tgtagtatgagtgcgagtctgtgggtgtacgtagtggctggcgttgttgccggtgtgttgtcgtgttggccagggtggtgggcgcggtcgattcctccccccccncccatcggcgtcaccgacggttcaccgagttctgctgctgttgctgctgcatgaggcgttgttccgtggccagttgttcactgtgcgaattgaatgaatcaggcaaattgaacgccgccgggggagtcccgaaaggaatttctgctcaaagagcatgagacacagaacgatgctcgtcaaatgaaccggtcggattttcccggtcgtacaatgggcactcgtctcccaccatggcccaacattcatttctaattcgtccgtccgtccttttccctctcacctctgctcctcctccctgaacatgcgcacacacgcgccccgaccgaaccgagcgtccatcagaatgcgttggatgttcattttggtgaccactttcttaattgaatgttcataattaaggcaaatgcttttctaggggaaaatttttcttaaaaaaacgaagaaagctataaaaaattcaaagaaagagagagagaatattttcaaaaaatcctaacaaattaaattttaactaaaaaaatgttgtctaaaaaattcaagtaattataaataattttgattgcacaaatgcacctcgtcgtcgttgaggttgcccaagtggcggacgagcaggtcgatgatttccgactcgacttcgtacaattgttgttgttgctgctgctgttgctgggcgtggtgctgttgttgctgttggtggtggtgttgcaattgttgcagttggtgctgctgttgctgatgaactgcttgctgctgttgttgttgggaatggtgttgtgctgctgcggccgtagcggtggacagaatgtactgcggcaggggctgttgttgtgccgatgccatcatcagcgaggaggaagacgaggaggacggagtgccgacgccgaccatttgatgttgccgaaaggatgctgaagtgccgctccgatttgtgccgctggtggacgccgaattgacgacatgtggaccctttggagaattgtgataagaatcagtctcaaacaatgtgggagtgccacggaataacagtgtgtgtgccaagacaccccaccggaaaaaaatttcaagaaaattttttgaaaaatttatattcatgaaattttcttataaaaaattctcagattttttcttggaaggtagggggagatggcgggaaggaattgccaaaaccccgtcaaattggcagacttaaaaacggcacttttatttagtgataattaggggagggggaagggcgaagtcgtcggcaaaatctttgaaagcggccgcccacgacaaaatgcccaccgaatgaggcgacgaattgggcccaatcggcggctgttgctgatggtgggccaaaagcggtgccgacgacgacgactgttggtggtggtggctgagcacgagtcgatctgcaaaaacagtaaaaacacacaaaagcaaacgaatgccgccgaacggagggactaaccgccggggtcaatgaacaaatgttgcgcctgttgctgtcggttggtctgcaactgttgcaactgatgctgttgctgctggtgatggtcaagtgtcgtccccgccgccgttgttgccgttggtggccttttcctggcggtgccattccgtgctgttgccggcactgcttgggtgttgttgtgccgtcgtggaggtggccgatgcgaagaaactggacgactgctgctgctgttgttggagctggtcgattccatcggcacaccatggcatggtggttggaagatgtcggtgcaacaccagctgcagcagcagcagcgacggagtccggcgggatggtgatga

SEQ ID NO: 22208 - DNA, 2354 bp, Heterodera glycines
agacaagttaagctccgtcagggggcttttcgaagcagccatgctgcgagctatcagaaccgaaccgcggtctctgcacaagcaatcgctgaagtcgactatttccaacctggccagcttttccagtgcgctggccatggcactcgctcccgattctccgaatgtgttgtcgccaagattgagtatttttagcgatgcattttgccgcacggattccgataatttgagtatcccttcagcgctaattccgttttgtggcatggagatttcctcaagggtgccaattatctgtaaaattaacaaaatgcgtttgttgataaacgaatggaaagactaaattcttttaaattaaattattcatctagtgcctgaaatgcttcagctagcgcagccgttgacgtgtactccaagcgattccttccggcgacaaagattttcagacaaagcggagtgccatggctaactgatcgccgatggcattctatcaaacagtgagcaattgtctgtggaaaattgcaacaattgaagagaagggtaaggatggacctttcccgcaattccaaggccgcagttgttaagcttcagcgtctttaaggcaaaggccgcctcgccagcaagaaattcttttatccccggcacagccataggaccaatggcattgtcactcaggtcaagctcggtcagcctcgctccactcagaatcattgcgtcgcacaaagttttctaaaattaatacaagaagttgtggggcgacagcgtaccaatgtcctgggaatctcttctttgagtcgtccggtgaacatgtcactccaaagggctctcttaatcaacagggtgacaaatggaatgcgacaattgctaccttcaagttgctctggcactccaatgcttcggcgatcggagcggtcgcacccacaccaagcgtattgccgcgcatttccaacacctccaagccggcacactcgcggattttggccgctatcttctcacctgaaacaaaatcagccctttatagggaacaaaaaattaaacttgttaatttcgtaaaagtcccccatataatatttttttgtccaaatattaccatctccgattgtgtccaatttgagttgtaatccagcaaatgacagaacacgcattacacccactaatagtatatatagaaaatatgtttgtaaaaaaaaattaaatgaacatcaaaagttaaataacttatcataaagaaatgatttataaacctaattcaaaaataacaaattaagaatgaatctgcacaatttaaacaattgaataaggcgtttaatctcacaatcagtctgaaagtttaagctttttgaggacatttttgacttcggcgttccctgcgtcttttttgctctttcttttctctcttttccttttttcgctctcttttctctttgctcttcgctccgatttcgaaaacccgcgccctaatcgcttccatctttctccggagcattgttttgaactgcgccggcacatttttcattttcaggtgatgttcaatttcggtcggcttatttattcgctttgcaattgccacctaaatagagtctgtgtaagcatcttccagcgaatggtaattatgtgcctaattaaatattctcaagataaaacgtacgattagcccattcatatggtgtttgtaagccaaatcaagtttcgtccctatttgtaactttgcgcaggttttggtaaccagcctttgttcgaccatctgaagaagtgagtggaagccgtaagttgtcgcaaagtccaacaattcgggaatgtttgacactaaatattgtgttgtaataataccggctaatgtaactaacattaaatgttttatgatccaaaaaggaaaaacacacaatccattactaatttaattaccataaaatgccgattttaagccaacgacgcgaaacgccaacttaacgagcgaaggtttgaagcgactttcaaggcgaatgggattttgctttgacgttccctttcctccatttataagtgcaggcaaaatggttgaatggaattcgaggaactaaacttatatagtccataaacaatcaaaagtatggtttttcaattaccgtcctttcaacgtatatctgctcattgccaatatttagacaaattttaaaaggtccttccgcaagatcgggtccaaaagccctaaatattttaaaaaaaaattaaaaaatataaggaaccgtaacaaatatcacaccagcctaactgcttgtttctcatgcgatatgttaacaaagttttccatgaatgaattatttctaaaggaaaaagcaaggagggtcaatacgttgggttaagactgctgatccgaagga

SEQ ID NO: 22209 - DNA, 2420 bp, Heterodera glycines
  misc_feature (51)..(51): n is a, c, g, or t
  misc_feature (75)..(75): n is a, c, g, or t
  misc_feature (77)..(77): n is a, c, g, or t
  misc_feature (94)..(94): n is a, c, g, or t
  misc_feature (2278)..(2278): n is a, c, g, or t
  misc_feature (2315)..(2315): n is a, c, g, or t
  misc_feature (2355)..(2355): n is a, c, g, or t
  misc_feature (2409)..(2409): n is a, c, g, or t
tcaaaaaagagttctcaatttgtgccattctttcagactctccctgttgcntgatgttactgttcgaattcgcgntnaaacttgattgacttgnctccatggttcgtattcatccccccccccccccaattgtgtgtttagttttgtgccgttcaattaattttttgccgtttaatgccatccctaattggcttttccccccttttccatgtgtccgtctgcttgcacacgccccacactctgtcccaatggcattcccttcactattggcttcttacagtgggcgaattttgaatttgacttcaagaatctgttcattatcttcagactgatgttctcgtcactgtcatttttgcgttcgattcccttttaaaggtaattaatactaattagtcaattaattattattttttaattaaattaaattcattaatagaccagttcccgcgccgctctccgcgatcgctggtgccagttcgatttgctccttctgtttttccatttcctttccattggtgtacattgcattgaaattttctccaaagattggctatggcttggcatttcctacgaaggatggtccgtaattgatggacgttattgttttatctccccactaattgctcctaattatcccttaattgtttcaggtggggcaccgtccgttccccgcgtccgcttgttatggtcaaattcattcgatctgtcatccgtttcaaattgcctcggcagcgaattcaacttataatgaagtccaatctccgttttttaattattttaaatatttcgaaattttccccctaaggcgttcctctcaacaaattcaaaatgtgaccattttcttcctgttcttcatgactttgtatgccataatgggtgtccaactgttcggtcgaatggaataccattgcgttttacccggcacggacccacgaaatgttacgatagcaggtactgtattcaggcaacaaatacacattgaaccgatagtatagataattaaattaccaattggtttcgccagatttggccatccctgacacaatgtgttccccccatggccatggctacgaatgccctgcaaatatgcaatgcatgaaactgtcgttgaaagccaaccaaattggcttctacggcatgtttaacgatttcggtaccattgttggccttcgttaattctacccaattagcacattccgcaatgaaggcttcagtctgtttacggtgtatttggccgcttctcaagagggttgggtgttcgtcctctacgacactttggacacttttccctcctattgcggctttttttatttcctcactttgattttctttttggcttggcttgttaaggtttgtcatcatttgttgtattaaacaacatttcatttgcttttgaacagaatgttttcatcgctgtaattaccgaaacattcgccgaaattcgcgttcagttcagcgaaatgtggcaaagcagagaaatggcgcaggacgaagacgcaaatcaaacggtaaaactcagacaaaacattaatttaaatttcagaattattttcgacagaaattggaacgcgacgacgacggcgagtggcgactgcgcgagttcgacccgaaggtgaacgacttggacaccatcgaccagtgccgcgtgcgccgttggctgtccgcattggtccgctccacttccttccacacattcatgctctgtttagtgtaattaatcaattatttgactttttaaatttaattttttgagtgttttcaatgccctcatcaacgcatcattcgtttatcggcacaacagaagcgatgcgagacgaaagcgcatttatcatgccattgaggtgcagctaaaatgccaagcaaacccatcccaccattctttaattgcttcattaattggttaattaatgttttctccaattattttttcatttgccaggcttttttcacgctgctctttcttctggaggtgtttctgaaggtgttcggcttcggctggcgtcccttttggcgccgtggtcagcaccgttttgagctgtttctctgtttgggcagtgctttgaacgtcgtcccgtccctttaccacaccaattatttcacctatttccaagtctttcggcttcttcgactcgttaaactttcgccaatgctcgaagattttgtttataaggtttaaaaaatgtcgttgttagccaatttatttatttatttttataattttgtcagatttttggacccggcaaaaaattgggcggcctcattctgttcacacttacgnctggtggtgatcacttctgcaatttcgcttcaactcnttctgttatgtgcccaatttggacaagtttcacaccttcnccccaggcgttcattgtccatggtttcaaattataaacccaagtaatttcactnttcaaggaatt

SEQ ID NO: 22210 - DNA, 2283 bp, Heterodera glycines
  misc_feature (48)..(48): n is a, c, g, or t
  misc_feature (78)..(78): n is a, c, g, or t
caactcgtactgctccaactcgtactgctccacctcgtactgctccanctcgtactgctccaactcgtactgctccanctcgtactgctccaactcgtactgctccaactcgtactgctccaactcgtactgctccaactcgtactgctccaactcgtactgctcaactcgtacagcttcaactcgtactgtttttcgacaaaaaaatgtcataacttttgttaaggtcgaccaaattaaaaacattcttggtatcattcaatagcctttaaaatgcaagaaaattttattgcatttcaaaaaagaaagttatgaccaaaaatcgtaaaaaaaattcatccataacttttttcaaacatgacaaaactttttgaaacttagtgggtagatagagaatttgaagggctattgaatgataccaagaatgtttaatttggttgactttaacaaaagttatgacgattttttgccaaaaaacagtacgagttgggtttttatcgcctgaaacacacgaaaaacatgtttttagcatggtttgaagcttctaggatggatttctatatccatattttccatatttcgcgatttatttccatattttcgcatttttgtccaaattttatgtccatattttgtgatttacctctattagacggccccaatcagctaattggccttttggattccccaaagaccagaaaattttccaaaaaaatcatttttttgcaaaattttcacgagaatattgaataaacttcaaattttcttaaaattggtaaatttatgtcaaaaataagcaaaaatttcgcttttcgggtttggttttcgctaaaaattagtaaattttagctttatcatatttttttattctaaaatgatttttaaaaccatattagccagttttatatgtattttagtaaatttatttaatttgaagaaaatttggaaatttacacttcaattcggaaaatttatgtccatatttttgcaattttaggtccatatttagcgaattttgatccatattttatggccatattttgcgattttatatccatataattcccagccctacttaagactagagttataatatgcaataaaaatccctaaaatatgcccttaaaacccgatttttaacaccatatttagccaacttttgaaaacaaaaaaaaaagattttttcgaaaaaaggagggagggataaactttactattaccgccgtttttacacatccgatttattaacatatatttgagaggattttcttcataaaatacatttgatcactgatttgaattatgctcggtcgatcattcttaattacaatttcatttcttctgcgtctgctcattgattttgttcgtttgtccgtcactcatcatttgtcagcagaagacggcccttttgtgatgctttgtccggattcttctgcgaatggtggcggagacaatggccttaattaagcgaaatttgaattatttaaacaaaatcaaatgcttttttaattgctcacccaatgcaatcattgcaaatgtaaagccaaatggccactttgttacaattgtcatctttcttctgctgctgaaccgccgcggtctccccaataattttgcatcgtttcattatccatcggttgcccaattcctttgctttggccaatgtcagcttttcctttgtccattcgttaagaaattcaaatggcaccatttgtattgacggcgcatgaataggaaaatgaatttcgtaagtgacggaagaaatggcattggcacggagaaaatgctaaacaatttgattggaaaaacaaaaatcacaaaaatgttgggccacacctccttgaaattgttgatccaatcgaagttcgtttgttctttaatgtctttgcaatgcaatcgcttgggttggccatcttttctcggtgtgtgcaaccatttggacaatgcttggccagcagaaattgtttcatttggcacattaaaacaatcaccaatcgcagcgggcaacaaagcaccggaatggattgaagtcaactgatcaagatcggtgagaattgtcggcgaagtgcgacgaagcaaattgtccaaatgatcaccaccggtaaagcgcaaacagcgaatgtttgtcgaaaaaattggccaaatttcacgaccaaaaatgtcccaaatccggtggccatccgtggtgtttgaataaggaatacacaaatgtaaatcgatgcctcttttgtcaaaaatttggtgatttgaaagaagaaaagcgatgacggagtgatcgatgta

SEQ ID NO: 22211 - DNA, 2355 bp, Heterodera glycines
  misc_feature (2324)..(2324): n is a, c, g, or t
  misc_feature (2350)..(2351): n is a, c, g, or t
cgggtcattttagtaccgaataatgattttaattaattagtaatataattattttaatcaattaattagatttgctgaccataattataatttagattatttatttaaatatttcccaaacaaattatatttttgagagaaatacagtgtcccccaaaaagtcttgactcaaacctgattaactatcttatagttcatctaaaaatttgaaataattcatgcctgcctaacttttggtgctgatcacaaaagtctcttataccaacttgatcagatcactccttcctagtgaccgggacaccccaaaatacactggaaatcggggaaattttcgaaatccctagggagctgggaaatttttctagagaaaatgtgcaagcccattggaaagagcacaaaattctctactggtttgccttttgaataatggggctacgacttttacataaaaagatatacttggttgaatatttgatcaccacgaaaatgattatttttgatcagtgccataactctttctagaagcatccaaattaagcattcttggtatcatttgatagctctaggtgtcctttatttgtctttaaaatttcagaaaattcggttcagtttcaaagaagttgcgactaaaattttctgaaattttaaaggcaaataaaggacacttagggctatcaaatgatatcaagaatgtttaatttggatgcttctataaagagttatggtgcattaaatttatcaagatattacgtggtcgtgtttttttcgtggttgtgtaaactgaagtagagccagatatatttagtatgattagcttattattaatttttaatatagtttttagtgtattttttaagtttgtttaagcaaataatctttgagagcttaaagcatatttcggccttttatagtccatattttatggccatatttggtgttttttagtcaatataatttaaatattttaaccctaataattaatacttaaaatgcacatattttttcctggtttctccatgctctaaatagtaggaaaaacactttcttttttgtgtttgcgaacaaaaaccgggacttttatttacatatttttacatatttcggggtttttatacatatttacatattttggatttttttcatatatattttcatttttttacatattttgaaaatttataaagaaaaaataagtttgaaaatgttgcctaaaaataccaaaaaaagtaatttttatgtcattttgtggctatttcatactttacggggaatttctttcccaaaaaataccattaaaaaccattttatttgcatatttggggttttttgtacatattttgggatttttcttacatatttatgtacatatttggaccactttttgtacatatttttggcagccctattcattaaccattctcgcaataactttctgtttatatattttatttaaattacttaaactaaaaatcaatacattaaatttttgtcataaaataaagtaaaagaaatttatgtataaatttattttaatgttcgaaaccaaatttattatttgaaaccaatttaaaagttcaagacgaaaaacgcacaaaatttatgaaaaagtgaacaaattaaaatgttggaaaatattttcaaacaaaaaggaatttacttgagagagggaaaacattcgcgaaaagaatggcaagaatttaaagcagaaattaataaaggttttggataatttcaaaatgggtcaagtaatttgacaaaagaaattttaaatgacaatttttgaaaaattttaattaataattgttgtttaaaattcagagagtaaaattttaaaactgccgaaaaatgaagaatgtgaagcaatattggcaaatgaaaaagaaaaaggcaaaaatagcgacagaaaaattgcaaaattttgagcattgacagaaaagtttgaaaagaaaaacaaatataaaatttaatgagaaataattttaaaatactaatttgtaaaataaatgttgattctaatattttttgtagtcaattaatatcattatttctttcattttgcgcaagtgaattatgcattcttaaaattaaagtgcaattggtgtccggcggtgccataggcgccgtggggcaaattttttgaaaagtatttgcccgatctgttaaaaaagtattaattttttgtggttttaaaacggtgcgggagaaaaatttaaaaattagggcacaaaaataaatgtataaacttttagagaataatgtaaatatccctgacagatattgtgttttttgttttttcccatacttccccctgccccattgccctntttattcaaaatgtttttcgactctnnagag

SEQ ID NO: 22212 - DNA, 1852 bp, Heterodera glycines
  misc_feature (31)..(32): n is a, c, g, or t
  misc_feature (34)..(34): n is a, c, g, or t
  misc_feature (48)..(49): n is a, c, g, or t
  misc_feature (52)..(52): n is a, c, g, or t
  misc_feature (72)..(72): n is a, c, g, or t
  misc_feature (143)..(143): n is a, c, g, or t
  misc_feature (1596)..(1596): n is a, c, g, or t
gctgatgattaatcaaagctctacgacgggnntntaaaaaatcatganntgnttgaaaaaaaaaattgcttnttcaacaaaaaataaaaaatgctaatttattcattttttacttttttccaacagttgatcgagatgatttnaacactaatgatgagtaagcagtcgagaagcaagcagtgaacaattaaaccacttctctgattaccacagacaacagcccaactgctgctgatgctgctaattatattgatgatgagataattagcattaaattataaacacacaaaaaactgggcaatcgcaagcaaaagtgtaatagtaattttggccatgaaaatcctactaattcattccttcatcggtcctactaaaaattttttttaatttgttttttttttaattaaaggactttcgccaaacatttgattatttaactggaaaccgaaagtatatttttgtttatctgaaattgatttttttcaaaattctcttttttgaatatttcttataaatacaaaaaattatattaaacaatcttttaataaataacaatttttttttgggtttatgaatattattttgacaatttttactaaaaagaatttttgaaattataaaactaatacgcttttcattagctttttgactgttgtactcattgtgattgccgctcctgtgcaaaaagcagcgatggagcagttgatggctggtatagtaattaaaatatatctaaaattaatttggaaaattgattatatataataccaaaaaaaaaagaaataattatttattttttatttaaaaatgaattttctatttggttaaagagttctataattttgttattttttcctataaagatttggttttctattaaaaatagttaatatcattaaaaaaaaacctatttttttaatcaaaactcttttattgtagcatctgctggataacatttatttaaattaatgaatttaattcattttattttaattatatttgtcccttccttttatctccgtttctgtatttatttcataatttattttaaatggcaaaaatataaaaatgaaaaacaatttttaaattggaaatttggaaattaaatttaatcgtataaattcaattctgaacattctctgttgctacgcgaattgcccattgttgttgttgcgttccgatgattgttgtgttgtaattggttggttgaagaaacttgaacactttttgaaatgcattccgatattccatgcttaaaaaaaagttaatttatcatgtaataattaataaggcacttaagagttcattgtagtgctggtcgggaccgggatttttgacaaaaaccgggaccgggaattttcggattgaaaagccgggattttttggctgggaaaaccgggaaaaaaccggactagtcccggtcccggtcaaaactggtcaaaaccgggactgggtactcagttgtacccgtttttttcagaaccagtcccggttccgacaagctctagttcattgcaatttatcgaaattacaatttttttatgagtaaaaatttaatttggttaatgagtttattattaattttagtcattgttnaaagtagactaaaaaaatattatacactattttatatttctcacgtcaattttttcaagagaaaaaaaattctaaatattctaatttacaattttatatttttccccctaaatttacttcattttgtaaagcactggcccattcacagccagcacaatgtttgtcaagcagctgagcaaaatggtgtgacagctttactggtcacagacaattggaagtgcggaatggtcagccgggcaatgcttgaccatgtgtg

SEQ ID NO: 22213 - DNA, 3063 bp, Heterodera glycines
  misc_feature (3015)..(3015): n is a, c, g, or t
agttggacacattctcattgtcaaagagagccattaaagccccccggggggggggcaccactgatttggacggaggtgggaaaatgaatgagcaaaagggaccctttgcgttttaaagaagtcgacgaacagaagacaaagcaaccatttttctgggaggggggctctgtgacataaattacggtagtaatgccaaacaataagcgaaaggaaattccaaatttgcaaatgtgtcacgcactgatcactaattggagcagcgccgtaattaagaacggaattgggtcctaagcccagacacatttggtgacgctttcattcacaattaattttggactcggatttaaactggctaccggattattgacgagcaaagctcgaagttcgtcttgaaccgtttggttgacgagttgctcaggcgtcggcgaaccccaaccaaaccaacgtgaccatcccgaaggaccgcgagattctgtacgagcagagaatggcaatgccaaacggatttcccgacacaccttccaatgtctttttaagttcacgaattcggtcagaggccgcgttggcaaggaaagcgcacgattggtcccacgcccttcggtcgggcaccacttggtcagcgacggcattcaattggataacacgctgaacacccaccagaattatttgtaaagacaaacgatgaccaatcaccaaataatccaacgcttttgaatcccatctgtgctgctccaacacggcactgaccaccgcagccttcagtgctttcaacaaatttccaccatccggcgatttttggctgccgtgcgtccgattggacttcagcgtctgtccgcccctttcctcgccgctcacttgacgccgaaagatttgtgaaagtgtttcccatccgacctttaaattttggtactgattaggtaattgagattataattgtcggacctgcactgatcggttggccaattccttttccgcccaatgtttcagtttaatgtccaccacagtgttgaaagaacttgtactttcaaccttaaaatagggtcatttaacgtaaacaccaccataattcgtccatttttaccgttgacgcgggcatcagaatttggtcgaacacttggggacagatggcattccacaaatgcgcacgaagaagcacttcccattcgtcggcagagacaagcgacaaattgaccacttcgtcgagcacttcgccacgggcctaaaaatgaaaaaaccgtgggggagggaaaccgacggaactttgtcgaagagttcgtccctggtcaagtcgcgttggtgcgcaaaagtgtttttccattccgtctccaaattgaagcgattggcgcggaaagcgtccgcctgcgcttcgatggattcgcgaaccatccgccaaaaacagtccgaaacctaaacaaatggacgggaaacgtttcattagcttaaaaaagtttttaccgccaatgacatattccgcgtcgtcatttgggtggccttcaaaacgccatccctaaagagtttggaactctcgaagaagtcctcctcgtatttgcggatctccgcaatgctcgcgtcccgcttgtccatgccggtgacaacgccgaaatagccgagcgctttcatcggaaatagtttcccgtcgaggatcttctttatccgatgcgggttgctcaagtttttctccgccaaatcaacctacagaattgcaaaatgactgcaaatgccgtcctgcggttgaaggacaacctttgtcagcaccaaaatcgtgcgctgaccgtccgggtcgacgttggtcaccaaatcggtcacattgcttcgttctgcgtccactgaaccatctgaaagaaacggaaaagaatgagacaaatttgctgcgatgccttggatgcaaagaattatggcgtttggattctccatgtgctgcttgcacatcttcgcgatgtcctccttcgtctccctggccatgtctgtggtaacagtcgaaatcactccgggcaaatcgacaagaaccattcggggcaaagacggacctaaaatagaaacaatgacggaaattggcgttggaatgaagtcaccttttacagtcaaagaaatgacttcgttggacaccgtttttccatcccgcaccgaattgcgcattcttagttcaatttcattgcgcaactgctccaattcggacgcatttgtcaggtcaaattcgcgattgctgtcccgaaattgggccatgtgataagggccttcgctgagagtcaccggaaatgttaacaattatgtcaagggtctgaagtgatccgattgtggcactgacatttgtgccccaacagaaccaacatttctataactttaaagcttcagtgatagagttttaccatacgataactttccgtatcactttttgcggcgttaatttatgcgttagtttttaaaattaagtaaaattttaatggcccggcggtggcaatttgataatggtgttcgataaagaactttcccgaggcttgagacattgaccattcgctgttggttttcataaaagaaggatataactatgaaaaacgcaacatcatcaccaaaatttcgaaaaaaggcttaaaaattctaaaaaggcttaaaaattctaagatttttccctaaaacaaagtttgaaaaatctcttgagccgagatctcgaacatcactaaaattgagtccccgtaaagttggaattttactgaaatttgtatataaaaaaaactcagtctcaggaatttgccccccccccaaatggatatccaatctttcccaagtgaccgactttgaccggtgctcgtgtcatcatttctccgctgccccgtgggaatatcctcgcttgggcaatcatttcgagcactgacgttttgccggccgattggtcaccgacaacgacgacacgcggcaaattgtccgcagttccgtaggaggagtcgaattcgatgagaatgtcgagcatttcggagtacaattcgatcaacgaacgctgaacaaaatggcagatattanaaatgattttcgttggttttcactttgattttcttctgtcgcttcatt

SEQ ID NO: 22214 - DNA, 1230 bp, Heterodera glycines
  misc_feature (1145)..(1145): n is a, c, g, or t
  misc_feature (1170)..(1170): n is a, c, g, or t
ttttttggaaaaattttatccgcccaaattgtttcaagcaagatggggagagcgggcccaatggattttatatttcccggagatttttgggttttaagaggaatcagaaaaagtatatctatttttctgaaaattttatcccgccacaaatgctctcaagcatgatagggagagcggtgcgcaatggatattatatggcccaggaattttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgtgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgcgcaatggatattatattgcccagagaatttttggcttctaagaggaattccagaaaaatggctatctatttttctgaaaaattttataccgcacaaatgctctcaagcatgatagggagagcggtgtgcaatggatattatattgcccagagaatttttggcttctgaggaattccagaaaaatggctatctatttttctganaaatttataccgcacaaatgctctncagcatgataggggagagcggtgcgcaatggatattatattgcccagagaatttttggct

SEQ ID NO: 22215 - DNA, 2168 bp, Heterodera glycines
gctacaattctaaatttatttatttattgtatttgtaattaattaaggagtcaaaatagaaaatagcgcgatgtttgaatgataactttcttaaaaatgccacagcttttcctggccctaaaatttgtcaagccagttttattaaagtgcagctgttcgcgttcattatacgcacaaagtctggtcctgcctaaaaagtggaactcaaagacggaatatactgccgtaataatacaaaaccaattattctgctacaattctaaatttatttatttattgtatttgtaattaattaaggagtcaaaatagaaaatagcgcgatgtttgaatgataactttcttaaaaatgccacagcttttcctggccctaaaatttgtcaagccagttttattaaagtgcagctgttcgcgttcattatacgcacaaagtctggtcctgcctaaaaagtggaactcaaagacggaatatactgccgtaataatacaaacccaattattctgctacaattctaaaatttatttatttattgtatttgtaattaattaaggagtcaaaatagaaaatagcgcgatgtttgaaggataactttcttaaaaatgccacagcttttcctggccctaaaatttgtcgagccagttttattgaagtgcagctgttcgcgttcattatacgcacaaagtctggccctgcctaaaaagtggaactcaaagacggaatatactgccgtaataatacaaaaccaattattctgctacaattctaaaatttatttagtattaattttgtaattaattaaggagtcaaaatagaaaatagcgcgatgtttgaaggataactttcttagaaatgtcactgcttttcctggccctaaaattcgtccacactagttttattgaagtgcactttttcattccatagactttgttttaaattttttgaacaaaaagtggtttacgacgtgctttttagcacggactaccgtcgcgcactgcgtaccgtatacgatgggccggcggaacaacggcggtaactccgccagcagcagcaactgcaacagcagcagcatccgacgcaaatgtacggtattcgcaaccgtaacattatggtgcagcataaccacagatattgagcagcagcaggaatcgtttcgaattcgatcgacaattttttcgacttcaagcgattaattttgaaagtgataatttttgcgaaaatattttttggcacagtaaacaaaaattggcatggcaaaattactcaaccaattagccaataattctatgtacgtaatattttgggtcattaaaacatagtttgggggttttggtagtttttggtacatattttggcgatttttggaaaaaaatgaattttttacaaaagtagcttttttggcacccaattcttggcaaaatgtccgaaattttaaatttttttttgtattttttgaccttttttatgagtttttcgcttttaaggcaaaatttgaattttgacgaagaaattccgttaaaataagtaaatctttgaaggcgagaaaaaatgtacgccaaaaagcattgaaagattttgatttgcgttatgctagagaaatggaaaaaaatgagactttttgggaaacttaaactattttttgatgatttttttcagtttttgtgacatattttggttgcctttgggaattttaggacatttttgtttggtttttttttatcaagggcctaattaatcattgagtaaaatttataaaattaattttttttttcattctcaatataaataattcattcatctttcattttgcaacaaatgacaaacaaaatactggaggtgccaccgatttattccccttttttgtccccggaggcgttgttttatttgttttcgattttattgcttcgttcatttcctttggcgctgtttcattttttggcatttcctttggtgctgtttcactttttggcatttcctttggcgctgtttcactttttggcatttcctttggcgttgtttcactttttggcattttttggctgtttggcattgtcttcggcgttgagtttggcattgttttcggcgctgttttggtctcagttggcggcactggctttcttggcacggcaggtggcactgttgcttgtttgctaattgatgctgccatttttgc

SEQ ID NO: 22216 - DNA, 1414 bp, Heterodera glycines
gaagccgggaccgggacctcgattttttttcgggaccgggaaccgggaccaaccgggaaattttaaaaattcaaaaaaattttaaaaatttaaaaaaaaattcaaattttaatttatatcaagtgaaaataatacaaaattatttggttttttatttaataaattaaattaatgaaaattttcaaacaaattttcttcaattatttcaaacaattaatcatttttggactaaatcatcgaatattaatagaaattcagatttgattttcacatcacttttttcggagcgctttttcaaaaaacttttgggaaagaaggggtccggcggtgccgataggcgccgccgggggaaattttaaaaatttgggtgcaaattgttaaaaattttcaacaaaaaaatgttggtttttgcgattattaagctcaattggtaggattttcatttaaaaaatgataaaatatgtatcaatttaaaaaaaactatgagtaatcatattttctttataggaaacccacgagtatacaaaaaaaaaattgaaaataatctaatttctgtagagggattgaaccaggggaaagaagaagggaaagtcaaggagactagccattaggccatttgcacacttgggcagtgttacttttaaagaatatattaattattattttttatttttccctttgactccaattttcttcactaatttttcactcagacccccattcttaccagtgcttgtttttcccggttcccggttgccctaccgggaccgggacctgagcttttcaaaacccgggacctcggatgaccgggaattcccggcccggtcccgtggcactctaatttttacatctgggcaaagcatgaccgcattttggagttcgttttgcgcaacatttggccaatgctcgaaaaaaacatttgtggcatggaattgcccttcggatttttgcaccgtttgcgtaaatttgcccctttttgaaactatgttcgttggatcagatactaaaaaaaaattcttaggataaagaaattttgctgaaagaaggggggagggagggtaccatccgaaacatatctgagtgtttttttaaaattttctatttaaaaaattctctacctttttaaaaattcattttggtttccagcagttatgaagtgcaaaaacggcaggggaagtgaggaagggatgattgaagaaagagaagaggagtactttgaggttggaaaatgtggtgccgttttctgttcagcggataatggtaaaatgaatttaaaattttttttattaccttacgccgaaaattgggcgtaaatcaaagaaaaaaaaacggaaaaatgggcgaaaatcgaagaaaaaaaaatcaagttggagggtggagagggcaaagccacagatggacgacaaatgaaaga

SEQ ID NO: 22217 - DNA, 1052 bp, Heterodera glycines
agcctaaaaaatgtatgataatttttctttaccataatcagcaaaaataataaaaaaattgtaatcaatgtttacttaatcgattttttgcttattttccattattcattttattattaattataagagcaataataaaagtaaaatttactttcaaagccatttagtaaataatatttgtttgtattaaatatttttggatttatactaacaaataggctcttaattaagttttattccctttttcacatggctcttggggttctccacaaattattattaagagcaaaaaatattttataataccttaataatgctttaacaatcacgttctttaatttaaatgtttcttacctaaataatttttaatttataatttcttgtaaaatacgcagaaacaagacgaataatattataatatttgtctaatattctttgtttaattcatatctatttacctgtagattcttctataataaagaaaaattattataagtcggcgtatattaatagtagctaaatatttcattcgaataattcttacaattttttaatttaaaaaatttagtgtttggcagtcttcgtatgttataatatgtttaaatttgttcgattaaaaaaaggaaatttaaattttactttttaaaaataacataaaatgattattaaatttttatttttcttatgacaatattaataaatattattattatttcattaattaatgatattattcagcaaagaatgtgttacattttattctttccattcataatttttcataaacattatcctttttaaaagataaattacaaaatttgctgaccccaaatttattattttattaataccagagatttatagaaatttatttaaatatatggctataattattttgaatgatacaattatttttaaaattttccaagataagaataaattcaatcttatatgttaaaatatcaaaaaattcttaatttgcatattaaagcggacaaaatgaatgaattcgcgaattaaaaatgcaaaaatggccaagctcaaactgccat

SEQ ID NO: 22218 - DNA, 1317 bp, Heterodera glycines
gaagatatttctagagtgaagcgggaccgggacctggtagcggacaactggctttattaataataatttcaataataaaaaataatatttttccaccatttttgtcaaatgtatatatatttaagtaaaaattttatttgagaatctctctcttcaaaatattttcagaatcaaattttaagaaatgcaatattttagtctagaataaaaaacaaaatttaattcaaaaacatttattaaatacaacaaacaaaagttaaaaaattccttgaagaaactggttaaaatttaaaaatatttttgttttaatcttttacaacagttcaatttaaataaatttattttacgaaaaaaagaaattgtatcgttataaatcgatggctttcataatttgaatggctctataattgtcgacaagtaattagttaataacaaaataataataataattagtctctctctatatttttattaaaaaattctctaatattttgcttttaatttttataaatggattaacaggaattcattgtaatttttgatataatatataaatttttatttggcatatttttctataaattttcatttttctgcaaaagttatataatcattttaaattgatccatggtcttcatacgtcctgttatttcagcgaagcgtagttgtacaaaaaaaattattaaataatttaatcaaagctttttttatatttttttcttttaaatcacagttgttaccgtcgattgctccttaaattgaaactattattttctaacaattacttatgaatgggttttattacttaaaaattattttatatcccaatggtttttagaaattttatattaaatttaatttcgaatccattccagatgaatttttgttattttaatgtattttatcatttggcaattaaatttttttctattgtagattattgtattttttcaacgattttgaacactgtttctcgcgaatattcatttactcaaacaaaaataaaggattcaacttatttgtcttatataacctttaatagtctattatatttaattcttacaaattagtaatacagccgagacacccactcagtcagttttttctgatcactttcactttttaaaatatattaaagtcggcagattcgttcccggctctattttttgtagggctcatttggccgcttcgcggcctcgaagtgcgctttgcgcccatctctgaataattaaatcagattacttagtgtagctctaattaatacgatttttaatgtttgtttttttttgctattttgaaatccaatatttgatttag

SEQ ID NO: 22219 - DNA, 2155 bp, Heterodera glycines
tattcttgggtctgcaactaacaaatcccaaagaatttttccggtagaaacatgttttggacacgttggagaggaatcaaaatatgttgctgtgatccaaataagaaaacaaatttatatcaaacatttagatccaaattcaatcattttctaaacaacagctgacaaataattgaattcatcaagaagtttccatcggtttctgttgttcgataggcccaatttgactcaacagcgctccaatcgcttcgacatttaaaatttgctgctcacaatacccaggctgaatagttacaacagttctgttagtatttattagctttctaaaaatgaacttgcctccccattggtgccatccacccatttgagcaccttaaaaatgaattgctagtaaattaacgtgtatttttgtattcaccgcaatttcgatattctgcgcccccgattggaccactggggctaaagacttgagcatcagtttaagcgtagactcctcatcagctgtgttgtcgttgccgtattctttctccagatactccttcacaatcttttcatttcgccctattgaaccggccaacaattcgtagtaaactccggacggttccgtcttgaaaagatgaggggtcccatcagaatcgaagcctccgacaagcattgaaattccaaaaggccgacggccagtggtttgagtgtatctctaaacaaacaaaaagttactcagatgttgtaagtcaattgacctgttttatatcagctatgatgcgagagatatgcatgacagatacgcggtcctcaagcgtcaatttgtaattttcgcattcaactcgagcacggtcgataaggacgcgtgcatcggcgctgagtccggcgaatgcgaccataacatgctaaacataggcgtgcattgaagaggaataaggaatttaccgaatccaatgcatgtattttacgaatggtacgttcgtcttgcagagtcgggatagatttctgcaaaataaaagttcaccagaacagtttaagcaatttttatgtctgtgaatacactagctaaaaataatttactttttcgactccaattacaacacaattttttcctttcacggcaacctaaagcaatgcacattaatatttttaaaaagcaataaaacgcaccgctgttgagcccttcttcactgcttcttgcgcatagtcaacttgaaaaagtctgccatccggagaaaaaatcgtaattgcacgatcataacgctccatagtttatttgctaaaatcaagcttacaaaaagcggttaggcatttaaaatttaagctccgtaaaaattcaattaaaaatcatcacatttatttttttaatttttcaatttttaaatttttcttttttggcgaactgtctacccttgtaacttctaaaaaaggagttgagactgaaatcccgcgccagatcccgtcccgacctgtctctgttttccatagtgaacaaataattattgttgtatttttactctttcgctgctccacacacatctctttcatgaactttagacaaaaagtattttaatgcgtcttgagaagtgttggttttgttcatcaacaatttatccgggccacggaattcaattcgtacgtaacgacgcaacggtgaaaacaatttattgttatagtacataataaattaaaatttttgtttaggttttcaagttttgtaggtcaaaatgcaacaaattatttaaaaagaagaagaacccgcgcaaattgaaatggacgaaggcatcgcggcgaattcggggaaaagttagtgtttgatttttgtttttactcttttacatttattgtaaatttaaatttcttttactctttaggaattggtcaacgatgttactcaagcgatggaaattcgcagaaacgaaccgacaaaatatgatagaaacctttgggaaactgcaggtaaatcgtccatatataccaacaaaccgtaacgacgaaaaaaagtaccggaagggagaatccgcaaaatctttgctctcggacacttaaacatttttcctgttttaaatttttcatggacgaaaaaacatatacagcggttttcgccaaaaaaaaaataaccaatttgggtagacaagtatgtctaataaatcttccatttgaattttgattt

SEQ ID NO: 22220 - DNA, 725 bp, Heterodera glycines
gaaaagcggtcgttatgactcaaagctcatcaaaatgaatgctacccccagagaatcgtcgctcaaacgccgccccttttgccgaggtgcactatttagccgaaagcggacgaccccaatgagttttttgaaaagcggccgttatgactcaaagcacctcaaaatgaatgctacccccagagaatcgtcgctcaaacgccgccccttttgctgaggtgcactatttagccgaaagcggacgaccccaatgagttttttgaaaagcggccgttatgactcaaagcacctcaaaatgaatgctacccccagagaatcgtcgctcaaacgccgccctttttgctgaggtgcactatttagccgaaagcggacgaccccaatgagttttttgaaaagcggccgttatgactcaaagcacctcaaaatgaatgctacccccagagaatcgtcgctcaaacgccgccccttttgctgaggtgcactatttagccgaaagcggacgaccccaatgagttttttgaaaagcggccgttatgactcaaagcacctcaaaatgaatgctacccccagagaatcgtcgctcaaacgccgccccttttgttgaggtgcactatttagccgaaagcggacgaccccaatgagttttttgaaagcagccgttatgactcaaatcacctcaaaatgaatgctactcccagagaatcgtctctcatacgccgccccttttg

SEQ ID NO: 22221 - DNA, 2742 bp, Heterodera glycines
  misc_feature (124)..(124): n is a, c, g, or t
  misc_feature (1331)..(1331): n is a, c, g, or t
aattaaacttacaaattagtatgaataatctgagctgaaagattagatctactactacttattatccacatacttatttgcttaaatgcgtatgccattcgatgagaaattatgaacgtaattncaggggatggcacaaagctcgaattaataaaccaaactccgtatttttaggcattggaattcaaatccttccctaataaatgaccatttaaactgtttattcctccggctttcgcttaattaatataattacctccttaggcgtcttctgtacgccaaccacttctcgtgactccgcgcctccgccgcgtggtgccgtctccgctcgttgctgcggcgtgcagagaccgcacgagcgcgcgcactgctgacggacgagcggagagacggcctggtggaagcacagatggcctaacgacgtgcagtcgtcggccgcgtcaaagcatgcgtcggctgcgcacaggccgcacgtgtgctcgcacatggacatcatcacctgacaaatcagggagggaacggcatttggttaattaattaaagggataagcaaataataaaacaattaacgggcaattaaataatgaaataattaacgggcaatttatattcatagagagtagaagaagacaaattttttaaaaacggatttccttctggtaaagaccaattttgggacccgaaactcggttgtcagtcaaaaaacagtgcctactaataagatactcctaattagcacattaattacccttctccaactcggctctttgcatttggtcttatgcgtcgcgcagtcaatcaccgtgccaccgctgtccacgcaattgaactgcggcgtttcgcaacaaaatgcgcatgttttggcacaacggcgtgccaaatcggacaattctgtcattaaataattatttttcaattttttgctttttaaatttaaatttgttgcctttgttcagacaagtcaatgggcggggcgattctttgctatggcggaattgttctttgttaccgaaaaaaattgtttcacacgtcccactgcctaattcgtcgtcacaatccgtcgcggatggccaaagagtgccattcttatgaggaaaaaaacaaatatggaatttaaaaagatagttgtaatttaaatttaaacaatacggaaaattggcatctgcgcattgcgcgaatgttttccgtccccgagggcaaagtgaagggcaaacttttgatgtcaatggcacggggcaatggtaacgcaggaggcaaattctgctaattaatttttttcaaaattaaaattaatttttattcatacaaaaaataaaagttaaaacccttcnggaacaaacacacttttggcatattatttctgcctttgttttgtaccgtttctgcaatattgctcaagagatcgaaaatgtcggggcgaccctaaaatagaaatgaagaacgctgatttgtggaaaataattaagccattcatcagtgaataaattaacttggtatttaaagggatcggaattcctatgatattgtcataaaagggatggataatttttgtttaggttttcttggttctttttttaattttcttccatttctgttcacaaaatactaatttcgaatgaattggatgaataagaaatttgaaaatttagtttaagctattaatttttcatattggtccatttgtactagttgatggcgttccgaagccctaaaattttccaaaatcggattctgaattctgagtccaaaaatgtattaaatcggacgtcagaattccgcgccattccttgtcggtaccgagaggatctacgggaatatttttgaaaaaaaaaacaccagaaagtctcaaaaaattgcagaagtaaggcaaattgataaataaaacaaaaaatatattacataattaaatttattattcgtatttattcatattaaaaagcgaaataaatacattttcagttgggccagcagcagtcgttgcaattgcattaccgtattgcgcccaaatgaataccgtagtaaggacagcgcgaaataatgaaacacatatattctttgtggaaaacattgtaagatggggaatgtacttggaagaacaataattcctatttattatatgaatctcgaggaaactcccgccaggaaaattcgctgccgcagagactccgcccagcgaaaaatgtggacaaacaaaacgccaaaacaaatgcccttgtgatcagagcagaaacagcaggggaaacgaaaccatgttgttttgttgtcccaaattattattcagggctttgtcctgtaaaagcattcccaaaaaagggaattaatgaatgcttttgccggcggaagggcgggggggggaagggtttgttgtttgatcagcagcggggcaattaatttgtaatttggcaaaacagttaattattaattgtacaaggcatgttgcagataatgattggaaaaaataataatatttcaatttaattaatttttatactataattgagcttagtaattcatcgtaaatagttaaataagcacaagcctaattaattaattgcttaaatcagtgcttaacgatctgaaaattttcaaaataaaaatatttaaaaaatgtaacatcaattaaacagcaattgtctaaattcagagcaactttggtgagatttgttatcaattttttacagtttattttttaattatttgtgaagttgcgggtttaattgaaatttattaagaaaatttaaa

SEQ ID NO: 22222 - DNA, 3084 bp, Heterodera glycines
  misc_feature (3012)..(3013): n is a, c, g, or t
  misc_feature (3032)..(3032): n is a, c, g, or t
atttattttatccattttttgtgtgttttggcactttctccccccaaattcgaccatcatcaattcattttcattcatccattcactacgagtgtgcgcatttgatctgctgattccaacttgatcatcctccccccccagcgatttgtttcatatttttacattttttgtcccaaaatttcctccgccgtttcggttgttgcttctgttgttgtttttaatatattattattacaatattatcatttacatattcattaatttcttttcgttgtcgcgtcgttcgttcgttcgtccgccgctttctttcgttttgctttttccctttttttgatatattttcataattatttatttctgatgctgttaccgcacaagcaaaacatacagtctcgaagacgtaatattcatgctttttgatattgaaattgaacatgtttttcgcctttttattgttgttcttttgattgatgagaacacaaaaagaacaaacaattaatcgaattgccgacggttttgatcattttggcaaaaacagaaaaaatagttggaaattggaaaaacaaattgcaccaaaagcagcagaaattgatacaacaaacaaattaatgtgataggcctcttgctattatctctgctatttccggttacattttggagagagaaaaaaactgcgagaaattcactcgtgacaaatgcaaatgagtaataatcggccaaatgaacggagtaggaacggaaatagaaaagtgtgtaaacattcatcatcatcacattaacaaaaaacgatgataatgcgcacaatcctcggatgctgctggttgtgaatttctcagataagtgacaaagggatttggaataagtttgatttggcgctattggcattttgccatattctctctggccttcttttctttcttttcactctctgttgctcaacgattttcgacagagcttttgctgggttctgcaatcacccacagaaattccactcactacctgctgcttcgtcttgtttacatttcaaaaatccatccaaatttcaccccccccccccttgggggtcgttttatttgcctcaaatgtttcttctcgcgtcatccatcgatttctcccccactatcgcttttttgccgttgctaatccctcattctccttccattttcctctcccccttttcccatgttggcctcgtcgttgttcatcaccagcaacaaagacggcttttctgctgctgatgccgaatcgccgccccattctctgctgagcgctctgttcggctggtggcccgacgattttgtccatcggctcgtccaaatgtcggcgggagggccggcggcagcggatggcggctacgccggcccgacactgcactttggcgaaagggaatatgttgtggtcggcttttggaagattggcagcggactcggtacaccccccccccccgggatatcgcttaaaattcggcaatttgttaattgaaactcaaatttcatggttggccgcttccatgctggtggtggcgttgatcgctgtgctgcacgaggcatttttaaaaattttaatccaaatttcaaatctaacaaatctctcacccaatttttggccgtgttgggcctgcgcttctttttggagcgcgagcagttgctgctgctcgccactgcggacgaccggcataacactaacgcatacgaaggtaaatgccaaagaaaagtgggcccgaaagcgaatgggcacgggcgcctttagaatttttggataataattaatggatttgattgactgtcaaaaaaacatgggaaaactctgtgagcttaaaatatctgataaaagttttgaatcaatttttggggaccgaaacggatttaattttaataaaattgaccgtaaaaactcaactcgttctagccaaattcgtagtgcccttgatttatagagtttttcgacaaaaaatcgtcgtagcttttgtcaaagtcaaccaattacaacattcttggctcttaattttcgatttgtgtgcaaatttcaaaagtaattaccatttaaaaaaaatttaaatatcattacgagttgggacagtacgagttgaactcgtacaattgttcctcctttattattttaagatgacaattttaattagttattaagatttgttggaaaatttattggacacttgttttatgcttttttgcgggttaaatccataaaattaaaattggctaatttggtcctctgctgctgagaattccatttggttcaattgctgaaaattgttttgccgcttagttcagcgacgtcgtcggcattcgtacgtgaacagcagtgtcaccggggacggggagcagcagccgaagaaaagcaaaagacaaattgtgagggaggaggtgcgcgacattttcaggcagctgattttttcaatatgtctttgttttttgttagtctaaagttttagttaaaatttaaaaattattttccaaatttggcagaactttttaaaattgacaaaattttcgacttttgtactgagaattctataaattttttggtttttaatttgctgttccccctgctgcttgaatgcatccgttaagactttaaaactgttccccgttgaaagccattttaatttacaggcgaattttcacccgagctcggatgcttcaggcacttctttaccttattcaggtgaattgtgccgcatgcacttacaaattagtgctttaaagtgcagaaaaattgctttttataaccgaatatccatttttgaagtgtttatttgagagtttgggtcggaccaagtcatggaacccgcaatgattagcaattagacccgcagaatggcattatcaacaataccataatgggagaaaaagagcaaccgtgggaaagactctcaatggctccaagcccttcaaaatgggtccctcccctcctccgactgtcgcgcaattcgtccctccccacgaagtctttttgggcatggccagggacggtcccaggattttcttttgnnggggtacgtctgcccccanggcgacgatcgtttttttcgcctctttttttgcggagcccatttttctcaaa

SEQ ID NO: 22223 - DNA, 1953 bp, Heterodera glycines
  misc_feature (60)..(60): n is a, c, g, or t
  misc_feature (119)..(119): n is a, c, g, or t
  misc_feature (1900)..(1900): n is a, c, g, or t
  misc_feature (1920)..(1920): n is a, c, g, or t
  misc_feature (1937)..(1937): n is a, c, g, or t
gattatgcacgtttctccctttttaagaaatgttgcagctatcccagaaaaagccatatntaacattatctttttattcccacgtactaagtgataaagtgtcgttagcaaaaaagatntaccggttccaccgggtccatcaatgtatagtaaaatctaattatttttttcaatgcatttgttttaataaaattataaatatttttctgatttatattcagaaattcgtacctatcctctgcaattttcaattcttcttcaggaacaaataaatcatcattttcgttaacattatcataaaattcttgaggtaaagttttataatggtgctgggacgtttcttaaaaaccgccacattgggcgtttcttaaaaccgccagggcgtttcttaaaaccgccagggcgtttcttaaaaccgccaggtgggcgtttcttaaaaccgccactttgggcgtttcttaaaaccgccagggcgtttcttaaaaccgccaactcatatgattatgtatataaatatatatatattagaagtttacataacaataaaaaatttaaaatacatatgcatatctattgacggtaaaataaaataattatttttatccttctttaaaacattctccaaaaatatgaactgaccagcataatatattctaaaaaataaaatatttaagatatgagttggagaacagacttttgttagaaagcaattaggatattcattaaggcaattgcaaaatttaatatcacaatcgtaacgtttctgatatttatttatgtagcacacatcgtggttatagcaacaattatcaactgcaaaattttcgaatataaaattgctaattcgtaatttgttacttttttgaaagttgcaaaaccagattacaggagctattagacaagagtctaatagagaggtgccacaataagtcccacagaatttctttgcaactttcaaaagggaatgaatttttataaagattatcacagaaataaaacaaaataattaatttatctttgttggctgtttaatcagttcacaatgtccatcattataatacaaaaatactgatgctgttgtttctttttgactcagattcgtaagctagatttttagtctgtcactgctagactaataatatttccggctgacacttacttgcacaacaaataaaaattaatagatattattgaatatttaatttaacggatatacatacataatcatatgagttggcggttttaagaaacgccctggcggttttaagaaacgcccaaagtggcggttttaagaaacgcccacctggcggttttaagaaacgccctggcggttttaagaaacgccctggcggttttaagaaacgcccaatgtggcggtttttaagaaacgacctagcaccgttacaaattcccaaaagtcgcaccacgcataaaaacagctttcgaatgagctattgagtgtttggagaagtaaagttttcaattttatatgatttttgaaattaatttatccctaggggtcagtcacatgagacgagcgtctgtcatttgattccgcttggctgcggtttatttttttatgacacttgataaaaaatcacaaaatgaaggttcatgcataatcagagcttagattcgtgatctgagtatttttgaaaaaagttcagaatactgccaactttgaatttgcatcagaatcatatatcgatcgattcctctcagtgagggaagtcgaatggtaccatttttagggcgcggcggcaattctgaatagagttacagacccgggactgaaatggccaaatggctttgggactgaaccgtccaaagccataaacgcatggaattgcgaccaaataaataccaatcgatcactcacggtctgctaatcatgaatccngagggaattttttggataanaaagaaattgacaaaangtatggctcctcaaaa

SEQ ID NO: 22224 - DNA, 1531 bp, Heterodera glycines
  misc_feature (43)..(43): n is a, c, g, or t
atttttttttttttttgtttacttttattatttctgataaatnttgagaatggagaaaaacaccgaaagcctttccaagttggatcctagcgaaagtaattacaactttctgttccctgtaacaaaaaccacttttagctttgggaaccgatgccctcttacaattgatggaactgatcaaactgaggcctaaacagaagcaggtgacccaggaaaagttttatgttctttatatctcttctgcattttaagggggaagtcgagtcggaaaaaagggaaatggaaaaaccaattgcggactttcaccaccgcaaaacggatcagataaacccggacagcagtgaactgaagaaggaactgcgtgaaaaagggaaattggaaagttacggacgaatcactgatgaaaagggggaggagaaaggtaaaaaagacaaatcaattccaaaatttattttgttgcttttcagattcttggggccatgcgcttcagaaggaattggacgaaaaggtgcgaaaattcagagagctcaaccgaaagaaatgaacgagaatttaattgattttaccggcattttcactttttcacaatgttagaaatttatagcattattcattttgtttgattcgttcattcggcacaacaactcaaaaccagaaaatccagggattatgccacacagaaaattgttattaatataacactttaatatccaattttgtttcctatgacgaataaagctctgaagctgtgcactagacaaggcaaaaccacggaagtagaaaaggaaaataaaacccattcccctaatttagtctgcaaaaaatccattcaaaatttattcattggaaacaaattgaaaacaatagacagctacataaatattctttggacaaaagatacaaaagtcaatcaaagcgaacaattggaaacaaacgcgactcccccgggtttatacaacaactttgttcatgttcaaacaaaccttatctttttggtatcattcgaaagcacaaagtctgaataatgtcacaacccgaaaacccaaaagaagacaatcattactttactcgcaattgccatcatactagcatctatgcttgataataattgctgggtcgttaacagaataaagacggcgaatgtatgtacttcacacaaaggcagtgttgacaaaatggttctatgtattaaaacaaaattttacaacttttgttttttttatcattttattatttaaaagtgacagtgatttttgggcgctggccttttggcgctgaattctttaagaaaattaatttttcatagtcagtcaaatacaactttttggttatcgacatggaattccgatttgcaaaaaaatggaagtctggattccgatttccgaaatttttgcaaaaattcggaaatttattttttttaattttttgccaattcaaaatggtttattattgtgaaataattattttgtatgtggctttctacttcgaccatccctgctctattaccgtatatgctctaattatagcccat

SEQ ID NO: 22225 - DNA, 1584 bp, Heterodera glycines
caattggccctttccccccgttttgtttttttccccctcaattagggatgatccatcccacccttttcccttttggcaaaggaacgaacattttctcggaccatttgttccatcccccccctccctccctcccttctcattttctctttcttccccttttttttcacaaaaaattgagtttttacaatttgatgtccaacaaaaagaagtgcaaaatggaaagttgccaaacgcacttttttagcctcattttgttgtgacgaaagaaaagatgggaaaacgcagaaaaagggggggggggtatcagctgacaaaagcaaaaagaaagggaaggatttgatttcaaagcaaagactgagagggaaagtgggcttatgaaatgaagagacgctccattgtaaaagggacggagagataagacatgaattaaagaaataaagacaaaaccaatggcaaatcgaccgagggaacacacaacgaaatgccaaccaattcagtctctgtctcccattgtacgccgtcgccaaaaatgcaatgattcgccgatatttcgccattaagcgcaccttcccttccttccctctctgtctgctctcatactgcaactcatccatgctcaactcgctcgcgattggtatcttttgagattgaatgacctccgaaggattggaggagagagtttagaaacgaaaggaagggcagagatcataagacagataagggagcacaggttgacaaaagtgaccactgcaagtgatcaatcagtacagcagaagggccgcgaagagtaaacaaaccaatggaaggaaaccgaaattggactcccccccccccaccgaagcccaacttctcaacttattttgagacaaggggcaccgcccaccttcaaaatccgtgtattcgccgttcttcagaaaggcgcccgacccaaagtcaatcagtttgagttgtcctgtcttcatgtcgatgatgaccttaacgcatttgggatgaatggaaataattggtgaagtcagctcacattttcgtctttgatgtctcgatgaacgacggatcggcccgcacaagcgatggccgtgtccacaatttgtttgaaaaagaagcgcgtgaccgattcgtcgagggcacctctgacagtgataaagtcgaacaggtcgcagtagggcgaaggtcgttccatgacgattaagaagccgtcgtaacgttcaaaccaatccagcagcagaatgactccagggcaggcggaacacttttcaagcagagcgatttccaacggaacatctttgccacgcagctgggcccaatcggtaacattgcgcctggccacgtatttgatcgccaccggctcccggtccgcgactcgaaaaccggaatagacgacgccgaaccctccgcggcctaactcaggccccaacttgtaattgcgctcgaaaaagtgcaggtcgtacgctaaacaggaaatgaaagaatcagcaaaaaatattgaaatttaattattacgcttccttcgtatctaaaaaccaaaccatggaagacatccctgtctccccgctcccccactctctccctcctctacatccctct

SEQ ID NO: 22226 - DNA, 2856 bp, Heterodera glycines
  misc_feature (57)..(57): n is a, c, g, or t
attaattttcatttttaaggtgatcgccaatccgaaccctttggccaatgcgccggnaaaattcaaaaatatttaaaacccgaatttgcatcaattacaccgtcagtttccttcgtttgttcagacacgcatttgggcgaaatttgggtgtccagcgggcacaatgccagcgggttcttttcactgttcagtgaagaggcgcatttgcaaacgaatcatttcaacgccaaactgaagacgggtgacaccagcacggcattcgcacgcaccggctatttgggcttcttacggcaaacgcaagcgatcacagcggacggaggtgggcgaagggagagaacgacggggaggggagcaaaaggaatggcaaatgacatgagacatttaaggcgaaacaatatttgaaaattcgcatttttggatcgaaaaatgaaaaataccgtcgattccaagtgtgtttttagcatgctctttcgatttttttctaaatccaatgcttcccctttttcacattgtcagaattacacgacgcaatctttgtggtcggtgctttggaggaagcgctgatgctgcgcggaatgcgcttccatccggtggacattgaactcagtgtttctcgggcacaccgccgaatcgacgaaaggtaagaaatcacgtcgatcaatccccccgttgttaattgcctcattagctgtttccacggcgcttaaaattgccttcgttaagctgcgtgttcacttggacccatctgttggttgtggttgcggaaacgcatgcccccgaggcggaggcgctcgacttggtgccggcgatcacttccgccctgttggaggaccaccatttgatcgtcggcgtggtggtggtgttggacccgggcaccatcccgatcaacagccgaggggagaagcagcgtatgcatttgcgtgaactgttcctcaggaccagctggaccccatttacgtggcgtacaacatgtgactgctgctgcttccgtcttcccacagcaatcaacagccgatcgaccaaaaatgcttacaattagtcatcactttgttgacacttgccagtagcacatcccatcacattctttgcatttgcttacacttttgccacttttctgttgtgtacattgtttccttttttattattctttcacagtttccttttcgcttaccgtatcccaatagcgataattattgtgtcatgcttacgtactgtattttttctatttttgtccactgctcaccaaaagagtcactttcaaaacatttcacacacattttcccattatccaaaaatttaattgattattttttattaatataaaggcagatgtttttttttgaaaaagatgtgaaaataatatgcaaattaaacgaccgataaaataaaatcaggtgttttttatcattgtaaggcaattaattattgacgcagtgaactagcgagacgagaagcaaacaattgccatttgggaaagactattcgatgttctgtcaatgtgaaaataggcaaaaaggaataaaactcccgagaaaagagactaaattcagagaaaagggagtgaaagcgctttcaaatttttgggcctttcttaattcattttgaaagtgatcgtttctggtagaaatagagcacgtcactgatttccttccgcgcctccaaagcatcgatcggagaaagggcactgattttgcgcagagtcattgccacgaatcgacctgtgggcaattgggacaaaaaatatgggagaaaaaaagacgagaaaaacggaaaagtcgggaaaaaagaaacgattcaaaagagatgccgcataagtttttgtccgtttaaattattcgtttggtttttttaaaggatgtcattttattttctgttcagagtgtgccctctcccgagattttgcgactgttggacacgaacgaacggataaaaggattaggggataattcggcaaagcactgcaaaattaaacttgggtggtggtactttggccttgagggtttttgccccgggattccattccaattttttgttttttaccccccctccccccgggggattttccctggtgcgttctgtccattgcgactgattgactgaccaaaacaggctaattcttccgcgtcctcctcctctgtttcggccctcctctgctgctgctgcggcacaattggcgccgaattgtcacgcgcggcggaagttgaaagttgggacggaacggggaaaagtgcggagggattcaacggaatttgggaacaaatttcggcaacagcgcccctcagaagcgaaggcgacgaaaaaggaggcgaagcagcggcgggagaagaagcgaaagaggaggcggaagctgtgctgccggtgggcatttccactgaaaacgaaaaaaaaatttaaaaatttgccaaaagtaaatttccattttctaaggtccaccaattttgagtgccgtatttttcagtccccggctcccttcgcccctgtccccccttcccctccctttttgtccctcccaccgttttcccttccgccgttcgtcgcccctccacctgcggtgatgtcttcgcgctgatccgtttgtccctccgccggggtcggttctgccatttgcgcgccccctccgctgcttcgtccctccgttgtgccgtgccgttcttcgtcctgccgttcgtcctcctccacttcctcctcctcgtgcttcaccatctcttccgccacctcaatcaccatcgtctgttgctgcttctgttccacgttcgcgtggtgttcggccgttgggcactgaaaaaggccgccggggctgctgctgctcccgttgctgttctcctccaacggcgtcggcagcgacgcgtcgtccgc

SEQ ID NO: 22227 - DNA, 1802 bp, Heterodera glycines
cctaatcattgttcggtcggacgctttttcgcgaaattaattaatttctggcttaaatagaaattgtcggtgcccccggcctcattttaacggagtgaggctcaacggcacaccctaccaacggaggcaagaacttttctatttgtgtgcctggtcattttgtgaaacatttggggctcttacgccatgaatagcctcccattgctaccaattggtggctctgtgcccccaccatccactcaacccatcatttaactacttctcccccccccccacttttttacttcgttcaccgcccttcgataattacggcctttacttgaacttttctctctaacctactcactcattcactcactcgtgtgctcattttactcattttgtcacctcaacaaagcatagacatattattccgttccatcgtctccccccgcccgcccattcaatcgggtccaagctgatgacgagttaatttgccctctcgtccccggcagttgctttcccctcccccattcaatcctatccgccggctgagcattaaaagtgctgttcacactcaattgaagagataatatgtgtgcttcttatggcccttcttctcccccagctcgacaattttttcttcattcttccgaatagcaaatgcccccctctctcttcgtctgtgtaactcatcatactcaatgaaaagcatccgtagtcagtcccaacagatttccgttgaaatctcaccactttccactcatttcatcaaccaatgttttttacacatccccaaagggtcacacattcgctactcatcattgtgtttttaaaaagcacataaatcgaccgaaacaaactgacgtctttgccctatgccttcgccctatgcgtgttcccccaaaagaaaagcatctctttccggcccacaaggggcgacagaagcaaaagggaggggggggggggggagaaggagaggaagcaaagggtgcagcggcgcctgccgttgtttccgccaacccaaccgccacctaaaccaaaatgttgtacataaacttaaatggaacggcggcgctttgaactgaggggacagacgggcgaacggatggcgaggggggtggaggagttggggggctttaagcattttctttggccacagtgaataatttgtactatccggcctcactcctccgttttggcagcttccactcgcccccactgcccggctaaagcggcgcttgttgctgtttgacaatggcttagcctaacttaatttgtcgttgggccttccgttgcccattccaaagggtagcatcaacagacggcctcgtctaacggctgttttgtggttaatcaaagaacggcattcgtccgtcagcccacacttttagtgagagtggaaaaagaaaaaccgacacaattggcaaaaaatcaatggaatcacaaatctaattgaccagtgatcataatgcttcaataaatcgctttttaagtgcttgagcactgattgtcattcttacaatgactaattataaccgacaaacaaagggaaacatcgacggattattttcttcggcaccccaacaccatcaatgacgaccaaaatgacattggacgacagaataaataacgctgaaaacaacatggccctgttcacacctttcatgtcacatgccaaaaattatgacgacagtggcgacaaattcactttcggcagtcaggaaatttgcacttttgagcaatggacccaactgccggatcagccgggtcccctccgcatcaataggatgatcgccattctcgccatgttggtcattctc

SEQ ID NO: 22228 - DNA, 2217 bp, Heterodera glycines
  misc_feature (30)..(30): n is a, c, g, or t
  misc_feature (86)..(86): n is a, c, g, or t
  misc_feature (111)..(111): n is a, c, g, or t
aggaattcgtggtgatcatgcccacaatgnaacggtgcacaaatgccggattctaaatttgccacaaaagcattgcgcaattattngagatttcacgcattaagagttttnaatgaagaacaaaacggaatggaaaagttgcatttatacaaaaagaaggtaaattaatgcatgcgggacgtgagatttgacttggaaattaaaaatagttagattataggttcttaaaaagtggtttattgtttgcgttggggtagtgcgctggtctcaattttttcggtcacaggttctaacccactgcatgcaaaaaccatttaacaatttttatttttgctttttttatgcaaagtcaattatcgaaaatatttttatgaaaccaaatttttattttttattattttaacaccataagatacgcaatgaagaatgttagacaaaatcaatttattttaacttaaaggagatttactgcttctttacctttaatgaattttttgattttaatgaaataaattaaaaataaaggttttattgataaataattttttttgataattgacgttgcataaaaaaagcaaaaataaaaattctgcaaaaataaatgctctatccacccaccaagtttcattcagaaaccccacggatacctggggaccttcctttgttagataaatcctaaaatagagaaatacttattaattttgcaactcagggggctgaaatttttggaagtcggaaatgtgagcccaaaaattctgaagttggaacttagactttatcggagtttacaaaattttattggttcttaaaatttaattttatttaaaaatttattgaaaaattgcctataagcggtatccgttttgagttatttttttaaatatatgagttttggtccactgttaagttgcatagagtgtcattctgaattggcaaaatatatatatatatatatttttttttaatttgaaaaagccgaaaatttaaaaaatttttagaccttttggagaatttggcgttgaagccatcatttctctcgagttcgaacgacaacatttcggagataaaaatcatattgttgaaagcgtacaaacattttaacattacacctgaagaggaaaaccttagtgaatttgaaaaaattacgcaaaattttgctaataaagaaaattatgaaaaagtgcagaaactggtcaaggcatttaaaatgagcagagtattggaacgtaatttgattctaaagattttttaaaattaaaaaatatatttgtccattaaatattcaattaatgaataatttattttttctatggattattaagaatgacaagtagtgtctaaaattgacataagaaagataaaatttaaccaaaaattccttcaaaacccattaaaaatttaatttacaaatttaaacaccatacgccaaactaaacggataaaaattaataaaaataaataaaaatttttgtgcatgtttttctacatttgattcattcaaaaactttcatttaggtaaatcacaaggtaatggcaccaacgcaaaaagaaccactcaaaagtaccgtaaggcgttggaacaaatcaaagctgagatggtaaaggatgcggattactgtaaggattgtgcaattcctaccgttacccaagtcttggcaacaccaattccgcttagtgaacaaaccaaagaattgatgcaaaaaggcgcaaaaaaacttggcacgtttttccaaaatttgcaatttttgccaaaaaacaaacaaaatttaagatgagaaatttaaaacatttactaagcgcgcatgattttcaaaactgtgtcaacaaatgaatgatgggatatgggaacagtgaacggatattgtgtgatgaaatattcattattatttttaatttcaagcatgatgttatattatccaacgaaaaaacatgtttttagatgatattgttaagcttccggtttttatgtcctaaaaataaacatcaatcagtcattttccgtgatcagagtgacccgaaaaacttcgaaaactaccatcgaaaaacaaatttttgacagaaaatgttaccataaaaggccccttcacaaatcaaattatgacagaaatttttctaaaaaatttattggttagacaaaaatttaaaaaatattatatataaaatattttattttattattatttggcttggataacgacgaggtgtaaacccaactcg

SEQ ID NO: 22229 - DNA, 1773 bp, Heterodera glycines
  misc_feature (1685)..(1685): n is a, c, g, or t
  misc_feature (1694)..(1694): n is a, c, g, or t
  misc_feature (1729)..(1729): n is a, c, g, or t
  misc_feature (1761)..(1762): n is a, c, g, or t
ccccgtttttgggccccggggtcgtttgggccccaacacaaaaatagaaaaatgtgcttttttgaaaattaagattctaaaaactaagcctgagggatccctcgccacttggcataagttaggtttaattaacattcgctcattttttacaattttacttattccaaatcctattattttttaatagttattgatgtacattctgatttggacatttttcagaaatggctaacccaattgcaaccaaaaaacaaaaagtaaaattgtcttacgaaggccacctttacaccttcgctaaaatgagttctgatgggatgacaaaattttggagatgcgagttcaaaaaatcaatttcacattattttggagtttctccggggaatttctcgcagctatcgaatgaacccgtgaatttctgttaatttttacattttttattgttaaaattattgttgaatttatttttaaaatgtttattttacatttttatgctgaaatttaaaaaattgtttttactgtgatttttcatttttctgtacttggggcccaaacgaccctggggcccaaaaacgagggcccaaaaacgagggcccaaaaacgggggcccaaaaactggggcccaaacgcccccgactccagtgagtgacagtgaactatatgcgtctctgccttacgagagagcggagagagcacgcgcatttgaagagacgaaaaaatccaggaagacacaaaagttccgatctctagtttaaaaattagaaaattttgagtttttaaatgcgcgatccgcggcaatttgaatgcgcggccgcggtttttttctgtgcgcgctccagccctggtgtaaacgtagttttatatattatttgttttaattttttaatttagccccaaaaatggaaaacaatcaaattataacgaaacaaaccaacaaaaaactcgagcatgaaggatgcctctatgtcttccatatgttcaatgctgaccgtgacgtaaaattttggcgctgtgaacatcagcgtgatgaattcaagtgcaggggacgccttcacacaacgctcaatgatgtcgttctgaagacaattggcgaccacaattgcaaccacagtgcggcaaatgtcatcacacaaaaaatcgtcactggcataaagcggcgtgccgctgagacgatggaaccaccagcggcaaccagggcgcacacacttcagcaaattgccacgccagtaatggcgaacattccaacaaagaatgccacaaaaaagtgaaaatctaatcatttttttacgttcacatttttggttttaagctagtgaagcgagtccgccatgaaatcgaattgccgccgccagtgccgctaacgcttcagtcctccattgtttcgtcccgaagaatgaagtgtgcatgagcgcacaatgaacggcaccgaccgcacaaataacttcgccgaagcataccattgcacgctgcaactttcgatcggacaaggacaccccccgatctggaaattcatcaatgcgcgagcatcagaaaataatcgacgtggacttcgaacatttcctcgctggaaatgctccgccgcaaaagcaaagcgttaccgtgaagtggacagacgaattttgaggattctggagcgctacaatgaggaaaaaacgcagccgcaaatcgacgatgatcaccaatatggncaaaaccanaataaccccgaattgatttattgaaatgctcaggngaatttcagcaatacccaatgggtaaatgaanncttgttatttt

SEQ ID NO: 22230 - DNA, 1957 bp, Heterodera glycines
tttcctcacaccctcttggtagaaaaattttttgtttcatttggcaaaccatctttaataatcgaaaaaagaaatattcgattggcaaaggaatcacaaggtatgccactgacagatgtgaaaaggatcgaagagaatatgtataaaaaaactttgtgataattctgtatctaccaattcagtttttgactgttgcatagtttttacactgagttcaattgtccgtttctcatttgaggaatggtcacttcgtacggtgcgccatgcgaaagcgacgaccgaattttgaaagcactgcaaattctcgtctattttatacccgaaacgcataagcaatgtttggaatgtttgctgatccatttgaaaagagtgtcggctcattccgacaaaaacaaaatggacgagtccaacctcggcctgctcttttcttcctacgtttttccagtccaacaacaggtgaaatcaaatcaaaacggatttttagcaatatttggacacacatacttgatgaaaagggtcgactaattattgttcattgtcaatatccaccaaaatcccccgacataattacaaacgaacaatttattgggaacaaaattcctttaaactcactcacataatttcctaacttgtcatgtcaaaagcaccaattttatttgtgatttacgatcttaaaggcctcaaaaatctttcggtgttactttatttgttttggttttgttgggtattttatgcctaaacccaattcgacaaaaattacttttatttagaaatacgaatcaattgaaaaggcaaaagacgaaattgcgcagttttgtcgtttgtttcccgttttactcaaacattgcgacgcgctgtttaaactgcccgctgagctcgtgcagactttcgacgcttctctaatgaaaagggcccttgagcagcagaattgcggggacctcacatccagcagcactccctcctttccctttctctcctctgttggtcggtcattttgtgttgttttgcattgttttatttgtcatttttcaagccaactccaaatcgaaacacaaaaactccgagaagagacgaagacgacgcgggtgagaattggcagaaaatcgcaactgaaagcatagacaaatttcagaagtcgccattgtgcactcgtgctcaaagagagtggcgacgcccaaccaaaacaccaccgatttggaagtggcgaagttggcggcgaacatcgcatcgatggaggaaggctcggccaggtcgcggctgttgaacaaaatgatgactgtgcagcgccagaaaatgggcattaagaagaagaagtccattctccgggtgctttcgtctgacttttctctcattctttttgctttaagcgtgcacttccccggcggaacagttgagcattaaaccaaaacaccaattgcacttcggatgattgaatctcctcaaacttttcacttttgtattttcattcacttttttcaaaacagggaattttatcgctatttatgcataaaaagcgcatggtttgataattttgttttcgtttctccctttctttgaaattgcttatctttcccttcggaagttttcctccatcactaattttccatcggttcttaaattcacataacccaaaatgtcttttactgtcgtgccaattcttttttgcttctttttgcctgctctttcgatttataaggtgtccatcctctgattggttttgtattttgtgaatttttttagccaaattgggactcaattgactcgcgccctttgcccaattggtacgacgaagccaaatttggtattttttcgcattggggagtttattcggtgccggcatttgggtcggaatgggtaaggccgaaaacagacccatttgattgttgaagttctttgaagttttggtggtattggaagggacaacgtgacgcaaaattcgaaagatttttcaaaaaca

SEQ ID NO: 22231 - DNA, 2226 bp, Heterodera glycines
aatttttttaaaggatgtccaatatcaaaatccgatgattcctttcggatctctgcatgccaaaatcgacaatttaatttagtaaaaaaaattaataatggcgaattatgatataattaatcgaaaactatttcacatagaatctaattaataaaaaattgttacatatttaaaatatttgcatcatgcttagaaggtcaccattcttatattgttgatgagtattgttatatattgttaacagatagattcaggaataatttatttaacttttaaactcaaaacataaacaaaaagcagtggttgccgcggacgagaaaaattgtcgggacacccaaaaaaaagtttggtttggcttttgggattcgggcggggcaacatgatatgtaatcgagattccatccaccttccccgatccttaaaaaagtcatataataaaagaatagaaatttatttttaaagaattttatggtcgctgaatacgacgaatttaacattcaacccgccaattccgcttctctaaccaggatttgaatgaaaagtcgaaaaataaattttcaaaattcaaatttattctcagatacttaattttaaatgctcgaaattacagttaataggcgctgtttagcattgtcattttcaatgatgttgctataattaaaaaccaaaaaaaattatcgttgtaagatttttttaaaattgctttttgaacgatattaaataattaacgctaaatgtcttaaattttgcattagaacgaattgtacaagacaatatttatcgtgtattattatgctgatgaagatcgtgattcagagctttgttcataaaatcaaatcaattttgttcaatgaaatgtgtgaattgcgcgattttccgacaacagcagcaagagccgtgccatctcgtaaattattaaacgatttgatcaattaaataatggcgatttatttaattattatttttttctgtttgatcaggacacacaaaatttgtgtttaacgacaacaaaaataacaaagaaaaggtgaatgtttgtcatctttgaattttaataacgtgtttttttttgttattcatacttttttaattttgattgtatgtatttaactcatccggacaattatccaaaattgtcaaattattcattttaaatatttttctaaatataatttttataatattttgctttatttaaataaatattatacaacaaaagcatgaaaattgaaattactacaacacatgattataattcgagaacaaagaatgtcaattaataaagtcaacacggaaagagcggacggcggcggaggcggcgaaagaatggcggggaaagtggaaatttaaatgggcaaattaacaaattaatgagtgtaattagtaaaacaaatgaatgacattgaagcattttgtcctgagcagttcctgctgataaatggaaaagataagaaaaagctaaggcaactgataagttcactgattccttgaaattaaataaaatatttccaaaatatttaaaattatttaaaaatgcaccaaataattaatttttatttatttattctgttcttcgcacctaattttgctgaaaaacttcggtatgtacagattatttggcgccatggagacagagcgccgctggaaaagccttaccccggcgatttaaatggtcaacctaaaaaagaaaaataaaataaataaattaattaattaattttcagatgaaagcaaatgggccagaggatggggccaattaacaaatgttttattttttaaatttcgaaattcaaacagtgcaaacaaattcaggatggcatgcggcaaatggaggagcttggccagttcctccgggagcgttatgccgctgcaaattttttgccccaacattttgacagaaaagaggtaagaaagtgatcaattattgattgattagggctatcaatttgtaaatattaatctccgaaatcaaaaagtacaggcaatttttaactggaatttgatctgaacgcctaattgtagataaaagaaaaaaaattatcctattattaattcatggacattgatttatataattaatttaattattttatcaatcattgagttctttcgcatcagctcagcacggaattaattgtaaagccaaattgggaaggtgaccgaaagttttcgccactgttcgtttagtcaccgagaaataatttaaaatatttctggatttttttt

SEQ ID NO: 22232 - DNA, 1951 bp, Heterodera glycines
atcatgaaatgtccaagccacgaattgtcaagctacgaaatgtccaaaagagtaaaaaaccacgaatgtccaaaagtctaaaaaagctcataaaaacccggaaaatggtctattttagggttttaggggttgctgaatacgaatacgacctttatattgccctttgccgaatcctggacccaaatataaacataaaatagcaaaaaaaaaattcaagacttctacaaagggtgctgatcaaaattcgtagggttcccaggagatccaaattgtgccatcatttgttttaatagcgcccgccaaaattcgcgtaatgaccgcgtcctgcaggacgtgtattgtcacttgtgagtaaaatggctaccagatcgggccgcgtccacctgtctgtccataagtccgagaaagcagtggtgacagagaccattaaatgttttttcaattttacttttataaatcataaggaccataaagtcttgcgtgttattgcggtcatacaagacggtatcctcaccacgttttcacgtaacattgctggaacgacaacggtcaacgggtttggaagtcaaaaaatgtcgaatttgtcatcggaattgtgtgattgaatttatattttccgttttacgaattaactgagaaaagtttattggaaatatcattgcaaattatttggcaaaaattgcagtagggatggcgaaaaatttacctttttgattgaaatctgtaaagagtgagttcaatttttttttctgcgatgccgattggagaatttttgcctcatttgttaacagattttacgctaaatggccaccccattaaacttcataaataagtaaaattacacagtttccaatcatcatatttttaaattgacattccggctcttccctggtatcgagtttagaagttgttacgccccaaatccgaagaggaaaaaaacaatagtttgacatcggacaataaggggtcgaaaacaaatagtttatgccgttgaatcgggtgaatttgaatttcttcgacgaaaatgtcgggtgaatttgaatttcttcgacgaaaatgtgccattccccgaggccgactttgaatcggacgaagaattgtcaaacaccttgcaacctgatcagactcgtttgcaggcctttgtggaggggcttcacatccgtggaaatgaagagagtgatgaagaagctgaggataccgatacatagtgaaatataattttaatattccactacaatgtgttttctgggattttataaatatttttttcttttttaggctaagtttccttatcattatatgtaaatatagctaaatataaatcaatttagaatataatttggagaaatcgttgtcgaaatatctattttaggttagtaggcgagatattaagtggatagaaattctgaagaaccgggcctggaccttcagcctccctaatcccgactccaaatcctcccgggtcaatgaaagttatagcggcggtatgacatggcgatctgtttattccggtgcagcaaaataaactcccattcagcagtgatcgatcaactgactaactctcgattgaaagagccgattaaatagacaattattggaggggcagtgagaaggcgggcaaatgtttagggaaagggaaggaaggcataaaactttttctctgttcacgaatcgcatataacccctaaggtatacggtacccattttccaagcccctgctaattgaggggcattttttttgaagttgccactcgaccaaacccttggcctattgcaggtaactctataaagttaaatgcccaaaattccgaggaatttaaacgtattttggtctagaaagaacaggaagtttcattgcagctcgacaaacaaaattcaaatgagaaatgctgagaagtgaaaggaagggaaatggtaaataaattggataagaagcgaaaaggcgaaaaga

SEQ ID NO: 22233 - DNA, 2213 bp, Heterodera glycines
  misc_feature (2184)..(2184): n is a, c, g, or t
tcccttgtacacgtatggtttggtgttgtaaatggtgtctcccatccaccaaatttcgttgcctgctgtgcagaatggcggccaacaccaaattgggcgacgccgcaatggccgtctgcacgctgaccaccttcagatggaccatgtcgttgatggtccgcgtgaacaactgcgatccgtccggaaacacgcgtttcaatcctcgattttcccatccgccggaggacaaataatcctaaagggactgaaaaagtagaggaaagtccaatgagatgctcaatcggatgcttttccctattttagctatttttcgaaagtgagggaggagggacaaaaaccgaaaacccaacgatttccaattaaaaggcactcactcaccgcctttaatcgggacaattgctgtctaaagttgtactgcaattccgtgctgaagtcaaactgtccgtttttgattggcatttccaagtcgtggcacactttccaccgtttgtcctcagcgaccaatttggccaaggcactcggcaagtacaacaaacgctcccattggtctatcattgtcatcagaagtctcttcactgcgtccagagaatccaaaacgggcgtgcaaatggtttttcgacggcttaaaaaacaacaaacgttttaaaatcttgaatttttcaaaaatgcatagtttgtttttgttttaatttttttggggggggggcagtttcgccgcaattttttcagtccgtaacttacgtcaatttactgtttctgctccgtttggtgttgtccggcgtcatcaacttgcccattttgttgtcccccggcattttgaacagcgtcggcatccaacaggtggccatgcacagcgaagtcattcgaggcgacagtcgcgtcactgtgcccagaaaacggagcaattgcgtcagcgcctcgcggtgttcggtgggcagcagcaaaacgcagtggtgcagggcaacgaagtgacgctgctcgggcaattcgctgaccattttgacgacgatttccgagatttcttcggtcatcagactgcctgacaaactggcgaagtactgcttcagcgcatccgcaacgtcgtaaggcgacgagtcggccaacagatgggccgggattggctgatcagccgagagagccgagcacgcctcgctgatctctttgatgcgcacgctggcacctgacaaaatgaggacggacagattggggagggtggcatttgatggcacgaaaaagagcgattaaatgttgacgatgttgtgagtcggacgcaccacttttgcggaagatgccatccgaagtgtgtgcccggcacttgagccattccataatatcgtagacgaaacgcggcaacggactcgcgtcggaagtgagcggcacaatggaactcagcgacatgccgtacagagaggacgatttagagggggagggacacggggaaacatcggacacgacggaggaggacggattggcggaggacagatgggctgaaggggggggggggggagagtgaaagcgaagtaaagggagagcaatcaatgggatcggattgaattcgaaaatgtaaaagtgaattaatttttaaaaatgatggaggtggcattttacatttcccaccattttaccacctttgtccttgaactggcgaatgacacttctcacccgccttgcccatcggttggagtcgttcaccgtgggggagaactgctcgcaaagttcacccaattttgaaagggacgcattgtgtagccaatcataaaaattattgaaatttgatgcaaatgaaaaaaaaaagtttattaccaaaacagcgacattcattgaatcaacgcgaagaaaacggtcatcgtttagcgattcttcagcaactgattccagggaatcggtgttcaatggaattctgaaaagaaagaaaaataaataaaaatgaggagagagagatagagaaaaaagtaggagaagggaagagaaaaaacatatggaaatgaaaaggggaaaagaaagagagggattggggagtgaaggaaggaagagatgggggagagagagaggagagaaagagagggaaagagagaggagagagagagaaaagagggaggaaaaggagagaaaccaaagagagggagggagagagggttaagtgaattaaataaattaaaagtttttcagtagtacagacatcgntggacgattcatcactgatctttgctgat

SEQ ID NO: 22234 - DNA, 2357 bp, Heterodera glycines
cacagctggatcctcattgtagagaccggcgcgggacgggatcccgcgcgggactttgcgggattccatttcacaatcctgcatttttgggaattgtcgggattgcgggattttgcaggattattccgcgggatcctgagtttcaataccgcagagcaagacccgagaattttgtaattttgtgcgggatcccgctggattcattggatttttgaaaattaacaaaatgccatatttttctagaaaaatttaattacctaattaagcaattttatttcatcctttttgtaaacatttttccgacggatcatatcggccggacacccaattcgtactaggttcaagtactccccccatccctccatcattgccatttttccctataaaatttgaagcggatctacgtgaaaattgcaactaaaattttattttgccaagagtaccaaaaccagattatacttttagaattggttgtaaaataccaaaacttattctatcaataattgaaaaaaactaaaagaacaaaatgatgctaaagcatcaaatctgacagctcttggataaatcccggaaaatcagtttcttcaatatatttagaatttcgccggtacttgttggactgtgccgtcaatatttaattctccccatatacttttcgacttttttgccctcctttgcctcatccatatgatagactttaaacgaggtattcaatttgcattttttttttcttgaataatttaaagttttggttctcccggatttgaaaatcaatccaacaattttataaaccattttgtttaaaggtggtcgtttaagaccatcaaatcagtctatttcttattgagaatgaattgagtggtagaacattcaataaaagtgcagtttgctgcccaccctcccaattttccgaaaaaactaatgggggaattttgcactttgcaattttctcagcattttgtatttttaaaattgtatgggtttaaattacttaattgttttatgtccatttaacatttttttcccttttcagaatgtaatggtcgacttggctacactcttgttgaggtaatttttatctcccccttttttcccaatttttttagcggtgaaaaaacgcatttttttcaaaatttccttggatgatggcatatttgttgtatttcctagggtgattttcccccgaattttcaggatgattcttcactgttgggtggcatcacttttcgctcaattgtgtccggtgacaaattgccgttgttgcgcgactcaccgcccgagtcgcatgttgagccggtggcgcaactgttgcgatctccacgtgaccacatggacaacatcttcaacccagcggacaacaacattgtggacaacaccaatggcttcgctttggcgccttacaccgaacagcgacgtaattttgccaaaaaactgatattccttacttgagctagacctggacctggatggattcaagctttttttttcctggacttggattttcctggattttgttctaagccatgtgaaaaataaaaccaaaatgattacttggatttaatttcagaatttattgttcagagtgcagtttttttgttttcaagttatcgaacactgattaatagatctaaacgattttattatggatattcctgagcaattagttgacttttttaaacatttgtttgttttttaaaataaatttaaaaaaaatccaggtccatgccatgacaggcctggatttttgtcaggaaacgcgggtgggcccgggcatttttcaaaatatcgcccttttcaggtgcgcccagcggagtgttggcacagcaaacgatgcaacggttcggcaatgcgtatttcatggtttgttttgttttataggtggcatgcttaaattcaaaagtcgaaaattcaaaaaaaaaaaactttttttctttgagtcactattgaatggccatttgaattggtgttgcaatgcgattgttgaaactaattttgcttatttttgaaagatttgtaaacaaaaaggcgtgaaacccgagaaatttttgaattttcgactttttttttgttcgagttcgggtctctggtttcggaatatgtgccaaaatgaaatagtcataatttattctttcttttcagggtaatagtaataatagcactaacaacaccaccacttcctccgcctattcattggcaacaattggcaccaatacgacgacgtacagtggcggggcctgcaacggcagcggcggcacattggtcacaaacgcaactggcacaacaggcggacgtcgtaaagaggtgtacagtaagttaattgaatttatgaaaaaccaatattccccataaaaaaaatt

SEQ ID NO: 22235 - DNA, 1536 bp, Heterodera glycines
caattcataaaatcaatttcagaaagaaaggactttataaatagcatttctacgttaaagttttttgatttggttaagtttttagtcagagccttccaactaaaaattttaaaaatcagcatttgaccaacaaaaaaaaaatgagcattcgggccaggccgtttttgcgcagcggttttgtgaggccgtttttgcacgagtgcctgttttagtattagaattgttcagatttatattttatgagacattggcataaatcggaatatttattttgaaaatttattaatactctatttattaagtaaggtagttaattaataatttttttttattatcattatgaacttatgaattttataacagcttaatgatggagaagaaattaatgatttctgattcttatagtttattctattttatttttttcatttacttcacattaattaaggttgtttattaatcctgaagagaattttcctaaattactatttaatttatttatttttaaaaactatgttaacatattttgggtttagcatcaatatactgtaaatgttatcattttttgttaaagattttttgtttgaaattcacattaatatcgtttcaaaaaataatctgtttagagaaactaaaatttttaaaatcttaaatatctataacaaacgcattctacagaaattctttaattcatttactttttaaaataagcaaaatttttgccaataataattatcaaataatgattttattattttttggtgaattaaattaataagttccggctaatttagtaaaattattattttctattctctttgaaaatatttttaattaattttatattagttttttttattttcgcatccttgtagaaaaattgctttggtttgaaattaattaataatatgttaattaaattttattttatttcatttaattttcgattttacgatttaatttgctttgtttaaaagaattcttgaatatataatatgatcagatttatatttttcttccatataatatatataataaaaaaacaattaaaatttatttttaaaaataaatgttttagaaaagtttaaaacagaaattttttggtaattacgaaaaattggttcgatttttcgcgtactctgatgttctatattaataaatgattttttactttttttctgaaattaattgtaataaaataaaataaattatttatttttttgctttaaatcctttttgttttgtttatcatacatttatttggttttcaccgtggccatagagtggtgattaatgcgtttttatgctaatttttttaatttttgttttaaatagttataattatttaatttttaaatacaatatttaattaaaaaaataataatttatgcttatttattttaattaatatagataaattatgattattaattctttaatttttcctaattttagtcttttaaatttttcgtttttttcttcttaatgattgacaatttatttttgcaattagttaataatttctcgtcatgctca

SEQ ID NO: 22236 - DNA, 1551 bp, Heterodera glycines
attatttaggcactccgttgggccgatgaaaaatgtcttcaaaatgccatcgaatgttccgctgagaatcgtcgtgctgcacttggcccggcacttttcaaaattcgtttccctctcatcccatcagatgcatttgtgaagcaaatcggtagaaaatcctttttttgttccttaaaggatttcatttatcgagcgagcatttcccttttcgcagttccttctggtgttctgtccaatgatgaatttgtcggcgttttccaattccattgccatccgaatttttgtgctgtgcccgggctttatccgctgaaatttccaactcaaacccgaatttctgattggaacatagccaaaggcaacagaggcactgtgactttggaaattgagaaattttctgaatttgcgcgagaaaaagagggaaatgagaggagcagtgaaatcgaagtgttgataaagggaattccgtggaaaatatcggcagaaacagcaattaatgaagaaagcaatgaaaaatggctgggattttatctttggtgcactaatccaacagcagaatgtggtcaaaatattaatttggatttaaattaatgacattaattaagatggaaaatggaattgcaaatgttcggcaacctttcgaattgtttcactaaaaagcggcacggaaaatcccattggaaaattttatgatcgcgtttttaacaatgaaagaactatttcgggatttgaaaatttcattgtatttgcagtgagtcgataattaaaattctttttcgaatttaatgaccataattaaggaattgatggacccgtgcaaaggcctttatgacaaaggcggggacaaagtgactttggccattgacaactttgtggaggaagaaaatgaggagaaattcgatttgaatccaaataaatccaacgggacaattgtgatggaaattggcaaattgtcagaatttgcgcgagaaatcattgggagtgaacgcagcagcgaaactgtttttgtaaagggaattccatgtaaaatattggcaataatagaaattgacgaaaaaagcaatgaaaaatggctgggattttatctttggtgcaccgcctcacaatcagaagaaggtgtacaataatattacatttaacaaatatttaatttatttaagatagaaattggagttgcaaatgttcggcgacctttcgaattgtctcattaaaaagtggcacggaaaattccattggaaaattttatgatcgcgtttttaacaatgaaaggactattcggggatttgaaaatttcatcgaatttgcggtaagtcggtaattaaaattcttttttctaataaatgaccataattaaggaattgatggacccgtgcaaaggcctttatgacaaaggcggggacaaagtgactttggccattgacatctttgtggaggaagaaaatgaggagaaattcgatttgaatccaaataaatccaacgggacaattgtgatggaaattggcaaattgtcggaatttgcacgagaggtctgtggaagtgaacggagcagcgaaa

SEQ ID NO: 22237 - DNA, 1483 bp, Heterodera glycines
acaaaaaaaaatgtctgacaatccaaaggaagcggagaaagaaatggaaaaagcgatgtaaataattaatctaaatttgatttccatggctaatcattctgcttttccgttttcagcttcatctctgctgattgttggctcgaagtgttcggtttgcttccgccatctcagcttggccttggcattgcgatgatcagtcaccgatttgactattacgtcgacgaacacttcaaaacgcgcaaatggacattgggcaaaatggaaattcgaagcaaaatacgacgatggagattgggctacttggaaattcgaggcaaaatcggagagaatggcgcaattgaaatggaaattgtcaattccgatggaaaagaattgccaattccgcaaaatccattgccaaaaaaagtcatcggattcgaaagcatttcgatcgagtaaaaaatgaattgaatttgtacatgattttctttccattacattcctctgattttcagcttcatcgaccaaaatgtgctcacttttatcggccattttcaccgtcttttctccgtttgttcagcaaaattgaccattcacgcaagtgttcgcatttcggagttcgttcagttcaccatttggccgatgttcaaggacagcattcgtctgttgtatttgagttcctttgttttacgtcaaatccgtcaattggccccgtcttttctctgcaattggccgtctctccaatttgtcacactcttttgcgactttttgcccgaattgccgcctgatgacagtgccaacacgtcagagggccaagcagtgaccaaatggctgttctcgcctcatcccgacaatttgccaaagctgttttatgtccaaatttgggaagatatggggcaacaatgggcggcaatagtggaacaaatcaaagcggtgatttgttcaatttactttgtttttaattttttttttttttttaggaattttccatcgcttcttctcccgtttctttcaacattactgttgcctttatgccgtttcattcgcttcctgttgttgtgccatttgaaatgaccaacgcattgactggggagaaattgaaattgaaaacatcaattggaactgaggacaatgaagatatttttgagctcatccgttgttcaattggcgaaggaagtgagcaacaaatggaaaaggcattgaatgaattgattgatggacgagagaacaacaaaattgagatttccatcaaacacggcggagtcgacgatgggtgaacaatttttaaaaatatcaatgctaattttttgtgttgtttttaaggcttctcgacgatttgccgtccgggccgagtggtgatcagaaacagcagaagaaatgaattgattggttgatttatgcgattatttgatctaaatgttgagcgttgttatttaggtaggtaaatgttgatcgttgttgtatttgatttttgctcattcacaaatcaataaatagggtctta

SEQ ID NO: 22238 - DNA, 2623 bp, Heterodera glycines
  misc_feature (9)..(9): n is a, c, g, or t
  misc_feature (11)..(12): n is a, c, g, or t
gcatgcctngnncaggtcccagtttttaatattgcacacgatgaagtaaaaagtcccccccagcaccaaaaatgtataaaacatttttacgaatttcttgaatcaaaatttacattccatgaaaaagaaaaggaggtaaacaaaaaatgcaattgccaatcaaatgaaaaaggctcaaaatattgatctaagctttccgatagaaaatcggcggctgatcattggccgatcacctcgaagaattcgcacttttcttcgccattttctatcactttcaatgacaacaaagcgaaaattttaggctctttttctataatatttccaaagatttcgtccaccattttttcaccgaattttttcacaacaaatttttgggatatttgctcataattgccgccagtaactttcagttcatcttcggtcaaatcattctttaaaaaaaataatgaaaatttttcaaaacttttagatatggaattaaaaatcggctattttttggaatatttccaagaaattaaattgtttttcccttatatgccatgaaattttaaaaaaattcaggcaatcagccattttttaaaatttaccaaaaaattccagaaatatttgtccgattgttccatcaaatgcttgaacagttcaaccccaaaaatgttcacaatgtatttgccaattgaatgtacgttttgcactaaatccgtccactttttcttttctgctttctccaattgttgttctgtttcatcgaattgttttgaatttccgtacgaattgcaaaatgccgaaataagcgcttgtctaatggcctccgatggcacaatattttcagccgatgttttccagcgaaaggcgcaagccatgctgaaattgaaaataattttaattgttctgtgtgatctcagtccgtccttaactccaaatttagttgattttgaattagattttttgcagattttataatttttaagtccatactgttccggtaacaataagaaaagaaaacggaaatagggctaataatgaaaagattaaaatggaattctattgaaattttaatcccgaagattgaataattttcaagaattacaatatgaaaagaaaacaattttataaaagattttctttgttttttttagaaataaaaccttataaatttcgttggcaattttaaagtcagagaaattgacagaagaaaatatcaattataaggaatgtatacctaaaagcgaacatgcgttctgtatacattgaaggcggaatcggtccaaacatttcctaaataataaaaaatataattatttttcgattaaataatttacgactttacccatcttctgcccgtcttcacatatgccatcagattagcagaatccttttcctgcacagtaatgtgtcttttaagaccgtcaatatatcttttcttcctttcttcactgaatggcgtgaaaatgtccacaatgccaaagtaaaggcgcaatttttggctattcaaaagtgtcgctgagttcggatgatttctgcactgattacaggtggctttgaaaaacggaatttcgtcactgaatttaaaaaaattaacgccagcagaagaaggcgttgacaaggatattttttaattttttcaagcaatcactcacaaattttcccgccccttacatttctttccctgaaggtcgggcggggaataatcctaatataaaaacttacgagctttcggtaattttttcatgttctccattttgttcaaagtaaacaccaaatataatactccaatcatttacgttgtttttcgccaaaacctaaaatattcataaatttattaaccaaattggagcaatcttgaaaatttttcccgcaacgcttataggcacagcgggacattaaattttttgtaaactaaaccataaaattagaaattatttttcatttattaggtgccgtgccttgtttgaataacacccaaaaaatgccaccacctcaaagtcacgtttcagctgttctgcgatattatgatgtgtttttttgtccaacaaaatgccttccgggaacattggctccactattttcggcacaaggggcggttcggcaccaaaataattgtaccatttgagcacgacgtcgtttaaacgctgttcctgatcaatcttgaccaatttgggctgacgcgaaaagacgcccttcacatcaaagttcaaaagtgtcaaatccttggcattttggaatacattttccatcagcagaaagagggttgaagtgttctgagaaagacttttatgaataaaaattgttgaaaatattttttttattaaataaaaatgaggaaatgaatttcccacttttaatttttaaaactttaaaagtaaaacaatttataaagagaataaattttatttaaagatttatttgcgtgattaatccctccggatccggtcccgcaacaaatttgaatttcaatcccgcagcgagatccgcaaatttgaaatttccctgtctctaatcaaaattacaacattttatttaattttaattttttggtatatttgaacttttaattacctcaatttccactcgaaacaccataaaaattttgttaataaatgatttgtttcccattttcatcata

SEQ ID NO: 22239 - DNA, 2438 bp, Heterodera glycines
  misc_feature (2389)..(2389): n is a, c, g, or t
attcaccatggatttattaaacgaaaaatgggcggaccccccacggcaccgatggagtcaaaattttccttaatatttcttaaaattacaaaaagtccataaaattgaaaagccgcgatcaaaaacccattttatgattcagaagaattccggcatgtaataagattctcattttgaatgctaattgtaaaattctaagacccaacatggagtttcactggttcaaccgaaattcgatccatttattcgggggaggcgaaagtctatgatttgaaaaaatttgtgttcaatgccgggacaaccgaattgaattatgccatccatcttaatgaggtttgtgagcagggctgggcgaagctcggcttagcactcgaagccgaagccgaaggcgaagcccaatttttattcgaagccgaagtccgaagctcgaagcccaaaaaacccgaagttttcgaagccgaagccgaagttttttcaaaaaatttttttaattccaaaatttttttcatcacaaaatttcggttaaatatcaaatttatcaattgacagaactgctagagaccaaccaacccctttcgataaataaatataatgaactttttgagcaatatattttgtaatttttataattcttagaatattcacggtttttgagtcaatttaaaaaataaagggaaatttttttaatttgagtgtaatttgttaacagattttcaacaaaaaatgaccaaattttgcgactttgagctacttttttaaataaaatagaggatttttagggtccggcggtgccgataggcgccgccggtaaaaattttgaaatttttagtgcactttgttaacagatttagtccaaaaatgaaaacattttgcgattttaattgttaaattttattgaatttactttgaaaaaaaggaatatttttgaaaaattagaagaaaaacaactaattggatgggaactgacccaaaggaaacataatgaaaagagccgagagcactccactcgaccatgcttctgaacaaacagagaaagcaaaaagtttataaatataattaattttaagtttaccaaaagccaatcactaggggtgcattttcacattgaaaactcaatctttaggggtgtatttttcccgaaacttcgggtaaaatagccgaagccgaagcacgaagttcgaagctcaaaaaacccgaagttttcgaagccgaagccgtttcgcccagccctgtgccggatccagggtcaaatctcgtaagtttttgattgaacccactcccctaaaaacataaattcaactaattagtcatacactatttcattcctttaccaatcggattcaactcatgtaaaatgtaaaaaatattagtgttttattgtaaaattaaattttaatttttaaataacaaacaattgtcaaacatactcaatatgatttaagccatttttcactgtgtcaattagcttagctaaaaaataattaaaaaattaattaattaaatgaagtgttaaacatacaatcatttaagtaatctgaacgaaatgtgtaaggaattgtcaaatttgaccaaaatgagtcgggagcaggattagcctgtctttgtgtccgtttatggccaaaatttgctaaagtttattttttgaataatccaataaaaaaattttaaatttgaatttttattttcttaccgtattccaattgatataaaatgttcttggcctgtggaactgacagcaaaatgtcgccttcaaataattggtccaacaaattgtgattcaaattcaatattgaatctttgtcactgtcttttgggcttggcctttgttttgacaatttcacaaaatgctataaaaacattttaattttaataattttccaacgtttttacctcatcagaaaattttttcaagtttttttgtgcttcaattttaattttctccagcaattgcttcacttcattgtgttcatcagtttcaaaaatgtcatttttctgaaaaaattttggacaaataataaaattaattaatatttacttttttaattgggcttccatttattaaataaacaaataatatagtttgaaatatatgaagaaataacatttttaatctaaatattttaaatgaattttatttgtaaaaattcaatttaaaatataattaaagaattaaaagttcattttggatgaatttttcattaaagaaatgcttaaaggtaaaattgaaattgcatgtaaaaataggtcaattagtcgctgattatttgcgagacatttttctcctaattaagtagtcaataacataacgttgatcgggatttgatacaaaaaagtttcattatcaaaaaaaaaattaactaattaattttataattttattttctaatanaaaactacaaattaacttttgatctgtccagtcaaatttatataaaaag

SEQ ID NO: 22240 - DNA, 258 bp, Heterodera glycines
gctttttattataagtcaattatcattatcacaaccttatttacgatataaaatttttatttttttaatccattttgacaaataaattactcataaagttttagacaaaaattaatttgtttttaaatgatatttattgcaccattatctttattgaattttttaattaaataaaattaaaataaagattttatttcattaaaaaaaaatttataattgaccttgcataaaaaaaataataaaagtctaaaatggatt

SEQ ID NO: 22241 - DNA, 1015 bp, Heterodera glycines
aaaattacgttggtatctgcgttgatggcgtaatgttagtgggtttaaattaaatatccacatttaaatttatacccgcaaaaactaataaaaaggtgatttggccattctctacatatgaccgctcagaaacggggtgggcacaaaaagtcaaattggacattaaccgatatttgcggtgcacggcgtttcgagatactcaattttcccagtgctcagattgcgtcggttcaacttcattcccttaatgttaattgcaggttatttgggtacgttttgagtaaatggactcatacacaactatcaataatgagccgtctgttacgggtcccactgaagaggaatccgtcctctccgcaactgcgacaacagcagttcagatctcgtcgccacctccgctgctcatttcccccaatgcaacttcggtgcgtttgtcgagtggactacgccttccgcaaggcggagacgatgaaggttttcagctcaacaaaacatttgtaatttttatacttttgttcatcagggccaagtcgtggaccaaaattgcgtcggctggcgtcttttggagaccaaataacttcgcagtcccaattttctggtcaagtggcgacaacagatttggctgaatttcgcagtccgtctgttgtaagtgcgtcttcggcggccacaaatgttgcagctgcccttgttcatctacaacaacatgcggtacacgctaagcaatattctcgatgactcaagttaaaattttcggtcatactttggtttgttccccctattttcgaaaaatttttttttttaaagttgtgtaaaacgcctttcctggggattttcttggtcgctatcggacatcagtttttgccaattccgaaccccggaccagaattcgaacaagaagtcgaaaattaaaatttttcaatttacttttatcttagaatctatattgaacgaccatttttgatgttacagtggtttgatacaaattttaacttgtttcaattaattttagggtaat

SEQ ID NO: 22242 - DNA, 1596 bp, Heterodera glycines
  misc_feature (64)..(64): n is a, c, g, or t
tccgtcaattacgaaatcgttttactgttcgtgcgccgtcaatacaaatggtgccattcgaatnggtgacgaaatggcaaatggaaaagctgacattgaccaaagaaaacgaaaatgaatgggacaccatttgcataatgaaacgaagcaaaattattggggagacagcggcggttcattggaacgacggaaattgggacaacaattgtaactgtgtgttcttttggcttgatagtgacactaattgcattgggtgagcaaataaaaaaggcatttaattttgtttaattaattaaaatttcgcttaatttagtccattgtctccgccaccgaaagaagaagacgaagcaggacaaagcagcgaaaaaggggcgtcgtctgctgacaaatgagtgacggagaaaagaacaaaaacagtgatcagccgcagaagtagaaatgaattaattaagaatgatcgatcgaccgatcataattcatccgtgatcaaattattaaaagtaattatttggaacgttttcgccactatttttgccactatttagttaattattttgggatttttgccactaaaaatccaatccctacttctaacatgcatttttttgagactttttttacactttttcggatttttatgacttttttgagtttttgcgacttttgttcgtgatttttttgacttattgaggcaaagtttgagttttacagaagaaaatgccgaaaaataaaattttcggtcgataaaaaggcaatgaaacctggatgaattttttcttaattattggaagattagaagtaatcattaagcagaagctaggcgatgaatcatctcaccaaaaagctatgatttataagacttaaaaattcaagaaaatcctaattttttgtaaactataaatcaactttttggtgagatgattaatcgcttagcttctgcttaatgatagcttctaaacacgttgagctttcgttgaaacaaattttgaagaaattaaatgacgaacaaaaaaattatggccattcccatttgaaattgtacgaactgccttgacaccgaaaatcccggtcccgtggcactctacttaaaatagtgataatttactattttcgcgttttgtcaatattttttactatttccgacatttttttggaaaatttcgcaacacaaatgcaataaaagcgaaaaatacacttttaagaatcgaacaaaaattgagccaaaaatttattatttactaattgcagttgcaaatgagtaggactgggatttttaaggccaaaaatgccatgaaaatgaatttctgggaaaatttttaatttcttaggagtgtattttttttaatttttgggacgatttttaggagggtaatttttctgaaattttttaagtagattcttaggggtgtattttttgaaaaaatttttaggtcgtttcttaggggtgtattttttggttttattgcatttttgttgagaaattttccaaaaaatgtcgaaatagtaaaaaaaaaatgagtcggggtcgttttggcgccgacgttttggcgcccacgttttggcgccagggtcaggtttttaaattttgtctatgtt

SEQ ID NO: 22243 - DNA, 2393 bp, Heterodera glycines
  misc_feature (2338)..(2338): n is a, c, g, or t
gctggcaattttatgtaaatacatattttttcttggattctctatgctctgaatataggaaaaacactttcttttttgtatttgcgaacaaaattggggacttttatttataatttacatattttggggtttatacatatttggtacatattttgggctttttagcatttttttctaaatttttttaagaatttacaaaaatttcttttgaaaaattaaaaaatttttttttgaaaatgtacccctaaaaatcgtttttttcaaaaaaggagataccaaaaattattttaaatatacaaaaatgtgcttctaaaattatttagctcatttttatggtattttgtgcctatttcacccgttacgaagaattttttcaaaaaataaccatttaaaaaatttttatttacatattttggtgtttttcttacatatttatgtacatattctgatcactcactttttgtacatatttttgccagccctacttattagaaataaatttgttaactgaatttttcccttgagaaataattttttattaagctatggtcttattacgactgaatttttctttcattttaaatccgatcattttgtgaccggaagttgaataattttcatgttctgttaattgctggatcaattttaattccctaataattactaaatctaaaattgctttttctctggttggaaaacattcatttcgccttacgtttcgcctattaacccaaaatcggagtttcaccgactaacctaaaatagatggtttgacaaagaatttcacctaaatttgtttatattattagctatatttataatgataatgaaatttaacctaaaagtaaactggaaaaaatatatttataaaattccagagaaattcttgtcattgttggggcttgggacacactgaactagagttgctacaacaaattttatcaatccaatgaaaaataataagtgcattcacgagctgttcttcgaaaaagcaagcaacaatttcgtatacggtcgtcgtaaaaggaatcagaagaccattttatggggatgcattcccttggcgagatgaaagcgtgagccaaggtagccgaacaagaatttcttctcgggatgtttgcggatcacttccataacctgcgagtcaacagttttctggtcctccttgcgctggtcggtcacagcgtactgcttaaattgagtgaatttatggaaagcattgcttttatacatttatcatttcaatttaggtacttccgggttatgctgcccccccctcaaaaaaattccaaaattcgtaatttggggtttccaaggtcgctgatcacgaatatgatatttattttagcatctgatgacttttaatcatagatttgaaaaatatttaaaattcaattaaatcatgaaaagagtcagacaggtggcataaaggcagcgatattgcgcaaaatctcgtcaattttaaatatttttctaaaatcatagatattttgtcaaatctatgattaaaagtcatccgatgttaaaataaatatcatattcatgatcagcgaagttggaaaccccaaattacgaattttggaatttttttgagggggggggggcgacataacccggaagtacccaattttcttagaaagaaattctagagctagactatgaaacaaaaaaaaatttttttaattgtttcggcgatattttgtccttcttcgaaaacttcaacagagagtgatattttgtggggttttttaaattaaagtttattgaatttaatttcggtatttctctgttgcccccattaattataatccacacatttggatgtgttgcggtcagaacccaatcgtacagctcgggcagcccgcaaatgccgaacagaaaccaggaaaggaaaattgggcccgaagtgatgcgcccgtgaagccgacaagcgtggagcaaagagcgcaaaattagctgaaaaatggaaaattaaaaacggcaaaaaaaatgccgaaaagtgtcgtaccatcgaaaggcaaagaaaaacagggtagagaaagtcgacagggttaattaattcccaaatgagcacgtcggcaatggccagcaggaagatgaagacggcatccgcgacgagaagccaaatgatggcctgagggcgggggggggaagcattaaatgcagaattcccgttaaataaacatgagggcttagaaaaatacggaaataattcccgaaatatggccataaaattacaaaaataaatttttcaaaattagcgtaaattcccacttccctcaaatccattaaattttaatttaattaaaaacctctaaatggcgaaatacagaattanaaatcagtttttaaattttttttttatgatttctagaataataattcatcaaaat

SEQ ID NO: 22244 - DNA, 1623 bp, Heterodera glycines
ttattcaggtactctgccaaattctcagctttacagttcattagcttggataaggctgttgtcagtgggggcatctaaatgactgacagggaagtgaatgataaggggcgtggcataggagggcatactgtggatggatttcgaaatcctcccgtctggaggtccctgcgtgctctcacttgagtgggcgtggcctattccccacgtgacacccccctctccatcacgtcacatacagtacccccacacttttcccttctcattttcatcttaacacacaaaaatattcctcgaaatggctcctcgtaagcagaatgagcagtttttggacgaaatccagagtaaattttaaaataaaacacaaaatataagcattttatagaagcgaaccacgtggaagaagcacaaaacaatcaaagaaaacataaaatgggtaaaatttttcacaaattttacaaaaattttggattttttctcatttttcagatattgatgatgacgtcatattggttgactcgcagtcatctcacgcagaggaacgtcctgcgctcaagaagaggggccgaaagtctcgctgggaaaaactgctggaggacgtgaacaacgcaaagaagtccaaccccgcagaggttgaagtcacagatgtcgacgaacgcaaagcagccaacgtcttcgactacccaacaattttctggaagctcgcacgcccaaaggtaatgtttgctctggtggcagccctacaatgttcttcttccgttgcagtatggggtgttcacctttatgtgcaacgaatgccgtaacgaaaacttcaagcgaggcgacaagcgcttcatcctcaacactggcagtggccaagagaagctggagtttacccaaacattctgccaagactgtgccattgactgcaccgacctgatttcttctaaagccgagacggctctaaaattattcgaaagcggagtcggcacgccaaattcgtcaaaagccgggttggctaaatattaaattgacacctattggtgcaatacttcaacgtttattgatttcgggtcgaaacaataatcgtctacaatgacgcaacccgccgcggttcagccaaatctgcagcaattaatcgacgtaattgctcagcaacagacgcaaatcaaccagctgataaatgttcaaagaaacaatcagccaaatccagcaatcatccaaacaataccgtcaatgccggacgttgcaattttcgaacaatgcgacgaaaagcatcgcatcaccgaatggctggagcgtttcacttttgccattgactcgtgcgcaccgaacgcggccgatgacataaaagtcaaggcactgatgaacaaactgtcggaaaccgcgttcagcgagtacagcaaatttgttctcccggccaaggtgacggatttcgactttgatgaaacaatttcgaaattggagaagctgtttgccaaaccacaatcaatatttgtggaccgatttgcatgtctgatggccaccaaagacgatggcgaagattttcacaatttgttaacaggcacaaacgacttttgaaagattttcagtttgacaaattgaatgaggaaacatttcaagggctaatgctcctaactgcgctga

SEQ ID NO: 22245 - DNA, 1885 bp, Heterodera glycines
  misc_feature (33)..(33): n is a, c, g, or t
ctctagagtcaaaaaaaaattcatggcctctcngggacttcaaagtggactctttatgcactgacatttgtcgcacgacgcgaaattttcgcctattcaaagggggcgttttcgtcgagcgtaaggcatggaggtggggacaaaacaatcacaaatcaaagcgtccaatttactaattggcccattaacacttaaacggttttttttgccccgtttagaccgccacctttgagagcgcattttgagagatcggcggccgaatgaaatgaatggacggaacggaaaaagtgctgcggctaattctttggatatttttgttttgtttttttctgatcagtgatctgagtgcgccttttgtttaaacatcatattttttcgttttgttgagcaacaggggacgaagaattttttctgatcacacaatttcacaaatgtgccaatttttttgatggatttgtaaaattgtcctaaatctcaattttcctggtgacaccccacaaagcaaccatattttttttttgatcgtcgatctcattttttgccgcgtttttaccaacaaacaaaaaatttttctaaattccttgcctccgtcggctgaaattttagagaattctacaaattttcattaaaaaacggttttgtttttcatgaattttcagtaagttttatatcaacgagtaaatggagttgtgattaacaaataggtatatatgtatgtgagttattaatggaaaagctcatcagttcgttaggaacaattccatcatttcttcgcatctctcccccaacattttcccccatattttctccaccaatttttcgtcctcctccaaattcttctcatcattgtcccctcacgtgtttttgctgagttcggtaaagtccacttcaacatcattaccaccaccaccaccgccgtccgtccccccattacttcctccttgctgctgctcgtcctgctcctccttggtcgtcgttcgctgctgttgtcgttgtcctccaccgccgccctttggcttcagcgtgatgatcacaattttctgacagtcggccgaaatctttgagaaaaaagagggggagttaaaattttaaggaaaaaaaaaattaaaaatagaatacaaataaaaaatgcaaaaaaaaataaataaaaaatttacatgagcgattgaagcacagtcagatggctttgcgtatctgatggacgagtgtaaggtcagatgagtctggccttcgtttattcggtacccgttgggttggggctcgtgcgcgcggaaaatgccagagatgtgcgggaatttgtcgagaaattgctgcacgaaaatgtcgttgtactcaatggcgaccctgcatttctgaaatgcgttgacaattttcttgaaacttttattttaagaaaaaaaggtttaaaatttttcaattttttttcttgaaaaactagggttattgaaaatttggaaacgatttggttccgaccccttctggacgattgccaaattttgaatgcatgtgatatacaaaaaaaaaaaaaattattattatttttccattgccccccatttttcccacaaaaattgtttaattttccaattgcccccatttgttctcactcacccggttgaatcggtaatttccgaagtccccctcctgcgcattgtccggcttgtccggccgttcgtcgtccttgtacagtggcagccggtgtccgtcatgggtcgaatcactccacataatgtcgcagtacgcccactgtccagcaccattgtaaatttctccttcgtcggccggtttctgaatttccgatgttggaaatttagtaaattaaccataaatgcatttgacacactaaagtttcttccaccccctatcaccgagaaaattttaaaaa

SEQ ID NO: 22246 - DNA, 1372 bp, Heterodera glycines
  misc_feature (10)..(10): n is a, c, g, or t
  misc_feature (35)..(35): n is a, c, g, or t
gtatagtccntgatgatgcatttgctttcatcatntggagctaaaatgagtttctgtgtgagtgtgtgtgtgccgagagtggctgcttttgcctagtgtaatgagtgggttgggatgggatgggacaaagcagcccgagccgggacaacggcacgttgccgaccgacgagcgaggaggagggcacggcactcgtcgccacccgacaattattattattattattagtattattattattttatttttgtgccgtgttggccaatgtggtggtggtgccgttgtgctttttctcatcatggccccagctttgagttgaaaaaaaatggccaatgcatttgcttggccattgccagcagcaacgcgttgagtgagggcggggggggggctttagtggacatagcacaatgacgacggacggcacttggccaatgggagagggcattttgccaataaaaatgtgcgggaaagtgaaaatgagttagcactggctgcccactcgtgccacaatggaaagttttgtgcattaatagaaagaggccatcagcagcagaccaatagccagcagcaaaaaataaattttggaattaatgtttaaatattgtttaaataagtcaatttgaaattgattttaattaaggtgtataatttttataattttttctacagtattaaagaatttgctagaaaatgttgaatttaaaaaattgaaattgttatgaatttacataaaacattcgtggttatcgaatgatgagaaaaaaatttttttcaaaattatatttttaaaaatatactagtttagacatattaagaaataatttttatcagtgaaaagaattgaaattttaatatgaataaaaagcattaaaaatgtatcactgattggacaagaaaaaaaaaccataatttgcttgaaaaatttgtgggtaatcttttaaaaaaagtcaaaattttttttgttaatggaagcccgtttttttctatgaaatttctagaaaattttgcttcaagaatgcatttcttcgtgttcttccttcacttcattctttcaataattcggtttaccaatataaaacggcttccatctgtaatttttgggacatcaaaaaatctttgatttcattttgagcctgaaaattaaaattttaaaaattctttaaaaatttaatttaaatgactttttctttttgttttttagtgatgttgtcctcagcaaacacaattttatttgcttctgttttgattacaaatggctcattctttcccatcattttcatcactaaattaattattaactaattaattattaattatgctttgaatatttgaatgaatatgaataaattttccattcttatacacacttttttt

SEQ ID NO: 22247 - DNA, 1557 bp, Heterodera glycines
aaaaaatggattagattttgcccatttttgaggtcacagatcagaaaagtaaaataaaatttgggttcgatggtgcgataggcgccaccaggaaaattttttttgaatgtatttcgtggcattttttgtcaaattatcggtagaattcgacccacacatctacaacaagtcttggctttaataagttacttgtacagtttcaaactgtcggcctccgccaccgttgtggcccactccaaggacatcaacagtgtggacataagtgccaacgacagactgtgcgtgaccgcgtcaatggacaaaacggcaaagctttggcacatcgaccggaagacgggccaactgagcgcgggtgggacactcggaggacatattagaaaaaattttcggaaataatttgctttttcttgtccttttatactcatcagccgttcattgccgtccttgaattttcgtatgttttttagttagtcgccacttgcagcggcgacctcaccataaaactgttctcacttctcgacaagacgtgcactcggacgcttgagggacaccaatttgctgtgctttcggttctcttttaattttccattttgaattttatataattcatttcacaataatgcccaacagattttgttcattgacaacggctcaaaactggtctctgtggacggcgggggactgatcaaactttgggacgtcaaaaagggcatttgcgtgcgaacggaggaggcgcacagcgacaaaatttggtcactgcgcgaattgccaccggcggaggaagagaaaaataagtgtaagaatttgacaaattttgaatttgaattttaaccaaatgctaatttttgtaaaacgattgccttttcagccattggtctccccaaaatgcgttttatgaccggcgcaacggacggacaattcgcaatttggacggacatttcggaggaggtcaaagcggagaaacgcgcggagcaaacaaagcggacggaagacgagcaacggttgtccaaccttttggaccaggacagactcggcgatgcactgctgctcacgctcgacttaggccaaccgtttcagtgcgttttttacccttgaaataaatcatttttattaaccagattttctattctcaattggccccttcggtcacctttcaaaacccaattaaacaagaaaaatttaaggcatttaagtgccaaatcttaaaacatttttcattaaatcacaattggcattttaaggtgtttgaccgtgttgaacaagttggccatggatgggccacagtcggaggaatccgatgccaaacttttggcactgtttcgccgtctgagtgccgctcagctgtccattctgttggactacgccgcccaatggaacaccaacacgcgaacatatgcagtgagtgggacgaggggaaattgggcgccaattgctccgattcgctcataattacccctaacctagtccaatttgtaaagtttcaatttcccgtggctattaaatcttcattcacttttcaggtagcccaattggtgttgaactgtgtgctgaaatgtg

SEQ ID NO: 22248 - DNA, 1592 bp, Heterodera glycines
  misc_feature (35)..(35): n is a, c, g, or t
aattctttctcttctcctctaatcctccactcatnttcttccattattaaccccacaaaatgtgtgctgagtctcctcaattgggactttgctggaatgggtgttaatctcagcaaaaaatgtattggtttgacctaaaaaaagacattttctgaagggacgccattcaaacaaaaaatagatgccaaagaatttggaactggcaaatacaataacatatatatatatattatatatatgcatggacactgatgagagtaaattaatttgaaaattattttttgcgattttcgtttgttgttcaaaatgccaaaaaaatttttgtttgttttcccgtctctccgtttttcgccattcattaaaacttgcgaatacatattctctggaaatggcattgattaaattatatctaaaaaataaaaaaagttggactatattatttttgcgttcatttgagccaaaaatgcacggggcccaaatgcctctgactcgattgaggtcaaaccaataattttgctaactaaccaacgcccattccaagcacaaacagagtgaggggtcagcagagcacattttataagagttaataatggacggaaaaatgagttggaagaggaggaggagagaaggaaattatgtcacgaagtcggcagtaggctttaatttaaattggtaaaaaatccgaagtcggcagtaggctttaatttaaattggtaaaaaatccgaagtcggcagtaggctttaatttaaattggtaaaaaatccgaagtcggcagtaggctttaatttaaattggtaaaaaatccgaaaaaaatatttttttaaatcgtctgggcttgttagaactcaaccaaaatattcgatagtattttttcgattaccatgagaaattgcataaaatatggcctaatacgcacgaaaatcgagtttttaacttggtttgactcttctagcttgtcctttggcacatttggcatttgtgagaaaagtcggaaaatattgatcataggccccaaactcaaaaatgcttaaaaacggtcagaattgatgtaaaaaggtttgaaatgggttggaaaatagaattaggggcgcgcttgccctttttcaggctgaaaaagtgccggaattggagtgccaaacttagctgggactcaagttaccgcactataaaaagcactcaaaatacattttgaataatttttctatggtaatttttggcgctgatcacgaatatgacctttattttgcaaaattccgaaccccgaacccaaattcgaacaaaaactcaaaatttttaaattaaacgaaaacatattatagggggttttgaggttgctgaacacggttatgacatccattttgatcaaatccgaaccctgaaccctaattatgaagcatgttggtcctcaaaatcgttaaaactatttttaaaccagcaatcagaaaatgctaaaagaacgtcaaatataaaagattgaatttagcttattgcgctaaaaaaccgccgcacactcgactacggcggccagtaggtggggcgagactacggaagaagtccgcgcgtgatccgcaggcggttgactgattggcgg

SEQ ID NO: 22249 - DNA, 773 bp, Heterodera glycines
gggggaaaggagaaattaaaggggggagagaaagaggggggatgaagcgggagggggggggggaaaggagaaattaaaggggggagagaaagaggggggatgaagcgggtaacatctgtaaacctaggggtcggagcaatcatgtcccaaattgacacataataagagacatgcgaatagcgcgaaatgacagaaaaagccaaatgcgagaagtcaatatatgcaaaagtgctaaaatcgaagtgctattagcgaaattttttctacaacttgttaatagctaaaatcatacagccaaaatcattttttaaaattttattccaaatgtaagaatcactaatacgcttttttgaggctcgctttttccaaaaaaactttttggtaaaagggggtaggctccgccggaaaaatttttgaaaatttgattaaaatttgttgacagattttcactaaacaatgatcaaattttgcgatttttatataatttttctaaggagaaataagagctgtggcgcgccgttgagaacagcttttcatcaaattaccaaattttgcgattttgggccattttctaagaaaaaatacgagttttgggggcgcggcggtgccgataggcgccgccgcctaaagaaatcgcaaattctgatcatgtatatacaggttttcactgaaaattatccaatttataggtaaaattttgaaaaattttatgcgaattttatccaattcttatgggtgtaaaagtcgcttctcgcgccaaaaagcgaaatgcg

SEQ ID NO: 22250 - DNA, 1133 bp, Heterodera glycines
acctaacaaattttacgtggcgaaatcatgaaaaccaaaataattaaacttatattaattcgtcgaaaaatgtcttaaatatatttttttgatttgatgttttaaataattttttctgaaattttcaaaaacatttttttcattcatttgagctgcgagttggcgggcgcgtgcgcagacagtccctgccgcaatggtggcgagtgtgtacagctcgcagacgacggcaacaagaccaacaacaataagtacacttgccgctgcaagcgcaactttcgcggcacacgctgtgaacagcgcgtggacgtgtgcagcgagcaggaaccgtgccagaatggcggcacatgcatgccgctgcagtcggcagaaagcgacggcgacggcgacgacggctttcgctgcacgtgcattcccggcttcacaggtacagtttttttgctgttacaatatctgtgtaaagtataaaatacggtatttttctaaatttttttttgatttaggtattactttttgtatattgatcaattacccgcaaaatataggcaaaaagtgtgaagtggacattgatgaatgcgcgccaaagccatgtctgcacggcggacattgtacagaccgtgtgaacagtttcgagtgttactgtaacagcactggatatacggtgggtaaattttgaaacaattaaattaaaaagtaccaatttttccaccttaaaattaagtgaaggggggggggggggttgttgtctaggaagggggcgggggggtgccaacaccgaaaacccaaaatttcaaacaaaatttcaaatttttttttccttaaaatttgggggagcggcgcccgaaaataatgcccccgctaatcaaaaataaattaaaaaaattatttaaagaaaataaatttaaaaaaataaattttggcacggcacagggcctccgctgtgagaaggacattgacgaatgcgctgctggtgaccatcgacgacatgaccaaaataacatttgcttgaacggcggccggtgcaccaatttggacggtgattaccaatgcgagtacaggacaggtgaaaaacaaaaaacgcgagaggggggcgggaagggttggaaatttttaaattatcacatttttgtgaaaat

SEQ ID NO: 22251 - DNA, 1688 bp, Heterodera glycines
gggggggggggaatgcgaatagttcaattaatttccgggctaaatttgcaatgtttcaaatgaaagaacagttaagtctttaagtataggagcaaaaaaaaattggataaaaaacgcatctcaattgtccatcaaatttgttcttttagcttccatcatttgacccgttccacttttctatttcggttttcccttgccgcctttctttttcgttccaaacaactgaggcagagagaagcgagaagtactgctttcggtggtcttaaacttcaatttatatttgcaaattaaaattttttgttgtttacgacggaagatttcttcgagacagtgtgagtgcggctggtatcgccgggagaagaacgacgtgcggcgggcttaaactccagtttaatatgcaaattaagcattttattttttacgccggcagatgtcttcgagacagtgtgagtgcggctggtttcgctgccgccctgtgtgtgagtgagaccggtgccgacgcgttccttaaattagagttaatagttaactacattacaaattattttgttacttacgctgcgttcctcaactatgtaagtggcaggacgtccggtgccctgaaaatcgattcaatatttgttcattattgcgtaattcattgtttaccaaagcatcctcaagtgcagccaaaaactgatcaagacaagggtcacgagctccacgagcactagaagccgcggtcttcacagcttcccagaaagtgcttcggcgcgcatttgcatatgaagttttgagcttttcaacagcctaaaatggatggaatgtgttggtcaaattatgattctgaagacaaatcccctccaaagacatactgagtgataaaatttagccacccgcagagacacaaatttatgtaatatacgggaggaggaatagatacaagacaaatcatttcgggaattgataaaaagtgaaatttcatacaaaagttcggggggtaatcgctttgggaccagttttttagttggggacattgtgttagaaaggcatggtaaatgagtttaaaaaagcagaaacggtcaaagaaatagctcaaagtggagaattgattaaaaacaacgaaaggcaagaaagagagatggacaaatgacgaaatagtggacggaatgggccagagatggcgacgagaaagtgttgttctctgtccctttcgtcgtaccacacacaaataattctcccctctcattataacacccattttaaaccaaagcctaaaactgaataagcattctgattgtcccgggttctggcacttttttaacttatcctacaccttcggccattaaaaattgtttatagaattaaaacacctcctcacgccacaaatcggacaggttgatgtgcatttgctccgcctgtgtcttcagcgcttccaatccgcgtttgtcatcgtcgctgagttcgcccctttccaagcgactgaaaaccaacgaaaacattaaatattattaatcattttaagtcataaaaacactatcataaggtttcactgatcttgataatgagagtcatttcgaccaatcataaaacccggacccgaattcgaagaaaagttcaaatttcgcttttttgttgtctccgttttttccgtgtatttaagccgattttatacgaaaatgtgaactttcagtttttttattcaaatc

SEQ ID NO: 22252 - DNA, 1712 bp, Heterodera glycines
ttcccctatatgcaaaaaaaaaaatttttttttgctttttattccaagtatatataaaaaattgtttataaacaaaactttattttaattttttaattcatttttatacacaaaatacacaataaaaatattagacaaaatatgttttttttcaaatcgacatgatatttagtgcatcattcatctatatggttaaggcaatcttttaatttttatggattaaaattaaaataaagattttgtttcatattttgataattaactttgtataaaaagcaaaaaaaaaattttttgcataggggattcgaacctgagaccgaaaaaaacttgattaacacactacctctacgccactggttactgttaggaggactaaataattattccttttctttaatactaaaaaaactaaaagtttggcacgtgcattactcagaactgtgcaaagtaagaaaagggctttaaaacccatttaattgaactttcattatggacatttttatcaaatatttgaattttctcaaaattctgacgtcacttccctgatcagaatccaaagtgatcagttcatcactgcagtccctcaactccaattctccttccaaagtataaatcaccgtttttaccattgttatgcccaattcggcctttcttcaatccaatgggccattcgatgaaaatgacctaatttcgcaaaaattgaaatagaacaattgaccagtgccgatcatttttgacgagagcactttcgaaagtaacaaactcataaacagccagacgatggaattgctgaactaattaatataattattaatttaaaaattacaattttaatttttgtaattttttattctgaaacaaaaaaagaaattgcgaaataaaagcggaataaaccaaagtcgtcggcgaactggacaaaacattaataaaagacaagtaaaagacacttcagcaaggggaaaggaattcacccgactcaacggcataaaccatttgttttcggcaccttattgtccgatgtcaaacggacaagccgaacggttcgtagacacatttaaacggacgtgtcgcaaattaaagaaagagggaatcaccgaaatgttggacacctttctggccacgtaccgtgtcacgccgaatgagtctttgcctgaatgcaaaagcccaggggaattgtttctttaaaggaaactccgatcgacattggaccttttgaaaccaaaaaaccgtccaatcgtcatccgcgacgaagcaatggaacgaaagttcaatcggcgccatggcgcgaggccgagaccgttcaatttggacgataaggtctacgcacgacatcgagtgtcacaggattggcgacccgggcgcatcactcagaaaaaaggtgtgatgtacgacgtcactttccaggacggatcaacaggacgcttccacgcgaaccaacttttggttcgccattcagatgataatgtggaagacgctctggacgtcttgaatgacgccttcagacttccattggcaccagccaatcaacatcttggcgatgttgtggcacaaccagtgaagaaatggttgaaatcgcgccaccatctacgcgtcccggtctgccacaacagccagacgaagtcatcgaagaaagcgccggtcagccgattgttcagcacgaaagacccaagcgaaatcggcgtccgcctgaccgatatacgcccggatgataa

SEQ ID NO: 22253 - DNA, 2325 bp, Heterodera glycines
  misc_feature (2126)..(2126): n is a, c, g, or t
  misc_feature (2259)..(2259): n is a, c, g, or t
  misc_feature (2270)..(2270): n is a, c, g, or t
aaaattaagccaatccgaagctgatcgactcagtgcagaacagttgctcaacgagcacaaacgtgactttgatcgtcaatatgaggagaacaaggcgcgcttagagcacatcagcaacacggtgcgcatatggcgacgggacaaaatatcgccgcagaaattaaaaaaaaattattctgaaaaagtttcagttttttttaaattttcttataagaaatttatagctttttgtttctaagtttaaaaatttttcttttaaatttctacggcgatattgtctcggcgatattttggggtgcacccgcgcatattccccgcgctttaattacctatttcaattggtgctaatcgtttcgttaaaatccggcattttagcgaatttttcgacaaaacttggcataactttacttaagggcaatcaaattttacattcttggcaccattcgatagccagctgtttcactattatcctataaaagaaaaaaaaattttggtcaattttagaaaaagttatatatgttttccattctaatagagaaaaagctgggctatcgagtggtaccaagaatgtaaaatttggttgcttttaagcaaagttatgccatgttctgtcaaaaaatagctaaaatggcggatttaagaaacgacccagcacgtttcaattcaaatttattaacttttttaatttgccagatttcttccatcgatagtgccctgcccgcattgaatctggaagtttgcggtgccgactctgctccatgcgatgccgtgtgtggtggacctggtccaacctgttcacgttgtggcggttcatcgtgtccaggcacattaaatttgaaaaatattaaatattaacgcaacaattaaaaattaattttaatttcccattatttaaattgtattttacattattatattaggctccgtatataaagctgaacaagccaaacattttgcacacgaagctctcgaaaaggtggagacaaagcaaaaagaagctgaagaggtgaattatttttatttatttaaatttttgtttttcattaaatatttaaaatgcgtttattaattaatctaataataattgtttatataaagcttctgaaaaaagtgcgagatgttctgcccaaaacgcaggaggcacgcaaatcaacagaaaaagcattggaaaactccaaaagagaggcaaaattataacaaaaaaaaagacgggaaaatgacaaattttaaaatttagtccgaacgtatcaacaaaacgcatgatgcattggtggcacaaattgagcaaatcaaaaatttccttgaatccgaaaggcataggtcaaatttacaataaacaatttaaaaataatttatttaagcgaattgtttaattttagacctgaagacatcagggccaaggttgaacacattctgaacatcacaattccattcaatgaggaacaaattcgacaactttctgaaaacgtaaaaaatgattgcacctttatttttctaggaaaacccaaaaaaatttatgaaaaattcgccccaattttttttttatttttaaaaatcattttttaattagaacccccccccccccccctctccctcccctgaaataaaggaagcccttttcaagaggtgttgaaaaatagaccatagatgggctctaatccagtaatacggcatttcccccaattttcgtttttccagattcgccaaaaagtttacgaggcaaaagagcccgagaaaattttgactgaaacgcatgccaacaaaacagctgcttcggagttgcaggcaaaggccgagaaagccagccaaagggcagcgtcaatccacagtaaaatgatgaacattgataaaaattgaaaataaaacactgaaattatcaccaagatgtcacggtcggcatcaaggagtcgctggacaaggcggaggaggctcagaaacaagcgcagatgacactggacgaagccaatgccagcattgaaaagacaaagtcaccatttacgggagcagctcgcccccccccccccactgccgttaccgttttaaatttaaaaaattttttaaggaaaaaaatcagaatttttttttctaagaaaatttcaagaaaaaggaatatacactgggactanaaatcttttttttccgtgcccctttggcaaagtccaggcggggccctgatcccattcggtctacaattgtgtatatgtaaattgaaaaaatttatgtttcttcaggtccaccctttctttgacagaagatgangtcaaatcatntggagttacgtgttgacgaagcacccgatcgaactcggaaactggtcaacatgac

SEQ ID NO: 22254 - DNA, 1639 bp, Heterodera glycines
tgcaggtcccaaaaaaaaaaccccaaaatcaaaatcaaattacagccaaagagccaccaaaacgaacggaggccaatgccaacgatggagagagcgagagagaatctgccattttgcaacaaaattaacacaccaccagcaaaaatcaaatggcacccaaaatatgtttgccgaaaaatccaaaattggccatttggcatacccaaaaggcagccaacacaaattctcattttcattaagtgccgcaccctgtttttgttggccgccccaatttggcaaatttaaaaattctttggcctgcggcccatttattttcagtctggccaaagatttgaagaaattttgcataaataaaataaattttattatcttttttatttgagtttcacattaaatgggcatgcatttttaaatataccaaattttgctggctaatccaaaaaataaacacaatatttcacaattttatcagtttttggggttccattatgagtcagcgcatgactattttagcaccaaaaaaagccaaagatcattttgattcatttaaatattattttattttatattttaacaatacattatttttatttatttaaaaactatatatttaaaaataatattttttatttaattaataaactttacaaaaaaattaattaaatatttttccatattctcaaaaacaaacatttgcattcaaatgccgagaaaaaatggtgtttgcgtgccactaaagcttcacataattttttaaattctttttttatcaaaaaaaaggattaaaatttaaaaatgaataaattaaattgtgtttaccgcttctttccccccacataatctcaattttattgattcaattgatatatgtacttaggtaggtgtagtttcttcttcaaattacgcgttcatcagggctacatgacatttcgcctactcgacatttcgcctactaagccaaaaacattcatttcgcctactaacccaaaatcggtcatttcgcctactgtcatttcgcctactattcatttcgcctactgacatttcgcctactttcatttcgcctaccaagccaaaaacattcatttcgcctactaattagtaggcaaaatgaatgtttttggcttagtaggcgaaatgaatgttttttgcttagtaggcgaaatgaatgtctttggcttagtaggcgaaatgaatgtttttgggttagtaggcgaaatgtcagtaggcaagatgtcggtaggcgagatgtcgagtaggcgaaatgtccgtacacccatattttctctgttttcattcctttttttggtttccgtttttagtctgctctgaaggtcctccaaacaaaaacgtccgggggagaaattgagcaaagtgcgacggcgggagctcactgtacaaacaatacgtgcaaaaaagtagaatcaaattagataattaaaaaaattctaattgtttttccatttcatgtgttcaccggtcccgagagcgatgccgaagaatgcgttttccacccgggcaatgccgtttttcacgaagggctcaaatactggtcgtgttgtgggcgcaaaaccaccgattttaccacatttttggaccaattgggttgcactcggggcaaacactgctggaaaaaggt

SEQ ID NO: 22255 - DNA, 1278 bp, Heterodera glycines
cctttttgtctccccctgaattttttttaccttgttccccccattttcgaaaaaaatgaaaattttaaaaagtcgttaaacccagggctcggatcgacaatttttcaaaatcagaacagattttgttttgcgaaactgcctccaaattagttatttttaaaattattcgatcaataatgtattattttttcgcctccgattgtcgaatttaacgatttttggggaggaaataagcaaatcgtaaatttcagtgcattcgggatcaaacaataagatttttaacaatttttgcgggtgcagtttttccataaaacttctggtgaacgggcgaggggagggggtccggcggaaaactgatttgttaacagaccaaaaaaggccaatttttccaataaaaggcaagcaatgactttttcaaaggaaagatttgattgtccggcttgttatttgtgattttttgaacgagttctgtccttatttgtgaatttcgtcatttttgtaccagtgttacctatctcaggaattgaaacagaaggaagggcacactctgaatttcagtttatctccaaatttgggcggctaacattcgaattccaaacgaaatgtgtgactggtagacttataggaaggaccacttttgtctaaaactcattttgacctgaatttacaaggagtgagcagaccgagttctacgcgagctaaccctccgaccaaacagacgccaaattttaccaccccgccccccttcctacaaaagcattgaattgaagcacatatgagcatttattaagcacaacaacaatacaattacataggcaacaattaaatatacattcatttgaagtgatgatcacagaaatttacatacagatacaacaatttacatgatgggggacaaaatgacaattttgggacggtgggatgggtgggatcctatcatgtccatgttgaggtgacgaagcatccttccatcagacgttgtactcgatcggcaagttcttgcggcgcaccatcccgtctccctggaaccactcgagcttgaacgcggtggcggctgggtccggcgtgttggtccactccacggtcacacggtcgcccttggtgtcctcgctgccggggtcgaaggcgtcgcaggagacggccacgttgacggactcctttgggccgagcactccgttcggcgggttcatgttgatgcgcttccggttggtggacttgaaggcgtaaccgatgcgcttcctcccagggttgatcccctgaaggggggggggggggggg

SEQ ID NO: 22256 - DNA, 1922 bp, Heterodera glycines
tttttttgggaaaaaaatttgatttttttccgggaaatagaaaaatttttggctggagcgggacatttgagtcccgggcccatactcgttaggggttggttttatcgaaaaaactccttcgggcaaaattgtagactttttaagctctatcgaatggtgtgccatatggccggaaattttcaaaaattttcgagctaggccccctagaaattttcaaaaattttttttgggttgaaaaagagggtgaaaaatatttttctggggtaaattagggtcctgagcacaaatatgatgtttattttaagtttcagattttttggaattttttaaaaattcgaaaatatttttaatttttttggtccttggaaatttgggttaaaatttgaaaattcataactcaatgaaggactgctcaatttaagtgaattaaagctttaaaaatagcaaaaaatcgggagaattttatgaggtttatttggttttataatgttcaaaagaaaaaaagttattccagaatttctggaaattttcgatttttcagaaaaaaattcataactcggttctgaaaggtcatactgtaaaagtaaaatactacaaaaatccgcaattttttcctctataatataaattttattttacatttttatatcttttttgcgaattgttataaaaataaaagtgatttttggtttcgggaccataggggggtgaccaggatttttgggtggaaaaattttttcaccgaaaatattccaaaaacatgtctttaggggtattttatgacgctgatcacgaatacgtgatcagattttacttttgacatcgttcagacctcagaatccctgtgtgattggggattctgaggcatcattttgaggggggggggggaagttcgaatccgggcggtgtacattatttttgctatgcatttttggttagttatttttaatgtttttaattcatttaaaagagtgtttgtttttttaattactttttaatttaaattaaattatttttttgtgaaaaattttttaaaattaattttttgtttgattaaagaatttcatataggcgaagttcggacccgggcggtgtacattatttttctttgtatttttgggttatttttaatgttttaattaatttcaagatttttataaattatttaattaatttatttaatttcattatttattttttgaatttataaaaaatgaatttcatttcaaaataaatattcaattattaattttcaaaattatatttaatgaataaaaagagtattttattataaaaaaattttaaattaaaatgcaatcgatttttataaaaacttttcattatttatttaattttaaaccatgttgtacctcttctaatcacttttgtacctcttctaatcacttttgtacctcttttatcacttttgtacctcttctcatcactgttgtgcctcttctaatcaatccctgttgtacctcttctaatcaccgttgtacctcttctaatcacttttgtacctcttttatcaaatttgtacctcttctaatcaccgttgtacctcttctaatcacttttgtacctcttttatcaaatttgtacctcttctaatcactgttgtacctcttttatcaaatttgtacctcttctaatcaccgttgtacctcttctaatcacttttgtacctcttttatcacttttgtacctcttctcatcactgttgtgcctcttctaatcaatccctgttgtacctcttctaatcaccgttgtacctcttctaatcacttttgtacctcttttatcaaatttgtacctcttctaatcaccgttgtacctcttctaatcacttttgtacctcttttatcaaatttgtacctcttctcatcaccgttgtacctcttctaatcacttttgtacctctt

SEQ ID NO: 22257 - DNA, 2664 bp, Heterodera glycines
acttgtttatacttttaaagacttttttattaatacagaattttttgaaatttcctaaaatccgcaatcttgcgcaggatcctgcagattttaaattcaggatttgcaggattgtaggatttgcaggattaatcctgccgtatcctgtcctgtaaaaaattttgaattccaatcctgcaataggatccgcaaatttgaaatttccggtctttagtagagaccggaggggatcgggatcccgcgggatttcttcgggatcccgcgggattaaattcgggatcccgacctcgggatccgtcccgaaggattttttaaattcatcgggattgatcgggatcgggatttcatcgggatcccgaaccgggatcccttccgaccattttaccaatcacgcgggatcccgcgggattgaagtcatgataatttttccaaaaatctccattttttaattaatatcttgaattttaaattaaaaaatattgtcatttgctaatttttcttaaaaaatccgtaaaaatcccaaaaatttccacagatctccaaaattccaattaaattttcaaagtttaacgtaaaagttggtcattttgtgacttttatttttttcaaaaaagaattatcaaaaatttttttaattcctaaaatattattttaaaacttttaggtaatattatgacacaacaatttctaagaattttgtgaaaaaattagattagaaattgttgtctacgtatttttccttcggtgcatatctgcagcgccggactctaaaatccttattttactgaaaattttgctcaaaatcgcttaaaaattttggtttttttggacaaaatctgttaaaaatcgcatccaaaattacaaaaatttttcccggcggcgcctatcggcgccgtcggcctccacctggttccctaaagtttttgaaaaaatctcagcaaaaaaatcataaaaatctgatttttggctccgatgcacttaacgatttgctaattttcctcaaattgttaaaactgatcataggaggcgaaaatataaaaatttatattaattaaattgtaaaaaacaatttaaagctatgttgttaaatgttctaatcctaaaatctgattttttaggcatgatattcgaattttgaaaattttctaaaaacctgatataattcccattcctatttttcttcaatgggattgatcaattataaatattagagaagcattataacaaaacttgacacaaaacgtaaaaaaaattgagcttttgcaaatcccgataatcccgcgggatcccgaaaaaaaaatcttcgggattgatcgggatcgggattcggtcgggatccgtcccgatcgtttttacgaaatgttcgggattgatcgggatcgggattcagtcgggatcccgactcgggatccctccgaccccagttgtccggtctctagtgttcatgcggtggaagttgcgaaaaagggcgagagaatgagtgcacgtggtataccgaaaagaagccagagcatttggcaatagtgtgctgcaaaaacaaatgaaactttctcgctgatctgtcccccattactccctctttttgttggcatccaaatccaacaatcatcgcttacttttttcttttatttgtttcaaacggtacggaacagacgataaaaaaatgtttgtaaaaataatttacaaatttttttgaattaattttattttaactaacgatatacaaggaaatctgccattacttcacttgattctaattagttgaactgatccaacaatttaattttagtccctttattattgtgccgatttttgggccaatgtgccaaagaaaacccatttttcggtcgtttttttggtaatgtttccaattgctgaaaaagggaggaggcctagctttttttattttgttgttattcaccaaaatgccattttcttttccacgcattgagaacagaaacggcgccgcgattttcttatcgcactttgaacaaagaaaataaaagtaattattattttaattaactacaaattatcaacaacaaaacaaaatttgatttttgagtcgcccttttcattattctcaattaatgaatgccattgcactaattttaattgccctttggtcatctgttccgtgccgttcccttctaatggcgtcgttttgaatgcactttgatcactggtcactaattggcctaattgcgccatttatccttccccaattacacgcccatcctcactaatgaccagtcgccgcccattagtcactctcattccatcgtttttcctccaacatttctgcttttttcatttgtttaatgggtgtaattgaattgcttattaatgattcgctcgctgccattagtactccccgttaatcagtggtcacccaattggccgtaattgtgaaaaatcggctaaatttgctatttaaatgacccattctctgtcaattagtgtccctatttccatttattttaatccatttcttaattaattaatataattaaaagattattccaatattggaatttccatattttccattcttagtataaatgccatttttcccattttttaatccgttggatggacaattttcccaaagcaaaaaattaaacgagaaaaatgaatttaaaatgggggaaaaattgtacaaaa

SEQ ID NO: 22258 - DNA, 1741 bp, Heterodera glycines
aaatatatattttttactttcaaaaaataatctataaattaatttgataatctacattaagttttctattatttattatatatatttttattttatttcaatgtaatgcgtttttttgcacaatttaaaaataaaattgagttgcctttctcaatgtgtactttaaaaatattatattttttcaaaacttgatgaattgggagtcttgtgatgtgtttaaaaattttaatttgttattgaaatttttttttgaaaaattttaaaaggagggttttatttttcttttgactagaatttagtttttattcaaaaagataatttaatataattttaattttttgattttgttttgataattaatactgttgtttttgaatttaatttaaattccttacgtttaaatatttgagtttttaatatattttttaaatatgttcattcgtgtgctataaaaaatgaatttgcttttaataatttattcaaaaattgttctttttaagaataaatcaattttattttttaaatattttcttgtcatagttttgcgcgtcgaaatgattcaaagtgagtaattttataaaatgactcaatttgaatattaaattctaatttttcgcttaaatttccaatttatgggttgatttttcatttttctattctttcctcgaaattgtttttttaatttgttttaataatgcgccttcattaaattatgtttcggaaaattcatcaacttatgaaagaataaaactaaaacgtaaatttaaatataatatgatattattaaagtaccattgagttaatcaaatcttattagaagaaaattccaatatttctatctaattatttaatttttctacgacttgtttaaaaactaaaagaaaggataattcttctatttaaaaattacaaatattatatgagtcaaaaaaactcaaaatatataaaaatatttcaaaaataaacaaatctaatttttgtaacaataaatagaagaatattactcttactaattaaaataatttagttaaataaaaagcttcataaaaattagtattatacttttaaaatttaaaagatcaatttttgtctatttatttcttttttaaataagcaattattatatagcatttttaaatttataattgatcgaaaaacagccgatataattaagatattactttattttttaaaactttttgatgaatttcctttataattattttctatgctaatattactattttcaaatttctttaagtgtttattattacaatagaatttttatttaaaatcttcataacttttatctctcgcgctcgtttctttcttcaattggatgattttgttgggaaaagggatatgtttaatctttgaatgataatttatttttttaatcttatataattctgatcaggtttattaaattgggcgtgatttgaatataataatttttatattatgtgtttaatatcttatttcacataaaattggcagccctatttataagtaatttcgtaacaaattggactcaacttttcaaaaaatttccactatttttacatgttttttggaacaaccaaaattgggtcatttttttgtgaaaaaacataaaaaatgccgttttatccagcagcgacaaaaaacaatatttactgttttttcggcgccgaaaaagccattttatataggcgccgaagtggccgcgccgaagtggcccctcagaaaaaacccgcgccga

SEQ ID NO: 22259 - DNA, 1573 bp, Heterodera glycines
attgtttgttgctacggttggggttgtgtttgttgcaaaagttatactgtgtgtttgtagttgtgtttattactaggttggagttgcgtttgtaattttgttgctacggttggagttgcgtttgttgcaaaagttatactgtgtgtttgtagttgtgtttgttgctatggtttgatttgtgtttggggttgaatatgttactacggttggagttgcgtttgtagttgtttattgctacggttggtgttgtgtttgttgcaaaagttatactgtgtgtttgtaattgtgtttattactaggttggagttgcgtttgtaattgtttgttgctacggttggggttgagtttgtagttttgtttgttattaggttggagttgcgtttgtaattgtttgttgctacgagctgcatttgttgcaaaagtcatagtgtgtgtttgtagttgtgttgttgcaaaagttagagttgtgtttgttgttacggttgggcacctaatttttgtaagaatttcgaatctgaaaattatctttcaaatttaatgcttcaaaattttacatattatctaaatatttatatatatttccaagaattaaaaaatgagagtgtcttcattatcaacacctattaattagttaagcggcggaagagccgcttcagcagtccgctctgttttttgcaccaataacgggttgctgaaaattgggaagttttgcgggtaattaaatgaaggaacgaagaagcgacacaatgcttttggtttctgtttcatgaaaaccacaacagctattttattgacacccctcagcatttgtaatgatcttcaaagagtgactgacttaattaaacacacaaaaaacagctgcaattggttacattttatgggccataactactgaaaacaacaaacaaaatctgtcacacgacgacacaataccggtgggtgattgatattaatatttatatccccatattttttcctggactgggagacctgatattaacgaaaaacatatttattagctttatttgaagcatttaggatagaattctttattcgaatttccatatttctccatatttgggtatttaaaaaatcctctatttctacttagggtggaacataatttttgatacccaaattttttccaatttttaaaaattcataactccgttatttctgcgcctatttaaatgattctttttttattttgttcttcatggtgtcctctttttatattactatcgtttcactttttatttgattgatagatttttctgccttttttcccgaccatgccaaaattgaaaattggcccactaattttcgaaatttttatggtcaaaaaccaaagctgatataacaaaatcttggtttttctatacaatttagaccagtagattccgaatatgaccttaaatggaacctatcttttcaacctgagcttgtactgctccaactccatgcgtgaagttcgagctgtacaggtttgttgcgatcccagagaccaaatataagaccatattcgaactcaaaatacccgatttaccttgtttaattaaattcagaatttcca

SEQ ID NO: 22260 - DNA, 2004 bp, Heterodera glycines
  misc_feature (1979)..(1979): n is a, c, g, or t
ttagcgattttatggggaaataattgatcgaaatttttgatttccaaaaaccgaaaggcctcatttgtcaagcccagagacattttaaaatttcgatttgcaaatttttcaatgtgtaaaaactgaaatgaaatgaactttgacttttaaatttaaccgacatttatttttgtatactcatttccataaacttttttttcagttccaaaaaatataaaaagtgccatcctcgagacggattttgttgtcaccgaatttaacaatgactctatttcggaactgatgaattgtctagaaaaaagaggagcttcaaaattgctcgataatgatgacttgaaacaccgaattgaaagaggtgaatgcataatttaatattaattaaattaatgcccaatttataatcaatgcgaagttaagctcgataaaaccaccgactccgcttaaaaatttgttaagaaaaaaggattaaaacaaaaaaatatgaaaaatttcgtaagaataaaaaataaatttagctttttcttgacgattactgaatttaaaataatttataattttaataattttttttaaaagtgatttcatgaaaaattgttgttcggttggcaaaaatgaaataaaatatatagtaaaaaaaatttttataaaaaaattacggaccggatcccgcaaaatctcacgcggattccattgcgaagagaccaaactttagataggtcgatcacaaaacattttaaaataaaattattatttgaatttaactgtttttataattttaagattttccaaaaagtctgctgaagttgccgccggattggctgcttttatcacttggccaaattcgctcacaacggcaattaaaagcttttgattattctgcgagaaatttctttgcaacatttgataaaaaagtcataaaattgggaaaatcaacgaaaaagaaatgcgttacttggaggaagaagaggatttatgcagcttatgccaaatgttaatggagaccaagtataatattccaaggaacaggaattaaatgctttcatcccccaaaattaaaattttttaaatttaattttaattaaaaaaatataataaaaataaataattttaaatcattaagattttgcttctcattgaaaaaactttggacattgcaaaaacggagaataaaaaggcggcaaaaatgtgctcaaacaaatggtcgaatggtacaaaaaaggagaatttactgaggaaaagcttataaattatgattatggactaaaatacagcagagaaaaacaaaattctttggatgaagtgagtgagtgcttaatcatttatcaaaaaaaaaaaattaatcaaattaaaaaaaatttgccactgatctaaaaatccgacaatttcaaaattcttctctctaattttaatataattgataaaacagttttttcgaagttaaacatttttacaaaggctaacaaacagttgatttcggacttgggacatgttcgaaacttaaggtggatcaaaaaaatgcacaattggatggttgaagaaaattcaaatggccaaaaatccttctttttcgctgttggaattcgcaattatctattaatacattttaatttcttaatcaaattcctttttcaatgcatattatttctgtggaagacaacttgcaacaacttctcacagaaatgggttatacggtcgaagaagttccacaaaatacggtagtgatcagcaatggaattaaatttaataaggacaaattgccaaaacagtatcataattgaccatgttacatagatgaaaatcctttctttattgggatttgaatagatgattagtctcttggttaattaattatttcaaccgtaattatacagtctgtttttcatttagtaatttttaaaaaattttttgtgggtggctcaattcattttaaaattaattagaatgcattttgtaaagttttcaattttttttttcttcanaaattagtttttggtgactctagag

SEQ ID NO: 22261 - DNA, 2058 bp, Heterodera glycines
  misc_feature (2014)..(2015): n is a, c, g, or t
tttgtattgtttatgttgattatgagaatgaaatgcaacgaaattcaacatcaaaatggtaattattattttaaatttaaaatccaattttaatttaaatttttagatataattgaaacgggaaataacgatctggttaacaatcttccaaatgacctttttgctgctgataatcaatcttttgatcagcaaaaatttatcaatgaatttttatgccgtagggaaaatgaaatcggaaaaactatttcaaaattggcaaaaaatattttatatgaaaaagcagaaaaaatgcgaaaagatttttgtgaggaattgagaaaaggaaaaagcattgaaaaagcaacacaaaaagtgggaaaagcggcaataaaattggcaaaagaattggaaaatgatgaaaatattaaagaaaatattcaaaaagcattgaaaaataaaaacgaaaaaataaaattggataatgcaaatttaaatgagttgaaagaagaattagccaaaaattattcagaagaaaatatgaataagctcaagagccttttttactcgaaacttcatgaattttttgcatcaattaaaggtaattaataattaattatccattgattaatggaaatagattttttgaatttactgtactttattcaatttaatactgtatgagtctttaagttttatccttttttcaggttcaaaaattgaattctttgaaccccataaaatcaatccgtcgcattttaatggccgaagacaaaagcgtgccaatgtccgtgaattattccaaggcgcattccaacgaatccgtcggcatggcactctaatcgcatgcgttttttatgtttttgtcgcatcgatttcactttttatagtgatttttctgattgcccgtttggttttagtaaatccggcagattatttggcatggcttctgatgctctggcttttttatgtctttttgcactacagcaatgaattcatcaaagaatgcgccgactgccttcgcaacaataataaccaaattcactcaatcgaattggcggagaatggtcccgctgctggtggtgctaatggacaataatgaattgatgtttaattaaggacatgaaactgacgaatgtgtgtgtgatactgtattccttaaatcgtagttgtatgaaactataaatatattgtatcatgtaggtaaacattgtcacatgtatttttagatgatgtatgtgtgtgtgtgtgtgtgtaaaaaatgtaatttttgaaattttaacttatgacacttgaacatcgagatcacgcacttaaacaaatttactcgagaaaaaaagtcatgaaaatacatttcatctataaatattgggtattcaaaaaatgataacataattgaataaagttaaagcaattactaatacctaaatagcaaaataaacaaaaagtgaatcgatccatccatcatcatcatattctataacccagcaaaataaaattatacgcaaaactgataaagtatgtttgatgctgtgtcactgtcgacgcccaccctataattaaaaaaaccaataaataaatggaaaacattaaaattttgtttttaggtgggtttttaaatagttaaaaaatgttaaaatcatttttcagcgaataataaaaataataagtaaaattctactgaatgtaatttcaaaagttcatatttttttttctataaactgcaaaaaaactttataagactaaaaaggcaatttttaattttttttttatttactatttttaaaaaatttttgttaaaaaaatttgataaattcggtcgtgattatagtatatttcttaaaaaaaaattaaaaattccttcttgaaggctgtgtattttttttgtttaagaattttttttaaatgcatgctggtaaaaatacaaaaattacatattttaattacataaagtacaaaatgggatttttgggagacgaattccgcgttagttaaaatggcttttgacatttttatttttattattttatggcattannattttgtttttttttcatatgctgctgaccgtgctcctccacg

SEQ ID NO: 22262 - DNA, 1955 bp, Heterodera glycines
attgtttgaaataattaaagaaatttgtttgaaaattttcattaatttaagtttgctttaacttttggattttattaaataaaaaatttaattttgtattattttcacttaaaataaattaaaatttgaatttttttaaaaaattttgaatttttttgaatttttaaaaattcccggttggtcccggttccggacgaaaatcgaggtcccggtaagtcccggtcccggttttgcctaaaattcccggtcccgaccgacgcactctatatagaacacttagggctctcgaatgatatcaatagggttgaatttggttgataattaaaaagttatagccaaaaacatgctacgaaaacgaccccggctccaatttacctattttgatttgtagtaaattggtttggctgttagtgaatcacacaagttttgtctttaaaatcagctctttttgggccaaaaatgcgctgatcacgaatctgagctaacaaatcagatttaaaatcatttatctaagatttttgtcaaccacttgatttttcctattttttaaattattaaaaagtttttaatggagatcttgccgccggaataacaacgcgaatttttctgtctccgtcccttgaaaatattttgctttttgtataataatttattaaacatcgtcttttgcatattggtaaaaaacataaagaactgaaatttccaaaacaacaaaatacgccgtttcattgtcaattttaaactcaacaaaaaaaaagtgccgtccaatgacaaatttctcgaaaaccaacaaattcctgccaacgttgtccgtccgcctttccaattattgtgtttcgccttttcctttcttcgcagtttttttgggacggttcagcagtgcttcctcgttctgagaacaaaaaatgtaatcattgaaattctcaatgcttttgccaacttcgtccgagctgtgccggcggaacacctgaaacatcggacaattcattctgctgctgttcaacaacggacgaattcgatgaggactgaccaccggatgagcctggtgctcatgaacggactgtgcaaacgaagcaaggtatcgaagaaatgccgggagtttttttgatgaaccactgactctgaccaagcaacgaacagacaaacgtgtccaaaacttaattttgattaagtaaatactgttagcatatatgttatataataaaatgtccatttatgtagcatttacaatttccgaatgaatcggccttttcttcggaggcgcaatgttcagcgatcaattgggccaccgattccttgaacaccgaagggggcagaagcgcaccactttcgagcccatccgaacgcgtcgctgatacacttttgcccaaactttttgcgagagctgtacatttaaaaaaaacattgaatcaaataataatttttggatttggtatcaaaattcaagcaaagttacgcactgtcaatgtggaatagtagagcatcgttggtgcgacaggtgtccacgaaggcgaacaatcttttctcagcactgcttaactttccatagtgcaccttatggagacccacaattattttccttgcctgaggccctctttgttcgtacagagagacttagttgcagcaatttgggcatttaatgaggcaacgtaataattcagaaaatgttaaaaatgcaaaaataaaacccaatcatgaagcactcacacaatccaaaatgttccttcaattgagaagacagtttgggcaacagcgcgtcgaatgagtttttgaatgttcgaacggtgaacggatcagcaaccgactgaagcccagcgacgccatggaccatcaggaaatgttggagcgctaatcatttgtttaaatgaataaatttgaccgcgcatgacgggtgcattccacttccccgccctcagataaaatttttaaatttcaaaatgtttgcaaatttttaa

SEQ ID NO: 22263 - DNA, 2162 bp, Heterodera glycines
ttttgagcgttcatgcctgccaattttggaaataatactgccgcttccgatcatatggtatcactacctgaagccaattgagcaccagccgattgctttgcgcaatatttgccggaagtggcgcgcccgccgtcgcggaagcggtcgccagcggcgccgtccggtcgcagtcgccttccgcgccgtcctcctcctccccaattgccgcaccaccgaccgaaacaggccctttggacagctccaaaagggcggcaactgaactggccgcatccggcgtgtgtttaagtgaagcggcttaaaactcgaaggtaactgcgcaaaaacggcacaacgaacatctccgaaaattggaaatgccattgctaacggcgcctttttcttcgtgcggcgaaagagcaccgccccttttttcgtgtgattggaagccgccattctgcacaacgcatttgcgcatctgaaaatgttcctgtcatgtcaaaacactaaaatttagaaatggtatttgctcctctcctagtgatttttttctctctctctcacacactatttcccccctctccccaatgttttttctctctctccgctctctctctcaaatgcttttcctcacatgtttttccaatgtcgaatggacagagaatggcatttggcaaatgttgcagttgtacacctccttgccctgctgtccgtgggtgcgcatgtgccgtgtcaatttgctgctctgcgcgcaagcgtagggacaaagttggcacctgtggagaggataaataattcagtcttttgccaatctccttctcccccccccccctcctcacttgtacggcttttcgccggtgtgcgagcgcaagtgaacgatgagattggaacggttggtgaacactttttggcaaaacgtacacctaaaaaaaagtttgtttgtgatgccttttgtctgcctttttcgatcagttcgaaatgccccttccgatcactccattccgtcagttttaggtccgatcacctgccctgccctcctctccccttccgctccgttccccccgctttgctcaccggtccttccgcgctttcgggtctcgcttcgccgccggttcgcacggcggctcttcgtccccgtcgacgacgatcaaccgatcgctcagctcgtctccgtccccctcgccttccactgtctgttgtccttcctcctcctcctgttcgtccaatctctgtgcctcctcatcttcaggtggtgtgcccggtgtgtcagcatcgtctgcaaatagcaaagtcaattaattttaataaaatgctttttctcacccggaaaaacggcgcccgcggcggcggcgccaagcgaagagcgcggagtcaaagcggaggccgagacgccgtgcaaaacattcgcggccgaacgacttcgaccggacggagtcagaagacgcgagcaaactccgccggggacgggcgacacaaaggcggaggaggaaagagtgttgggcgaagtctgaacggacaacacaaaatggcatggtaatgccaacgaataacactggactgaccattgaactgctcgccgccgtcgtgtggtgcagcagcggcgaccgtcgcctcaacgccccggggctgggcgttaccgcggagccaccggcgactacgcgcaccattgacgaagcggtggtcggtgtcgcgcgttggtgcgacggaatgggcgtcagcgaaaggggcggcgggggcgagccgagcagcgatttagaagagggcaactcggcggaaacaacatcctgtttattgcgaatagatgacgacaataagaatttcaaatttgtttttctcaccccttttggcgttccgttgcgtttggccaccgcggcagccatcaaattggacagaaaggcggtggaagcggcagcggccgcggacgttgttgatgacgcgggcggaaggaacggaattggcgtcgcgtttccgctggaggaggcggcgccggcacttttcgttgtcaccgcttgcaaaagggcgccgacggcagccgcctgaaaatgccaaaaatggtgaaaaagatggcacggagtattgaactaacattttcacgttgaatgttctgctgtgtgtgctgctggatgtaatattgttggatggcagccaaaatttggggttggaacaaatcgctgacagtctaaaca

SEQ ID NO: 22264 - DNA, 1717 bp, Heterodera glycines
  misc_feature (1597)..(1597): n is a, c, g, or t
attattggtgataaatccatgttctgaatggtgtagaacctatccataagttgttttagaatgggctttaaaggtaatgagtagggccgcaacttttagtgatttaactatttttttgctcaattgttttgaagaaaggagctcaaaaaacgcatttctgcgttgaaattttccgattcggatctaactatcggtcactggaaatcactattttggagcttcgtcactaaaatagtgaaaattcactattttggcgttttgtcactattttttcactatttcggaattttttggaaaattccttaacaaaaatgcaataaaaccaaaaaaatacacccctaagaatcgacctaaaaatttttcaaaaaattccactaagaatcggaaaaatttcataaaaatttttcccccaaatttctttttttgacaaaatttttggtttaaaaatttcaatatttgctaaaaaatgtaagaaaggaaatgtacctcatttgcaatgcaatcagtgaataaatattacttttgctcaatttttggctgaaaattatgtcactatttctcactattttggcactttttgtcactatttcttcactattttggcactttttcctcactattttagttaactatttcgggattttccgtcactaaaggttgcggccctacttagcatccatttccttttcatttcttccgttttcagcagaacatcttccgattccatggcccctttttcctcctccgcttcccaccaaactctccaagttcatcatcattatcacatcaccatgaactcttcctcatctctcaccattaatcgcatcatcccctcttctcttccgttcttttttcttccattttctccctgaatttgctctttcacttttcgttcactttgtatggaccaaaacacccgatttacaaatgttgttcatccgagtggaataaagcgcctcacaaccaatagaagtgatcagcggaaggggaggacggggaattaatgccccccgaggaggaggggaaggaggaaaaggcaagggataatcaatcccacgaaaccggcgctggtgtttaaaatcattttattcacctgaatccgtgaaattattgcatccatttatgactaacacgtaaaaattgttagattttgcttttttacagtttctctcccttctttttccttctctctctctctctgtctctatctttctctctctctctctctctttcccctattccctcactctctttccccctcctcttcctcctttctctatcccccttttaaaattcctccggtgataatgcgttgctccgatcgatctgccggctgatcccgccccgtccactggccactcttcctctccctccctttcctttgtcccttcccttctctcattatgaatgacttcctcttccttctcacattttgagtgcccattatgtccatcaaatcaattggctgaacgaatgaagcaaattttgacaatatttatggaggacagagacaaatgcgcaactaactcattagaactgattagccgataaacagaggcttctaattgcttgattatgctaatccacaatctgtggncaacagtccatgattattatttaaagacagaattaaatatgagtttctcttacacctcaaaatatggtataaatgccttatgcgttcccgcccgtccccattccatgccaattaattaat

SEQ ID NO: 22265 - DNA, 1822 bp, Heterodera glycines
gccatgatgtgcacgttagggcacttccggtttccctttcattatgcgatgtgtcaactccaattattggaggaaaccaagtgcatgtcggctgacgcaaagaccctaacagactaaaacgcgcctaggtagcgaagctcaagaagcgcgcagcgctttcccaagcaccaccctcgcatgcacacacccgctagttatatatatgttatataggttttgagtttcgtttcaaaaaacaaaatctcccggccgaaggccgggagcgccctgaaagtggtggaagggtcttacaactttttgaggtgcatccgggaaaactataggttttttgatccgacggccaactgagtcccagggagcgatttgtcacttttgcttgcagtttaggacccgtaactttttttctaaaaccctaatcaaaaagtacccgctttgagggcacccccccaaagggtcctctacatgcttgtattttttatttttttattagagccaccccttggtctgcagttgtgagcaactgaagcgtgctcaaaaagtacacttcagtaccaggtgaataacacgccgagcttttatctgagggaaatgtgcccagaagacttattgtagagcttggaaagctcgattttttgaaatttcaaaatttcgaaaattttcaaaatttttcgagttaggcctaaaagtaggttttggggtttttgaattttaggattttttaacgatttttcccgggaaaacggaggccacttccaacacatagtttttcgagctctatcgaatggtatttttttcggaaaaatttcagttttttcccggaaatagaaaaattttttggcctgagcgggacatttgagtcccgggcccataactcgttaggggttgatttaagcgaaaaaatgccttagagctaaattgtagagcttttaaaatgctatcgaatggtgtgatatatggtcggaaattttcaaaaatttccgagctaggccccctagaaattttcggaatttttttttgtgttgaaaattggggtgaaaaatatttttcaggggttaattaaggtgctgagcacgaatatgacctttgttttccgtttcaaaatttttggaattttttaaaaattcgaaaatattttccaattttttggccaaggaaatttgggctaatatttgaaaattcataacatatgattgagttggtcaatttaaatgaaataaagctttaaaaatagagaaaaataaggagaattttatgggatttatttgggttttctacatgaattagaaaaaaattattccagaaaaactggaaattttcgaattttcagaaaaaaattcagctctcggttctgaaaggtcactctggaaaagtaaaatactacaaaaatccgcaatttttagccctattttataaattttatttcacatttttatcacattttaaaaaaaagatacaaaaataaaactgattttgggattcgggacccaagggggtggacaggatttttgagtgaagaaattttttcgccaaaatcttccgaaaacatgtctttaagggtaatttggaccgctgatcacgaatacgtgatctgattttacttttgacatcgttaaaacctctgaatccccgtgtggattggggattctgggggcatcatttttgagggggtgggggcaaggttccaaatcccgacggaaaacccattattttttttatgaatttttttcgttattttccccggtttttaattaaatttgaaaattttctttttaattattttaatttatttttttttaattaaaaaaattttttaattcttttt

SEQ ID NO: 22266 - DNA, 446 bp, Heterodera glycines
ccgaaggcccccgtacgaggccgcgaagcggccgagccctccccaactgttcaacatcccaaggcacacaaaaagttaaaaatgctaaagaaatttgctgaggttgagtcccagtgtttgtaatgccggagatttgagtcccagagattgaaatgctggtgggtttagtttcagtgattggaatgtcattgaaagttggtgggttgagtcccaatgtttagaacgccgcagatttgagtcccagagattggaatgccggagatttgagtcccagtgtttggaatgccggagaattgagtcccagagattgaattgctggtgggttgagtcccagagattggagaaaagccaagaaaatgatgcgagggcgcgaagcggccgagccagtcgattttatcattcataattctataacacaatcgtactgcctagcgggggatgcgccg

SEQ ID NO: 22267 - DNA, 1469 bp, Heterodera glycines
cttttaagagcctaaaaatacatccataataatgaacccctccatatcctgttaattgtttgcgttattccttcgtctgcctacttttgtcccatttcctcgtcctgactcatcaatgtgtgtgttttttccccattgattggtggggggggggggggggggcgggggacacttcgcattcccattttattcactcgcccaccgcgggggaacacaatcggagcctacataaatcagaaaaaataccaatgtatattatgattgttctatcttttttttcatttacatattcattggtgatcaactgctgatcaaaggagatcgaattttgaggtatatgcctttttttttgctatttttatggcctaatacggacgaaaaacactttacaaaaaaacaccgctaaaaatccaacataaaattttaataaaataaatccctaaaaattgacctaatttttgaaaaaaacactccctaaaaatgggaatttttcacaaaatgttggttggactgaaaatggcgtgttctgacaagttgcaattttttaatactacataccagggatggcattccgaggccccaaaaattttcagaaatcggaattccgtgccatccctgctacatacatacatagtttcctttttttcggtgctgttggtcgtaactcaaaaacatgggcgtggtgtactcaaaaaatcacaaatcagaatattttttgatataactttgctcgaaagcaaccaaatttttagttcttttgcatggatagccccaagtgtcttcgacggcattccgtcctgcaaaaattttgaatttcaatcccgctgcgggattgcacatgtgaaatttccgtactctaatattaaccagttaattactccttttatttatgtgttttcccaaaaggaattatcccccccccctccctccacctctacacatcatttaatttctacaaatatttgtcttttctatgataacacaacaatccccttttacattctaccaattaaattagattattaatatttattgtttaattgttattttaatatttatcaaaacatgtcactttcaaatgttcacacaaatttggtacaaaatggaaaaggtagaaaattaaagaaaattttttcactttttttatatttcagaaactaatgacccattcgctttttcggctgctgaccacccacaaaatgttggcaacaacgaatcatcgtcatccattgagcagaaaagggtcagcaaaattgtggaaaaataaattaaatttgaatattttcatgttttgctttattcgacacttgggtatatatatcaatttaaaatgcaaccaatgctatgcctaatttataagcttaacagtcccttatttgttaggggggggggtacgaagagacggactcgctcagttgggcgccggcacgtttctgactataacttttttctttgtcaaccaaatcgaa

SEQ ID NO: 22268 - DNA, 2198 bp, Heterodera glycines
  misc_feature (51)..(51): n is a, c, g, or t
  misc_feature (57)..(57): n is a, c, g, or t
  misc_feature (61)..(61): n is a, c, g, or t
  misc_feature (89)..(89): n is a, c, g, or t
  misc_feature (92)..(92): n is a, c, g, or t
  misc_feature (94)..(94): n is a, c, g, or t
  misc_feature (97)..(97): n is a, c, g, or t
  misc_feature (103)..(104): n is a, c, g, or t
  misc_feature (110)..(110): n is a, c, g, or t
  misc_feature (112)..(112): n is a, c, g, or t
  misc_feature (115)..(117): n is a, c, g, or t
  misc_feature (122)..(122): n is a, c, g, or t
  misc_feature (124)..(127): n is a, c, g, or t
  misc_feature (137)..(137): n is a, c, g, or t
  misc_feature (140)..(140): n is a, c, g, or t
  misc_feature (144)..(147): n is a, c, g, or t
  misc_feature (165)..(166): n is a, c, g, or t
tttattatacagtaattttgtaccgttcccaaaaccactaaaaagctagancaaagnacgnaaaaccaaggggacctcttgaaaagggnaananganaagaanngcaaananatnnncactncnnnnaaaggaaggnggncgannnnttcctcaaaaacaacaanncgcgcattgaacggagtcgaaaaaatacagcggacgaaggcggacgacgacttggtttggatgatgatgataatgattggtgggcacgttcactgagcatatgaacggaaggagggaaggaattggcaccacagaaaagggagtcaattactcactcactcatcggcaaaacatcaaaagaccgccctaattgccgccattcattttaagacgcattttgaataaaaagcagaaaatcggagagcgataaaatgagacttttccaaaaagttataaacatttaacaaattgataaaaaatttgagtcacaaatctggccaaatcattttggcctaaagggtcgctttggccaaatactttaatctgactatttgtattttcaaccaattttttaccaaattttatgaacttttaatttaacgcatcttataagttgaaaaaatattatctggtgcaatttgttaaaaattagtaaaaaaaaaaaatatttttaaattgttttaattaaaattaaatatggacaaatattttcaataaatattttatcattttcaaagaaaaaaattaactattttaattattaacacatgagttagcataaaccacagctttgtgggcaatattctcgcttcatcctcaacggataaacttcggagatgcaaaagcctcggggcacaatttgttcacaactaaatgccaattaatttcacttaaaatgcccttctcattttagcaaactttacaacattagaagcctaccgagaattttccatttggtcagcactaataagcaacaaactttggcactcactatgggtaataatcacggcatttgggccccacaatgttgttgccgccgccaattgcatttttgcgcaacattacgtacgagccacgggatgatgacgacgacgacacccgcgcgggctgctgcaccaacggcgcgcgaggcattcccccggcgggtgccgcggcatcgacgacaacctaaagaaataaaaagatcgcattgggcggtcgcgcagaatcaaaatcaccaaattctgctgtggttgttgttgtgggttgggcaacaaaaattgttgttgctgttgagattgttgggccggacgttgcacaacaatttgtggttgctgctgtggtggtggtagtggtgcgggtactgcttgcagttgttgttgggcgggctgttgctgaacatacaccgtttgtggctgttgtggctgtacctgttgctgctgttgttgtggaaactgtaccaatttataagcaagttgctattaataatttccttcttcacctgttgcgtttgttgttgttgttggacttgttgcggaagctgtacataaactggttgctgccaaaccactgcttgctttgctgtttgctaatgaggttgaaaatttagatgcattttgaaaaagggaacttcatttctttaccattggcacttgttgcggttgttctgctagtactgcctgtccttcacgttgttgttgctgttgttgttgtgggagtggcagtgaataaacgggcgatggtcccccatttgcctccgtcggctgtggtaaaaagttgcccagctgaccattggcataaacttggccagaggctgtcggcatttggttgccttcaaaattaaatgcttgggataattaagcttaaattcagccattttctgtgtaccggccgggccaatgattggaacgagtcgatagccatccggagttggcccaccagcagacggcagccgaacacgtcgcggtaggacgaatgttttcgctggtccgcgacttggcactgacgacacggcacgcgttggcccggttaaaatgcgtcgccggcggttgttagcacgcgtggacgacagctgaggcttcggcttctttttctgtgagatttaatatgtgaaatgctttacctattttggttttgatttcgaatttaatttatttttaatttcatttttattttggaattccccaccgcttttcccccattgtcttctgcttcttctgctgattgctctttc

SEQ ID NO: 22269 - DNA, 2182 bp, Heterodera glycines
tatttaaaaaaataaaaaattaatattaaattaaattcttctaaggttttattattaattaatgggtttaattacgagttttttttcaagagtactaaaaaatttattttttcattaactgtgatcagagaggctcctaaaaaagcccaaattttcatgagtgatcttattttacaaaaaattttgcaaaccaaaagggtccctccccctttggcttttaaaattcaaaatgggcaactttagtaataataaagccgaattttattacaatttataaaattaatttatgaagcattaatgttattttacctttattttagcataaaattgtatttgtttttatttatttttattcattattgtaaaaaaacactaaattttgcactgagtaaatttttttgaattaaaatattttttaattcttaaaaatatatattttttttatttgcaaaccaatagggtcccctctttgttttttaaaattcaaaattggtaactttagtaaaagcgccaaaaattcaaataataaaaataaaattaagaaataaacattttagaactcttgaacaaaaagtcccttaattaaatcaattaattaaaataataagaattaattttaatttaatataaatattacttttttaaatatcaaattgctttttaaatttattaattactttctatagtgaactttaatttttttttaaaagactttttaagtttggagggctcataaacacagaactcgttgatttgatcgaccccgaaaaattcagctaccattccgtagggagggtcccgctgctgctttgcgtgcagtttgcagtcgctgtcctgaccctccggctgacctgcgcgccgtttgcggtcgcggtgctgcacctcctgctgacctgcgcgcagtttgcagtcgctgtcctgaccctccggctgacctgcgcgcagtttgcaatcgcggtgcagcccctcctgctgacctgcgcgcagtgcccagaatcggttcccctcctcctgctgctggcaagcgtgcagtttgcagtcgctgccctgaccctcctgctgacttgcgcgcagtttgctttcttggcggcattcccccggtgcttttgcgtgcggtttgcacagttctcattttgaggtcgttttttcggctaatactggagaatttgtgtagcggcggaaaataaattaacagcaaattattttttctattttttatggattacaaaatatgcttgattaaaatgggaatggcatttttaggcaaaaaaacaaattttttttttagactttttaggtataaaaaactacaactttatttttgggtgatatttaaattggaaacgaaattaatttaaacatttcgtgtatttctgagaaaacgtgatttttagtacacaaaccatcagtcggatttgtgtatactctcttaaatattgtcagaatgactaaaaaaaattccagccatcttgtgaattctttttaatctgctaaatcccagccctgctcaagagtctcgagtcgagcagacacgaaaaatctacagggttcaattttacaaagaaaaacgatggatatgcgttatgggggataacgattggataaaagaattgttgggagagactaaactttgaggaagggaggcaaatgcaaaaagggcagcacatagataaaccagatgatatacctataatgagatgcgagtacttttttaggaggagacatgaacacagcagagaaagagagaggagagacaaagaaaaagaaagagagagagagaaaacgagagagggtgggagctgggagagagaaaacaaaataaagagaggaagagagagagaaaataagagaggatgggagctgggagagagagggggggggagagatatagagacaggaaaagaaagagagagagagagagaaaacgagagagggtgggagctgggagagagaaagagagagagaaagaaaaataaagagaggaagagagagagaaaataagagaggatgggagctgggagagagaggggggggggagagatatagagacaggaaaagaaagagagagagagagagaaaacgagagagggtgggagctgggagagagaaagagagagagaaagaaaaataaagagaggaagagagagagaaaataagagaggatgggagctgggagagagag

SEQ ID NO: 22270 - DNA, 1811 bp, Heterodera glycines
aggaaaaagggattaaaattttcaattttggcaaacaaaaatagacaatttataaaattatttgcgaattctttttattcttataattcgatttttaataaaattcaaaaataccgtatttgctctttttatatgccatggtatattatttttcaacctcctcagaagggggtagataattggagattggtagactaatggagactgggagattatttttcgatgatttatttagtggaaaatttttgaaatttctgaacatgtcgccaaaaaatgtcatcgcgtcaaaaaaaaatcattttattgtatttctgttaaacaaaatttttttttgcttcaaagataaaaattgaccatttttgatgcaaaatcggttcaaaatttctcattttttgggaattcaaaaatttgctattttatgcatattactcatggcattttgtcgtcggcactttcatacagccatcgaaatgccgatgctcatagctgggaggaggatccttttcaaacatttccattggttttgcgtatttgtggcaagcaatttcatagggtgttgcccaaatgtggagcacgaatttggaaactttggccacaggaaaggcaattttcataaattctgtgccaaactgttcctcggtccatgccgttgggtcaaaaatgcacttaaatcattttcattattttaaatttcatttaaaattccatgccttagtttggcacaacatcgtgccattttgtgagcaggcatcaaaaatttttccagcaaaaaatagctgtgccatccaatcgtaatcggccaaaaaggcaccaaaattggacgcattttgaaattcattcaaattggatgaaaacactaaagaataaataaatgcatagaatgaaatatgtaaaattgcatttttttcaccgtttttgagcaggatttctgtgtgattttccatttcattgatcagttcaatgtccaaaagttgatcaatgccattgcttaaaatgccaaaagattttttaaaaattatttatttaatcaaaaataaatggaaaataacatctcaatcatgacatctgaatttaaaaaataagcaaattaacaatattttttgcaatcataaaaattatcaaattaattaaattaattttggttattgatcactttaatataaaaaattaaacaaaatttttcaaataatttcgcagattttctcatgaaaagtctcatttcctgaattttctggtatgacatgcggtaacagttgggtagaaagagatgaattatcgggacatgattatatatataataagaattcatatagacatggttatatctcgtgaaaatcattccgaatgcgtagtagttgtgggtgtcaaagatctatgagaaataaactggagataacatctttttgtcgccagatgagaaatatggttggctttctcctgtttgaaattttacatgaagtgaattgctatttgagtataatgtagacaaacaaataagttatcagtgatgaaaatgtaattttacagagaaatgaaagatataaataatatggagcatttaaacaatagtcttccatgttaagataattcatcaaatacataataaatgtttacaggatatataggcatccaatggccgaactagagctagatgtctaatatttagcagtcaattggataacaatgtacaatagtgtcgtaccacatgttgaagatggaatgatagccagaatcgcacaatacagatagggcgaagaaatatgagtgagtgtttcacaaatatatttagtgtcgtcatgtgatcacctgag

SEQ ID NO: 22271 - DNA, 1941 bp, Heterodera glycines
attcaataaattttaattagagcttaattagactatactgtacagaatcttaattgtccttaataccgttttaaccgactttcaaggatcttaattactattttttaaatagaaagtttcttttttcgaagaaaatttgaaggaaattttttttttaaaattcgcaacacttaagcaattaactcgccttcaatggcacgaatctttcgccgcacatcagcgcacggcagtgggcccagcgtgacaatggtggacgtgtgctgccgtcgtggatggcgtcgtggcatttccggtgccgcgtcccaatcatccgccggcggatgctgttgttgttgtagtcgttgatagtgatcatgatcataatcatcatcttccgaatgtacatcatgacgacgctgcattacggcgcctcgcgcggtgctcggcgcggcagaagcgtgccgcacgcgtgcggaatcggacgcggcagcgtgtcgccgccgccttggcgtgaccgtgtccgtttcgtaatggatcattgctgcctcatccgcatgtggcgcacgcgttcgtgcgcgtcgtacaacattgggcgcgtgtgggacaaaaccgcccgcgggcggcttccgggcgccgtcaaattcagtacgtggacgatgcgaaccgtcaggcgatggcataatgacaccggtagtttgtcgtcgcgccacatcctcaagggggccagtgcctggaaaatctcaaatcccagccttacagtatgacagagccgagagtccggcaaattacggtaccgtgccccttgatttgctgctcgggttcgtctggcacaaaatcgcgcatttccgccttgtatggcggttgtcggaccacgggcacccagtggtgttcatctgcagcacccccatttatttggacggacaacggaccgtaatgctccaccgattcggataccgtagttggtgttggccatctgtgtgttttttgtgtactgtatgtcagccgttgttaattactgtagtacaaacaacctggtttctacgatcatttcccacagttccgtatgcatactaaacgatatgtttcccacagtaccttacgcatattgtactggtatatttgccagtgttccctatgagtacagtaccggtacgggtttttgaaccacgataattactgtagtacaaattaattggtctacgatcatttcccagatagtagttccctatgcatactgtacctgtacggtttttcgggcggcggttgccatcgtttgccagtccgtcggatctccaccggctgttccggcttctcaatgaactgttcacggcgccgcaacatgtcaatgttgaagcggtcgcgcgccagtcgttcgtcgctggtcaggatttcgttgcgctcgtccacatgctcgctgtccaccacgtatgtgcgacgccatgtgacgctgctgcagctggtgccagcgagcggcgactgtagggcgccgttttggtaagcgactgtgccaccaccgtcaccgccggcgttcactgcgacagcggtcgcgtaccgcgggtcgaacgccgccggcgtgttcgccccctcggcggcggtcgctgcgctcatcggtcgcgtctcgaaaacgcgtaccgctgcgacagcgggcgacaacagttgcgtctgcgagtgggacgtgctgggccgctcagacgcgccgatgcccgtgtcggcgggcgatgattgttgatgatattgttgtggtgatgtcagccgtgaaagttgctcttgttgcagtttgacggcttgaagctaaaaataaattttaaaattgaaatcccaaaattttgccattttcagcggaatttggaccattgagcaactcaaaaaaaaaaagattgtattgggctgatcagaacaaattacttaggaatataggtaaatctgtcctccacttgatcaaatcccagtgagacgaacaga

SEQ ID NO: 22272 - DNA, 2385 bp, Heterodera glycines
tcttttgggcaccagccgcactgttctcgcgttttttagtccataattttcggccttagacccatttcgaaccccggacccgaattcgaaacaaaaaagcccaaaactcaaaaatttcaaaatacatttaaattatttctaaggtattgcttcgcgattagacaattatgttggatttggtcggcaaagaaaaaagttatagaattataaatgtaaaagttggaaattaatagaaagttcttacagctggaaatgggcccttatgcctaaatttcaatttttgaggcccaaaacttttttatttttagagctttggttcgaatccgggttcgtggtgcgaaataggtgtcagaatctgattctccgctctttaaaaccctaaaacaaaattcgtattttttatttttgacttggcgctgaaacgacctggcgccgaaacgtcggcgccgaaacgatacggacccactgaaacccctcggagaaaatttaatgtcacccccttgaattttttttaaataattttgctagggtaattttatgcgctgacaagaatctaaaattaattttggccgattccgaaccccggacctgaattcgaacaaagaaggcgaaattcaaattttaaaaatttactttttgttagaatctgtacagaaataaccatttttggtgtttcaataatttgtagggatgcgatttttagttaaatacctaaaatttttgcgcacttgtaacgttgagataagcataaaaaacgagtttttagcttcgtttggagcttctacacccacttttctaatacctatttttatacctatttcggcattttggttacctattttaaggattttcaaaaaattcttaacaaaaatgcaataaaatcaaaaaatatacccataagaatcgaccaaaaaaaatttcaaaaatgcaccctaagaattggaaaaatttctcaaaaatttatcccaaaatttatttattttttctattgacaaaatttttaatttaaaatgtcaatattatctaagaaaatattaatatatttaaattttcgtttacaaagagatatgtagaaccaaaattttccctctttgtttgcttttttccactaaaaaatcgttaataaaaatttttatttacctattttggtacctattttggaatttttgtacctatttaatacctattttgagatttttttttaactttttaagtacctattctgcgattttttttacctaaaaatcgaagccctatttattaagaatgcaacagatcgacgatattttttcgatgtttccaatattttattgaaaaaaatttaaatttttgaatcattctcaaaatttaatcaataaatttcgaaaattattatttttttaatttgaaagttctccaaaatacccaattaagatttaatctgctagccaatttccgattttttgccgctttatttttacaataaaattttgcaatttgaccaattttttttaataaaatttaggaatttttgtgtccgggggtgccgacaggcgaggccggaaaatttatgaaatttttctacaaatttttaaacaattttgcacctaaaaaaagaattttttttttgatttttcggctatattttagaaaagaaaaaaacatttaatagttttttatttttagtgcttgagaaatttttgtaattaaatttttcattttttcatgaatatgtctttaaataataaattaaataatttgattttgtttggggatcgaaccaaggcaaaaaccaaagaaaaactgctgtttagccacaatttttcgaattcagaaaatgaaagtttttccagcaaagtttaatttcattcatttgtcccctatttttcgtccccttctcgagagtcgacactcaattgtttctttggctccctgcctctgctgctttttttgttatctcttcctttttttccgtctcttcttctctttctctctcatcactcacttcctctctctgcccctccctctcatttatctcacactctttcccgtgcccttgtttcctacacaatgaccgactaccggaactggagaaagtcgcgggcgatttgttctgttataacaagtatagatttagtgatagttgacagctgttcgttggtgcagatttattggtgattaaaggaagtgtgaatggatttgtgttggttaaatgtagaacagtgaaatacagtgaagggtacagtataggtgaaaaagtggtgacgaaaaaggacttaaatacgatacaaaatgagggggcaagcggcaaaatcatatggaaaattgataataaataagtgtgattaagtgtgaataagctcaaaagatggtacatacgtaatcctgattaatcataaatggtta

SEQ ID NO: 22273 - DNA, 2084 bp, Heterodera glycines
aggaaactaacaaacgttttttggctgcctttttcattattttcccaacttatacaccattgatgagcttcaattgctctactattttactcagaggtgatctttcgctttttctattgataaaaatggtttattgtttttttgggaaaagataaaaaaattcaaaaaaaccgaaaccgaaacggtataccgaaaatttttcttcggtttttttcggttcggtttttttcggttttttaaccgaaaccgaccgaccgacaaatttttgagtttttcggtttttttctgtttcggttttttttcggtttttaaccgaaaccgaccgaccgaccctcttgtccggtctctagtaaaaagtgtccaaattttagggatttttcgtgaaaaaatcggcataacttttcctaaacacaagaaaattaaataatctttgggtcattcgatagctcttggattgctctattagaaagaaaagtttcagaaaatttcattgagttatcacaactgtgaccacaaatgttcaaaaaattgccataactttctgaaaactcaataaaatttatctgaaatttttctttctaatagagcaagccaattgctatcgtaggatacaaagaccatttcatttgattttgtttaagaaaaactatgacgaatttttcttgaaaaatctgtacaatggcacttttaccaaaagcccatgatggcactttttacggaaatgacccagaaaacgatcccaaataaccgaccctttcccttggtcaacaccaccggcaatggcttataattgtgggccccaaaacgcaattctctgtcgatgaacgtgttgctgctgctgttgttgttcaatgacggttgtgcaacaccaaatgaagcaaaactacggcatgtttttgagggtgccaacgaattcttcaaaaatggtcggaagacacaacgagcaaacattgggcggagaaagtggaccatttagtcaaaatctatggacgatttagggaaaattcaaaaatatttattttcgaaaattctaaaccattaattttggagatttggattttttcaaaaatttttgacctttaaggggtgtattttcgaattaaaaattatgaaaacctatacaaatccggttcctactaattatggagcaattcatttattaattaaaaaatcgatgtgcaaataaaataattgtgtgaatgaatgaacgaacaacaaaatattcgccgtcattgagtgagagagaagagacgataaaaatggatttgggaggatgataaattgggcaaaaataaatgaatgtgtcgcgtgatatcattcggtcaaaaaaataatacaaaaattcgattacggggtaaaaaatggctttttttgggaggacacgggtgggtgaaagatccgtccaaagtttcggcttggcctttgatccctcaatttgtttcattcgtcgtcggcagacaaagcccagtccaaacagtcaaacagctagagggcaaagattaattaattttttttattatggtgagaaggcaaaaacaaaagtgacatatatgcacctaattagtgaagagggacagataaaatgtgataattaagaaaggcattaaaaagtgcacttaaaaataatcgtataggtaaatgaattcaatgttgcaatgatttacaagtgattttagtttgttgtaatcagtttttgaataaaaatgcaaaattcataactcttgaatgttcgacctttgattcgaatcccggctaggggttcgaaattggtcaaaataaatgtcaacttcctgttcagcgaccccgaaaacccttataaatatgttttcaatgactttcaaaaaaacttttttttttgtcatttaattgctaaaagcttgttcttcctggagctgtttggagttttctataagaacatcgttctgcattccgaacgccggacccgaactcgaacaaaaaatcgaagtcaaaatttcgaaattagagtttttcttcaaaattggattaaatacacggaaaccaactaaaagtcatcagtctttcaataatagatcatggatgccgattagaagcaaagatgctaa

SEQ ID NO: 22274 - DNA, 2603 bp, Heterodera glycines
gaatgccctaaattttattggaaaaaaggcgaccaaattttcaacaatttcccccattgtttttccatggccacctgctgttcgtcttgctgctgctgttgctgctgcatcagttcagtggcggacacagagtaagagccgccgcccagaaatttggtgccaaagccgcggcactggtagggccgttcgctgtccttcaaaatggtgacggcgtcctgcgaaaaaaaaattggaaatttgtcgatgaatacagtaaaaaatcattggcgaaaaactaaaaaaaaacttaaattttgaacattttataatcaaaacgtaaaaaatctcagagaaaaagatatttgagtaaaagaaaactatcgctggtcaaaataccacaaatttcgggtcgagaattttggaacaggacatatttcatcgccgattttttggcactaaaatttttaaaaaatttctaaaatttttcacaaaaaaacttagaactttataagaaagtttcaagaaaaggaatttcaaaaatttttcagcgatttttgtttaaaaaatttatgatgcattaaaaagttttttcgaaaatttttgcaaaaaaatcataaaaaaattttttacctcttggtattttcatacaaaaaatttttctaagattttttcttgaaaatttctaaatttgtagtaaatgaagcacctgcagcgtgtcgggcagcggctggtcgcgcgtctccggcaacaacatcaccaaagtgccggcaaacagtgaaaaggtggcaaaaatgatcatcggcacgatggacagcgtgacgtcggacagaatggcaatgtacgaagagacgccggagccgaaccgggcaatctgtgaatttaagggcattcgccaaaaaattacaaccaaaaaaatgaattttttttagtccgttatttcccaaattttttctggataccggtccttggacggattattttctccaaaagtttagttggtgttgaatttttgaaaatggggatttgaacattttgactaaatcactcaaaaattggcatttttggccaaaatgaatttcgatgtttcatgccaaatgacgcttttctaggctcggatgagtgtattttcaaatttttgtgatcggcgctatgattttgatgtagaaaatgcaaaacggcgcttaccatggagcaaaatccgacggcactgaacggagggaaaatgattagaaaaggcaattaaacattattaagtgtggcaaaaattggtaccatgacaaacattttaaaaacatttttgattttgtctaaaaaatgaccaaatgttgagattttaggccaattttttaaagaaaaaatgaataggactttttgggggccggcggtgccgataggcgccgccgggaggaaaattttgagaatttttaatgaagtaattttgttgggaaaatagccaaatttttcagaaatttccctctttttccccttcgccggggcgacccccacccacctcttttacaccccccccccctgccccagtgatttgaccatgggcaccggccgggcgtacctgttccggatgacggtcgggtacagctcggaggtgaagatgtacaggatgttgaagccgccctggatgaagattttgccgagcaacatcagccccagcgacagcatggaacggttggcactcatcgaagccatggcgcacagaatgaaaatggcggcggcgaccagcgtgaagatttgggaccgtttccgtccgtacctttttggagacaaaagacaataaattgtttttttggggtaaatttgagacctcattaaagaattggaaacaagttcgctcatattatgaaattttctcaaagatttatggacaaattaaagaattaaaaaatatattgtaaggtaattcccaaaaacaaaaaatattaagaatttgaaaatgtggcgctaaaaacccaaataatttttttttaatttaattaaatcaaacaaaaaactaccgtaaaagagggtctatggcaacgcatacaataatttttaattatttcttaaaataaaatatttttaaaatgaaaaattggcaaaaaaaaatttttgtattttttttttgttaaaatttttggaccaacgaatttacttcatcaaatagacacagaagatcagtgtgggcagttcaatggcacccgcaacggcgttgttcagaaagaagttgccgctgaacagcacacggccgggcgccgactgatcggacagcgctttaaaataaagggcaattattttattaaagtaattagttggctaatttagtggggtaattaaattattaaataaaaaatctatcaggctaggaaaaaacaatattataaacactgctcgaaaattttcaaaaaaaaatgtacaaaaatttagcgaaaaaattgttgaaaactagcgaagagaaattctatgtttctcgtacctccaaaaaatttgcaaatttaagaaatttttatgggcatttgaacgaaaattctatgccattcaaaaatttgtaatgacagcatttatttgcacacaagagcaggtcattccggagcagctcgtttccccccccccctacgtatcctccccgcttc

SEQ ID NO: 22275 - DNA, 2334 bp, Heterodera glycines
  misc_feature (11)..(11): n is a, c, g, or t
  misc_feature (90)..(90): n is a, c, g, or t
gaccccaaaanaatttttgaaatttctagggggcctagctcgaaaatttttgaaaattttacatcatgtagtacaccattcgatagcatntaaaatgctctacaattttgctctaaggcaatttttggataagatcaactcctgacgagttatgggcccgggactcaaatgtcccgctcaggccaaaaaatttttctatttccggaaaaaaatcgaaattttttcaaaaatatcaccaatcgatagagctcgaaaaactatgttttggaagtggtcttcgtttctctgggaaaaatcgttaaaaaatcctaaaattcaaaaacccgaaaaccgttttttaggcctaactcgaaaatttttgaaaattttcgaaatttttaaatttggaaaaatcgggctttcaaaactctacaataagtctgctggtaactccccgcccagatcaaaccctaatgagttattcaaccgggactgaactggacaaagttggtactgaaaaagttcacgaacctacagcctttcctattgcagatagaggtttggatttttttttcttttttagaaaacacttcaacttagccccctcacagcagacattttttgattcgggttttagaaaaaaagttaggggccttcaaacgcaagaaaaagtgagaaatcggtccccgggactcagtcgtccgcgctgaatttttttctatagttttcccagatgcgcctcaaaaagttgtaagacccttccactattttcagggcgctcccggccttcggccgggagattttgtttttgcaaacgaaactccttgtcaatataacgtatatattaactagcgggtgtgtgcatgcgagggtggcgcttgggaaagcgcttcgcgctttgggagcttcgctacctagataaggtcggcttgtgaaggttagcggctgcaagtttttaatttttgttgggcttggacggaaaaatattagcgatctcaatttgcattcgccaaattaatgggttcattacgttcccgctccccccaccgtaaaaattttaatttcttcaaatctagaatttttaaacgggggggggacaaattaatgtactttttacaaaccaagtttcattgtactataatataaagaaaaatgccaacggtatttaaattgcaaattttatacctttccaacttggtttggttacgaactttgtcaatcaacacacttactaatgctggtgttgttcgcgtgggtccagcggattgtcactggaaaacaccgatgcgcaaagatgtcgtccacagaggggacagtgaaagttcggctgcggtttgttcatctccacgtcatttgtcgcttgtctaaaccccaaaataatcatttcctgtcgtttaattccatttttgggttttgtcaagcagttcaaactctttcaacttactttgatattggaagccatccaaaaatggccaaagccaagaaaaatcggctctgcacgccaaatttgtcggccaacgcttcgtcgagtacattgtccgccaacggaagttcgggctggccgctgtccaccagttggtgataacgcgcagtgatgtcataggttgcggaagtgttcagccccgggctaatgcgccatgggcaaatgacggtgtgcgcttcgaccaatttgcgttgaatgtgtctaaacagaaaggaaaatgagtcaattttgtacgacaacagtatgtgtgccctcctttgatttgttcgtggtttttgatgatgatcccgaattgaattttcaatttaaaccaactcccaattctgccaagatttcagtttccataaaatccagtcgccactgaccgaatgcaatggttcagcacgcgattggacacttcgtcgccaggcaatttgatgtataacactttgccacagtcgtcgcattgcaaaaactcctcccccacatttttccatccatgacgtgcgcacacaacaggcgaaatttccttcggtttcgcaattcgactggccaccttttgatttggtcaatgtttacaacattctcaaacagtaattccaaatatttcacatcaaaggttgccaatcttcgtctgtaattggcccaactcttctcgtcattcaatgccaattcagcagacgagctaaattttagaaatagataaatcactaaacagggctaattgtagggcaaacatttaaaagtacctgccaacattcacgcctccatcatttccgttgactgcgtcgtttctagccaaaaatcggaaatgagcgatggagcgtttttaccaaagtgttgcattcaatatcggaatcgggctttccgttttgtcatttttttggacaaaa

SEQ ID NO: 22276 - DNA, 1954 bp, Heterodera glycines
ctctctggggctaacgtaagacaccttcaatttgtaattgaatggtttggattcgattttctgatttgtcttcgttttgcttgtcctccattcattgcctttctcttcagcactcactccgacgacgctttgccttttcttcgcattagcacttttgacaatgttccgcccaccattctcttctacacaaagggtgcaaaaggtgttgtcctccactttaaagctttccccaacgaaatgcgttcagttaaaaagcctccgccgcactttgcctctcgactcacttggtgcaacaattcccttttggccctcgtcgtccgtcacaggttgaacaactgaccaaacaattagtttcataattgctcttttgttagtttggctgctagccatttcaaattggtggacgaatcgaagaaatggattggctattgggggaagcatttgaagtcaccgcaatatcggacactgaaaccgttccaaaaggtcggtctattatgagaggtgttcttttagttggtttgtttctcacgtcacgcttttccaggtcaatcattttcccggcgcctttcatttgggccgtaaagatcgcctttggctgcacatttacgagtttatgcagcgtttcgaaggggacctcttctgcattatgcccatcacttatgtcctccctcgcgacgctcgaaagctccgactttatttggccggctatacggatcgccatgtcattctgaaacccgtaattattaaatttaaattatgacaaatctttaccattttaaaactcttagcccgcttctgctcgtggcactggcattagcattgtttcgcgttttgatttggttccaccaaaggctgcgcttgtcgcccaacagtaaaatttacgagaaattcatcttttaatttttgtttttaagttatatcgaacggcctttcatcataaatggtgcaaaatttgacttacgaatttacgtttatgtaagtatctttttccaatattttgtcactttctgtgattttaaggtcacttcgtatgatccacttcgtgtgtacgtctacgatgagggattggtcaggtgaacaaattctcagcgaatttctctatttttttttgttttttcaatttaatttcagttttttaatacttttcggagggggttgggggctacgagtgggaagtaatttgcttccttttttcgtaagtattaaaaattgaaaaataaaaaacttgagttttgcaaaattccatttgtccatgtcactcctccatttcccctctccaaaggttcgcaagtgttgcgtacagctcagcgttgtcctcctactccaaccaattcattcacctcaccaattactccatcaacaaacatgcgtccgatgagcccgtccccaaatggcgtctcagcgaattttggtcttttttggaggccaatggccacaattccacgcgacttcgcaacgacattaatttggtggcactcaaagcaattgtcagctgcgagacgcacattcgctcgcacggcgaccattacagtgactttccatttgtcaggtgccaaaagtttatttattttttgtatggaccttaagaattaaagaatcgtgaaaagtggttttgtggcttttttgggtcactaatctcggattttacaaagacttgtcgaattaattctgaaccccggaaccgaattgagacaaaaagtcgtaaatcatttaaaaattcgcatttatgaccaaaaccgggttacacatgagaaccgagccaaaaaatataaagcaagcgaatactgtttttatacattaaaaaatcatataatttaaaattgcaattattctcaaataccattttaagccatgagttgtacggcatggacattctggtggatgccaacctccgtccctggttaattgagatggtctgtcccatcattttacattcattccttttcacaagtga

SEQ ID NO: 22277 - DNA, 1824 bp, Heterodera glycines
  misc_feature (1773)..(1773): n is a, c, g, or t
cttttcatgttcgaatgtgtactgaaagatatgtcattttagacctttcctttttagaaacttcgtattttctcaatggtgggatttcaatttgaggcatccaaaaagttggcggagggtaaaaggcaggcagaacttccataggcaaatcggaaacaaaatctcaaattaaaattaaatataacaggtaaaagaattgaaaaacccatcaacctgttggcaatcgattcattaattgacaataagttttaaaaaatctgaagacgggaaaataaatttacaaaatttttatcaaattaacaaaaaaaaattctctatttttcttttcgcatttttttgctgaagtgaatttatccttttctctgacaaactttttttgttccatttcgacttttcttcgccatcagttagcacatcaggaaccggcaatcgcctagattattggacccgaaaattttttctctaaggtgactatcgggtttgcacgcacttcattatcgcctcagtaatttttttgaaaaattttggagtttataattgaaaagatcatttattgacgcctgaactgaataaagctggcggtaatagttaagatggtgggccccctttttcaaaaaaaaaaaaaattttcaagaatttttttcagatataaatttaattaggggttctcaggatcgggtagaccgattaggccttgcctaagccattgtacgagttgcattttgtaaattctcgtaaagctgagttgtccatcagctgagaagtcctaggctgagttgtcccggctgatcctgacgcagcttccacactctcagcttggcctttacattgcgctgatcagccaacaatttgactattccgttgacgaacacttccaaacgcgcaattggacattggacaaaatggaaattcgacccaaaaaatttccccgaatttccgcctgataacagtgccaatgcgtcggatggccaaatggctgtttacgcctcgtcccgcaattttaaagggtcttttcggttttgtgaaccccccccccctgaaattttcaaataaaaagtcatttctagggtaatttggggcgctgatcacgaatatgacatttatttttcaaaattccgaatctcgaacctgaattcgaacaaaaattcgaaattcataaattacaatgaaaacatatttttgggggttttcgaggtcgctgaaaacggttatgacatccatttgaccaaattcgaaacccggactctaacaaaaaaaaaggaaattaattctcgacaaaattcaaaatatgtaaaaccgacgcatgtaattggtcctcaaaatcgttaaaactatttttaaaccatagtcagaaattggtaaaagaacgtcaaatataaaagattgaatttgcttattgcgctaaaaaaccgccgcacactcgactacggcggccagttttttgaaaagcatggcataactttacttaaaaacaaccaaattttaccttcttggtgccattcgatagctaagtttttttctatttctcaggcacaggtctcttcttttgccgcattcaattgataggtccatcttatagagaaattggtataagcaaatttgtttaactaaatttattcaaaattacaaatttaccatgaaatttgaatgtaaaaatgcttataatgaataaatagaggcacaaaaaataggcaattcacatttgacttatagaggggttgaacaatagaaggcccgggccttcaaataacggatttacggtaattaaataancatttttgtacactatcacttttattcttcaggacttttatatttgtctat

SEQ ID NO: 22278 - DNA, 1778 bp, Heterodera glycines
tttgccacggaaaaagtcgtcccacggcgagtccagccagttccggttgcgcagctcggtcacctgcttggcactctcgtgcgcattctccagaatggcgccgtacttcttcaattcttcgtccacatattcctgggtcaataagaatttttagaaaaaaaaatatggaaaaggcaacactccactcagagaattctgtcccagaatttcgggttagggtttgagcaacctactccgaaaaaaaaaattcagtgtcgataaatttttccaatggaattaaaattccaatcaaaacgcaaacctggtcagcgatgccttccgccaaaatcttcttctgatactggtccaacaacggctttgtctgtcgaatgcgctggtacatcaacggctgcgtgaacatcggctcgtccaattcgttgtgcccgtaacgacggtagcacaccaagtcaatgatcacgtccttcttgaactccttgcgccactgggccgcaacatcgcacacctgttgaattttttgaggttccaaatcgcattcgaaagattatgtttttaaaaaaacaaattgcgaagaaacgcattgtcaatgaaaatttttttttcttgtttgagaaaaattggtgaaaccatgaataacaacaaaaaatttttttaatttaaagaaaatgtttcttacatgcatcaccgcctccgggtcgtccgaattgacatggaagatcggaatgcccatggcccggccgacatccgtgcagtaaggcgaagagcgcgaggcgcgcgggtccgtggtgaagccgatttggttgttgaccacaaagtggatggcgccatagatggagtagtggggcaggtcgttgaggttgaacgtctccatcaccacgccctggccggagaaggaggcatccccgtgcagcaccaatgcctttttggggaggggaaatgggtaacaaaaattcatttttggggaaatttcacacattaaatgacaattgccgctgatcaaactcaccatgtgacggtcacagtgcaaatcgttgctgtaaaatgcctcagcacggactttgccctgaacaaccgggtcaacagctaaacaatttataaattttcgtcgaaaatccaaattttcaatgcctaaccctccaaatgtgacggatttgcaaccaccgcaattttgatcatgcgctgcgattggcgattcagccgttcaatgcacacgcccaaatggtatttgacatcgcccgagccctcgtcctttggttccaaagtgctgaactgggccaaaatggtgctcaatggttgacggcacacattggacagcacattcagacgaccacgatgcggcatgccaaggctggaagggtattgaaattacaaatttaaaaaagttcattcaaaatccctcccgaaagactcacacaatggagtcaacgccgagcgcagacgaccggtcgatgacctgtttgatggccggcaccaacacttcgcaaccctcgagaccgaaacgcttttcgcttggccatttcttggccaaaaagtcctcaaactttgtggagcggatcagccgtttgaaaagcacctaaaatgggggaccaatttttaaattattccattttttcacacacttttttctgctccggtggtaattctgtgactttgggcgcctcaaaatgttttcggatccaatcctgctgctcgtagtttgtcaaatgcatgtactcaacgccagtgtgatggcaatagattttctggaattttttgtttttatttattgaattgctaacaat

SEQ ID NO: 22279 - DNA, 1495 bp, Heterodera glycines
gaaaaaagttattccgataaatagcaaaaaaaaaaaaaaggtcttcaggtactggtctcccccccccccccccgaaaaatgtttctagatacgcccctgggggtgagtctgacttatttggggctttatcaccactattaactgcccgatgcaattctgattattcagtcgacttttttcttcgtatttgtccagttggtcctcaattgttgcatcggttggccccggcagcagcgacttcttcttcgtcctcctcaaccgcttcccttcacaacagttcgcgtccgctcgtggagcatttctgtctggtcggcatgtgcggctcgtacaccgactttcacgtcgatttcggcggttcctccgtgcggtaccatgtgttcagggtgtgtgttttttggttctatatatgtaagaaaagaaggaatgttttaaaaaagttttcttataaaaatttctgtttcaaaaatttttacgggtgaagtgacccgggagggggcccctcaaaaattttcaaaaaaaattcactatcagctttttggaaaatcttaatagtcataaaatttcaaaaaatgtttttcttagaattttctttgaaaaaactttctgagatttttttcttgaaaattttctaagttaataaattaaaaaaaaatttcctcgtgtagtagttctcttcccgcacttcaaaaagccttacaaaaaattttcataaaattcaattttctctaaatggactaattgcgtcttttattttccctaaagggagagaaagtgttttttgttgcccgtccgtccgcccaaaatttggccgaatttctgcgctggcagcgccttgacggacgcgcacgttccgagacattttttggcgactgtttgccccccggggaacaactcttccgagtccatgtccgagaacgggagacactgttcttgccaagcggtcgaccatttaatgcgcaaataaattaaaaaggaatgaattcaaaaacttaagtaaaaagaaaacgtgccctccggtggattttgtgccgaaaattcattttcgaaattaggcacagaaattttggtttaatcagaaaaatgtttttttcctttgtatcggtttcggaattctcatttttctaagtttaaaaattgtagcttttctgggtcgctgatcacgtatccggcatccgttacgacccatttcgaagccctgacccggactcgaacaaaaagtcgaaaattaatttttcaccaatttttttcctctttgcattcgctaagattttcgttaatttgaattgattagggcaataaatgtgaattttgttgaaaacgaaactaacaaaattaaattagggacacccattctgcaggattgtcaattttttattggggcctaaactccataagaaccctattttttatatataaaaattggtattttttcatttattgaaaaaccgaaaattgaatgcgttcaattctcaggttggattcacgcggttttcac

SEQ ID NO: 22280 - DNA, 1721 bp, Heterodera glycines
caagaaaagcttaaataacaaaaaattcgaatctgttatacaattccatgctgtgtagttttctataaagcaattattcatccactcttaattactcacctattctagcccattaaatgccatcaccctttaaagatacttcgcaagaaaagcttaaataacaaaaaattcgaatctgttatacaattccatgctgtgtagttttctataaagcaattattcatccactcttaattactcacctattctagcccattaaatgccatcaccctttaaagatacttcgcaagaaaagcttaaataacaaaaaattcaaatctgttatacaattccatgctgtgtagtattctataaagcaattattcatccactcttaattactcacctattctagcccattaaatgccatcaccctttaaagatacttcgcaagaaaagcttaaataacaaaaaattcgaatctgttatacaattccatgctgtgtagttttctataaagcaattattcatccactcttaattactcacctattctagcccattaaatgccatcaccctttaaagatacttcgcaagaaaagcttaaataacaaaaattcgaatctgttatacaattccatgctgtgtagttttctataaagcaaatattcatccactcttaattactcacctattctagcccattaaatgccatcaccctttaaagatacttcgcaagaaaagcttaaataacaaaaaattcgaatctgttatacaattccatgctgtgtagttttctataaagcaattattcatccactcttaattactcacctattctagcccattaaatgccatcaccctttaaagatacttcgcaagaaaagcttaaataacaaaaaattcgaatatcatactccgggttgagtgcgggtgtgggcgcggtggagtccgacaattgcctgcacttgggtgcaggactttgacaatttggagggagagcacaaaggggccgggggcgatcgagacgggactacggtcggattggggccgcacagaaagaaagcacagaaaattaccaccaaattttatctcaaacttgggtaattaaaccgaaatgggtgagcaatgggggaggacaattgagggggggcaaaaatcggccaaatgggccacaaagtgaaaaatgtgaacaatttggccctattagcccatcacaaaaaattgcattgaaattggtcaaaaatgggggaaattgggagagcaaggagttggagcagtacaacaacggaattgtgtgagggggcgcaatcaatgcatggaaatagcttggggggcgccgtgatggtgattgattggggagcggggcgcttgtgggacaattgtggggggcgagaggaagagagagagagagagagagaggcgaagcaacactttggtgtgctgctgatgattggtgtgttgatgaagcgctggtgttgagcacttatttatattggccaaaaagtggggagagaatgggcgagttgaagctgataaggcgggaggaacggaaaattgctggggagagtgacagccagtgataaggattgggggaggaatgtcactcaatcgaacattggccccaaatttgaaaattgtttaatttggtttttggtttttggggccaattcaattttgcacaatttgtgcacaattgtaaatcaaattatttgattttcgcgagagggcaatcgcgacac

SEQ ID NO: 22281 - DNA, 2002 bp, Heterodera glycines
  misc_feature (1994)..(1994): n is a, c, g, or t
atagatggataattcaataatttattgccttttttcctgcacagagttcggctagggacatcatgttcgaggtgggggacaagcagcgtcgcattgccacagcgtttgaagcggtgcgcaaccggacaggcggcgccgacgcatcctttgcctccatgccattcccgtcgctgatcgcccacctgcagaaccgacgtgccaagcgccagaccgaggcttgcgagtcgtgctgcattccgggccatcccggccgcgctggcacgccagggccgccgggacagcccggaacgccgggcgcgcccggcagacccggcgcgccaggtaatttaaaaagaaaaattttaaggaattttaggcttacaatgaatttattggtctctgagctccgagttttcaattttaaaatttattttttgataaattcaataaaaaatagataatttaaaaaatagaaaaaaaaatttggacactacggaaaaaataaatagaaattcttagtccaaaaattggccataacaagaattttttttattgtaaattttcatcaattattcaaataattttcgaaaattttttgtgtgtgcctattttttcaaaaattatttttgcgtcttgaatagaataaaaaaaacaaaatctgctatatgaaattaaaattacgtaaaattaaaaaattgtaacaaaaaatgatttttaaaaagatggcgcaaaaaatttccaggacgaccgccaatgatctgtgaggagattgaaattccgccatgcaacccgtgcccgcctggcccacccggcaggcaaggcccaaccggacagcccggcacacctggcagatccggacctcctggccgacctggcaccaacggtgagtggagttaaaaaagtagtttttgttttttaattttacaattttaggcttgcccggacccccgggccctcctggaccgcccggcacgcctggacctactggacccgatggagaggtacagtctattatgtcatactgtattcttctagccaaaaatttcattccatgccaatgcacaaagccgaacaaaaatcgatattcgaaataataaaacccaaaattttcgaaataaaccggaattttcgcaggcttttctggatggcgcccggaaaatgcgtcagtggaaaatgcgttagtagaaaatgcgtcagtgaatgttttattgtcataaaacaagttccttgcgttttcgggggcacagaccatgaatccggtatccatttcggccaaatccgaaccccagacccgaattcgaacaaaaactcgaaagtccaaattttcgaatttagcatttttggttcaaaacggcatacatgatctattattgaaagactgatggcttttagtttgtttccgtgtatttaaaccaattttgaagaaaaactctaatttcgaaattttgactttttaattttttgttcgagttcgggtccggcgttcggaatgcagaacgatgttcttatagaagtttatttctatattacaatacaaatgccatacaactttattttaaagtattttttatcactgacgcattttctactgacgcattttccactgatgcattttccactgaccgattttccggtcacgcattaggttatgtatttcaaaaaattatgcaattaaagatttttatacaaaatgaagtaatttggacaccaaattcctcttttaaaatataaacccaagaattaaacattcaatatgcacaatgattgatcaaatgtggcaaaaagtgtacaaaattaggcgatgattgatcaagatgccaaaaaatatacaaaattgggcgattattgttcaatgtgccaaaaaaatgcgcaaaaaatgggaaccccatcaaaaatttttttcgttatgaatgtatgatggctttatgctgctgatgctacaaataataataacattatttattcaattaaaatttttgtttatttatttttaacttatttattttttattcaantagtgtcc

SEQ ID NO: 22282 - DNA, 1585 bp, Heterodera glycines
  misc_feature (1541)..(1541): n is a, c, g, or t
  misc_feature (1550)..(1550): n is a, c, g, or t
atgaccaactcgggcagtcagaacattggcaatgtgatcaggtgggaattgaaggggacaaaggcgaagtgatcaaagagaaggacaaagagacagtggaaaacgattgactgataaggaaatgattcaaaaacataaataaaatgatcaaagaaacgtgttaattgatacgatttgtcatggttttgctcttggcacaaatgccgtccactctcagggacaccaacttcttggagccgggtctgttcctctaccgcatttcgggctcccatccgttggacccgcgccagggccaaaagggcgccggcggaagtctaacgggggaagaggaaagcgactacgaatatcagcaggagcagcaggattacgagccgggggaccaaatctgtgagttgatttgacccgttggttcccaatgttcgcgagtgattcagcggaatgtccgcccgaccctttccgcgactcgtgcccacccaactgcaacgtggtgttggacgacaatcattgctccctttgcatttgttcaagtacgtcttcgagacgtcgcgcacccattgccattttcaggtgttatttcggagaatttggccgggtcggcctacgaaaagcactcaaatggtttgcacttaggcaatgttttgccaatgcttcaaaagttttttcagacatttctcccgaccgttcgcttcgtccgttgcccatggccactctctccgcctctcagcgcacttccgacttgagctgtacgcctcggcagggtcggctccaatgccatcccaggtgaccatcactttcggcacttttccaatcctcgcaaattcaattctcttttgttcgcagtgccaattgcatccagcagaacaacggctactgttgccaatgtgacaatggcttcatcggcaacggcgtcgagtgtttggcgaaggacggaccgttgcgaatcaatggaatgtttgaagcggcactgaacggaaagcaaatgcaacggacggaccttttcggtcggagatacccactgattaaactcacatgggttgtgctgatcagtgcacttacttcggtcatttcagcgtacgttcagcccgcggagggccaacaacacacggcattggccaaagtgccgcccgaaatgggctggtcactgctccttttggacgcactgtccacgccgttcggttggcttttcgccaaagtgccagcagatgcgcagcagcagaacggattccaacttagtggcggcaatttcactcggatcgttaacattcatttgggtcggtgtttctaatcactcaaatttacgccgtttcttttctgatcagtgccaataatcaatcagataattgaacaggtgaacgttatgcgctggtcatccgacaagaatttgctgatcgccagttcaatgagcacttttccgtcaatgttttcgtcagcggaactttgccccgagtgcgcggccccgtccaagtgacagtgcccgaattgaagagacttatcgcagagagagagccggtgaatgaatgaatgaatcatcgaattacttnttgcgattngggggaaagaaaagggaaaaccatcaaaatgggcg

SEQ ID NO: 22283 - DNA, 1182 bp, Heterodera glycines
tccgaacggcacttaaatgtgcgcgccgcgggggaagaggagacgaaagtccgcgtgacaacggtaaaatcaggcgaaaagacaaagcaaagcgaagaaaacactccaattaaaggaccagcaaattcacttcgtcgaatgtccccacaaagttcgaattgcgaaatttccatgggaaaatccgcgaaaaatttaaggcaaagcaaagcgacgccctttccgttgtgaaattcgaacgattaaacgccaattttaacaaagaagaaagtgtagtgcgattcgcatcgcaaagtcgcattgtgagcaaagggggagaagagacggacggaggagggacggaagacagacaggtgggggaagaggaagaggaaagtgatcgggaattggggagggaaagtgatcggaaaataaggaaggaaagtgatcgggaattggggagggaaagtgatcggaaaataaggaaggaaagtgatcgggaattggggagggaaagtgatcggaaaataaggaaggaaagtgatcgggaattggggagggaaagtgatcgggaattggggagggaaagtgatcggaaaataaggaaggaaagtgatcgggaattggggagggaaagtgatcggaaaataaggaaggaaagtgatcgggaattggggagggaaagtgatcggaaaataaggaaggaaagtgatcgggaattggggagggaaagtgatcgggaattggggagggaaagtgatcggaaaataaggaaggaaagtgatcgggaattggggagggaaagtgatcgggaattggggagggaaagtgatcggaaaataaggaaggaaagtgatcgggaattgggagggaaagtgatcgggaattggggagggaaagtgatcggaaaataaggaaggaaagtgatcgggaattggggagggaaagtgatcggaaatggggagggaaagtgatcggaaaataaggagggaaagtgatcggaaaatggggaaggaaagtgatcggaaaatagggaaggaaagtgatcgggaattggggagggaaagtgatcggaaaataaggaaggaaagtgatcgggaattggggagggaaagtgatcggaaaataaggaaggaaagtgatcgggaattggggagggaaagtgatcgggaattggggagggaaagtgatcggaaaataaggaag

SEQ ID NO: 22284 - DNA, 1376 bp, Heterodera glycines
ttttttaaaaaatttcattaggaatttccatataaaaaaaattctgaatttttttttcttgaaaatttccaaatttttttaaaaaattctttggcgaaattatgtcccggcgaaatttcggccggcgaaattttggggtgcacccatttctgattatgcttttatttggtatttaaaataattttcctcagaattaatcgaccgacttttttgacaaatcagttggccattttcgtaacaaaattcattaaaaattctttaaaattttcctccggcggcgcctatcggcaccgccgaccccccaaaaagctatcttttcttaaaaaattagccaaaatctcaaattttggtatttttagacaaaatctactaacaaatagcattaaaattacaaaaaaatttcccggcggctcttatcagcaccgccggccctaaagttatggcttgagctcgcaattacggcaccaaaaagcgcaaaatagcactgaaaaaaggcacaaaaatcccgaaaaaggcatgaaaaaaggcatttaaatttttttattaatgatttttagggagcaaaacacgtaaaaactaaccaaaaaactaaattttgctgatttattgataattcaattttataatgtctttcaataaggaaatttttaaacctaaaattttttatcaagaaaaaaaatgaattttggcgttcaattcataaaggtatattctctgaatttttttacagtagctctctcaattggctttaattatgcgctcgactgacgcatagacgcaatcaatcaattaattaattataatttcatccatcggcaggtgacccacaaaattgaggaaagcgcttgccgtggttcggcccccggcgacaccatccaccaaaaaaaagatgagaattaaagacgatgatgatcaagaattaaaataatcaaaaaaaattaactttttcgatgaggaatattttctgattggagggtattcaaattcattaattttacttggtaaatgtgaataaccatcggctgtttggaatgatcaaattaaatatcatatttactataatacagccccctctgaaataaagccctccttttgaggtgagttgaaaaataaagccccggggggatttcaagggaaggtgttctgttccttgtcaccgatccaactctccgccacgtcgcatttatgatgaactgaagaaaatttgtccagctttgatccaacgcttgatactccgcacaatctccgcacggctttttcgctggactcggccaactccatgcctttggagcgcacaacttccacttggggctgatgggtatccaactcattgttttcgaaaaaaaatatttaaagaaaatccttaatatgatgcc

SEQ ID NO: 22285 - DNA, 1477 bp, Heterodera glycines
  misc_feature (1451)..(1451): n is a, c, g, or t
tttctgccgatgggtgaagcaatgctcggggctgaagctcccccaatgcgtgtaatgacggacggcgctgtttgctggtattacaacaaatttggagcaaatgtctacgttgactgcacataatcaacaacaacaacgacgacagcaacaactccatcgcctacaaccaaagaaaccacttctttggatgtggaaattgtggtcggcggctgtctggcggccatcgctatcattgcgatagcggccgataacttgaggcgttttaaaaaaaagtaagctgcacaaaattaatgctgggcaaattaagcgattatttttagagggaatttatttattttttctaaatttctcggagcaggtcctttcctctccgcgtcgccacccccccccccccccccgaaatgttttcaaacctagaaactttttattaaaaaaaattcctaagaaatttcttaataagaaaacttcaagaaaaaattttttgaaaaagacacgtaaacagaaaattcttaacaaccttttttaatgttttacatagaaaaagcattaaaaatcgctactcttaaaaaaaaaattttttccaatatctaagaaacctaattgtaagaaatttagaaaaatgaaatttgatgcattcttttcgggtgcctaacttccttgcgtggccattaagagaaaattgaattttttttagtggttttgcttttctgccgatgggtgaagcaatgctcgggggctgaagctcccccaatgcgtgtaatgacggacggcgctgtttgctggtattacaacaaatttggagcaaatgtctacgttgactgcacataatcaacaacaacaacgacgacagcaacaactccatcgcctacaaccaaagaaaccacttctttggatgtggaaattgtggtcggcggctgtctggcggccatcgctatcattgcgatagcggccgataacttgaggcgttttaaaaaaaagtaagctgcacaaaattaatgctgggcaaattaagcgattatttttagcgggaatttatttttttttttaatttctcggagcaggtcctttcctctccgcgtcgccacccccccccccccgaaatgttttcaaacctagaaactttttattaaaaaaaattcctaagaaatttcttaataagaaaacttcaagaaaaaaatttttgaaaaagacacgtaaacagaaaattcttaacaaccttttttaatgttttacatagaaaaagcattaaaaatcgctactcttaaaaaaaaaattttttccaatatctaagaaacctaattgtaagaaatttagaaaaatgaaatttgatgcattcttttcgggtgcctaacttccttgcgtggccattaagagaaaattgaattttttttagtggttttgcttttctgccgatgggtgaagcaatgctcgggggctgaagctcccccaantgcgtgtaatgacggacggcgctgtt

SEQ ID NO: 22286 - DNA, 1572 bp, Heterodera glycines
taggggcgaaaaagtccaaaataggacccaaataggggcaaaaaattcgcgaaataggggcgaaaaagttccaaattttgggatataattttttaaattgcagttttttatatgaaaataatttcaaattaaggcaaacaattttattcactgattgcagttacatataagatatattttcgaaagttttttcatttcttatgggtctatttttgaaaaatttagtgtcgattcttaggggtatatttttctgaaaattttttggtcgattctttggggtatattttttcaaaattttttggatcgattcttaggggtgtatttttcgtttttattgcatttttgtatttttatccttggatatcatttgagcttctctcgccataactaagccgcaaaaaaaatatgtaaaaacataaaaatccggtctctattgatgatatatggaactgcgtttttcatgcttattatcaacttcttacttttgattttttttaattgtagtaaagttttccaaaatactgttttttgtcggccaattgctgatttttaaattttcatctaatcagcagaaaatatttgtaaagatggttgaaatacatcctttctgtaacattggtgtactgcgaaagaccgatgataaatcattaatgaatggacagttggcgttaaaggttttaaaatggaaaaatgtagatgtgtattaggctatgcattcccataaaagaactaattttggcaaggcagtctttcggttcattggtcccggttttttataaataaaatttctggaaacatatttctaaggctaatttgggccgctgggtacgaatctgaccaccttttcgaccaattcgaatcccgaacccgaattcgaacatttttttaaaaaactcaaaaatttcaatttcatcaaatatgtacgcattagatgtccggacaacgctccaattgtctaattgttgcccagttttttggacgaatatatgtggcaatagttcaacggaaaaaagttgtcaatgcttattgttaggcgtacttatgtaaatatttgatgaaattgaaatttttaaattaaaaaaatgttcgaatcgggttcgggatccgaaattggtaaaaaagccgaaaattagtacaatagcaaatcgactatgctctacacgataaaagcggttttaaaaagtaattactcaatccatgacaatttaactaaaacatgcatgcacagagcgcgcgcaattaccttagtcctgtttgtccgatgcatgcagctgattgcactcacagtcctctctgcaggacacatctttacagctcaagcactcgtgcctgcagcaacgcgagattgattttaacggaaaaatgcatgcacgtccgagaaagcgcgcgcccgtctgcacgcaatgcaaaattttgttcgctattttcctgttacaatcaaaatgttttcacttaatttcttcattttttgaatatttaaatattatgtaagaaaataagcatggcaaaaaataggtcctaaaaagaagaaaaaaaaaattttttttttgttttttctaaaaatatgactct

SEQ ID NO: 22287 - DNA, 1306 bp, Heterodera glycines
ggttttttgtccaaaaatgaccaaaatttgcgattttgggctaattttttaagaaaaaagtgactttatgccaataaaatttcaaaaaattctcaatcatgagaaaaattacattttattcacgaaagattcctaataccatattaataatcttatataataaagttgagtgtttgtgctatgtatgtatgtaacattgtttgaatgtggcgttttgtatttgctgtgaggagagattgaaaagaaaaagagatgaaaagaaatagttttgaaaaagaagaagttaaaagaaatagtataggaaaagaaaaaagcaaaagaaatagttaaagcaaaaagatttctcttggaatgccggagatttgagtctcagagattgaaatgctggtgggttgagttccagagattggaatgtcattgaaagttggtgggttgagtcccaatgtttagaatgccggagatttgagtccattgtttagaatgccggagatttgagtcccagagattggagaaaaagcccagtctattttatcattcttaattctataacacaatcgtactgcctagcgggggatgcgccgaaggcgctgaccccgctataataaaaaataataattctcaactatgagcaaaaaattgacataatgccataatttaatatccaaatatgttataaattcaaaaatttaccaaatttcctttgattattttttccacttttccaaatgctcattttcaaggacgtccttgcatccaaggacattttttattttcaagaaagagggcccaatttcaaggacgtccttgccattcaaggacgaatcccatccctgcaataaaagctttccttccatttttaggtacatcgatcactctgtcatcgcttttcttcgttcaaatcaccaaatttttgagaaaagaggcatcgatttacatttgtggattccagcatcatacaacttggatgagcagccaatttgggatgtttttggtcgtgaaatttggcccattttttcgacaaacattcgctatttgggctttaccggtgctgatcatttggacaatttgcttcgtcgcacttcgccaacaattctcactgatctcaaccaattgacttcaatctattcctgtgctttgttgcccgctgcgtttggtggtgattttgatgggccaaatgcaacaatttctgctggccaagcattgtccaaatggttgcacattccgagaaaagatggccaacccaagcgattgcgttgcgataattacaacgaacaagcgaacactgattggatcacaatttcaagga

SEQ ID NO: 22288 - DNA, 903 bp, Heterodera glycines
agcctaaaaagagtgccagtttgaggattgtcggtcattttgtgaaatgccaaagttacgggtgtccaatcgtcactgagaattgacaggcaaatgtgcccgttggagtacacgtggggatgcaccggaatgttttcacccataaacataacctaaagggcaaaaaaggacttattgtgagtgatttgaaaatttataaataattggttcttcaaatcgcacatacttctggcgatgagaatgggtattggtcgtcaaatctgaattgcaactgaaaaatttcactgtcgtacaaagtattcctgaaatgaatgtaaaaatttgcaattaattgtcctaaattaatgaacaatgccaaccttgccccctcgaggatgagactccaacacattaaatttgcggtcgcctgctcctcttgaatcacatgaacacctaaaaaactaaactggagaaacaatcggaaataaattgggaatggaaaattgctgcacattaacgcaaactcagtgccaaacctgaggggggatcttttagcatttgggtgagttcctaaacaataaaagtgaaagggttttttttttgagtaataaccttcgccaaccgccgtttggttgaatccatcgcaattaggtataacaaatatagtattaattaattaataatcagatggaatgaaagcgactgaaaaatgaaaaaccttgtataaaaacgaattctcgagccaaaattttggtagaaaaaccgggattaataattgtgaaatggataggatgggtgagagccacaaataataaaagggttttttacatttttcaatattttcaactaacaaaacggaaggggaggcaaacgaacgaatgaatgagagagaaatcgatgcagggggggggggaggaatgaaat

SEQ ID NO: 22289 - DNA, 712 bp, Heterodera glycines
  misc_feature (673)..(673): n is a, c, g, or t
cccccccccactcatccacccactctttcctcccccctccctcctctcccatccatccagtccctcccattggaattaatatattgctccgtaattgcaattgcgcgccgctccttccccaaatccgagcaattccagccagtttccttcctgctccccaccttatcccttttttcgtcccatttcttcatcattcccttcgtcagcttctcctccgcccctgtcttcttcgtcccatactttttttagaaactcgtcgtccaaatagccacaaatggctcaccgtcgccgtctcttctgctgcttcgtcccgctccaaattatgataaaagagaggccgcgttgtgctgccggtggccatttagtacctcttcgacccccgccgaatatttgcgcttattcgaaatggcaatgggcggacattcgccgcatttcgccaatccgtccaccaaatcccaacaatttcctttcaaataattaactttccggcattaaatattggaaatcgaagaaggcattcattcattcattcatcgcagtgaattgtctccaaattcgccgcccatttgaagaattaccgagtcgccgacaaaagtgtcaatttgtggggcgcatcgacagttacaaaatgcatcatcagctgtcagttcctttcaacttttccgtccaagtntctccgaacttccccccccccccccaaatgacaaatatg

SEQ ID NO: 22290 - DNA, 2204 bp, Heterodera glycines
ggttttttgagtttctcaggtcataacttttttggaacttgatgatttttttttgaaattttgcatgataatagaaaacacttatggctaccgaatgatatcaaggttttaaaattttcttcattttgggcgaagttataaataattttttgtcaaaaattttccatttgatggttttatgactatcgttccagcaccattgatacttatggccagcaggcccctaaccagaaaaaaaattggaggcctcagttttttctttttaattcacacaaataaacaatgttaaattaccgtatcatccaattaccgtactatctcattttccaaaaatactactgtatagcagtgacgcatttttccattggagctttttccacattttccatcgatgcatttccgggcacgcacccactcacgccttctccttcttcgctggttatgggcctgctgcccatgccccaccccaattaaacgacgactaattaggcacccaattaataataatttagcccctcgcgcagaaagaaaaatgggaaaaaattggacaaaataataaaatccgttgcggaagaggagaagccgaagaagcaaaatgacaaaaataatgggaggaaaaggaaggaaaagaagaagaaatcggagatgggaaaaatgggaaaatttatgtgagtgaatttggggggaggcaattcagagccaaatttgagcaacaatcaaacttttaagcaaatttaattaacagattataatttgaaaatttacggtggagtatttttcgggtaaaccggagaaatctgaaatcggaaaaacccaatgaagcccagggatcccagttctccacctggtctggagaatttcggccgaaaatcctgtctagtgcctttttgacgaaaattcatgaaaatccgagagttttaattaattcaaaattttaaagtgtcatttttgtacaaaatctgctaataaataataaattaaaacaaaaattcttaagaaattttcctccgcgattgactgactctccattgtcaaaaattggaaaacatttttaaaataatttttcgtataaatagaaaaaattgaaaatttggtcctcgtctgctgggcatgaaaaaatgttggccgcgtattcagcgtgtacaaaatttgctagtaaataataaattgcaccaaattcataagaaaatttcttaggcgacggtccctgaaattattttgagaaatagaaaaaatttacaaattttgtcctttgtctgctggacacattaaaatgtttgttggccacgtattaagcgtttttcgaattccattctcattcattttcatatgcattttgacccctgtttttgagcacaggttcactgtgttcatggtgatcagtatgttcgttccacaagttccgctcaatttggtgatcagtaagtgcaaaaatcaatcatttaaaaatttatctaatccaattgcatacgccaccaaaaacaacatattttcaattataaaatctattatttttttaaatgattatagataagttttcaaaaaattattttctgttttataaaataattattttatttttttgccttatttttttgctgatattttaatttttattagtaactttgagatgattaatgcaaaataattcgttaatttaattttcaatattttaattaattattcccccttttaattgcatttgttttgaagagcacaatgaccaatttttgccaattgcgccagaaaatttggcgtgccgcgaggcgaccaatggcagcggtttcaattgcgagctgagcgtcaaccaaatggtggtggacgacgactgtagggacgtgtccatttgggcacggatggacaacgacacgagcacactccaactgttgggcgaacaggtgaagaagaagaagaagttgaagcagttcagggaaaattggataagggtaacactggagaattgaatgatcaaaaattcttggaaaattggcacggattttcattaaaatgggactcaatgggttttttgggcagttgggaagctggtttttcgaaaaatttaaataccaaggatttttgggaaaatgggcactggaattgatgaaaaattacacagggtttttgaaaggatttttggaaatttgtgagatcggcatcagggataagggaaaatcacaaaaaaaaattttcgtatacgaaaacga

SEQ ID NO: 22291 - DNA, 1214 bp, Heterodera glycines
aatctctgttgtacctcttctaatcacttttatacctcttttatcacttttgtatcactttttcactgttgtacctcttctaatcactgttgtacctcttcaaatcactgttgtacctcttataatctctgttgtacctctcctaatctctgttgtacctcttctaatcactgttttacctcttaaaacgggcgcgaatccgccctttaaggccgcgaagcggcctaaaaatcgctgataattttttaaaattccgataaattatccctaacatcttctatcttttcattacttttaataaatttaaatgtttggttttattaataataaatttttttagtttaattaaattattttttgatgaataatgatgttcatttaaattatttattatatttaattaaagaatttcagctattattttaaaatttaattttaaaatttttttcatttcaatttaaataactattcaattattatacatttcataatttgtttttcattaataaaaagtgtattatattttaaaaaatgaaaaatataacacatcgattttttatctattttgaataaaaacaattccttaattaccgtaaatgctctatttgaatgcccactttctaatcactcttgtacctcttttagtcactttttcacctcttctaatcatttttgtacctcttctaatcattggtgtacctcttctaatcacttttgtacctcttctaacaattttgcacctcttctaatcactgttgaacctcttctaatccttttgtgccacttctaatcactgttgaacctgttctaatcactgttgtaccttttttaattcacttttgtacctcttttaatcacttttgacgtcttttaatcacctttgtacgtcttttaatcactgttgtacttcttttaatcactttttacctcttttaatcactgttgtacctcttctaacaattttgcacctcttctaatgacttttgtacctcttctaatcactgttgtacctcttctgatcactgttgtacctcttttaatctcactgttgtacctcttctaatcactgttgtacctcttctgatcactgttgtacctcttctaatcactgttgtacctcttctaatcacagttgtacctattctaatcacttgtacctcttctaatcactgttgtacatcttctaatcacttgtacctcttctaatcactggt

SEQ ID NO: 22292 - DNA, 2014 bp, Heterodera glycines
cagaaaatgctctgaaacgcaccaaattttatttatatgctagtttaggcactctgatgctttttctatcaaaaagggagatgaataaatttttaaaaatttttaattcctttttaaacaggccaaaaagtttaggcttatcttttttttcagaaacttatcagaagcgccccaaactttgcagggatactgaaaggaaaagaattaacctgttttatcacattagcttgtcatcagtttttataaaaaattttcaaaattctgagtctcctattattttatttttttttcaaaattttgaagggcggagggagggcgaaggcccaccacgaggccgcgaagcggccgagtgagtacctcggtgcatgaaaattattaaggaagagagttcattatttgtttattttttgcataattaattcataaatattttttccagaaaatgctctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcattaaatatttttatccaaaaatttttttttgggttttcggggcagtccccctggaccgatgcgcccagattatggggagacggatccttccgggatagcttcccgatagcctgtactttaattctgcgttggatttttgctccccataatggttggagtaccccaaacggacaccttgaaaaaatcgattttttggttttcgggccagtcccccggaccggatgcgcccagatttatggggagacggaatccttccggaatagcttccttatagcttgtactttaattctgctttggatttttgctccccataattgtttgagtaccccaaacggccacttgaaaaaatcgattttttgttttccggggcagtccccccgaaccgatgcgcccagatttatggggagaccgaaccttcgggaatagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgattttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggagcgaaggcccaccacgaggccgcgaagaggccgagtgag

SEQ ID NO: 22293 - DNA, 2414 bp, Heterodera glycines
  misc_feature (28)..(28): n is a, c, g, or t
ctgatcagaatggagttgaaagtgcaantattgatcaatgtcggtgaaatttggttgctttaaaaaacaaaactttcattttaatttgaataaaatgaaaaagttacgctatgagaagtcgaaggcgcattgcgcagctgataatgataatgatcatcatcactttccccttcctcatcagcagaagcattgaagacaatttgatcaaaaaaaaaagatgaaccgttattcgttaaagagtcaaaaagtcaaaagtcataccgaaaaagctgagacattccctttcctcggcactcatttcgaattggccatgccgtgtctcaactgattctgcggcctgtccatgaccatgcccaacttgctgctgctgctggtgttgctctctctgttcctcgtgctcgttttgcgtgtcttccttttccctctctttttcctcttcctctttctcctcctctttttctttttccctgtcttccttttccctctctttttcctcttcctctttctcctcctctttttctttttccctgtcttccttttccctctctttttcctcttcctctttctcctcctctttttctttttcaatgtcttccttttccctctctttttcctcttcctctttctcctcctctttttctttttccctgtcttccttttccctctctttttcctcttcctctttctcctcctctttttctttttccctgtcttccttttccctctctttttcctcttcctctttctcctcctctttttctttttccctgtcttccttttccctctctttttcctcttcctctttctcctcctctttttctttttcaatgtcttccttttccctctctttttcctcttcctctttctcctcctctttttctttttccctgtcttccttttccctctctttttcctcttcctctttctcctcctctttttctttttccctgtcttccttttccctctctttttcctcttcctcctcctctttttgatcctcctctttattctgataattttctcccctcatttttccccttttttgctgagtttctaatatttcttttgcccaattgatttcatagtcatgcagcttctcaccaattatttttgccatcgaaaaaataatgccaactttgattaaattgcgtgccgaattcctttcctcctaaactttgaatattcaattaattttaattgtttctctcttttttcttacctttgtcccttcattttccgcgaatagttttgtgcttcttgctgacatttttgtcagaaaagcaattagcgcttctccaatttggccttttattgaatgcatttctcttaagaaaggccccacaattattcctccgctgtccttggccaattgaatcaatgcctttaaaatgggtttttggattaaattactttaaattgccaattaattgacttaaccgaatcgggcggtattaaattataaaaggaaaatgttggagaaatatgccgaagcagcaaactgatgaatttgcgagcttggaaccgcgtgacaattcgacgattttctcaaatggaaaagcattaaaatcatttcgataaaagaataaaaaagaccgaccgaatggggcaaaaaattgggaaatttcagtgggaggcgaagggatcggtggggaaattgcggacggagcagaagcagggcctaaatgactaatcgttttcacaattttgcatttaagtataaaatattaatttggattcattttattgccaaaataataaaaaatttattaaaaaatataaaataattaacttttttaaaattatttgataaaagagaacaaaaaaagataatttcgatttaccatgttcttccaaatcaaacgcaagtacggaatttgacttttgacggaacaaaaatacgaccaatgcgaatgccaataaactcaaaacattgtcattcatttttgtgaacggctgaaattaatattattttgtgaaagaaaatgataattttaagatggtttttccattttcttttaaaagcatttggccacgtttaacccacgcttttcctgccaaacattacacatacccaagcttatatgtaaaatggttgctattaagatttttaatcagctaatattcgacgttaaaaaggtataattgaatgaaaaaaaatgcaaagagaaaagtcagagctcccaagtgtcctgattttcttctgtatcaaatatcatatttttcgtctactattattagggctggcaattttatgtaaatagatattttttcctggcttctccatgctctaaatagtaggaaaaacactttatttttttgtgtttgagaacaaaagttgggacttttatttacatatttttacatatttcgggtttttctacatattacaaatgtacatatttttatacatattt

SEQ ID NO: 22294 - DNA, 1410 bp, Heterodera glycines
  misc_feature (1225)..(1225): n is a, c, g, or t
  misc_feature (1273)..(1273): n is a, c, g, or t
  misc_feature (1283)..(1283): n is a, c, g, or t
  misc_feature (1313)..(1313): n is a, c, g, or t
ggaacccaaaaggaaaatgcccaaaaatttcgcattgtcagtgcttccatttttcggatttatttgtgccacaatttttccacggcaatcttcactcaaaatcgtgcaaattccgacactttttcaatgtccataaaaagtgttccattggatttgctttgaaccaaaattaatttgtccttttttggtccatcaacagttgtgatatcaatggtcaatgtaattccttcagtttaatcttttaatttttttgggtcaccattttacttcgataaaaattatatgggaaaatggaggtgggggagggggaagataagcaaatccaattcaaatgccaatgggtagttgagttcatttttcgacccatatcaatagctaaatgttgcttttaaaaaaaacgatgggaaaactggcagaaaaatggagagaaaagggagtattcctcccgaaatttacaacaacaaaaaaattcaaaaaatcaaattttattcacaaaatgtaaaaatttagacaaaaagcaaagaacgaactaatggaaaaaggcaacataaaatgaaggagtaccagtactttttctgtttttgttctatagaagctcatactgttttataattctttgtaagtcatattgataagggcaaaaaggaaagcttcatatctctgccagattgctcctctccatttgtcagcaatttaccatcgatcagagccaaaaagtgccaatttgttttgcttagctcagctggggtgtataacataaaaagcgttttgggaaaattacatataaaattatcattatttttgcctaaataagtgaaatgacaatggccgtccacatgaccaatttgaattggatgctcagtttgcggatggactctctgattttgatgtaatagcccttcaaaagcattcacaaattgacataaatttacaaatttgcaaaaatatgatgtgaaaaaatatgaagcagcttttgctcgctttttgcccccgagggccaaaatcaaattaggatgggcaacaaaaaagtgcaaataatgggggcgaagaagaaacaatatgggacgggctgattcttcgaacaacatcaatttgaattttttgttttaatttagttgcttctgttcgcattgtgaagtgttcggcataattgtggctttttgtctttgcaatgccatcgattcggaagaggcgaccaattgacaaacaagaacaaaaacagaanaagtatctgtgctcattcattttatgttgcctttttccattagttcgntctttgcttnttgtctaaatttttacattttgtgaataanatttgattttttgattttttttgtgttgtaaatttcgggaggatactcccctttctctccatttttctgccagttttcccctcgttttttttaaaag

SEQ ID NO: 22295 - DNA, 1755 bp, Heterodera glycines
tgcaggtcgatggggatcaccaaccctcacctaattttcactttcaaacgtactgaattgtttgttaatcaaattatctgccttatcaaataagcagctttacgaaacgaaatctggaagcttaaacaaagtgaatttatttgcaaatataaaaataatattgaacctgagctttgttcggaatgagataacaagatgagaaaaaaacaaattttactttggacggacttctagctctgtcatacggcgaatcgttaatgaactctcggggatgggattcggatcgcgttcctcctcgtacatataagtagaagcaattgcgagcattccaccatcaggagagaatgagaggcttacaacagagcttgggaaccttgaaaagaggtaatttagtgaagcaaaaaaaagcgctaatacttcctaaattggcataagcgcttccggttgaacgggtcccacatgttaacgatgtaatcgctccctcccgtggcgaaagttcggtggaccgggtggaaggcaacagcgttgaccgggtaaataagctctccgaattcctccttcacgcgatggcatttgaatgcatactgttgtgagaagttgtcatcacaaaacaaaacaaaaagaatttacctttcctttctgtacttccgggtcctggtcgaagtattcaacagccacgcggccttcaattgaagacaaaacaaacgcttcgccagaggggaaacatttgatagaacgggtttggaactaaatgcctgaatcagaaaactgtaattttgcttttcaaactttcagtggcgattctcttgtctgcaatggggctttcatattccgaacatcccaaacaatcactcgccgatcttttgttccaacaacagctctgttgtctacaacgtccagtgcatacactttgtctccacattccatggcaccgactggcatcaaagcgcgaatgtcccacaactgttaaaataaattagagatattggggtgaaggggtgtaaaggaccttcattagattgtcccatccacccgaaactgcaacacgcatagtggcacaaaactccatgcacctcactccatcggtgtgttggcccataactgtctctgaaaagaaataatgcccaagttatttggatatctgtcaataccacgtccactctccaagtcacacactttgaccacctcatccaaaccaccgctgacaacttttattgcatcctcaaatgaagttgttcaaaaaagaaaagaaccaaaattcaagacaaaatgttacgacaaaagtgcagcaaagtacagatttagtatggtaatatgtgcgcatgtccattggtgcccccggattggtgacatcgaaaattttaacaaaagtatcccaagttgagacggcaattaatcgtctagtaatgtcaggagaaaactgaataataatgatgaaaaggataaaaaaagaaaatagatacctgaattttagaaataccataagcagttttgagagaaacaggaaattcatttgccgaagcacgtaatgagcattcatttcaataatttatatctgagaaaattaatagttttacacatggttctaaatcaagcaaaaaaagacaatcaaaaatgtaaaaacatagtctcgggaatttgcagaaatcgagggagggcagatcgaatttgaattgatatgtagtaaaaaatacaatgttaattatagaaacgaaattctgtgaaattccataaatttgtagataaggactaatt

SEQ ID NO: 22296 - DNA, 2201 bp, Heterodera glycines
ggtggtggcagaaccaaacggacgagtgccagcgtgaccaaagcaagtgacataagcaccaaaacaaatattaccaccaacaacaatgacgacaagagcagcagcaacaatctcgacaaacatgacaccagcaacacaagcgttgacgacccgttcaatttcaccactcaatcggacgttcatcctgagccattgaagaacattagtgtaagcattgggactgaaatggccggtccaacaaagtgtttttttcaacaaatgaatcattcaattttgaaaaaatgaatgattgaatggttcattcaactcccatccttttgtttgtgtcgtaagatggtgcaatttcctcccctcccctgccattatgcacagatcgaacgttcatccttcaatgaggtgaagtacaccaagtcattgcccagctcggctgaccgttacgcgaacatggagaaaattgcggccagccgcaacccgcagttggccgcttcgctctccacacagccgtcaaattcagttagtgtgtgtgtgtgccgtatgtgccaccatcttttgaaaaatttgtttcggaaatattggactgcaactcttttttgtacaaaaattgttttaacttatcaatgagctgggcaatgtcttggtgtgcgaggcatttctctagtaggcaaatgcaagttttacccgtctattggagacattacttttgcatcaaaacggaaaatgccatatttttgtgtgttttagaaggactcgttgtcccacctgagctcgatgaccagcgccagtcttcgccttgactttggcgacacgcccaagtcgatcagcagcattagtcaacacgggaccatcaccaaggcatcaaaaaatactaaacgaatcaattatacattttaattgcacagccaaagcttgggttgtctggcacgacgcgcaagcgacgaagtgacgcgtcaaccgcggctggcggcacgacgcctcggtccacggcgccgtcggccaaaaagccacggacagcgaccaggcgaaagcggtcaaaacgcgggaggagggcagccagtgatgaggacgatgatgatgaggaggaaatagaagtagaggaggaggaagaggcggaaaaagaggacgacgttcagcaacagggggagcagggtgaccaaagtttgcgcatggaagtggacggtgaagggtcgacgagcggacgtggccgaaagcgcggcacaacgcccaaggcgccggcagatgcgggcgttccaaagacgccggaacgcggcagtttgaggcgtactgctgggtagggaatggggcatcgacaccattttcataggggttgacaaactggacataatataaatattcgcagccaatttacccgtttttgctagctgtatcgtacattgaggaatttaatttcattttaagacatacaaacccaaatttagtattcatttatttgctagagttatggataacaaatttccaggcttgactcgtcccggaaatcggagcagaaacagaaggaggagttgttgtaccaagtgccggaactgtcacctgccgaacagttgggcgtggactgtcctcgggacgcgcatttgttcatgggcgtcggtgcgcgcgtgcttgccctttggggcaacgattattactcggcgaacatttgcgggtttgaaacttttttttattacctattaatggtattttaatggccattcgaatgataaaagcggtgtcatggaaatgttttttccgccaaccgacctttacaaaatttacttccatatttcagtcgtgaagcattgggccgttactatgtgcacttcgtggaggacaatctgaaccgtatgctgccacccactggcgttattcctatctctgcgttgaagccgggaacaaaggtacatcgactaatttcaaattaaacaattttattttattcgttttagatttcatttattgacattgtgaatgacgaagagattggcaaagtttgtgaggttgttgagcagccaccaacagacgacgctggtggatgggcacggggagagttcaaactgtgcgagttggacgaggaagggaaccgaaccgacgttatcaaaacgtaaaaaacctatccattttggcattttgatgccgcatttttaaaatattacagtctcaaatttatttttatgttttttttggtttagtggaatatagtttaatgt

SEQ ID NO: 22297 - DNA, 1576 bp, Heterodera glycines
ctttctattctctttcaaatcgccccaaattttttttacagcttaactaggccctattaagcttatttccagaaaatctcgcatgaattctcatttttaaattttttatagatttttaaatgtttgcattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggatttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcgatattaagcttatttccagaaaatctcgcatgaattctcatttttaaattttttatagatttttaaatgtttggattttttttggcttaccaaaacttcatcgaacctggttctttctattctcttttaaatcgccccaaattttttttacagcttaactaggccctattaagcttatttccaaaaaatctcgcatgaattctaatttttaaattttttatagatttttaaatgtttggattttttttggcttaccaaaacttcatcgaacctggttctttctattctctttcaaatcgccccaaatttttttttacagcttaactaggccctattaagcttatttccagaaaatctcgcatgaattctcatttaaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaactttttttcagaaacttatcagaagcgccccaaactttgcagggatactgaaaggaaaagaattaacctgttttatcacattagcttgtcatcagtttttataaaaaattttcaaaatcgccccaaattttttttacagcttaactaggccctattaagcttcagaaaatctcgcatgaattctcattgataaattttttatagatttttaaatgttttgattttttttgacttaccaaaacttgatccaacctgttactttctcg

SEQ ID NO: 22298 - DNA, 1263 bp, Heterodera glycines
ggcgctttaaaagttgattatagaaaaaaccacaaaaataagacaaacccagtaacactctttaaccaaatgcggacccccacagcaccaacagggtttgggccattttaagagcggcagttttggctttggtggcttacgtccccgcatttcctgttcaattctgatttcttgggcccgtgaagggccacaagacggtccagacaaacgcaagattccctctgaattttcagttttttaaagagcacaccaataccatgtttagtttaccatttcgaaccctcgtgtgagtttgcgaagagcctggtggctcaatgtcagggaggacgtcccaaaagtcgtcgtcgtcgtcgttgttgttgtttgcttccggacccacacttctgacaggaacttctttgtccgaagcaacatcccaaaggtcctcgtattcctctgggctttgaacacggacccccttcttagctttgatacgtttttggggcgagaggtactggttgaagaaatttttcatgtcaccgaaaacaaggattaaagtttaattataatgagacagccaaaaggtatttaaatgtttaaacatataaaaggatattgcctatggttttttgcttgctatttatgtaagccaaaacatgacgtacccacatttatttattaagcaagaaaaataagtttcagaagggcggtgaccacttactctgtaactgtcaaaattatagcgaaacagagcaagtgaataaagaaaacaagcaataaaatctttgttcgaaccctcatttcttcacaacatcctgaatcttgacggacgccagcttcatagtattgtcgagaactgcaattttttcctggaaagaatacatttaatttacatgcaaaatattaaagtgtataattacgttcattgcgtccattttggctttaaagtccacttcaatcgtacccacttgcgtctaaaaaaaactaaaacataagtttaaagaaacaaaaaccttaatcgctgaaacttcagtttgcagctttgcgagagctcgcttcaaattgtgctcaaccgtacccactttcgtttggagagcacaaatgtcctgacgcatgtcctcagtctaaataagtcatgtaattatcataaataatatatacaactttaccgcaattgaagaaagcgtttgcgagctctgaactctcgcgttcagatcgctgacttgcacgcccaaatttccagtcgaaccctcaatagccagttgcaggttgttgagcttttcc

SEQ ID NO: 22299 - DNA, 1192 bp, Heterodera glycines
tgatggccggttcgggcacactttcgccaatggatttcgtggggcaacacacgggcaccactcaggtacagctcgtccttgatgaccacgtcttcgcccaacacgctggtgttcaccatgtgcacgtgactgcctgaacaggtcgagaaaagtgccaaaaagtgaaccagtgaaaaaaatcattgaaaaagatttcaaagaataaattccaaaactcatggcaaaatcacaaaaaaatccgtttaacggatcaaagaaaaccattcggatatccctcctccaccaaaattaatggaatttcacgtaccaattacgcatttgcgccccacaatgctggaatggatgagtgtgctgcgtcgaatgactgtgccggacagaatggtagagtcgcgaatgcacaccccgtcgaggagccgaaccgcggcaccgatgcacacgttgggcccgatgatgcagttggcaccgatcgatgccgacgggtcaatcatcaccttttggagggagaggcatgagggaagataaacggatttggttttataaattattcaaatgccaaagataaagggatatatttttggatttttccccattttttcctgagctcccagcggccaaaattcaagaaagcaagtttttttttggtggctgtaaagctatttttcgagttacccctagatttgaggctttttagttcctattttacatttttaatgcctatttttggcttttttaggacctaaaattaatagttgggattttgaatgaaagcaaatttgattgcaatttctatggcatttgagcttcatttatgcagttacgggttgattaattgtgcagccttcgccgattgtcgttgacgacgaattaacgccattttcaagagcacttttcacaactttttgctgctgttgatgggcaagataaagacgaacaccaaaaaatgtacgaaaaattattgcaaaaaatgattgaaattaagtacccctaagaaaatccttcggctgtccaacgtccatccaaaaaccgaccaatataaaggcgtacaaattactcacagaacacatttttgggaaaatctaaaaatttttaaaatacttatttccaaattcttaaggatgaccgccgctcacctctttctcaattgagcatggctgacgcgggattagctgcagcaccgacgggtttaaatgta

SEQ ID NO: 22300 - DNA, 2071 bp, Heterodera glycines
cttccgatggatttataccgtagaaatgttcagtgatttcgatggcacggcggtatacggtaagcgtaacggcgggttcgggaatctgaggaaggtcagattcaaaacaaagattcacagtgaacaacaaaacattttagcagaggaggtgcggttctattgcactttatgagtccaatcgacttttatgagtccaatcaattgacaatacctggtttttatacaataactttgaacaaaccctatctttttggtatcattagaaagcagtctaaagaagctaaaatatataaaatttcagcgtttaggcaattgccataaaagatttgattaacttagtaattgttgattaggtattttcgtttataactttgtttaaatgttagaattctgttgttttctcgtattattacattcttcagacttgcgctttcgaatgaaaaaatatagggtttgttagaacattgaacaaagttattgtgtaaaaccaggtattgtcaattgattggactcaaagtgcaagagccgtgagcgcgggtcaatgccaactcttagacaggcaagtcgtacaatagaagcttaggccttgacctaaagcttaggcctaagtctgtgcacgagttgcctttttatgaaaaaattaaaaaacggcattcaaatgcaaaagtacggccatgaaaatttgtttaggaaaattctgcgactcacgagttgaatttggaagaattggcacaatgccaattcgtttctgtagcggtcgattaccgatctgaaaccaatcgatgtcagttccattttgcagttctggtaataatccatgaatttaaggacgtccagcattacttccactgtccttaaaaatctctctattgcattgttcgattggccatgcattttaaacgtcttacaattagaggtttaattaatgaaatttgaggataaaaaatactaaacaaataactcagtttttgattactattttcgatcattcaaatcccgttaaaatataattattacaataacaaaatcacatggaatcaatcgaaatgatggaaaaaacaacgaaacaatgtgtcacgaagggaaacattcagtcagccatggtcataattatggttgttttacgcataaatttgccacgcacaatgcaacactcatgacgaagcggaaactgccaactttcgcaggtgttccatgaacacttgcatggaaacgtcgtccgtgaacacgggggcaccgccctcctgaaattgtaatttcttcaaatgggctgaatattattcattcattcacctgagaatacgggttgttgtgtgtcaacgacggggttcactttggaaagcaaaaagcgagcctaaaaggaagattggatgaagatggatgcagctgtatccgcttctgaaaacctgtgagccttcatattccgtcacaatgtatcgaggcactggaaaacggtcttggatgatggccgtggcatcctgcacgggggcgtcgagcagctgcttgaacgaagcatattgggggtcattttggtaattggcttttcgccaagcagcaattgtcttaaaaaaggtattttactcattggaatcacttgcaaaagaagaaaggacctgtccatggtaaattaacacatggaagaaatcgtccattagcaaaatgcggtcaggcaaaatactcgacgagtccaaaaggacgggttcaggaggtccattgaaagaataggagaacagctgaggctgtatcatcgtcgtactttcaaaaacattttcacccatcaaaatatggctgaaaaagatatataaaatacattaataaaaataaaacacaaaccggtagtatacagtttcatcaggagaattgttaaacacttgcagaaattgggaacggcgcaaatgaaacataaattgggggaacagagaaaatttgtcggtaagtttcagtgaagcagggtcttctttgtggtaatctccaaatctttgtaccttaacaataaatttttaagattggaattcacaatgaaagtagagaaatgcgagaggtttgatagtgaaataagtcaccagcaaaa

SEQ ID NO: 22301 - DNA, 1059 bp, Heterodera glycines
  misc_feature (4)..(4): n is a, c, g, or t
  misc_feature (936)..(936): n is a, c, g, or t
  misc_feature (965)..(965): n is a, c, g, or t
aaantcgttaataaaaatttttatttacctattttggaatttttgtacctatttaatacctattttgagattttttttacctatttaagtacctattctgggatttttcttacctaaaaatcgcatccctgaattcatttggcgccaacgtttcggcgattgcgaaaatatgttttacaatctttggttgcatatttctgagttttacccatgcgaatagtctgtcttattttctttatgcgtcttttcgtgcatttgtattgctttagttgcatgaatgtgaattttgatgaaaaatgaattttcgactttttgttcgaattcgggtccggggttcggaattggtcgaaatggatgtcagattcgtgctcagcgtacctataaacccctagaaacatgtttttaagacttttgaaaattttgaaaaatttttcaaaaaaggtgtgataccatctaaactattaccgagaattctaacattccaagaaagttacaaacgaaaatcagcaattacttaattaatcaaatcttttttggtaattgcctgaacgctgcgattttatatattttagcttcgttattttgtgctttcgaatgataccaaaaagatagggtttgttcgaacatgaacaaagttattgtataaaaacccaggattgtcaattgattggactcataaagtgcattagagccttttccataaacgttgtcctcactcaccataacaaaaagcgaatacgacttgaggactgtgaagtcgtgaccgcgcacttcaaagtttattttttcgaacagtttgtccacattcagcttgtcgttgctcgctcccgtcgttgtagcagatgccaatgatgagtattgacgccgaaatggaaaagacaaagatggtgtagacaaaaaggcgcacttcctagcaacaaacggatgaaccaccanattcacagcggacaacgcgcgacaatggnaaaagcgggagacaggcagaaaaacactgttcgaaacgaacattcttaaattaaatgccagtgggaaaagtcacaaaaacgcagtaaacgaaat

SEQ ID NO: 22302 - DNA, 1143 bp, Heterodera glycines
aaaggtgaaaatgaaaatttgtaattcttttactcttaagcagccaagtctgagtttttaacccctagattattcagatcaaacttttattttaaattttattaaatattatttagctatcaacatttcgaaagtactttgtcaaatgccgaaacaattattacaagataaatgatgtctttcaaatatttttccacgaaatataatttccttacgttgacccttggagatgttgtttagtcaccggtatttattatgtaaaggatttcttttgtgagacaatttatttttaatggaagtatatatgatattaattcatactcatttttttttgttaacgtgcatttttgaagcagaatatcatctcttatttcatgttaaattaaattttatgcaataaaataacgcgataacaaattaaatttaaataaaaactgtaaaagtgatcttaaaattaattatataagtgtgaatgaaataaacttattcaaaaaaaatatttgacataaagaaaagaaaagacaatagttattttaaaagcatatgaaatattaaacaaaaaaatgagaattcgaaaaataatttttttattataataataaaaaacgaaggcaattcttttgagcctaatcgattatgaaatggctagttttatggccatttcttcgctatccattgccttttcctgagatgagatgtgtgattcggcaggggggggcggtgcgttggagaaatttttgtacgccattgttcgtaaagcgacgagggaagagaggggaggggggggggggggataaaaaaaagaagaatggcattgatttggtttttaataaaataaaaaagcttatgggggggggggggcaaaaataaaaaaggaacggccaccgatttagcttttaaagcaaaaattaacatataaaatgaaggaacgataattaatttttgaaaattgtaattagttatttttaattcttaagcggctttgtgaaaaatgcatgcacctaatatttgcaaatttttgaatttagtttttttaaattttaacagcctctgagctttttataattactaattattttttcatttttgaaaccataaaattgccaatattatttggtataattttgttgtatcttttttttt

SEQ ID NO: 22303 - DNA, 1164 bp, Heterodera glycines
attggtaaataagcacaaagtattaaagattttgtacccagatcaattaatttgataagaaatgctaaaaacaaattttctaaactgttaaaaaggattcttaaaaaaatatttagactatctttatatctcttttcattttaatgtatgtgaaggaaaattaattcatattgaaaatatattaaaaaaaattatacgatgcaattgttttttgcgcaagattatagaagaaacttcagtataataatattcgaattcaaattaataaacatttttattgatttattcttttgacagaaaaaaaagaataaataattaatgaattaacaagcatatttccaataattaggtaatacatttaatttaacaaaagtatgtgcccttaaagagacatagactgtactaattataaaatttaaaaatattaaagttcattaaaaatagttgataaaatatagaaaattctcgtttataaattaataataaataaaaatatcaatataattttctatttcaaatctaagaatttttaattccatgttttatttaactgtcaaattaatatattctcgacggacaaaaattgctaagtacaacaatgttatgctactattataaattaaaaattctttaacaaattgtcaagaattaaataaaagtcgacacaaaataaaataaattaacttttgtgaattataataataaaaaaacgcattaaggtttcaggggtaaaataaaagcaaatactctttaaaaattaataataaatcattgttgtagttaatggataaatattaattttgcgacatacattgaagagttggaacttgtccttattcgcaagaaataaatcaagtacatataatttgagtttaataaatcaaaaatattatttgaaatattcaaaatttattctttaactattattaaaatttataaaaatatcaaaaaattttattaaccaaaacaggatgatgagtagccaaatctacatcaacaagaagaaaattgaataagattaattaaacactcaaatgtaataaagattatttagctttaaaatcaaaaagtattacacaaaaaaataaaaattagtatattaaaatgaattcgctggtttatccaagattataaaataataattcaatcaagagatgacgaata

SEQ ID NO: 22304 - DNA, 852 bp, Heterodera glycines
ggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataatgtttgagtaccccaacggacacttgaaaaatcgattttttgtttcgggatagtttttcagaagtgctctaaagcgcaccaaatttatggggagaactaattttagcactctgatgctt

SEQ ID NO: 22305 - DNA, 1559 bp, Heterodera glycines
attgaaataacaatatacataaataaatccaattataatgatcagactttcaaaaaattttcaaaaatgaaccctaaaaatccaaaaagaattaattttttcagacacaaaaaatatatgtaatattgaaatcaaaataagaagatacatcccgaaaatctgtttttttgattttcattaattcactatttaaaaaaatttcaaaaattctgacgaaaaatgatttttgaaaattgcggattgcgggaaattgcggggtttttggacccccgtaattgtggattgcggatttccgtaactgagaaaatctccgcaattgcggattgcggatttccgtaattgaaaatccagttgcgcccagccctggatcctagagacctgatttgacttgcgcattttcattcagaaaagtgataagaataaacatggaaataaacaaaccttgcgtcgctgaatgacagcaaactctaaaaatgaacaaaatgtatcaaaagactgtcgaattggcaaggtacaaaaaaaaattttcaaaataaatttctctaaaattccaaaattttctctattgcctatcgaaacgtgtggaattttttccttaaaaacattcaattcttaaaatcaacccaaaattggaacttgactaacttatgcaaaattcaattttctcctcgttatcgtattgaaattccactaccgtaccccatgtgcgccaacattgtgcaccgatagccggacggacatgccgcggtaggcgatgggtagccagccccggcgcaaatgattgtgtgaccctgcttatccgttgccggcaggcgcatccccgcacaaccggcgaggtccactaaagcaaattggagaaatacgatgaaagtagagtgcagcgggaccgggacctgaacacgggcaactgagtacaactgagtaccaaggtcccggttttgaccagttttgaccgggaaattcccggcttttttcccggttttcccagccaaaaagtcccggtttttcaacccaaaaagtcccggtcccggtcttgcccaaatttcccggtcccgctgcactctagtttaaaacttattaaattagatagaaaaacaaaataaaattttggaaggatatgtatttcgaaaaaaatttatattcatagggatgtcatggatctttggcaaaattcttttttttcaaccggtttaatgcctatatattttctaatatgtattcaagctttcatcagacaaatatttaaaagtgagtacaataaatgagtgttatgttcgcaaactctcgtggccaaccaactactggcattgctgctggtcatttgtttgagtttaaggtttgttgttctacagttcttgcttggtattttcccattccgtgccaactgttaattaattaccctttcatcatttggtttaggctggccgcactttgatcgaattgggttcttctgcggataagcgcagggctgtggccaaccccgaccccggcctgatttatatcaaacactcacaggatgaccaacttcttcatttgtgttggctgaatcgaaaaaggaa

SEQ ID NO: 22306 - DNA, 2049 bp, Heterodera glycines
ctaattaaatctattaattacttagttagttatttcattaaatcaattggatccgggattacggtaggtggacacagtcaattagtttattcattaaaataattgggtcccgggattacggtagacgttgggtgcattgatggaatgaaatttgaagattttgcgttacggcaattttttttcaaaaaattcacggcattccctcacgatattgagactacatattataaaatgccataacataatggaaattgcaaatgctacaggcaataaattcctaaatgatcttaggtcatttggtaaaaatatacgacaattggggatataaaatcgatggcttttaaattttttttttaaattttgacggaaataaatttgacaccattaaaaagaattaaatttttcaagattgggatgacggaatttaagaaaatacccagcaaaagggattccacgttattaaatttcaaattttaatccctccaaaaattctttccaaaattcaatgccaaatttcaaaattcctccaattggcccctactgttgagacaaaaactgatctcgccgcttctgtctgctgttgatccaacaaattaaactaagcattataatcaggtatactgatgatgatgaaattgggtagggccgaaatttgagatgaataaatcggcagaggaaaagccccggagggagagaggcggggggcacaaaatgtaacttaactacaacttctcgggaccaaccaacctcgagagtgaagcgatgtcgaattttttagcatgacaaaagttttgttgctatccaattgaattgactcaaaaaattttttgtcctaattaagcaaagcattttaatttgtcatagttttagggatgtattgtaaaagtcattttgttttacattttgccaatttttcatgtcacattttttttgtcaaaatttcgaaaatttgtaccatttttaaaatttgtatttcattctcttaaataaatgtaagcaaataattttcaaagaataacaaaacaattgagcaaatgatttacaaaaaaaaaaaaaaaaaattttgacctcttttttattttttaccattttgtctttttatttcgtaaaattaatttgataaaaaatatttaaattaaaatttaaaacaaagtttaaatgaggtcaaatgggtaaaagtgatagacgacaattgattgatatagacgacaattgatttggattggaaaagctgaaaaatagaaaattcagacctccagcaaagggaaactagagaaaatttggtttttgaggaattttaaaggaatagctggaggtctgcagaactattttcttttgacaagatgggtgagttcattttgaagtgattgaatttggaggagagctctgtcaatttcgttttggattgctttgtcaacctgcgatggttttgaagtgtcttcactggcctccttcggttctggcccacgtccatgactggcttccttcggttctggcccattttcgttgacgggagtcgggtcttttgtctgtgcgggttgcatcggtggtgccactgggactgggtcttgttgacgttttcggacccgcgcttcgtattcctccttgagttgttctttggtgagcgcagggcggacgaacaggcgggcaaggtttttctgagaacggagtcgaacacgctcgcgcttccatcctccgagtgcaatgtgttggtgcgcggatgttggcatgaccactttgagtgggcgtggtgtagttcgctgagagtcgaaccggccaacacgaaagatggcggttggtccagcctcaacttcgagatgatccaagatttttgtggtggcttccctgtcatcctgaacacgctccgatgggcggatggcattgctttctgggaggccgatgaacaccaatgtgcgttggcgttcttgctctgcgagtgcggcagtgattgggtcgaggtccagcacaggtgccattgaacgtttggcgggaggcggagtgatgtttgttgcgttggttcgcttcatgtcgaataattagaataataat

SEQ ID NO: 22307 - DNA, 2094 bp, Heterodera glycines
ccccccccccttctcatctgtcgtgctttcgggcgtcatctgctggcccaactttatggcctaatcccttccagtcgccccctcattattgtctttgcccattcgacctcacattttcggccggggcttttcccccgtcggcttctgctgtccacgcctcgccaaataaactttggacgagaatgtgcggacctcattctgctgcacacatttatgggttaattaacagcaagcaatttcgccaaattcttgaaatttaattacatttttttgcctgtaataccaaacaaaatatttcctttaacgatttcgaaaatgtagactaaaattaaatttttgcctattgaattttatttttctaatttaaaaattacaatttcttccttcggaatttttataaattattttgttattttaatttttggctaatttttttccattgattaggcttcctcatttttaaaatttacaactgatcatcacattttctgtctcgctttttctctctttttgctctttttgccccaccgtttcacctcataaatctgtctgctgtcagctgctgatcacacagtttttattgatcaaaactctttctgactgatcatttgaaattctatggtttgtcaatcactctttttttcgcttgtgatcagaagcagtgatcggtttccgcattacgtcccttccccctattctttgctttttgacgaggaaagcaaatccatcgcaatatgttggttatttgagatcatttgaagtgatctcccgatcagttgggtatgcatttccgatcagaagctttggacggaatctatttttaaatttatgacgtaattttttctgttgcttattttaaaaggcttattcataattatattcattttaattattgtccattttccttctctatgctgtattttaattgacatctgcttataggtattaaaagtgactgataagcacttaatcatcagtgatcaaatgcagtccattaaatcccttttttaattcaaaataactctgtttttttatatagaatagataaaatttctatcaaataattttcaaactcaaaaattttaattttattatttattttgacacaaaaaatgatttttttttttaatttttattgtatttgctgcattttctctatcgtttttgggagacaatgtgaacaatggatgtgttactgtggcttaatttttttcaaaatatatcccattttataaattggacgaactctaatcgacattttgtgatggtttgttacctgtgatccctggtgaccccactctttgtattggattttgggtgcattttggtgttatgtgtacattatgtattaaacattttgccggggggggggtcgggtggaatttgcgcgattggcggatttattcttgggcgaggagagagagcaaataatgctttatgtatacacatattctatttgttgtgttgtcgattgggatggctcacctccgtatgttcggagcgacggaatttgagggcaatcgatcggaaatttcgggaggggggggggggaaaggggtgaaggttaatgaggtggggaatgaatgaattaatgaggaggttgcttacatatgtaagttcccgagaatttgatgatcaatgagttttcataaattttatctggggaccgtgaaatttttgagattattttaacaactgttaagttttcttacagttacaaagaatttgaaaataaggattattttaaaaataaaatgtattttcgcttcctaaaactcggactctctaaataaggacaaatcttaaaaataaggacacttatgaaatggacaccaaattatcaattcagtaaccaaccaaatctattcatagggtaacgaataatgggttttattttaattaaaaaataaaactatttttattttgacattcttctttctgtgtaaaattaaaatttttaattttgatttttttagaatttcccactcaactagtttattcacaacaatcatatgtttattttttataattaaatccaagactctcgaactaaaaagaaattgttcggtgaccattctttgatcaaagaatcca

SEQ ID NO: 22308 - DNA, 1313 bp, Heterodera glycines
taattagggtttgttgaattaatttcatacttaaatggcgacacaacagcaaaaagtcggtcaaaagcagcacaaaacattgccattaagccacaattcaaagcaaaaatcattggctaaaaattgaaaaattaaatcaaaataaaaataatttgaaattcagaatttaccgtcataattaagtcagcagtgagcaaactgacaaaatttgtgcccaaaatgacaacaaccacaaaaaaagtgtgcccaatttggtggaccaattcacaaagacaaatcaatgccatcagaaaattggcggagccgcggagggaactgaaaaatttaaatgggaaaatttaaaattaaatttaaaaatgccacggcatttgcctggatttgacagtgactgccaaaactgtgccgttcaacacaatgccaaccaaaacaaccaaatacagcgcaacggccggcacaatcaaatcggcggacggaccggcgaaacggtaggccaaataaagctagaaataaatgaaaacatttttatttatttaaataaatcttggtttaatttttccaaaaataacttaaaatagttaaatcctttgtttttaccgggtcatttgagctggtattaattgatgccattatcagagaaaaaagaaattttctatttctatgagaaaatgccaacgcaaaatttcatggcaaagtttgaaaattccgaagtaggccacagcaagttagaaaaaaaggcatatgcctcaaaatccgtccctagttatgacattcaataaaagccaacttgtaaaatgttgtacaaaggtactcgtacaattgcttaggttcttaggcataggcaggcctaggctggctttggtctaagcttaagctttattttgtaaaaaaagacttgccttttgtacgagttgctttttgtatgagtttccattgacccccgggcccgtcagtctctaatagaaatgtttttattaaattttcttggtacaacatttataaaatttagtaggggactgaaatgtgccctcctcggctttcatttgataaatttgccacttttagaatatgaaaatttattttttgccatttttttttggcaaatttgcctttaattcagggaaaattgggaccaaaattagccataaattgataaacaaaaaatggatataatcaaaatatgatgataaataaaggaataatataaggccacattaaacacaaaaagaaatttaaggaaaatattatttaattgtgccaaaaaaattaattgtaaagtgctcaattgcccgtttgacaataatatgtgaacggaa

SEQ ID NO: 22309 - DNA, 914 bp, Heterodera glycines
  misc_feature (58)..(59): n is a, c, g, or t
ccaaaaaagacttccctttgtttcgttgttgtttttctctatattttaagctacatannttcttaggaaattggggaataacacaattggctaaaatcataaatatttcggcattgattaacaaaattaattgctttgagttttatgatgtaatgaccgattaagataatgagcaactgtatggagaagcaggtgttcaaccggcagttgtccaagcacggccttcaaagtacggacggagatatttggccatgaaattcgaattcacttcagaacgaattgttgatgagcagttaattgaggctaatgtgaccaccaaagaagtggaaaatttgttggcttatgacgagtcgttggacgttcttttggcagccgaccaattcaaaaaagaaatgaaagaggaggcgaatgagttggacgacgaccttctcaaaatgctcctccatgaatttcctcataaattttttgaggtattttcaatctcccaattcttctcttttaaattttgtgcttttagctgccatttttgcatgaatcgatgatggtcgagcaagaggaggatttaagtgccgaggaaaagttggaggcccaattgctgtacgagcgcgagaagcgcggcatcaatttcccaccgcagcagtcgtatggtgcaggacagccggatctgttcggcacgaatttgccactgcaaaattttgggtgctttttatatgacaaacgggaaattttgagtaatgtcactgttttttccagcaatccattcatggcgccacacttccaacgaccatggcattcgacccctttgcccaagcgcattgagttcgcaacagcaaccactcaaccaccgcgaaaacaccagcagcccaccgcttctcccgtgatggtcataaatgaaccgatgacactgccaaaag

SEQ ID NO: 22310 - DNA, 1695 bp, Heterodera glycines
gatgcaacagtccaatggtaaaaaaattttttttttttattatcaaaaacggttgtttttatttatgtttttttttttgattttgttaatttttaattgcatttccaaggtgttccccctcctcctccgtttgtttggcgtccgcctgaccctggtgaaattattcagatagatgactgaatgcgaaagttttgtgatcgactgatcattccaagcaaaaaacaaatggctttataagtatttttgtaaaatcattattcccagaatttttaactctttcttttctgaatttgatgagtccttttgaattttattacatttgcatttggcatctctattctgtaatttttatctaaagcgaaataaattgttctgaatcgtttaatcggtttttggcacgtccaattgtgtgccgtacatttgtccgccatgtgccacgttcgaagtgccgtctctttccttggcgactgttgtgggttcaaccactgcaaaagtgccatcattccttccttttctcgttttttattcccccaattcggtgcctcaaaagttttcggatgctttgaatttaatttagccaatgtctcccttttctgtttcttttacaaaccgttaattctgatgtcggccgcttcgtcctccaacagaatttcccttaggcatgcgcaacagccgcccattggccaacggaatgaccggcaaaaaagcgaatggaattattttttcgggggggactaatggaggataagtggtgccatttgagacaaaaaaggaatggatttattaacgatgaggaagtggattagattaaaaaataagtggggggaatggcactcatcttcaaacaatggcaaaccatcgctatgggaacgaagacacacaaagaaagcactcattgcaccatttttattgaacacatttaaaatgatcttttattgaaccagtgttgactttcacttcgtttatgtgtatttaaacaaaatgttaaattcaaagattcaaattcgagtccgaggttccgaattggtcgaaatggatgctggatttatgatcaacgaccccgaaaacccttggaaacattaaaaatgcaggggttggaccagctccactattaccgaaggttcttagacattgtataatttcctacagattaaagtaaatattctgatttatcaaattgttaaaggcgcaaaattcaaaaaaaaaatacaacagaaagattatgttgatgagaacggagcaaatattacagccaagtcaactttgttgtgtgtttccgcttgcctttgccggtaaaccgatgggtccaaacctaacaaaaagttgaaattcatcccgaacaatttattagctatcaaagcggaaggaatgttctttgctttttaataaaataacagaaaaaaatattcattctttattagatgcaaaaaaacaaagattatgtaacctaaaattatttatgtttagaaatttatttatagaaaccagcctaattttgttgattttaattttaaatcaacaaataaatttaaataaatatgttaccaattatttctgcaatttgacatgcatcgatttcctcgattggctcgcaaaggcgactgactacgggatggatttgatgggccaaataataatgaatatctgaatgagtgaagccaacaactaattggtttatgtgcgtcccgactctag

SEQ ID NO: 22311 - DNA, 1694 bp, Heterodera glycines
  misc_feature (61)..(61): n is a, c, g, or t
ggtgtatgactgacctcagccatgcacctccctctctttaaaaaaaaattaatattacctntaatgatggcaacacaaaattttttgaatttttcactttcagcgcttatcaaagacgccggagttaaaaattctcaatttcataaaattctttagcaaactaataaagctaaagaaatataatacaaaaaaaaataaaattcaattataaattaattttatttacatattttttaacacataaaaaaagttaaagcaactgataatttcattcaaattttctctactaaataaaaaaaaactattaaataaaagtcaaaatcgaaaatgccaacagttagatgcatttattttttaaaaaattgcaaaataaattttagctttaaaaaggaataaaaaaaagattggccgacatttgcggcttgaaatttcggtgttacatttgtcgcgcccagcaaaacgaaatatttttcagcggggtcaataagagttgtgccaagttcagaatttttgtagcagggcaatagtcgacctgtcaaagaaatggaaatttataattcaaaaaataaaagagttagcattttacatatttaattaacataaatgagaaatctataggacagacatttgccgaatgcttgtaacaagagcataggtacattggattacaagaaaaaagagttaaagacaataattaaatttatttaacaattatttaattaataaatagcgcaataaattaaattccggaaaattttcgggtctcattcccattgttttttaaaaaaattttgaaagaaatagaagcactttttaataaatacagaggattttaccgaataaataagccaaatacttttttaactcttcttcatttattatatattttttactagcagctctgagggcatgcgtgccgagtggagtcttctgggcctagcagttcggggggaaccggtaaaccgccacggtgtagaccgtcgcggctgtaagtgcagtagcagctaccagaagatgcgtggaatcgcgagtaatttatttgaaaaatattattgaatttaaaaagacttaataaaaaacaattttttttcttgctgggtgtttggatgggggggctgccgaccccgcccccaaccccccccccccctcacgctggccgtaaatgataaatttataaaaaaaaatttcaaatcaaaaaataataatattataagaaacattttttacaaagaacagcattaaaaaatgttaaatatgatgaattgtgaatatgatttagaataaattaagtaaaaaacacaaatttaatttccattctttaagaataaatcagcaatttatttaatgattttttaatattacaataatatttattaaaatgtactaagaaaggttaaggaaaaaagcaaaaaaatgccaactattcaaataaatcagaattccattataaagggtaaaccattttcattataaatgattaaaagaaaatagtaaagctgatcggaaaatatgaatctatgacatatgattttaaaaggggaaaaatgtgaataaaatgttctagagcccagtaaaatgtttgacgattggcagttgtgccaccttcatcttcatgttgcgcttctttgccacctccctcagctttccccgttccgagggcgccgaccgtgttgttcctggcgcgtctccacatt

SEQ ID NO: 22312 - DNA, 1179 bp, Heterodera glycines
attaaaaaataattgttagatttaaaaataattaattaaactgttattaaaaaatatttacgacaattcaaaattaaatttccattttttttattcattttccaaattatttaaaatttcttgtcataaattatcaaaaatatattatattttattatattcctcttaaataaaaaaaaaattttcaagaaataataattcaaaatagagagaattttgaaatttattgccattaaaatcccatccctttctaattatgacttaattaaaatgttcaaacaaaacgccgtccattgaaatgttttgcattaatttaaatccattcggaataacttggcataatgccaatgctttggtcatcgtcttccccaaccgttcatcatccgctcctcagttgaccccaatttgcggggcgaatggggcacggcacattcgcccactcccattgtgtcccccgaggggcaaatgggcggggcgtgccaaattctatggcaccacaggtggagggggggggatcggttaagtgaatgaatgcctgccacacacaatggcacatccttccattacgcccgccgtcggaagggatgtgccaacgcggaggccccgcccctccccccgggggattttttgcccggccatgccaacttattgtgcccaattgcgcacaattttccttccaatgatcttccggtcattatgtgaataattaaaagcccctctcgtggaccattatttttccaaatatgttttttttaaaattttaattatctaaaaaatactcaaaggtttgtcgccaatctttcctcgataatcctcattaattaattaattatcattttaattggacacttcgaaatggagtttagtcagtccaattaattattccatgattaattaatcaattttcaataatttagcatcttttctcgtcagatgttcactttttggcccgtccgtctgtctttgcccgatgggcttcaaaattgctgttccaattgccaattgcccattagcagttcattgccccagggcataaacgaccattacgttgagcagcagcgaaaggtgccaaaggaacagaatgccaaaaacatcagcaccaaaagacaaaaacggcacacaaaacaccgccaaattaggcatacggtaatttgctaaaatacaaaatgccaatttaac

SEQ ID NO: 22313 - DNA, 872 bp, Heterodera glycines
aataaaaagaataataataatttacagaattttgccgatgccaaagacgaggccaaattggccgaactatgcacagaattggccattcgtttgctgaacatcgccgatcggtgggaggcgaaattggagatggaacagaaacaacagcagacgaacatggcattgatcattttcaaatggattttcacaacaaaatgacaaagtgtcaaacaattttaattttcaaaaagtgccaaaaaatgtaaatggcctttcctttttaattgccatcttttaaaatgatttctcacttcgatcgataaatggcttaatttttgaattttatgcttaaatgtttttttacttcaaaatgagtttaaaatttaaaaattcagttgaaaattcccccgtgtgtcctcattaagcctcaatctttttgggggacaattgacattggcacgattgtgccaatgtcaattggagaggcgggggggggggggggattaattttcgcggacaattgtctcctcgccgaattaatcccccaaaataaataatccgcagactcacgaaatcctgtgatgataatgaacaaaaaatattagtgaatgtaaagcgaataattaatcagatttatgaaaaaagctaacaaaattggggaggacattaattttgtctttttaaattattttcgctgatttttaagaaaataatttattaggaaaataattacaaatagaaattgtaaaatgggaaaacattaatttgagcttaaatgctgtgcaagggccacttttgaaattcgaacaatttaccaaaaaaattcttttttaaaacagtaaaatgttttaattggattaaattttgagggaatttagtcaattaaaatggca

SEQ ID NO: 22314 - DNA, 983 bp, Heterodera glycines
  misc_feature (34)..(34): n is a, c, g, or t
  misc_feature (953)..(953): n is a, c, g, or t
aaaaatccccagaaaatacgaggaaagatatgcntggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccagaaatttttagactaatccgaagcaaagcacgaatgaattaaagaggcgaaagaattcacagtatcgtttctaatagggaaatattgacaggatattcggctaaaaacgggtttgatcatttttagcgcatttttaggtatacatttgagacaattgggcaggacaagaaaagaatgaagttgatgcctcatgaaactcggaattggttatgttttgtcgaaaatatccttacataatactcataaaaaatacaaataattcaacccacctattctatgaccacattctgaaaaaaatcccagaaatacgaggaaagatatgcttggtcacaataaaataaaaaatggctagtatgtaaaaatttgcggtcacaaataaaataaaaaatggctaatatgtaaaattggcgtccangaaatttttagactaatccgaagcaaagca

SEQ ID NO: 22315 - DNA, 890 bp, Heterodera glycines
aggaggagacgagccgattgagagaggccctcgagggtgaagaagggcggggattcgtcgtcggaagaggaggatgagtgctgttgttggtgctgcagctgctcctcctcatggccttgttccatgggtatggcaatggaaaacgacgacggccggtgtacggaagcgaaagggacggaggcggtcattgcgcgagataaaacagcggaggaacaaaatggggggaggagggagtgaatcgatgaagggggagggagcaaatggaggggggggggagcgattacgaattacgagcgatcgcaggaaaagataaaataaaatcgacgcattgcgacgctaataaatgaagggaaaagaaaacatgaatataaaattcttaacatttccttgagccaaaaatgaaatgaaaacaataaattaatcaaataaaatgaaagttaaaacggaccgaacgacggaagtcaaaatgaaaacccaatttcagcagagctcattgccaatcaattaatccgtctcattagcacttaattaatgcttaacgaacgaaatcagaaagaaacaaattaaagagaaaatcagcaaaagtaaagcaaaagaaaattgcaaaacgaaatgaaagggaaataaatttaataagcaggcgaagggaaggccttaaaacaaggctttctattgtaaagggtgtgactctgaaggaatgttcatcggatggaaaggggacggatcgatggacaaaaaaagagggagggagaagaggggaaaagagtaaaaaaaagtggaagaggaaagggaaaggaggcggagggagggagaaaaaggagtcgagggaacggcggaattgcgaaacagcgaacccactctttttgcggggggggggggggggtatttat

SEQ ID NO: 22316 - DNA, 1318 bp, Heterodera glycines
  misc_feature (1166)..(1166): n is a, c, g, or t
  misc_feature (1187)..(1187): n is a, c, g, or t
  misc_feature (1203)..(1203): n is a, c, g, or t
tcggattgtatcccgagtcgggatccagaccaagtgccgatcaatcccgatgattttggaaaaacgatcggaacggatcccgagtcagggtccagaccaaatcccgaccaaatcccgattattttggaaaaacgatcggaacggatcccgagtcaggatccagaccaaatggcgatcaatcccgatgattttggaaaaacgatcggaacggatcccgagtcagggtccagaccaaatcccgaccaaatcccgatgattttggaaaaacgatcggaacggatcccgagtcgggatcccgaccaaatggcgatcaatcatattattattttgaattttccattgaaaaaaattgttttgaaaaattagagaaaaaacaatttcttaaatatattaaattttttagaaaaagctaataatgtgaaaaatccgagatcgagactcgagaccgaaaaaacccaagacttttctcgagtcgagactcgatcgagactctcgagtagcactaaggggcgggggcataatgcacgcacacccatccaatataatttttgttgaaattctcaccaaaaatatgttccaatgttcgggccgaaagccgcgtgccgcgtactgcacgtgccgttcaccgatggcgagcagagacggcttcaaacactcctccatgtggtagagatttttggcagcataagcgattgtctgctgatgggaaggcggacacccaattaaaaggttaattggataaaatactaattaataattaatttatcatttaatagcaagtgaattttaatgtagggaaaagccaaaaaaatatacaaacaaatgttttaattaatttttaaattcatttatttatgagaaaaattgaaaagttttaaatttttattttcgaaatattctattttttcagctgatattccaaatggtttccttcttttttctttagcctaaacaaattttagttttaattaattaattaaattaattaattattgcctggacaaatttgagggcctgggagcgaaagtcggccgattggcgccactcgtcgccatgccgatgaattttggggaataattgctttgcttgaggattgtgctcaaaaatatactgaaaaattataatttatataaaaaatttaatatatttattaaataattttttanattaatttaatttcatattanattaaaaaagacgaanaatttaagtcaaatttttaaatttgataacattaaaaacaataatttgtttattttttaccaatttcaaaatttttaaaataaaacttggccttacgtcgtaaatcgaagcgccc

SEQ ID NO: 22317 - DNA, 1447 bp, Heterodera glycines
gctttttctttatataggaaaatccattaagtgttataagttgttgagggggttaaaaatgtgaaagagaaagtgaggaaatattgcccttttccccttttctatgttttctctgctgcaccactgtttcgcttctctttgatttctttgaattagaatttgcgggctccctgcgcgatggaacttcaaatttttcattaccggtaatcccaaaaaatcccgcaatttccaagagagggatagctgattagggtcaagcaaaatcccacgcgggattcccgcgccgtgctctattcaaaaggcaccgaaatccggcattgatcagcgtaattagtcagctggactaaatcagactaaaatattttattttaaagatgttttaagttttcggagaaggcgtcgtccattttattcggccatttcatcatcgattgttccggcttcaccttcgtcgactgtatgggcgtaaatgcactcaaagaaatacttattttgttcaattacaattacactaatggaccctaattattctaatgagtgtaattattagaaaagtcattaatagccgaaaaaataacaacagattttcaccgaaatgcgcgagcaaagagttcttgtgtattttgcagcggcaaaaggtgggcgttatttaaaacaaattgtcgaaacaaaatgccaaaataatttagcgcccgtgcgcgatctgttcgaaaagtgcggctttttccgctacgtgcaaaagcacaacttttacccgacaattcgcgacgcggtggcaatcgcgcggaagcggcgaaatgcgtaagcggaaaaataaataaataattaaaatgtgaaataatggtaaaggagggagagggaagcttaaaaataatgaaacattccactaataaataattgttattttaaaagatgaaaaaaattcgttaatttaattattattttaaaataaattaatccatccaatttttattgaattttaataaaattaaatttcttattctgacaatagtttttttataaaattatgatcagggcaaagtatgcaaatgcatatttttttcctggcttctccatgctctaaatagtaggaaaaacactttcttttttgtgtttgcgtataaaaatcgggacttttatttacatatttcgagattttggtgcatattttgccattttttgtgcatatttttcgatttttttccatatttggccattttagtcaaatattttccgatttaaatatctcttaagaaaattttgacaaacaatagatgagatttaataccgaaaaccttgagaaatttttgatttgcgattgcaaaaacaaccgataaaatttatgaggaatacaatttttttttaattgaattttaataaaattaaattttttaatctgacaataaaagttttaaaataaattatgcttataaatttgtttattgaa

SEQ ID NO: 22318 - DNA, 1550 bp, Heterodera glycines
ttttttcgtatcaaatttaaaaaaaaattttgaattttaaaatagattggatcgtcaaacaacaaaacattatgttccccactcaaaaacagttgtgatcccgatattcctggtcctgttgctggtgatgatgatcttcatccgcaacaaactgtggagaccgccgccaataaccatccaaattcctacgacgacaatttttgtttgtccggcaccgccgaaatgggcatcgctcatcggtgtcttttttttcttggcattatgtttggtatttggcattctattaattttcaaatattttgtttagcctccgggggcgtgtgtttgaggagcatgaactgcccgcatatttcatggcacaaagtcgttgttttcgcctggaggcgccttcaaatcagcaggactcgggcctctaccgcgtgcatgagttcaacaaagtgtgttttgcaagggaaaatatttcgaaattttcggcccaaaaaattcacaaatgaatggccccaggtgtccgtgggatttccaaatgaaatttggtggtggatagagcatcaccgtttacaagtgtgcaatggtatagtggtagtgcgttaggcgaaaattttttgcgtcccaggttcaaatcctctacatgcaaatccattttagaattttatttttgcttttttatacaaaagtcaattataaaaaattttttataaaacaaatcttttatttttaattttatttcattaacaaaaaatttattaaagataataatgtaataaatatctttaagttcataaaatctaatttttgtctaatactttttgagtaacttatgtgtcaaaatgggttaaaaataagaattttatatcaaaacattttttggataaaattgactttgatatgtataaaaaacaaaaaaataattaaaaaatgaatttacatgtaggggacccgaacctagtgtttaaaaaacgatgacaagcgcactaccgatacaccaatggacaattcgaaaagaagcaaataattatttaatggccaaagtgaggcaaaatccgaggcccacgtgctggcaaatacccaaagagttttggccgaactgtgtcaggtcagtgcccatttgtccatttggcttttagatttattttccaaattttatgaagttttgtgtgcccgttccgccggtcatatcattttgctggtggaggggacggagccgaccttcgggaaagtgtcgttcccattggaagggcacgtcgtcacggccgataacattttgccgctcatccaacacacgcttggccgccgagaaagagtcatttgcttgccggtaagtcgtccaattgcagagacatttttggggacgaagcccaactcatttttggactctttccaactttaatattcggagaatttaaatgaattatcaaaaaatctgacaagacatgaaactcctcatatgagttaattgcagatgttcgtcagaggtttcttcaaaaagtcgggcgtttggcacttttccgacagatggcaccgtttcggctgtttgatggtcagagctgaat

SEQ ID NO: 22319 - DNA, 1374 bp, Heterodera glycines
gatggcatttcccccctttttactgtacattaattaccccattaagtgtgccgttggccaccatttgagccaatcgttggtaagcaatgaattcgttcagtgccgttttgatgcacatcagttcagccactttcatcgtttcgtccaacattaccttagatttttatttttttattatttaattgtgctcattaaaattatttttcaaaaaaatttattttcgacgactattgaaataataaattttcattttttatttattattagcaaaaagttatgaaaaaatttgggtttttctgaacatttttgataataaatctacaaaaaataaggtacattaatgttgtcaaatattttattatctttttatggtcgtgtaaactgtgcaatagagccaaatttcccgaggcccgagactaataccgcaaaaagccaagaccttttttcgagcattgattgactcgagaccacgactctcgatcagcgtaactgattatcctgtctggaacctcaacttgatgattttttattaaattaatttaaccggcgactctcttttagaaaatatgttatacaaaaaattgccaagcaatcttatcaaatttatttgtattttttgcatttagttcagttgaatctgtgcctactccgctcaggtgattttaccaaaattaaattcaaaaatctgttgaaaatctttgaaaaattttcaaaaacatccttttgcttctccttcccttctttcagagcttcctcagtcggttcgtgctcgttggtggtcagtcattttctatttaaattttcaaaaatccattaaaaaaattcccaaaatttaggcacgtattggcgctctgttcgctcctatggtaagttcaggtaaatttgtgatcaaaccctttgatcgcacttcatcaaccattgaacgcgtcgcgtcgttagggttcactaaggctttctccccctccatgaaattttttatattttttccaaaacatttttcatgttttgaaattttttcgaattttccaaaatctcgcaatcccgcacgggatcccgcaaattttaaatgcgggatttgcgggattaattccgcgggatcccgtcccgcaaaaaattttgagttccagtcccgcagcgggatccgcaaatttgaaatttccggtctctactagaaactgagtcaattgattaaatttgatatttaaccgaaattatgtgatgaaaaaaattttggaattaaaaaaaaaattttgaaaaaacttcggcttcgaaaacttcgggttttttgggcttcgagcttcggacttcgaataaaaattgggcttcgccttcggcttcgagtgctaagccgagcttcgacggagccctgatcgg

SEQ ID NO: 22320 - DNA, 2481 bp, Heterodera glycines
atttgaattttgacgaagaaattccgttaaaataactatatctttgaaggcgagaaaaaatgtacgccaaaaagcattgaaagattttgatttgcgttatgctagagaaatggaaaaaaatgagactttttgggaaacataaactattttttgatgatttttttcagtttttgtgacatattttggttgcctttgggaattttaggacatttttttttgttatcaagggcttaataatcattgattaaaatttataaaattaaattttttttcattctcaatataaataattcattcatctttcattttgcaacaaatgacaaacaaaatactggaggtgccaccgatttattccccttttttgtccccggaggcgttgttttatttgttttcgattttattgcttcgttcatttcctttggcgctgtttcattttttggcatttcctttggcgctgtttcactttttggcatttcctttggcgctgtttcactttttggcatttcctttggcgttgtttcactttttggcattttttggctgtttggcattgtcttcggcgttgagtttggcattgttttcggcgctgttttgtcctcagttggcgccactggctttcttggcacggcaggtggcactgttgcttgtttgctaattgatgctgccatttttgccataggcattgtttgctcatttatttgatcgtcagttttcccctccggcaattttccaccctttgtttttgcaaggcttaatgagaaaacgggaggaggcggtgcatttggcattaattgagctcgtggcgccggcggtggtaccattttgccgttgttgaatttgatgatattcactgggtcgcctgagggtcgaaataattttaatttgacagttaattacattaattactgtgcccacctgtgtattcaattgactgattaatttcttcggatgacatcagtaaacgaatttttttatggtcatcctgacgttgatacagcatttctccttcaaaatcaatctaaaattttattttttaattaagatattttgtattttaaaaaaatatataaattttaattagggttttaattaaaatattataaaatttattatttcaaaaatgatagttctacatgaaatataaaaggcaaaaatgaatatataaattaatctttacatcaaaatatttttatattttccaattaaaaaaatagtttcattaaattcttatattaaaaataattataaataatattatttcgaaaatggtagttttatataaaattaaacgatgaatatttgatcaatttttttattaaaagatcactatgcatttatatatatttttaattaaaaaatgatttaaagtacttgccaatccgtattttcttgctctgatcagcatgccaactaactataaatataactgaataaacttcaaacttatattttggatcttactgtttctgaaatgcgactgtacatgtaaaacaatgggccaaatcttaaaaattaaatttaaactttatattttaatttcctcccaaaatgccatacttcatgtagcaatcgggcggtgtgccttcaccattttgttcaatcatttcgcatagaaacatcacttcacgcatcacatgctcgccgcccttcaaattcatgattttttgtttttttttaaacaaaattaattaatttatttatttaattaaaatatttttttaatctaatttaaacaattttaaaatagaagttgctggcaaataatgttcatttaaaaaaaagaaaaattattataatataaaatttattgtttattttaataaaaataaattactctaacgccgcgggcctgtgattttgtgccgattaaaggtctaataaaaagaataatatatatttttaatttaaacaatatatattaccttccataatcctgggaatttttatcaaattttggcgctcccgcaaattgctttgagccatgttctctgcccaattaaaaagttaattaattaataattgatcatagtcaaaaaatgaaatgatttaatttttaatattaaaaataattaataaatttgaaaaatttttacatttttgaattgttcactgtttgtattgcggttgtgttgaatttggccacagtttggtccacagatttaagctctggatcatgtttgatcactggcatttattccaattttttgtttaactcttcaaatggacaaaattttaaattccattggcaaaaagaaaaatggccaagattttggggaaaatttaaagggaacaaataataataataacaataattgccgttttgaatgggtttgtctagcctaattaattattaatgggccgactcattttaaaaattcaaccacaaacagaataactcagacaagaaaagcacatttttttagatgaataaaatatatcttagaagatcttgaatttaaagagattagaaaaaaggaaatc

SEQ ID NO: 22321 - DNA, 1919 bp, Heterodera glycines
  misc_feature (106)..(106): n is a, c, g, or t
tttaattaaacgtgtataatttttatttacaatgaattaaatctgaaaattcagaacatgccgtaaatgaaaatgtgtgatccatgcaaagaaaaaaaaatccagnaggacaattttaattacaaatgatcactttctgtttatgacaaattcaaggacacacttcaattaaagatgtacgctaaaaaaacaacgtaaatatatattttttttacaagattagaaactgaaagcctgaaccggtagtgagtttatcccttaattaaaaaaccatataaaatttttgaatcaaaattcatgacgcattttcagaatataagcattaaaatgctataataacaattaaaaaagatttgaagtgatgcttttattaatgttagaaagatttaagttcgaggaattaaaattttggacttgagggaaatattgttagcattcaccccacctttgcaataattagtttttctaaaattttctcacccataattttttaaacttctgtgttccataaaattaatatgtatacttttattactagggattcaatttttaggcacaaaaaatggctcccggacaatccgacagtggacattccgacagtggacaatccgacagtgaagacaattcgacagaggtggacaatccgacagtgaagacaattcgacagtgaagacaattcgacagaggtggacaatccgacagtggacaaacggacagtggacattccgacagtggacaatccgacagtgaggacaattcgacagaggtggacaatcagacagtggacaaacggacagtggacattccgacagtggacaatccgacagtgaggacaattcgacagaggtggacaatccgacagtggacaaacggacagtggacattccgacagtggacattccgacagtggacaatccgacagtgaagacaattcgacagaggtggacaatccgacagtggacaatcggacagtggacattccgacagtggacaatccgacagtgaggacaatccgacagaggtggacaattgcgacagttggatgatctctgacaggaaaatgcacaacaggatttaaaaaactgccgacaccacaacgtcacaagtggtagccgtagtcgacgccgacggaagctgaaaaagggggaaaatgcagcatggacaaaaatgtggtgttcacttccgattgccatgtatctgaagaaaagccatttggaaatgagcgattcggaggcggaacgcggcagtcggtccataatgtccaagtcgggcggattgaagccgagcgcagtggcgggaagaccatcggtgaccaaattgacccaaagcaattggacggggatcagagcttcgggaatgcctgaagcgtgttcacaatcagtcaggacacgacaaaacaacgaatgaaagtgacaaaccaagcgcagcgacaaggaaaatggagacgacttcaccaatgtttgacgagatgagatagcgaatgctgaaaagcgaagaactcatttaaacatcattaatgtaattataatgaacccaatttcaaattcttcccctcccatccatacaattgtttcatgttgttgtaaatggcacggccttcctccaccgctgccacaattgttgagaaattgtcatccgccaacaccatttccgcggcactttttgccaccgccgtgccactgcccatagcaatgccaatttcggcctttttcagtgccggcgcatcgttcactccgtcgccggtcatcgcagtgatttcgccatgcgattgcaaatattcgacaatctcaaatatacaaatttttgctaatcgttttcgaattgcttaacgtaccttcgatttgtgcgcgggttcaacgcgagcgaataatttggcacgacggcacgcgtcgctttgctgttggggcggcagtcgtcaa

SEQ ID NO: 22322 - DNA, 1151 bp, Heterodera glycines
cgattttatggagaaaattgttagataacaagatgatctcagatttgagaaaataatgataaaaatagttgattcgtttttttttaaatttaaaaaagtcaaaaatatgcacttacaaaaaataaaataaataaataaataattatatttataaaacgaaaaataataataaaaaagcggaaaattaatttatcttataaaaaaataaaaataataaaactcctctaaattaacaaataattgaaataaaaattaatgtaccaattttagaaaaaacaacgagataaataaatggaagtcttttgtgaacaaaatgaataatcgtttaattaaaacaaaatatttgcaaataaaatgttttttcaacaaaattattaatattaatcaccacaaattcatttctctgatcataaaaatggccttcacacatttttttgtgacttttcttcgcctttataatcgcttttgttgtgcgagaaaataagctttaaacattgcgcaaaatctgtttgtatgcccaaatatgaaagccaataaaataaaagcagaaaatatttaaaaagaaataatttaaaaaacaaacataaaaaattaaaatgttagtcaaatataatgttttaaatccaggccaggcctggttccagcctatgacatgcctggatttttcgtgaacctgaattttccagggtccttgttcaggaaatccatgtccagcagcaggtcccggctttttataatgttggactctgtttaaaaaaaccaaaggattctctcattttttttgcacttaataaattggaaatttttttatgtttacggataaatgaatggattttaagcgataatgaataagatcaaaaataatttagtcatattaaaatttgggtaataattatgctatttaaacaggaaatattcatgtcaatacatttgaaatttgtcggtattatgcaaagtaaataacttccatataaaattttcaacaatttttacaagatcaaaatggaattatctcttttttttcatggtaaatcagcatttgatatcctaaattaaaattgtaattttatttttaaataaatatttcaatatatatccaataatttatttttcgttaattaaacacagaaaaaaatacgaataaaatgaat

SEQ ID NO: 22323 - DNA, 1645 bp, Heterodera glycines
gaggacgctcaacatggtcgagcaattcgtgtcgcaacctttttccacaaaattacaaaaattttcaacaccatatttatcagcagcgcacaaaacaacgatgaaatgctcatactgtagggaaaaattcaagcaatatacggtaacacaggtttggtaacaattaataaataaggaatttgcaaattaattagtcaacagatttttcgtccaataaaaattttaatttctcaccctgacggattaaaggcccaaaattaaaaacttatttatattcaaaaagaatttaattttagatttcatttttttgtttgtcaattattgcctaaatgagtcatttgaaatgcctaaacttttatttgttgcttttttgtataccttttcaacaaattttttcttttcaaatgttaaaacaattccatctgcactttttgtcttcgttcaacagcatttccaatattttttggtatgtgccaaagtctgtgtttataattttaaatgaatattttatgtcagttttttaaaataatgaatttttaaaaattaattagatttattttattattaaaagattttattaaaaaaaccagctaaaacatgaagcattccattcaatgtttttattatttgagcatctctgataaactttctctgatctctaagaagcatatcgcgttgtgcaattaacgcattgatgtgatcattaatttctatttgctcattatttcctaaattggtataattaataaggcccgatttttttgaattatactgcatattatctggccaaatatcgatcgaaccagacacaatttcaattaaacatcaatcattatggaccgggcccaataaaaaatttaaaaatcattgtttgacgtaagaaatcaaacactaacttgagagtaggttcgggcccccgaccccgaaaattaagattatttttcgggttattcatcgaccctgcgctatgcaccccgacccctgaacgcagcttgagtcgggatcgagaggtaaatcataaatccctaatccgacccagattgatttgatccacccgactttaactgatcccgcctgacttttctcaccccaaagagttatagccctagcctccttgagagttcggatagtttgagtggtggttttatttgtttgaactaggctttttgggtcgagactttgctggcatatcataatggcataatttttaatttgttttttttggcataactttgcgtgctttattcttcgacagttctttttatacactttttcaattcatcattatgccatcttagtacagtattgcgcactttttcgtcataaatgtggtcggcatgtgtctttttatgcacaattggggccaaaattcgtaaaaatgtgctaatgttttgggcagtaagagccttcgatggtaagcgtgtaattattggtccaggggcggatcgaatgtccacagaaattgtatgaaatataattatgggcaacggcgctgacatctataggttgaggacgcattttttgtataaacgaagacgttggcattaagtttaaaatattggtgtaaaataataaaaagcgatttactgtatttcctcaaataaggacaccccgtggctattattagcgaaccacctcaaaaagg

SEQ ID NO: 22324 - DNA, 1351 bp, Heterodera glycines
cagaactctgagaggataaaaattgatttcaattaaatgttttgcatttttaaacgattgaggggggaggattaatgaatgctgctcctactttttaccaccatttatttatccaccaggaaatgacctttgctcgttgaattccaacgctctcttccgttcgttgggttttatgcagcggacgtaatgcggcacacagcgcatcagcgagtccatcagatggttggcctgactctgtgaatgggaagtgcggaatgtgttttgccaattcagcaaacgaatgaatggaagaggaaatgaaatttggatttgtaaatttctaatttagggttcgaattcgaaaaaaaatcattgagtcggacgacggactctgattttggtggaggcactagttggctttttgttgttgccgttttcattcgacacgcagtcggcagcgaacaactgacgcatgaactcactgaaaatatgcgatgaaaccatttgctattttttttttcttggtgtttccacacacttctcactgttttgcattagttggaccaagtcgacgtgcaatatgtccatgttccggtcgcaaaagccctcaatttggtagaccacctaaaaaatggccagtcaacctatgaaaatgcaaaaaaagagtgcctcgcccgcgtagtgtcgtacgacgaaactgtcggcaccagaacggaaatgctcgtggtcttcgtgttgttttttcagatcactcagaaactttttgtccgctccttcgttttgcccgtgcagctggagagaggtgtcgtccaagaggaacattatgccttagaatcgatgcgttttgttggggattagtccctcccatccatgctcaagactgaacaatttcacgagggtcttgagcatcgttagccgcccttggactaactcatccccaccaccgccattgacgctgctcacccggacgcggccgtttcgcctcgatcagttcgcagacaattttattgttgaaaaattcgatcggagtccacttcagtccctccgattggtactcctcctgttccgccttcagcgtcaattcgatgaaaatttgctggagtttttcattaacgaaattgatgctgaaaagggaatgcaatgggcacagaaaagcggcactttcgcaccaaaactgttcaaatccgttccgttcgaacacttcgaagccgtaaatgtccaacacggccaacgaaatgtcaaacgaattgcggttggcatccacgttcagtgcacaatttacagaggccactaaaaacacacagtgttgtcaaacaagcaactatggtagggtacggtaccaaggaagtcaaagagacgcgtgtacagtcct

SEQ ID NO: 22325 - DNA, 1284 bp, Heterodera glycines
aatttttggaggaagagtccatcgttttttattctccctaaccagttcgaacagtgaaattcgaaaatgaacatttatatcccccgcccccgctcaatttggtgagtttgagcataaaattgaattctttaaaaatgttcaaaggtccaaaattgctttattgggcactaaagtgaagattttgcaatcagcccaccaccatcaaatgaagaaggaatgaatgggtaaagtgaatgaatgattaatgttagtgggaagttacgcccaaatgtttcttgccattcatttttctttaaattgttccgttatcgcctgacccttttttctcttcctttccttcaaatcgacaaaaaaaccagcgattgttatcaaattgggttggacagtgcacaaaaatattcataatttgcatgaatttgttgagcaatggttggataataataacaaatgaaatgctttttaatttcgcttatttttaaattgcaacgtcctaaactgtctttgaacaaccttttatttagagtagagcgggaccgggaattttgggcaaaaccgggaccgggacttgccgggacctgagaagccgggaccgggaccgggacctcggtttttgtccgggaccgggaccgggaaccgggaccaaccgggaaattttaaaaattcataaaaattttaaaaatttaaaaaaaattcaaattttaatttatatcaagtgaaaataatacaaaattatttggttttttataataagttaaattaatgaaaattttcaaacaaattttcttcaattatttcaaacaattaatcatttttggacaaaatcatcgaatattaatagaaattcagatttgattttcacatcacttttttttggcgcgctttttcaaaaaacttttgggaaagaaggggtccggcggtgccgataggcgccgccgggggaaattttaaaaatttgggtgcaatttgttaacagattttcaacaaaaaaggttggtttttgcgattattaagctcaattggtaggattttcatttaaaaaatgataaaatatgtatcaattaaaaaaaaaaactatgaggaatcatattttctttataggaaacccacgagtatacaaaaaaaaaaatgaaaatgatctaatttctgtagagggattgaaccaggggaaagaagaagggaaagtcaaggagactagccatcaggccatttgcacacttgggcagtgttacttttaaagaatatattaattattattttttattttttaactcccaattttctcac

SEQ ID NO: 22326 - DNA, 960 bp, Heterodera glycines
  misc_feature (109)..(109): n is a, c, g, or t
acacatttttaaatatactgccttttatttactctaaacaatgaaacatttataaaatatggcattttcagactgttacaaaagttataagtaaaacaaatatacagtntagtccaacaactcttaaagcaacaaacaaatgcgaatttttatgcacaaaatactgttttttacaaacaaattctctatcataaacgcatttctattatttttttaaaaaattgatacattcacattgttttttgtactatgagtgaattttgatattaaaattttgaaaaaaataagaaaatgccatatacgaatactttttgggcgatactatagatggtggatggtcaacctttttgaaaaaaatgttttgttatagaaagtcaagaaaaattgttatggagtttttttgggtaaggaacataaatcaaatattcattgagaacaatatagaatgccggaactcgcattcagaacaacatttcaaaaacaaaacttcataaatttattatttttgttagcaaaatggatcaaaattcgtgttaacctcaaccagaaatataacaaaatcatatttgcaggatatggcatttatgtactccattttgcaaattgatgcataacatttgcgatttatacgcaaatgccatatattttaatcctaattattccttaatgctttttgtccttttccttatccattgctcttttcttttgtcactgtttttttctttaattttctgcccaccgtttatcaaacaaatgcaattagcatatgataattaaaagacatcatttttcgcactaattgccttcctcctcccccttctcctccgcttctttctttctgtcccactttcccttctttcctccgttttttcgtcctcttccttcaattcccatccaaaaatctatgcttaatcaatcgcttctcacccaaacactcatcctttggatgcaaaatccgat

SEQ ID NO: 22327 - DNA, 1496 bp, Heterodera glycines
agaaggcattgcgtccaatgatcatattacgatcctaaaacgaacaaaaaaatattttaaaaaatttcggtggagggggggaacgaccttctctccgtccgtataaatgataccaattgtcgcaattttatataatttttggagttattggtaaaggtgccaaaattttattacatatttttgttgattttttttttacattttaaaaagctatagaaattggatttaaaatatgaaatgaaagaaatttgcaacaaaattagaaaattatatcatctttgatgacatcgataacctatttggcaacaataatttggaggcaaatgctgggtcataaaaaatacgcccctgtaaaatgccgtaccccatcaccatcgaacgcggcgccaatgtcatgttcaccgagtgccatttggtcaacaaggcccttggcataggtcaaattcggatcaggatgaccacctaagaaaagattggatgttgtttttgttggataaacccctaagaattcatccattttattggcaccgtaatgtttaatttcagggggttagaatcgcctggctagtattttggctgaaattttcgacattttcttattggtgcccctccaagtttcttcgcccaaatttcccaccaaattcgctcatttttccaaaaaccaacaaaattggcaatgtttggtgcaaataccatacaaatttcgcccatggcatcctttatcccaagccaagccaaagtcctgggagtgtccttaatggccccctctctggccatggcaatttggccaaacctccaaagtctggtttcggcactatccgtagacaactttgtgccggcgcgccgagtcggtccacaaaaatggtggacacatagggcccggtgacgccgtgcattgagtcgaccagcagccgaaaggggcgcccatcggtcattccaccagtgagaagggcgcggatctgaaaaggccaaaaatgaaaaaagttaacctagaaattttctaagaaataatgtaaaaaaaaataagagaaaaattaaaaaaatgaaccaaaatgtgtgcaaattcaaaaaatgtacaacattacttttgaagacataaacgcaacaaatttttgattaaatatcgtcttatggatcagcttggaatatggattatgtgaacttttgtagatttttttaaatttttgtgtgtgacacccaagcccgtagccaggtaaaattttcggggggggggggggaaagggaggggtccggtccgaagacctgacctttttttttcttcttttttttcaaatttatccataatttttttttctgaataaaattgataaaagttgtttacgatctgcaaataactacaattttccacttgtagacttttctattgtttggtcgtcggcggctgctgcttaaaaaacaactttttcccgctgctgggtaccaccttttcactaaaaaaggacccaattttggccgttttacggaaaatttgagtg

SEQ ID NO: 22328 - DNA, 1010 bp, Heterodera glycines
accatcttactgatcaatcaattcctatctccaatttgctctcccattttcctccgatcacttgtttctctaaatcttttgatcacccacctttcaatcagtgatagatagccaatgatcttacagatcaatcaacccttttgcattttgctctcccatttcttccgatcactgattgttctttctgatcaccaagttccttccccctcactctctgtttagtcagttgatcacttcgcttctgtcctccttgcgctccatcatctctctgctgttgctgctgttcctgttcatcgtcatcttcgccctgctcggcatgcaggtgtttggcggacggttcaactacaacccaatgcaacaggtactatcactactccacctctgctgctgattgggattttgggtttatccccctcccccactctcgaatcctatgacaatttaagaaccagaaacaataagttattgaaaagattaaagggccatgatcggccattcatccgcgaaagtcccaattctcgataaaaaaaagaaaatatgagaaaacaacgaaagcaattcgatctagcttcgggagtctcggatttacggttcgcttcaaaatcccggcaattactcccatttttagaagccccgtgccaacttcgacacgttcatccaatcgctgctgacggtgttccaagtgttgacgggcgaagactggaacactgtaatgtacaacggtatcgaaagttacggtggcatcggctcgctgggaatgcttgtctccgtttatttgtaaaattttggcacattttcttttggaatttcctttccgccctccgcccatttctctctttgtttagcattgtgctgttcatctgcggcaactacattctgctcaacgtgttcttggccatttgcgtggacaatttggccgaggctgatcaggcaagtgatcagtcaggcaacggtctgctgaatggctgagtgattgggttttctgattgaagatgatcaggacgcatgct

SEQ ID NO: 22329 - DNA, 1043 bp, Heterodera glycines
ccccccggcggcgcctatcggcaccgccggaccctctgttcccttaaagttttttgaaaaaagcgcgtcagtaaaaaagcggtattaaaaagcaaaaaaaaggtcgccaatttcatggctggaccatttcgcaaaaattgaccccccccccccttttcatgtatgatgtttgaccaaggaatgtgatcagtgacatttttgatcacttcggtatctggatgacattcaatggatagggaagcgatcgatttgggatgcctgagatagtcgggatggcatttattgatcaggaataaagaataaatgatcagtatgccattccttgatcagtgaggctatttgggatgtctgagacggtcggagtggcatttagtgttggcatttgcggattagttcaatcaattcgtgtgataactgatttgtttgctactgtgaaaagtgttgctgatcaggaacgtagaataggatggtggtttttcagcgtcagtcaagtgatcagaatgattttttgatttaaaccatggttttgatgagttcaggtgatgaacgcaaagccggaagaggaagaggacgaaatggaggtggaaggcgagtacgaggacgacgacaagtacgaccatggcgaggaggaagatgaagcggacgagggcgacgccgatgacgatgacgagattgagggcgagccggaggaagtggtggtcggcgcgaggccgcgacgggtgagcaatcgatcagatcagcgggggcattcgatcggccgatcgatttaacacattattaataggaccaattttcctgatcagaggcatgatcgctacatttatagatgaggataaccgattggattaatgcgtcatcgatagataaggaccaccaatcgggttaattttcgatcataggaatatgatcgatgcatcattgataggtaaggaccaccaatcgggtcaatttgctgatcagagtgaccatttttcgttttttttatcacactaattacaattaaatgttcctcatttgtcaggtttcacatttgggcgttcaga

SEQ ID NO: 22330 - DNA, 1255 bp, Heterodera glycines
tgagtgtttttaaattaaaaatgagtaaagacagacacattgacaaatgggcacctgcttgaactgctcctcgtacgaccaattgggcgtgccatttctgttgtgactgctgcagttgccattgtggtgggcaaccgatgaccgaccttcgctccttaatgagcagcaattaaattcaattttttttttaaattggatattttaatgattcatctgcccacatttaaaggggccatgggcgaaggttttgtttcatttgactaacaaagcaaaaagttatggcttcttaaaattgtctcatcagacgcaattgacccctcgggggtaattataaaacttttttttttcttaaaatgacaaataatattcattcattaaaaccatttgttttattttcccctccatccgtttggctcactttaagctcaaatcctcgggttcccccatcgcttggttttgtccggaattgctcctctcctcgtcttcttcctcctcctcctcttcctcctcgtccttcacgtaacccatcggcgaagaagcgatttgttggaacaaattttcggaggctgaaactttttaaattcatattttaattaaaataaaaattacgatgaaaaaatgaatttaattacaattattattggacggaatggacagaaaagtcgccgcatcgaattgattttgatgggccttaataagtgggcaagaatattattattcccccatttgccattgccattgtctcccaacctgcatgaattgctgggattggtgttgcagtgccatcagaaagggcgaaagtgtggccaattgctgcacaaatgggttgttgttcatgccgcccgccggttgtgccattgtcggaaggaatgggactgagtcggcggcggagaggccggctaaaaagtcaaatttcaaatttcatttttaccattgccacttcaaatgccgcacttcctaactgattgctcagcttctgaaaggctttgtgtgcttcgaaaaagtccatcgtcgctatacccgtgccctgctgctgttcttcccccgctgaaatttcaatttttttaaatttcaaatcaaccccctcccccgcccctctcgccgactttgctccgtcgtcgctgtgcagtcaatggcattgtgccgcaacgcatgctgcaagaaaagactgggtgaactggccaccaactgttgctcaactccggccaattttggctgttttcaaatgtttaattattaatgaattttaattaga

SEQ ID NO: 22331 - DNA, 720 bp, Heterodera glycines
gaaatagtgacaaaaagtccgaaatagtgacgaatagtgacataattttcagccaaaaattgagcaaaaataatttttattcactgattgcattgcaaatgagtagggctgggatttttaagaccaaaaaacccaaaatagttacctaaaaaaatttttaaaattaaaaatttttgccaagaaagtaaatttttgagaaatttttttttcatttcatagtatattttgaaaaattttagcttgattcttaggggtgtatttttttgaaaaattttagctcgattcttaggggtgtattttttggttttattgcatttttgttaaggaattttgcccaaaaatgtcaaaatagtgaaaaaatagtgacaaaacgccaaaatagtgatttttaactattttagtgacgaagtcgccaaaatagtgatttctagtgaccgataatgacatcagaatcgaaaatttttaatgcagaaatgcgttttttgagctcctttcttcaaatcaatcgagcaaaaaatttagttaaaacctaaaattcacagccctactgattaggttccgggtttcccaaaattcccggtcccgctcaactctatttaaaactatcattttgcaatcctccaaaaaagaaattatgaagctccaaccctgacgaattagcaaatgaaattaccatttgaaagttgagatgtcgaagtccttcaggggaaaattaacgcg

SEQ ID NO: 22332 - DNA, 1249 bp, Heterodera glycines
aatcaaatttgcaaaattctggtctttgaccccgaacaaagactatctatcacatttaattgctgattgccaaaagaaagactcaggccattgcttcatggagacctgcacaccccaaaacaccttgaatttcattgaattttaaaaaaaatcctagggttcgcaacattttttttacaaaatatgaactccatttgaaaaaaaacaaaattaaagattttttgtatacatatgaacaaaaccaaaacaccaatcagtgaatggattgcagtaatgggaatcaaaaccattttatagactacacatacatcccttatatacagaacaaccaattgcatttcacagtaacgcatgtcttttacgagaattatgcacaccatgtttctataaaagacatcattccatcggggattttcattatttctattaacgcagcaacacaatgtcaatttcttatcgtcagcttctgttcattgctgcttttctcttcatcggttgtcatgcgcatgctggcgttgatcacacgcatctggcgagcttcacttgtgccacggcgaaggacggtgaaatcaatggcttcagagcggttgacgatggtctgctgtgagttgtgcaaaacccttccatttgaaacaaccaatcatcccaaaatcccatttcagaattggttccgacgccactaatgccactggtgctatgatcctctttggtttccagacgaacaaaaaggaggatttgtacttcaaagtctttgtgccaacatcatcatcatgcctctcatcagtgaacaacttcgtcgtcagcggtcgattttgtgaactcggagcgttggagacagaggtgagtgaaaaacactcaatttgtcacataaacaatcagttttttgtggtttcagactgaatcggctaactgtccggatggaggcggcgctggcaacggctgcaactcccgcagtgtcacctgccaaatcaaaaccgtcaaggaagtagcggaattgcctgacggtcgagtgttcaaagtcaacttgggaaatctcacacaagtgacggcactgtgcacgaagtggaaggcgtacttcgtgagtttgacgtttttacaggtgaatcatctatttatgctttgttgtttcagaccaatgttcgtcaagtgatggaatcaggcggaggcggagaaccgtgtgtgattggtgattcggcgagcggttttccaatgtggctcatcgttttgatcgtcgttgtcgtgatttggt

SEQ ID NO: 22333 - DNA, 1970 bp, Heterodera glycines
  misc_feature (1763)..(1763): n is a, c, g, or t
  misc_feature (1862)..(1862): n is a, c, g, or t
  misc_feature (1895)..(1895): n is a, c, g, or t
  misc_feature (1950)..(1950): n is a, c, g, or t
aaaatggctcaaaaatttttgataattttcatcattttcgttttaaattaaatttaaaaaatattcaaaaatgaagaatttaattatttgcatcaaaattttaattgctgccaaaaaatattaattgttgcaaaatctttaaaaaaaattcccaattttttaaataaacatttttgcacaaaattctctatttaagcaaactgtgtgagttttgttgacacaatttcgtgtgttcaaatgttaaaatttttgctagggatcatttttcattaaaattaaataaaagagccgacacattttagtttacaggttttgaaatttatttttggcattttgtcagtaagtgtagaaattcgaagaaaaaaaatgacaaacagtgagaactgacggtccaaagacttgaagcacattgaactttttaactgtttttttgtggaaaaggttataaaattaacaaaaataatttattcaaaaagcgctacaaatcattgatacaaaatattttttattattaaaagttatactgttataacttataattagagttgagcggtaatcggtaattgtaaaaaaaccggtaccggtactgaccggtaatgcaaaaaccggtaccggtaccggtaaaaaccggtaattttccaacgtaaaaatttttggacaaaatttttcaaatacaaaatttttattcagttttcgcgcgagtgcctgttttttttcgcggcacgtttttctgaagacttttggggacaggaggggccggcggtgccgataggcgccgccgggaaaaattttgtattttttaatgcgatttgttaacagaatttgtaaaaaaagaccaattgattaatttttgggtttttaggatgcttaaaatgaaagaaaaaaagttggaatattttttttaattaaaatttcaattaaaataatggtaaagaaaatatgaagaatattctatcccagtggggaattaaacccaagcgagaaataataaaatcagaaggtttagccagccacttgaccacttatgcatatgaacaaatgctttaaatgaaaataaataatttaattttttttctcaaaaaatttctccttcttcaccattccctactcttttctcacccagacccccattcttaccagtgcaaatttttaccggcggtaccggtactagacaaaccggtaccgatactttgatttttgaaaaaaccggtacaaaaaaaccggtaattaccggtcggtaccggtaccggtaccggtaaaccctagttcaattccctattgggatatgatagttttcaaattttttaaaattactttaattaaaatttacttaaaaagaaaactttctaacattaaaaataatttttctctatttttaaaacagcattagacccattaattaaccaatgactggacattttttggacaaaatctgttaaaaaattcacaaaatttcaaaaattttcacagcggcgcctatagcaccgccggacccccattttaccttatttttttaaaactttgatcccaaaatggcaaaaatagtcctttattttcctcaaaaaaattggctcaaaaacataaatttgttcattaaatgggcacaacatattgacattatctcgaaaaaagcagtacgatctgcttttgctatactaaaatcaatcaaaactcgtgatatgaaaatacttgtaaatttgtttaatatttattgcaaaccaattttagagtttggatctccaatttcaatccttatttaaaanaggatatagaaaaattggagaatgtccaaagaacttttatgagagtatttagacgtaacaattatactgttgacctacctaattatgctgaattcttanatatttatcatcaaaactcgcttgattgtcgtnaggtaaaattagacttaaaacttttctatgaaataattttaggtaaaataatttnacaaataacgaatccttttc

SEQ ID NO: 22334 - DNA, 2195 bp, Heterodera glycines
  misc_feature (894)..(894): n is a, c, g, or t
cttattttaatatggttcgttcagaattcttaataacataattttccggtggaagtttaccggcaccatcggacaaaatttttttttaatttgatcatttttgaatttatattcaaaaaaaggtcgtcgatttacatggctgccccccccctctcttttaatgtatggtcactttcactgaatgataaatgggctatttctttgaataaatttgtcaaaaattgcaggttatttgttactgcgaccaaaattaagcaattgccaaccgaattggtcagatttcgcacttaccctcacgtttttccgatgattccaccgacccgcagaaaattagcgtttggaaagcggcccgttatacaagtgcggcgcccacttattttccaagtcttgacaagtacatcgacggaggtaaacaaatatgaccttattgaattatgaaattttgatttgatgaattagcaccagattctggtgaatgagtccgaaggttttcggcccatattcaggggagacgggacaaaatttcatcgccgaaatttcgccggccaaaatttcgccgccgtaatttcgccgggacaaaatttcgccacaaaaaaaaaattaaacattaagaaaaaaaaaaatttatacgaaaattccaagaaactctttttccaaattatttcatgaaattttctttaaaaattctgaatttttctcgaaaaattccaatgttatcaaaaaaacgaatcggccaaaaaacgaacgtccgtcgtccaatggtaccaccctcgtccccctatttttgatatttttcgaaattatattccaatatggtatgccaatatttgacaaagtcggttttgaaatttacattagaaaaatattttgacttctcgggtgtcccttccgaanttaattactggatatgtgcatgattataatgcacgtttttggtcctttttgagtcaattttttgaatttttaatcacttggagtctgtgccttaagtatttttaaaaataattataccaccaaacccttttaggaattatggcaaacaacccgagtgtggagttactgcacgaacttgccttcatggacaattcgaaacttcaatttttgctgtcgcttggcactggcgttgcaccaacagtcgaactggcgacaactgaatcgacattcccaactgcgacaattgaaggacttgggaacacctacagaattttgatgtcacaggtgcaaacttaaagaattggtttcttatatttaaaccgggagttcgttcggctctattgcggtttacaaggctaaaaaaagaccattgaataattagaaaattttagtgctcatgaatcctaaaagaaacagatcttgccttcttggtatcatccgatagctctgcgagcctattagtctgcaaaatttcaaagaatttctttctcaaaaaaagatggccagaaaatctcataaaactagttttctcaaaatttttggcgataacttttgaaatttaacgaaaaatatattctgattagtttttcttgttgtaaacaattttattagagccgagcaatagtgaaatttgagttttaactttttgttctaactcgcgttcggggttcggaattaatagaaatggatgtcagattcattatcagcgacctcgaaaacacacaaaaagtcgttttacacgactttttaaatttttgttattttttcgaaaaatggagggcgggggggggggagggggacaaaacacacaattaccgattgcttgtcaaaaaattttacgtaactcatgtaacatgaataagagataaaaacgaacatcatattcatgttcatctcaaaacatttccctcgaaaaacaaaaattatttttagggggtcacaaaaaggaaaagtaacctccggcgcacatgtatgaactggtccttaatttatatgtatttgtctaaaaaaattttttttgatggtggggatgaaaaaaaaacaaaattttttaaatttattaacagaataggaagcaaaaaacataaaataatttttgatgatttttttccaattacagggtaaaaattatgagtaattaaattttagtttgaataaaaagtaattcattaaaaaggatgaggtgcaatggatgacattttctgtaaagaatttattttgtaaaacataaatatgagatgacaattgtagaaggcgtcagg

SEQ ID NO: 22335 - DNA, 1289 bp, Heterodera glycines
tttttcactctgcacagcgcgcaaaagaatcaattaattaattgtttaattaatttgatgataattaactaattaattaattttatggtaattaactaactaggtaataaattaaatggtagaataaagttaattggcccaccttatactcagcgtgtaagcgtttggcctcacaatttgtgcactggtcaagaacacggagtttgaatgcacctaattaaggcatttttaggcttaattagctataaaataaattttttacagcgatttgaaaatcgccacaattattttagttgaaaaattaacagataaaattaggaaaagttaaaaaaagaatttagagaatatttttttcccaattttcaggttttttgaaagattgttataaaaattctttttaaatttaaaatgtacgaaaaatggttatggattattttaaaattgtttgagaattttcatcccaaatgtgccatcgtcgtcaatactaattgctcatgtcccgaaaaacgtgccttcaaaaaggcccacaaccgccgggcatcggttgcacgcaatgcgccatttgggccccgactgagcgtccaacaccaacacgccacggccgccaaagcagcggttcaagcagggcaacactccctgggttctgtcggggacacaaaatttaaaaatgaaataaaaaataaatacaaattaatgaaatgaaatgccatttttaattaataatttgaattttaattatggtaaaaagaaattaattaaagtgcattattttgtaataattaaagaaaaattcataaaaaataaatatattatataggtcatattgtcggttttttggagaaggtgattttttgacgagaatcaagaccaataatacatctagaatgcttaaaaacttgaagactttgtccatccccatctcctcctttgcccggggcttttcatccccggcattgagagacatccccacacccgattattcaaaatttaaataatttaaatttaaattttttccctcctcggcacatcattcactcattgcccgtgccaccacccacttgtacgagttggggcagtccggatgcgggcacaggttgcagctcaactgtttagtgccccgcgtctcctccagcgttgggtggttgaagcagtacgggcagaacgggaacgagctggacagcttgccgcccggcacatggtagtagagcaactcgaactcgtccagcggacacgtgcgctcaaaatgctgccgaatggacgaccctttggaggagggcagggcgtaggtt

SEQ ID NO: 22336 - DNA, 1027 bp, Heterodera glycines
caaaattatttgaacccataagttatcacattattaatgtgctttttcacctaaaaataacatagtctttcactgatcgcattttccattttatgcgaccgaatcgccaaattttttaaaaattttgtgccaaaaattcacatcgcaaatcgggcaatacaatcgttggggccgcgtctcgaccagcttcatgtagcgccggcatttgccacatttgctgaacggtttgcccgagtcggccagcgatgtaaatgaatctaatggggtaaaatggtgaatttaaaaattgtttaatgggcctaattaattggttaatgggcgacattcacctccaaaaagtgcgtcaaccaaatttatgttctgcacaaaattgagaaatttctgccgaaaaatctcaagtgtttggttcttgatctgaaattaaatttagaaaaaataagtacaaatatattttacgcaatttcaatagttaaatattttgagattttttaaattttaaaaatttaattgactaattattttatttattattctgaaagaaaatgccttaactcattaataatacaacattagtcagataattcattagtcaattagtgatttttatccgtcttgaaattggtaattaaattagttatagcgcaattagttagttaattaatgatttgtccaccgtctgatagtccgcttttcccttggcaattaggtccaattggcgctcaacattagcacgcattgttggcaaaatcaagtcggggtccacgcgttggtagccatgcacaagcgcaatgcccaatgttgtgggcatcaatcggcgacgggttggctcaacctgcccaaatttgtgccaaatttaatttaaataaaaaggggcaatttatagtaataaactaatgaccaactcaaatttcggtcaattgatgaaaacttgaacaaatttcttaataaaaattcattaaaaattccaaaatttttcttaaatggcttaaaatcacaaaaattgatcattttagtgaaaatctgttaa

SEQ ID NO: 22337 - DNA, 1697 bp, Heterodera glycines
cagccaagcgaggcggcccgccaccgacacattgccactcagcagccatacacaggctttcacacgtgcagcactgagcggtataccacagctccaacgtatggaagcaccccaaaagcatggctcgtgaggcagctgccccgtaatgttgggcagcgtccacaagtcatctcgaacgacctgtgcccatcagcggacgggggcatttggtggtgccaacgctagcccaacaggacagcaggtaggtggtgaataggaatcacttgggtaatgatccagcagcaggttcacctacagctaccttgttacgacttttgcccggttcaagccactgcgattaaatcggttccagtctgcataccgaccgaagccggaacactaaccgtccccgaatttctcgaaatggctcagtcccgggcagcgacgggcggtgtgtacaaagggcagggacgtattcagagcgagttgatgactcgcccctacaaggaattcctcgttcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatgaaaaagctatcaatctgtcaatccttacggtgtccgggccgggtgagtttccccgtgttgagtcaaattaagccgcaggctccactcctggtggtgcccttccgtcaattcctttaagtttcagctttgcaaccatacttcccccggaaccggaagactttcgtttccgggaagctccccaccagggcgaataaatccgccggcggatcgctagttggcatcgtttacggtcagaactagggcggtatctgatcgccttcgaacctctgactttcgttcttgattaatgaagacattcttgccaaatgctttcgctgtagtccgtcttgctacggtccaagaatttcacctctcacgtagcaatacgaatggccccgtttgtctctgttaaccattatctcggtcagcaaaaccaataaaatcggaccgaaatcctcttctattattccatgcacgaacattcaagcgaaacgcctgtttgaagcactctgatttgttcaaagtaaactcgccagcccaccgacgccgaccggtaaaggccaacgccggggaaagaccggcagaaaagccaaccaaaccagtaacacacaaagtgtgcaccggacggctagcacagatccaactacgagctttttaaccgcagcaataattctatgcattttgagagctggaattaccgcggctgctggcaccagacttgccctctcatagatactcgttaaagggtttaaattgtacccattccgatgaccggcctcataagagatcggtctcgttatttctcgtcactacctcctcgcgttgagagtgggtaatttgcgcgcctgctgccatccttagacgtagtggccatttctcaggccccttctccggagtcgaaccct

SEQ ID NO: 22338 - DNA, 906 bp, Heterodera glycines
atttgatggcttcaagatttgaaattaaaatcttcatttcgatgaattttttttggtcggagatggaacgcttttatagtattctttttaaatttatttttaaaatattatctaattaaatttataatttttcgagaccgaattgaattgtataattaagtttaaatatttattgacactgagactattttcggttcgacctagcaccgtaaggaagatagtaccttttaatagaataattattttgattattctttattttctttataaggcatattaatttgggaaaaatattttttatctattattttagaaaaaagaaatataatggatgcttaattttattggttaattgtaagttagtacatatttttgaatttttacataagtttagttttatttctgatttaattctattcaattccgcagttacctgagccgcgtcgagtctccatcggctcaacctttatttgctacctgatcttcgtttcacctatttcattttgtacattttttacattgatttgaaattatttatcattcaaaatttgaaattatatttaaatttatttattaatttaaaaatatttgtttaaaattttaaagatcatatgcactataaatagtaatttattttatttttttattcaaaagctttttttttaaattgtctaaaagattcaggtacataaatattataaaaattgattctatccatagttctttaattgtttaaatcgtattatcttttagcaatttgcggcttgtaaaatttttttttgttattttatttaaacctttaaatatttaattaataattttgaaaaatttattgcatttatcattttgtttatctcacctatatgacctctcgagtattgggcttaatttaattctaaatttttt

SEQ ID NO: 22339 - DNA, 1163 bp, Heterodera glycines
  misc_feature (17)..(17): n is a, c, g, or t
taaaaaagagatacaanttttggtattccatctttcttttttcattccttcttgcagcgtgaatgtctttccagttccaggcgctgcctttataattataaattttaattaaaattatttgtgtttatgatcattccgtacttactgtatttaatccattttatttttataattttatttatttagtttatcatatgggttcttttagttttaaaattagtttaaaaggcggattcttagtttttctttagataaatgtatattttgataaatagaattttaaatgttttaataatttttatataatatcgtccatgctaattcaaatgctcttttcgctcttccgagaaccttaggtccaatgcaactcatttgtttgacttattttttagtttatttttagctaagccaaaaatatttgatttataaagctttttaattaaaacttgaaagttaattaatttaaattccagttaagacactcgatgggctttgtgtaatcctcaaccggatgcaattatctatcattctaaataatttttaatctcattttcaagtatattgaaataaatcagcaataaataaattattataaaagtgttgtgtatgagataattatttgtcaattaaataaatgttcaatcgactaccttcattttataatagtcgttgtcatttgatttttaaatagtttttttctctgtgttaatcaattaattatttatgtatgatttatgaattaatcacccgtgagagggggcagaattttccgcttgcgccattgcttgagtctgcaacaacatcggaatatgattctatcctaaattttaaacaatattattttaatggttaaaaaaccattctatcctttgtaaatattgaagtaatatataattctaattatttatgtttaataaattttatctttttaattatattttcagatttttatatttataagtttcaacaagtttcattaatacattgaaagtttattatcaattattttaattttatgccttgataagccaactcgagaaactgtcgggtggattattttaacgagtgacgacacttaattcggcgagatccattaattcaaatttttgttgtcaattatcaaaagtatgttataaaagcttgatttttttcatcatttttag

SEQ ID NO: 22340 - DNA, 1848 bp, Heterodera glycines
ccgactgaggccgcgaagcggcctaacaagctaaaaaccgggcgcgaatcgcccgtatgagttcaatggatttaaaaaacgggcgcgaagcgcccgtctgaaccaacaaaatttaaataacgggcgcgaagcgcccgtcttgagcctcgatgtggactaaaaacccctaataattttttttaattttaaaaacaggcgcgaagcgcccgttcgaggccgcgaagcggcctaaagatcgctgataattttttaaaattcccaattttttcacaacccatagcttatctaggtagcgaagctcccaaagcgcgaaacgcttttccacagctaaatagccgacggttcacgcacccgctagtttatatactttagaataacaaggcaactcatttccaaaaacaaaatctccttacggtttgccgggaggggttcgaaatttcgaccttgggggcaacttttgacggcgcattcaggaaaactatagattttccgatccgagggccaactgagcgccaggcgccgaaaagtcactttttaaaaattttttttgccgtttttgggattcaaaaattttttaaaggcctaattgaaaaatcggcctcgtaaaggcactccgttggaccttttagcacattttttgcttcttcaccgaccttgtagggcctaccagtttttctgaaaaactggctaaaaatggcctacttttttgggccatttcagcgccggcggaataactccccggggtttgattggaggaggtcggtgtaagcggcttttttgtacagcttgacgagctctatccaaccatgtttttggatttctgaaattttcagaaattttcgagctaggccccctcgaaaattttccgtttttgaattttatgattttttacagatttttccggggaaaacggagaccactttcaagcaaccgtttttcatgctctatcgattggtgtcattttcagaaaaatttttcaaaaattttttggaaatagaaaatttttggttgctaggcctcaatttcagttctggcgcaataactcgtcaggagttgattttatcaaagaatcgtctaagagcttttttgtagagaattttaagcccaatctaatgtgctttatctcatgtttttaccatgagtttaaaaaaagttataaaattaattgtgattttgaaactcaaaaccataggggggaccccatggttttgcatttcatgaaaaatttttttactcctaaattagctaaaatgcatttttatggcataatttgaggtcctgaatacgtatatatacgctttattttgcgtttcagactttttggaaggtggttaaaattttttgaaaaatcgtcaaaatttgagccccggaaaatcctgtgaaatttcgaaaattcataaatctcttcgtttttggtcaaatttagtggaataaagctttaaaaatagagaaaaattgggagaattttatgagatttatttggaatttctatcttccaaaataaaaaagttattccagaatttctggaaaaattcgatttttcagaaaaaaaatcagaactcccttctgaaaaagtattttataaaaataatatactcaaaaaatccgcaattttttgctctattttataaattttaatttagcttattatcacttttttgaaaaaagttatagaaataaaagtgattttggcattcgggaccaaaggggtgtaaccatgatttttgagtggaaaatttttttcaccaaaaatcttcccgaaatatgattttaggggttatttgggccgctgatcacgaatacgtgatcagattttactttagacatggttaagacctcagaatccct

SEQ ID NO: 22341 - DNA, 1515 bp, Heterodera glycines
gtcaccgcctgtggcgctcgtcagactgcttcctccgccttccgtctcgcctgctccgtcttcgcatgctcccttttgcgaaattttgcttttaaattgttatttcccgtttattatttttcggtactgaaagtccattttcactgggacttagttgtcccagtgctcagatggcgtcggttcgataccttgatttttaacttagctcatcaagagctttcgaatgataccaaatttgtgtgattttaacccttttaaaagcttaggtgcctcccttttcactcaaattttcaagttttaaaccggttcaaaaacggtttaaacgctttgccgcgcagtttttttgatggtttaggcgtttcagcacctaagaaaacctataaaagtatttttatgcaattttgagtctgggacctatgatggatattttaccttttaaattttttagtaaattaaatctcggttttttgttcaagtcagggttcgagtttcgaatttggccaaaatgcatgtcataatcgttttcagcgacctctaaaacccctacaaatatgttttccttgtaatttatgaatttagaatttttgttcgaattcgggttgggattcggaatttaagaaaataaatgtcatattcgtgatcagcgccccaaattaccccagaaatgactttatttgaaaatttaagggggggggggtcacaaaaccgaaaagaaccaattttttttgacgcgttacattttttggcaaattttcaaaaaattttccatataaatttttttgttgactaaaatttttgtaatttactttctttcttgacaaaaatttttgtttttgaaattttcttaattttgaaaaatgcattcaaaatttcgattttaattaattggaactaatcaatgaataaaattagttgccttaattttaaattattttcatataaaaaacaacaatttaaaaaattataccccctaaatttggaactttttcaaccttaatttcgccttcgcccttatttcgcgattttttcgcccttatttacggccttattttggactttatcgcccttaaaaatccgagccctacttctcactctctcttttctctcctcttgtctctttctccctcttcctcgtttcctctctctctctctctttatcactctctctcttctagccaatataatgaagtgaagagaacgccaattaatgctttaaatgaagtgttataattctcaaaggccagcgccaaacacacctttttcgctataatccccgctcgcttctcttggcatgccatttcctcgggcgacaaacattccgtttttgacaacaattttaatttaatggaactcgaattttagaaaatgctattgcttaggcagtgagagagggaaacagagagtttttggagagagagagagagagagagagaaagcgaattagagagagggagggggagagagaaagaaggaattagggaggggttgggaagggggagaggaagtagagatggg

SEQ ID NO: 22342 - DNA, 1683 bp, Heterodera glycines
gggaagggtgagggagccacgcatggttgcggtacacgcatcgattatgaaagccgcgcatgcactagcaacgaagtcctttgcgcgaagcgctcatgtcagcgcccgcctatatataatgaatgcgtactcgcgatgcctgtagaccaaaatcccttatcacatccataaattcatttcaaaatcgcgcatgcaccaaagtttgaaacgggcgcgaagcgcccgtcatgaggccgcgaagcggccgaatgtccccaaaaaattaaaaaacgggcgcgaagcgcccgtcctgaggccgcgaagcggccgaatatcccccaaaaaaattaaaaaacgggcgcgaagcgcccgtcatgaggccgcgaagcggccgaatgtccccaaaaaattaaaaaacgggcgcgaagcggccgaatatcccccaaaaaaattaaaaaacgggcgcgaagcgcccgtcatgaggccgcgaagcggccgaatgtccccaaaaaattaaaaaacgcccgatcatgaggccgcgaagcggccgaatatcccccaaaaaaattaaaaaacgggcgcgaagcgcccttcatgaggacgcgaagcgtccgaatgtccccaaaaaattaaaaaacagaccgtaaagcgcccgtcctgaggccggctacctccgaatttgtcgctgatctgtcattatgcattggctgatgcgaattgatgaggaagaagacattcccacactgtcatgtctctcatcacaagtgcactccaaagtgtcatggtcaatgccgagcaaatgggccacggaatgggccaaggaaattgcatttgcatggggaccgaatgggtcggacacctaaaaaacaaaagtccgaaaaggaactcggagtgtactagttctcgtagaaaatgtaaaaaatgtatatttattttgtaaaaaagttatttctaaaattttgaaaatcatgaaagtgtttctttaaccaaactgctctagagatttgaattggttgaaccaaaaattgggttaaatctactttaaagtttaagattatgccaatgccgcgccctttctgaaattgtccaaggaacacaaatttaaaaattaattttggtgccactgtattttgctgctggcaatctgcccacaattctttctaatctttccccaacatccatctcaaatagcaaatgctcatcagtcttcgcccgccagtctctcgcaacactcaaaatgcgataacatcgccgcgtccgtcgttccttccccgtcgcccatcaatcacttttcattccctctcaattcaaagaatttcgattgttggccaaatagcaaatcacattggcactggccattttccgccccacctgaacaactccgaccgcccttgaggtgcaaatgctggcgaatgaagcggccattttgtcgcctccggacattttttggcccgtcaacagaacagtcgcgtccttttcgatgtcgtaaatgttccccgtcgcgtagtccaacgcattgcccaacacccgctgaacatccatcgcatttgcagattcaattcgctgtttgtccgcccaaaattcggcaaaagttacgctcagacaaacacccaaatccctccgtaacaacttaattaatgaatgaacaaatgcggcattttataacgggggaattctgtaccaaatccgccaaatgaccacgtt

SEQ ID NO: 22343 - DNA, 2275 bp, Heterodera glycines
aaaagtttagtagaattttggagacccgtgaaaattttttagggattttaagggatttcttaaataaaaataagcaaatgacaatattttttaatttaaaattcaaaatcttaatttaaaaaatagagatttttcgaaaaaagacggatcccgaggttgggatcctgaatttaatcccgcgagatcccgaagaaatcccgcgggatctcgaaagtatattatatcccggtcaaaaaaaaatatttaaatatacaatttaatattaaaaatattaaatttcgttgcacttataaatttaataatataaatagaacttttttcatttcttattcctttcataattcagcatcattggctcattcgtcttcagtcaggatagcatccaaaaccaagaatcatggcttaaatgaataaatttagcaattatttcattaaaaaaatttcaactaatctattagcagcaccggactcaaatggacttaaaattatcaattttagagaaagatttttgccaaattgtacatttaagaaattgactgatttaaaaaaacggcacaaaaattttggcacggatactgaactgacacacccgctcactaatcataaaacatctgtataaacgctttaattcccaccattagcggaagccactgattgagcatcatcatttcgtttgccaaatcagcatcccgagcaccgaaaaggcattattatcattttaaattaattattatgttgaggcaaaaaaaaaatcatagttggactgtggcaaaaactccgtcctctgtttggtcgggagtttctcccgttccactggcgccgcctcactcctcaaattgccgtgccgattcgcgatgccgttggggtccctttcccaaggggagtgaggcggagggatcggggaggcaaacaaagatttgtgagggagaaattgactccctaatgaaaatgctggcagcaaacggcgcaggcgagggagacgagagatgtgaataaaggtacatccgacttagactgaatcaaaaaaagcagataacataactgagtctgttccataaccctctacaacaaaattaactaaaaacatttgtattttttttaaggaaaacctgaaaattttggctgattttcgtaacaaatgcattaaaatttcttaaaattttgccccgttggcgcctacgggatttctacagatttcgattttttgttgacgaatttttttttcataactttttaattttccatttggcgcgattcttaaaattcatgatcataaatccattaaaatgcatgtgatattggtcgtgttctgttgctgtttccgcgagtgttggaattggcattttttgtgccgacaaagctggcattgttctttcctctcagttggaccccgcgcattgacgacattggcataatattgagaatttgcgcttgttgtggatgacaatgatttgtacacttgtacaaaacaattttggcatatcgcacaaaatccgttcgaatggttttgttcagtgccaaataaatcatcggcggaattcctttaaattaaaaaacaaatctcatttttcgagagtttgggcacttcctgtgaacctaagagctgaaattttaactagacatatcatttttgaaagaaatagatttttaatgatttggtgctttataatggcaagcttcattaaaaaaaaattttttttaaatcatagtttttctaaatttcccggttttcagtgtatttttttgaggtttatatccttccgagaaaggaactattttaaatttaccctacttttggaaaaaattttgttgacaacattttgcttttcaactcttaatattttcgaaactgctatgaaatttaaatttcaactcgttcggttcaccaaaaatggtcaaaatctcgtaaaaatggggtaaaataaatttatctatcgctgagctctgaaaaatttgattaaaatgaataaaaacttcaaatgcaaataaattgtaacaaagaatactgtaaatctctttagaacagattagtgcttaaaaacttatatgatcacactaccgtatatcacatctgaaaaaatcctatacgtatttttcactgacgcatatttgcggtaaaaatggtcattaccaatttacttttgcccttcactcataagcaaccaaattacggcgaaccgaaaatagtctcagtgtcaataaaatatttaaatttaattattttaaagcaattttttttaattgaatattaaataatattaaaaattttaaaata

SEQ ID NO: 22344 - DNA, 1351 bp, Heterodera glycines
tagaaaaaattgaaaattttgaaatcatgtttccccccccctttcccaggggtattattttgtaaagtctttttttcctaaataaacttgtcaaaccccatttttcgcaccgtgaatgttatttttattgaattctgaaccgttttgagtagattagactagaaaaaattgaaaattttgaaatcatgtttcccactcccttctcccaggtgtattattttgtaaagtctttttttccccaataaacttgtcaaaccccatttttcgcaccgtgaatgttatttttattgaattctgaaaggccgcgaagcagccgagtgagtaccttcggtgcaggaaaattattaaggaagagagttcattatttatttattttttgcataattaattcataaatattttttcagaaagtgctctgaaacgcaccaaattttatgtacaagttgaataaggctctctgatgcttttactatcaaaaagggagatgaataaaatttttaattgctttttaaacatgccaaaaagtttaggcttaaattaaaaaaattttcttcggttctagctctttcaataagcaataaaatcgtaccaaattttataggcatactccccggtacaggactaacttaacctgaaaaaatgacaattgtaattggttttaaatttttttagaaattctgagtttttcactgtttattattttttgcaaaattaattcataaatattttttcagaaagtgctctgaaacgcatcaaattttatgtacaagttaaataaggctctctgatgcttttactatcaaaaagggagatgaataaaatttttaattgctttttaaacatgccaaaaagtttaggcttaaattaaaaagattttcttcggttctagctctttcaataagcaataaaatcgtaccaaattttataggcatactccccggtacaggactaacttaacctgaaaaaatgacaattgtaattggttttaaatttttttagaaattctgagtttttaactgtttatttattttttgaaaaattaattcataaatattttttcagaaagtgctctgaaacgcaccaaattttatgtactagttaaattaggctctctgatgcttttactatcaaaaagggagatgaataaaatttttaattgctttttaaacatgtcaaaaagtttaggcttaaattaaaaaaattttcttcggctctagctctttcaataagcaataaaatcgtaccaaattttataggcatactccccggtacaggactaacttaacctgaaaaaatgacaattgtaattggttttaaatttttttagaaattctgagtttttcactgttta

SEQ ID NO: 22345 - DNA, 1041 bp, Heterodera glycines
gttgcgttgttgcgcaggcacaaccggttacaccttgggtacggttaaacaaacattccatttatttttaataatttttaatcaatgtaatcacaaataatctccataatcgagtggttcgggtaatcgtcagcgagtacctcgagttactcatcacccggaagagatttttgaacttcttttttgcagctaaaattaaatgatagtaatgtgttttgtctggtcggcaaaatttttaaaacgtttcaaggcgcgttttggagtgctgaataagaagtaggctatgtttttcatgacaattccgagctccgcatctgaacatattttcaaaaaaagtattcttaccacaatcatgaaagtctagtttgaatcgttttcagggtagctgatcattaactcggccaatttaagaaaattctcacatttaggggcattctttccaatttttttgcaagtattttggcatttttatgcattttagcaaattcttgtgcctaattatcaactatttaggtatatatattagtcgatttatagcacataacaatccatccctatcattggaatatgtctctttaggaaattaaaattccccccccccctcccctcagtgttttattaattcgatattttaattaccatcgtttcccccaactgcattagtcgcacttttacagctctcttgaaagcggattcgagaaggcaggcgtcttcaagtgctgggagctcatccaattttgaaaaatactgcaacagaaaaaattacatatttaaaaaaattacacacccccccctataattatttgttcgttcaaaattccaatataattttttcataatgatcaaaaataaactaaccttaatactaccttgtaaatcaaaatgttgagtggaggggaggggaggggaagaaaaagagcaaaatgttgaggggggggggaagaaaaagagcaaaatgttgaggggggggggggtgaagaaaaagattaaaattttgagggggggggggagaaaaatagcaaaatgttgaggggagggggg

SEQ ID NO: 22346 - DNA, 2401 bp, Heterodera glycines
  misc_feature (2370)..(2370): n is a, c, g, or t
aattttatgataaattactaatttttcaaaaaaaaaatttttcttataaacttttttttaatttcggctcgataattctcatatctccgaatttaccggccctccaacattttttttatgattatgagttggatccattaataatacaatgtacaattgcactttcgctactctgtccattttgttgtcccattgtcagtgacgtcgtgtccagttggtcgtcgggcaccggcggtgccggcattttcggcgcgttggcatttgccgtgctcaccgaccgtcggctgttggcgctgcagccgcagaacgcactgctcgccatgctcgtggtcccgctgctactcatgtggaccttttggcgcctgctccactttccgtccagcgcgtacagcgggtaaaattcagttttatgggggaggaggaaacgaaaaatgtacaatttttgtaacattcctttaaatatttcaaaaaattttccggcttggactttattaattgttgcaattctcaagattatcccaaactcaaaaactctctaataattttacacttttaaaagggaagcaaattaaaatgaaattaaggcgcatattattgcaagaaatgcacgcccaaattatttcggaggaataaatgccacatttcgagataacaatagattttttcaaatgcgcctattcattaatttatgcaatggaaacgaatggtttttttacaattttatgcgccctctgttcatttttcaaaattcaaatcctggtccccaaacagaaaagtacccaaagtttgtcagcaggaaagaaaattggactattcgaaggtttgatttacgggtacaccccaaaatctcgccgcccgccgtagaaattttttaaaaaaattcaagtttagaaattttcaagaaaaaaaatcttattagaaaattttttataagaaaatttcaagaaaaaaatttttgaagtttttttttgaaaaaaactacctaaattatcataaaattagaaagaaaatcgctgaaaattttcaaaaatttttttcttgaaaaagttctgccattgttttccagttcagtgtctccgccgtattccaacacgggcacagtcgtcgtccctactaatgccaacagcaggagggacccaatcgtcgccaatcgcagtgccgccaacactgtccaccattccttgccctcctctctgttgccgttttccaccgctgtcgccaccgacgcattcgacgattatggcacagcaaatgccgacgccatcactgaaccgttgctgaacaccaccaccaccaccaacaatagcagcagtggcaacgcattgacaacaaccactgtcattctgccggcctcccaaattttttgttggaacggcggccgacggacggcgtacaaaattcgagtgggttgttattattatccggtaaagggaaactgacaatgagctatttaaaaaaaatacccaatttttcttaacaaaatgccttaaaaattaaaatttctctcggcggcgcctgtcgacaccgccggacccccattttaccttattttttttaattttaactcaaaaaattgcaaaaattatgccttttttggccaaaggcggctgcatattgctattttttgctctccggcgtcgaccagttttgaataactttttggcccgaagagcaaaaaaaacataaacttttcggctgcccctcccgaaaaatttttttctggttacgggcctggggcgacctctcctgcctcgaaaatacacatctcagggttttcagcgactccgattttcccccctttggaaatgcgtttatttaatgcaatttttgcgttagccgctgctcaagtacatggtgccgttgtgcgtcgtctacttctccgagtacttcatcaaccagggcctgctcgaactgttggtgttcgactgtgcccattcgtttgcactgtcgcccaccagtcagtaccggtggttccaagtgctttaccaggcgagtcggaccgggaatataagggttgaatatgccaatggcggtagaataaccgtcggaaaatttaaaagttttttgacgtgattcaatagaattagccccaaaacattgcaacctaaatttatataacaattgaaaatttaataaaattgctaaccgaaagtgccgaatatgaggcgaagtggcaaatttacattttaaagagctactagtctactatgttgaacaaaaggccattaaaaaaaatttccgggaagggagccccgacttttgcgcctatgtcaaaaatcggcttctaagttaagttttttcaagatctgttagcctaaacagcattaaaattaagaattatagtcttctagtttactaaagaggactaanttatgtagtttgaataattaatgattttttc

SEQ ID NO: 22347 - DNA, 1260 bp, Heterodera glycines
attttagaacaattttataatctataaatatgaattcatcataatgaaaaacaatcaaatagttgatttatattctgattaaatttatcttatttaacaagagctaattcatttttatataaaaaatagcgcatatgacaataaataaactaataaattctgataaaatgttgtatataaatgcaaaatcatagaaaagcaatgccgaggcaatagcaatgatttatttaaaaaataataaaaaaaacagagtaactaaagagcaatttgaaaaaattaaatcttcaaaatataaaaaattagctaaaatttgtttaaaaattcattccagcgcgaactcatctcaatattcagtggatttaatgagattaaatccttttttatattttattttctaattttctatttcccaaatttaacggcaccgctgtaccattctaaattggttgtgatttattctaaaaacgtgttctatattcttcactccacttaaagttataagtgcaaaaatccaatagtctgtgtttttcctagctccagttattgtatctgcgcgcatgcttcatctacaaggtcaagattttctacatccggtccaatttgatgcggaaagaatcgctggtatatgttatcatcactctcatcatcatatacattaaaatcgacatcaattgcttttatctcatttcttacactttttataatattataaatagtcccactttcctcgtttgggtttggtgagtataactcagaattcgaagaactaaaatattcaagcttttccacttttggtactgaaattgtactgcctaagcgtgaatactcattcagttttacatttgggtaaaccaatgcaaaatatggccatttgtcctccttacccagccgaacagccattgcacactcacccattctctggaaaataatcatccttagctgatcatcactatttttatcccttttttgtcttttttgatattcatcgctttctggtttaacccttgcccaggcaagagtatcagtacatcttaaacctattccagaactagaaggacagtccatattattaatcggttctgttggattcttttcatcacttttttcagtatctctcagttcaagtattttctcattaccacgttttattgccaaagctgccattgtttttataataatttctctacaatgatttatttctgcaattcttttcatttccttttcattagcactttggcttgccgaagcaatattttgatt

SEQ ID NO: 22348 - DNA, 1178 bp, Heterodera glycines
tgctaaagccattataatagtaaaaaaattcactcactgtcgtaatgtccactgtccaattttccggttctgtccaaataacttcactgtcgaaatgtccgggagccttaatattttagcaaaaagaatcaactaatggaagaaaaatcagcataaataaagaaaatgaaaaagaaaaaatgataataaagaaaaaaatgcaaaacaacattaaaaattaaattattcaaaatggaacaattaaaaatattatcttaaattataatgaataaatcagctattattaaattctaaataaatttttaaaaacaattgatcgaaaaaagtaaaatatcaataaaatttagatacaaattatttatataattaatttggtaggacgaagaaaaaaagttcattcattaatctatgttaaaaatgaataaataaaaagaccataaaaacaataaaaaaataaatatattaattctttaaaatattcaaacaattacagaaaaaaacagaaaacaaaatgcacaaaatactgtttatatttatatatatataatccaaaaatatatttaacaaataaaaaacacatattaaagtggcaggaaaagtaaacgctatttaaatatgaatattttaataaagtgaaattaagtatttatgaaattttaaacaaattcttaaaatgaagtaaaatgtaaatcatataaacgaaaagaattcaaataacaattcgttattcaataaggggccataaaatattattaattttttattgaataaatgttaatatttaactccaaataaatataaaaaaccaaattgaccagtataaattagtgaacaaaataaaaatttaaaataatttacaactgtctataatattcataaaaagtgtttggaaaattaacaaaaaaaaaaaagatttaaaacctaaaagaagtcagaaaagcaaaaaatattataatttacgggtaaaagcagtaaaataatcgaacttgagtctgaaacaaaccgaataaatcaggatgaaacttgatagaaaaatattcaatttttgtttgacaaaattaacattattttaaaatattaaaatcaatctaattacaactatttgtcttaaattctttaattttgatggaatttttaattgtctttgcttttttgaaaatgagtaaaatttttaagag

SEQ ID NO: 22349 - DNA, 1972 bp, Heterodera glycines
  misc_feature (35)..(35): n is a, c, g, or t
atttgtagggttctcagcagtttccctgcaaaatntgatgagcttctgatcagtctagaacgttgggtgataaaatgaaaaaaataattaaaaaaaaataatgctggtgtgctaagtgtgaagaactgtgttcttccaggcaaaaaattctaagaaaatttataagcatttgtagggttctcagcagtttccctgcaaaatttggtgagcttccgatcagtctagaatgttgggtgatcaaatgaaaaaaataattttcgaaaaataatacttgtgtggtattaattcataaatatttttttcagaaaatgctctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttaaacatttttctttgttgaaaaaccttttattttaaaaaaactagcaatttaatttttatgaaaatcaattattgtgattttttgaaaatctcaacattgatgggctaaaaccattccatccagttaattttttgtgaaattaaaaaattctcacaggcaattgccgtttggccggttaaatctttaaaatttatctatctctgatgaactgaatagaacaaggaaaaatttttagatgtaatatatgaaaaattatggcaaagtgtatactaagtgaatagttatactaacccaaatctgaggttggttaggaataagtttcgtacactttggcacgcataagctcctaaatagaatttaagaagtctttacgcttgactgaaacttaaatgtatacttaaaattattttataaatattattgaagtcaattgtaaagatttctgtccttatccccatttgagactcacatttatttgtttcaaaatcttatcggtctgctttgcgaccatgatgagatttttgcacgtgccggtctgcttagcgaccatggcaacatatcggtcagcttagcgaccatgatatgtagtgcaaacgccggtctgctttgcgaccatggcgaggctggtctgctttgcgaccatagccagtagtgtcggtctgctttgcgaccatgacacaatgccggtcagctttgcgaccatggcaacatatcaatctgctttaagactggtatagaaatcaagctcagacttgcactcgcctttgcgatgcatgtggctgggctgcccaatgggagcgcctttttctggccttgtatcccagctgaatgtttgcaaaaaggattgttctttgattacttagcaatgctaattgttcgaaggtcacattttgtaaacaggaggttggctacggtgggattgtcctctgttcatcagcaacgcgtctgttgttcggagttccctgcccctggccatttagggattggcgcgaacaaagggcaataaaattggttcgctgacagctccttcggagcattgtcgcaccaatgtggttcgctgacaggcccttcggggcatttgtcgcaccaatgtggttcgctgacagtcccttcggggcattgtcgcaccaatgtggttcgctgacagtcccttcggggaattgtcgcaccaatgcggttcgccgacaggtccttctgggcatatgtcgcaccaatgtgcttcgctgacatgccctttggggcatatgtcgcacctacatggttcgctgactggccttcgaggctgtgtcgcactttctgcactcttgaatgtgatatgtgatccgatccatggctgatgtattcagcggaacgactacacaccatgacgaataatgatgtcagattgaatctatttgccactctgaataaatgcttgattaacacgtgcatttatgcttcagtgtgcctcatatgtatgccatcttatattgtaaaagtcattttgtt

SEQ ID NO: 22350 - DNA, 1923 bp, Heterodera glycines
tgatgtttgatccgacccagcgattattacacaacagtcgaccggtttctggaaatgtgtaagcagcttaaaatttggcacagttttcccattttgtagtaattgttcaaatgaatgtgtaaaatgattagggaaaggattatcgatgtttactaagcacaaaaattgcattttctattaaataattttctctttaaacagcaatgacatgttggcatatgaaaacaactatttttggcattttagcgctttaaattttcgtatttgatggatttgtgcatgtttttcggggtgtcattttttgcgtggcattttactgcatgtttacatcgcgataattaattaattaattgggtaattcattaaaactcctttttgggtgtcattttgcgtgccattttaccgcattttttggcactttcttagtccgattttacgcttttagtgcgcgcctctgaaatccaaactctaagtattgcaatatgtaaaaataacaataataacacgcaagtcattaattaattaggtaatcgattaagcatttttttgggggggggtttaatttttgcgttgagttttacggcatttttggcactttcttaacaccgcggtttttaagcttttagcgcgcgcctcaaataaatatggcaatatttaatagtgtatcacgcaaattacgaactcattaggtaattaattaattaggtaattattggactgttgcctcacaatttggctgatgtccgtctcgcgttcgatggcgattttcggcggcggacctttctcgtcctcggagtcggagctgaccgcgtacggatcctcgtcctgtgacatttctgcttctgatggcgcaaaagccgctttttgtcgatcaacaaaatcttaaaatacgcaaaaaaattgttttagtcatggcaaaaattttgtgaaattttgttaaagttttgaattggttaattcggaattttggtaaaatgaatatcatttaattgtatttaaaaataaaattgttttttttagaatcaaatatccaaaaaaagcaattaaaataaattgttcatcaaatgacaaaatgtccattaaaatataaaactaaaaaacatctctcctctgccaaaattttcaacaaaaattttattcatttcattttcgttaaatttttaaattttttcaaaatgaaattttggcctagacatagttaaaatatttaaatttttgtcgatgcttttcctatggttttcctttaaaaataagacaatttttcaaaatttcaaacaaatttttaaatgaaaaaatttttcaccgaacccccatatggttggctgaactaagcataaatcgactgactaaaaaaatgaaaaaaaaatatttaaaacaaaaggggtttcaaaatctgagattgagatgcttgtgccaaatgaatgaaaactgatgggagcgaaaattaaatgtgaatgtgtggcggtggaggcggtggcggcaaatgagtgaaaagtgagagccaaacggacgcaccggcggcggcgacgacgacggcggaaggccaaacgatcggcgaatggcggtgcatcatgcgtcagtcagccggcggctgcttggaaagaagcggattggagcggatatcggcggatcaaggggaagaagaagaagccgagagaaatgagggatgggtggaagccttggctgggagagaggaggaaaagcggcggcggcggcacacaaaagctgtcaaatgggaggatgggagggggtaaagcacacggtttgtcaagagcgaaaatttggccaaatgtttcttaggggggctgtttgggctgagaggggaagctataaaaagggggagaagcatgggatgggatgagagataagggatatcttccttctctgttgcccagccccgggtggataatggggggggggggg

SEQ ID NO: 22351 - DNA, 1446 bp, Heterodera glycines
  misc_feature (1338)..(1338): n is a, c, g, or t
  misc_feature (1416)..(1416): n is a, c, g, or t
  misc_feature (1426)..(1426): n is a, c, g, or t
tgtcaatgggagcaatgttttcggcatgtagtgctggaatttcagaattctcgaaaactgacatctttgtgagaactgaaagcggtacggaagaattacaaaataagtccccatttgggcttaaaatgccgacaaatgtcaattggagcaatgttttcggcatgtagtgctggaatttctgaattctcgaaaactgacatcttagtgagaactgaaaacggtacggaagaattacaaaataagtccccatttgggcttaaaaggccgacaaatgtcaattggagcaatgttttcggcatgtagtgctggaatttctgaattctcgaaaactgacatcttagtgagaactgaaaacggtacggaagaattacaaaataagtccccatttgggtttaaaatgccgacaaatgtcaattggagcaatgttttcggcatgtagtgctggaatttctgaattctcgaaaactgacatcttagtgagaactgaaaacggtacggaagaattacaaaataagtccccatttgggtttaaaatgccgacaaatgtcaattggagcaatgttttcggcatgtagtgctggaatttcagaattctcgaaaactgacatcttagtgagaactgaaaacggtacagaagaattacaaaataagtccccatttgggcttaaaaggccgacaaatgtcaattggagcaatgttttcggcatgtagtgctggaatttcagaattctcgaaaactgacatcttagggcaaatttcatatttttattttaaaaattttacaaaaatttatgggacaattataaattaaaagatgtattatttttattttccaattatcttttgattaagctgctattcattattttttgcaatattcactttctgaaatttatttcaacaattttaagttcaaaattagactttttcgctatttgcgttttctattactcaaatcataataatttttcttaccgtatggctaaatttcgcaaaaccccttggtaccgtatgggcaaatttcatattattatttaaaaaattttacaaaaatttatgggacaattataaattaaaagatgtattatttttattttccaattatcttttgattaagctgctattcattattttttgcaggattcactttctgaaatttatttcatcaattttaagttcaaaattacacttttttcgctattggcgttttctattactcaaatcataataatttttcttaccgtatggctaaatttcgcaaaaccccttggtaccgtatgggcaaatttcatattattattttaaaaaacaaaaatttatgggacaattctaaattanaagatgtattatttttattttccaattagcttttgattaagctgctattcattattttttgcaagattcactttctgnaaattatttncacaattttaagtcaaaatt

SEQ ID NO: 22352 - DNA, 1731 bp, Heterodera glycines
  misc_feature (1702)..(1702): n is a, c, g, or t
  misc_feature (1726)..(1726): n is a, c, g, or t
ttatttgtagggacgtgaattttagtgacgaaaaatcccgaaatagttaactaaaatagatagtaaaatgccaaaatagtgacaaaaagtccgaaatagtgataaatagtagagtagagcgggaccgggaattttgggcaaaaccgggaccgggaccttttcgggttgaaaacccgggaatttttggctgggaaaaccgggaaaaaatcgggactagtcccggtcaaaaccgggacctcggtactcagttgtactcagttgtctgtgttttggtcccggtcccgctctactctaacaaatagtgacataattttcagccaaaaattgagcaaaaataatttttattcactgattgcagttgcaaatgaataggactgggatttttaagaccaaaaaacccaaaatagttacctaaaaaaattttttaaattaaaaatttttgccaagaaagtaaatttttgagaaaattttttttcatttcataggagtatattttgaaaaattttagctcgattcttaggggtgtatttgtttgaaatttttttaagtcgattcttaggggtgtattttttggttttattgcatttttgttaaggaattttccaaaaaaaatcgaaatagtgaaaaatagtgacgatacgccaaaatagtgatttttaactattttagtgacggagtcgtaaaataatgatttctagtgactgataatgacgtccctacttatgaaccataaaatgtctaaattttcatttaaaaaagcgaaatttaaatcatgtccaccattgtggagcatattcattatgtgcctgattttgtgactgaagaggaggagcgtcagctgttggagcgtgtgtatggcgtgccgaaaccgaaatggcgcgaattggcacggcgtcgactccaaaattggggcggcactttggttggcggtggcggcactgttgggacggaggaggaagacggcaacaagcaccagtacctgttgcaagacgaacagttgccggaggtgcgaactcggcacaatggccaaaatctggggcacccaaaatctctctgccgaaatttaaaaaaaaaataaattcaaacttggatatttttcaaaaaacctgaaaatttttttgaaaattttctaaattaaatttttttttttaattttgggaggcgaattgtcacgttcccaaaatctgttaaaaaatcaccaaaatttcaaattttctgatttgctgcataaatatggaaatctgaattttttaattttcgacattggttcaagtcagggttcggggttcgacagagccttaatcatcaaatatgtaaaatttaaaaataatttatttaaaaataattttctttcagtggttggagcattgcattgataaaatcatggcgttcaattcgggctccccaatgacaacatttgctacagaacacaggcccaaccatgtgctggtcaacgaatatttacctggacaaggcattatggcgagttttattcttgccaaaaatataaatttattaatataatttttcaattatttttaaaattaaattagtaaaaaaaattttccattatttttaatattaattaattaataaattttattattattattttcagcctcacacggatggaccagcattttacccactgatctccacaatttcacttggctctcacacagttttggactgttacgaccanagtaagtcatgtctagggctccanatttt

SEQ ID NO: 22353 - DNA, 1938 bp, Heterodera glycines
  misc_feature (376)..(376): n is a, c, g, or t
  misc_feature (385)..(385): n is a, c, g, or t
  misc_feature (1862)..(1862): n is a, c, g, or t
  misc_feature (1887)..(1887): n is a, c, g, or t
cattttttgggccaaaaatttgttaaacaaatcaaaattaaaaaatgcaaaaaaatttttcccgggtgccccttttcggccccccccgggaccccccctttccccaaaaagttttttgggaaaaccgccgcaaaaaaaaaggttgtcgcccgaggggaggtaccccccccccaagccgaaatcctgggaccgtccctgcataattcataccaaaaaatggaaaatcatagaaaattaaattttagcttttgcactaaatattgaaaaaggctgaaaacttgggaagaatgcctattaaaatgtggaaaatttgtagtcaaaaatgaacgaaaaaccaaaacatagcaaaataatttattcattgaattttgaaganaattgaaantagacaagaaaaatttaagggaaagatttgttttttttattcagaaaaggtaccttttatttttaattttatttttttgcatccatttgacaaagtccaaaacccggcccgaattcgaatgtaagagacggattttgagtacttgggctttttgctagaattcctcccccgtcctttcccgcatcggagtccgattaaggacataaaatgcgaggggtacgccgaaagggactttgccatgttgcctttcccacctgatcagattggccactcggacagcgttcagcaagtctttctgctgcacaaagtgtcggcagcgggccaacaactcgtagggctcgtatctgctcaggtcgagccgatcgtcggcggagtacgcgccgggcagctcaaaggtcaccagcgactggagccaggaggcgacgtagcgcaacagagtgccgccctcgtcgccaatctgtgccgtgcgtcgggccaatttgtgcacctggcaaatttcaggggcttaacgaaaacaaacaacaaaaaggcattccgaaatgtgttagaaaattagtaaattttcaaaaatttcgcattttttgtatttttaaaaaattgtgagggcggaaacgacggggtgtaattaactcaccgatttttaaaaaaaattttgtgcaatattgtaaggtcgggattcagttttagactatggagggggtaattattggagaggagaggcctcctatttataattgtaatggctttctggggcgaccacttataagcgatggcatttccctccattgggaccaagccgggtcaaatgccgaaaccagcacagtttttaattattttttgatgcagaaattcggtgaaaattttggggcagcgaaactcaagtgttttttgactcgaatgtcgccccttctttgaatgcccctggtagaccctgtcgaagcgtttgatcaatccctgctccgtcggcacgccccgttcaatggcacccgaggggaaatgggcgcagacggactgagcaaaggagtcatgttcagtgagctgtttgagaagagcaatctgaaaaggaagtctcgttcgttagcacagcgcaaaataaaatccaaaattaaactgatgaggccaattttcaaatgttcaacccaattttgtggaaatttttcttaatttatgtccgtctctggctatgatgagcttgggtcaaaaagtgtgggaatttttttggcatttttgttgaaatttaactcaaaattgcactgaagaggggaaattaaatgctacacaccctttctaaaatgtacaataaacagcatcgaccgacctctttcaatggcgttttgtacggcgttttttgactctgtgcgccgccgccactgaccaaagcgtccgtcagcgattggcaaattgtccaatagattttggcccttctgttttccaaatcctgtgatggcaaatgtttggaaataatactaataataancccgacgtgccagggggtatttccnacaaaaaaacaaataaattttagaattaaaatcaatattaaaaaaatataa

SEQ ID NO: 22354 - DNA, 1253 bp, Heterodera glycines
  misc_feature (1180)..(1180): n is a, c, g, or t
ggcttgtcccttccatgtctccgttgttacgggaccaatagggaaatgcgtgtcccaatattctccggacggtacacgccacatgagaagttcaactgcccctggtagacgaatccaatcatcttttccgattgtgaattgttcgacttttagagagtccccccatgacgtgacaagcctttccccgtccagaattcctccggttccttcttctatgactgtttggacgttgtcctgacaattaacaccgtaccatccgtactcttttctgattggtttgaaactttcccaacgtgtttcacttattcggttcatcggacggaggctcagtgagtcttggcagtcttccagcgacgcttccttctcgaacttcttgggcaggtgatcaagagtgaccacgcgtaaaaatgattctgtgcacgtcaccgtcgttatgttccagcatttgaaaaccggaaacgatcgtgggatccgtattggtatgtagagaattgatttgttcatgattggctgggtctcggtcgggagagtacagtctcgttcttctgggaagctcatggtcacagaagttgcctctgaagggcttattgggcaaatttggtactgcgccgtcgtcggtgaaatgcatgccataatggctgccgccagagttaaaagacagataaatgggaagttcacttcgtttacacgccaagtgcctctgcctctgccggagttatcgccactcatactcatcccgcggtgctgatctacccccggtcggcctctttgtggccagttttggttttgttgcaaatatggccgggcattgaagttgttttgttgaaatcggttgccaagtggtgtttgatttgcatttcgtgaattaaaattttcgcggtaactctggaatcctcgcgttcttcctctgaatcccctgttattccctctttgtacgaaagtgttcagcatttgttgaccaaaacgttacggtggcattccctcagttcgttgaacaagatttatcctcctatcttcttgtgttttttgttgctcccgcaattcatttaattcggttcgaacagcgttaatttcagctagcgcaacttccgcttttgttccttgcgtttgtttccaaatgtcttctgccagtgctccttgcatttgttggaccctttttgcctgtgtgattgcttcctanatgtctgaggttcatccatgaagagaattttttcttttattgacgccgtcatgtttgcgcggaaaaagtcctt

SEQ ID NO: 22355 - DNA, 813 bp, Heterodera glycines
aattgatttagacaaattgttagtgaattgtgattactgacgaatggtgaatattggtgattgttagtgaaaattggcgaagtcaaatgatttgcattagtcaattgttgtgaatttaaatagagatcggcgaagtcaactgtcgttcatcggccaatttttgaggaattaattagaaattgaaaaagtcaaatgatgttcattggctaattgtagcaattaattagaaattggagaagtcaaatgatcatcagccaattgttgcgttgtttcatcaatgtctttctcatccgttcgctttgtcctgttctcgtgatttccctgtgctttccatttgctgttgagcaatcacccgacctctttctttctcctctttgtatcaattaagctccccaattaatgtccctttttttaagtggactttggatccactgacttttgtccccggggctaaaaatgtaatgtcttgtgccttttccccatttcgatcccctgactaaataacttcgggtaaaaaggagatgaaaatttcagaggaaatgcaaattcaaatgctatattggcacagagattaattttttatgtggattaaattaatgaaaaggtgtgccaaaaataaacggatatgaatatggggggggggggggggtggtgggaaaacggtgcaacggaaattaaatggaaaatgcaaatgacaaatttaaatttatgaaattatcgcaaatgtatgtcataaataaatcgaatggatcaaatgaaaatttatgaaatgaatggaaaaaaatacgacaaaaagcaaatgggaaatgggaa

SEQ ID NO: 22356 - DNA, 2126 bp, Heterodera glycines
  misc_feature (152)..(152): n is a, c, g, or t
ttttgactacttatttccagacgcttaattattattattatttttttgtttttgtcacgccaaaacgcagcaatttggtgaaccgttcgacagaaaaggcataagcaaatgacagaatataaggtcggttctatgtatgcaatctgtgggcncaaaccctcagtcaaaataggaaatttctctgatttttcgtttttttacgggtataaaaacaaaccaagaaattattattttctgatttttgtaaagtttttgaggccatttaatagacaaaccattgtcaattccgactctaaaacttggacaaaaacattttcaaatggctcaaccaaatcgaaaatttccgtttttttcatcaaaattgaggaaaatttgttcctattttcttctttttacataatttggcttaatttagtcccaaaattcacatgaaaatcttgttgatttgatcaatttttccccatttttcagttggtcgtcgtcggtgacggcggtgttggcaaatcggtggatggaattttttggcattttttactggaaaacattgacccccacttttaggcgctgaccatccaattaatccagggccaattcattgaggagtacgacccgaccattgaagactcgtatcgaaaacaggtttattttttcgctccgcgaaattagctaactcgaaaaaagaattttgacaattccttagtaaatggtttttttttctttgaaaattcactgattttatggacccattctaagcctttttaggcaatggtaaagaattgtgggcccggatttatttttaaaaaaaatttattttttattttgctcgaaaccaattttaagaggttttcgagggtgctgattacgaatctcaactcgttttttggggggtaaatgcttctaattcatttaacaattatttttttgatgtaaaacaatgcttcaactgttaattggataaaaatgcgcaattttcgccaaaatttgaccggttataacttatattttggaaaaaaaattttcaactttttgttcgaattcgggtccggggttcggaattgggcaaatccgagttcagattcataatcagcaccctcgaaaacccccggaaactgaattttagtccaaaataaaaaagttaaaatagggggcactatatggaaagtgacagtttttgaaaagtttttcaaaaggggggaccctttttgtgatagtcataaaaatttattctctggggtttttggggtccccgatcacgaatccttcaattattttgatcaattccgatttcctaatctaaatttgaacaaaaaatcataattttaaaaattcaaaatttcaatttttatttgagttcgggttagggattagaaattagtcaaaatacatgtcagattcgtgattagcaacctttaaaaccccggataaaaaattatcatggttttttatcttaaaaaaattttgcaaaacaaaagggtccccccttttgtttcaaaaactgtcaatttgaacaaaaaattgtcgtaaacattcgaattttcgagtcctcttttttccaaagattgttatatgacttcaaccaaatagcgcccacccgtaaaactataattttatctaaagagtttgaattttcgacaattttttagtgacgtaaatccttactctttgtcgccgcaataaaaaaaatatttaaaaaattttgcattaaaatttcagaaatttctttaggtacttattgacggtgagacttgtttgctggacattttggacaccgcaggacaggtatactgaactcttccgtctaacttagcaaaaaaaaaaaaaaattttttttttggcgaccatcaaaataccgaggctttcttggttttttttttgagatgcattgacaatctgcaaaaagccacttccaatccccctgtcctccataggtggacaagggggggggtcaatttcgtaaatcgtacgattggttagccaaaatgcgtaaagacgcgaccaaaaaaaaaattttttttttcagttttggctttttttaaatttatttccatccttttgcaggaagagtattcagcgatgcgggatcagtacatgcgcacgggtgagggctttctgctggtcttcgcgct

SEQ ID NO: 22357 - DNA, 965 bp, Heterodera glycines
  misc_feature (942)..(942): n is a, c, g, or t
cctgaaaattaaaaaaaaggaaaattaaaaattttctcgctttggttttagcttcggcgtttgtgcctactaacgatacccgcgtcgagaacgcaccaaagcattgggtatcaaaggagccgaggagttctgtgatagttaaaggggtgatttctaccccgccctaccacacgctacaccctcctcattaatgtagcgattaacttacctctttaggctcctaaatttaaaaaaaaacttaagtttttcaataaaaacatattttcttattaatacatatatcattattttcaaattttgcttcgaattttaatataaaaataatatataaataacttaatccaagcgataaaacattaaaatgcttccaaccaaacgatattttgggttttcttttctgaattttcttttgaatattttattttaattttatcccagctccgagttcttgataaagcaacatacaactgaccgtgtgagaacacatctcttgttaaatcaattccaattttttcgaaggtttgtccttgtgcaccattaatcgtcatacaaaaagctaattttaaaggatattggtgacgcttaagtacataaggaagttttttatcttctattaatgttattcgtggaataaaatcaatttctcctgtcctatcacccgtcaaaatcattacccttaatacatttttttctatatcaagaatctgtaaacgcgttccgttgcataagcccatattcacatttaaattcctgattaattttgtaacacaattaattttaagtttaagttcatgatcaggaaggctatttgtttgaagtttatttagcacctcaggaagaataggtggtcctttactttcggcatcgtcaacacttttaaaaacatattctcttccttgaaatctttttaaaatttgttcattataaatgttaatttctctnattatatggtgctaaaatacagt

SEQ ID NO: 22358 - DNA, 1934 bp, Heterodera glycines
aatttattaaaattgctcctttctttatgcaaataagttaaaattaaggcaaacaattttattcaccggataccagtttgaaatgaagtacatttcgaaattttcgggattttagggtcgattcttaggggtgtattttttgaaaatttttacgtcaattcttaggggtgtatttttcatttttattgcattcttgttaataaatttcccaaaaatcgcgaaataagggcgaaaataggagcgaaatgccaaaatagggacaaaaacttattttaggggcgaacactcaaaatatggatttttaggggcgaacatccaaaatagggattcctagggtcgattaggggcgttaaaacgaaagttttttgaacaaaaaaatgtgtttttcgtgcatttctcatcgagttaaagccgcagaaaaaataagtaaaaacctaagaatccgcgccctactaataactcgaaaagtagctatagcgaaaaactataaatcgtagccctattaacaaccattgacttcataatggagcccggacaaggccgaatttgtaaaaaaatttagaacaaagagtatcacttcaaagactggtagtaaaattaaaaaaaattaattaaaagtagttagagactccattttcaccggattacggtagccccccataggtgtgggaggggtgcatggccaactgagcgccagccatttgagcgccgccaagtgagcgcgggccatttgagcgccagacttttcagtactgaagccaaaacctattgcgcgactttttttgcaaacccaaacctattgcgcgactttttcttgcaaacccaaacctattgcagggggtgcgcgactttttttggtgcgcgactttatgcaaattattttattaatttaaattaatttaaaattaaattttaaacatcttaaaagtcaaaacaacttaagacgttgaatttaaaatcatttaaaattcatcaaaaattccccgcaccgagcggatccgaaccccagggggggcggccagactgacgcactaaccactcggccacattggcaatggataataagcattaatttgctctcataaagggaaaatttgacgtcaccagcgggggcaggggggcgagagcgagcagcgagagaggggagggggggtcaaataaaaatattaattaaggaggggcgggggtgttggaaaggtgccaaataaacaaattaattaattggtcgcgtactttgtggtgccgccctccttcccgcatgcccattatgtaatttgaaaccttcagacaataaacaatttattaattggttttttgtccatttggtaattttcatttcatttaattcactttacggaaggaaaagccaatcaataatcccttatcatttttttatgccttaattttttccttctttggcatttgtttacccatttacccattactttttgccatttattatttatgtgccagattggcattattatggcaccgttttttgtgccattttgccgcaattttttggcattgttttgcccccttatttcccaatttagttcttgccaatttttggcattcttttgccacaatttttaaccctttcttttgccaatttttgcacatttttgtgccaaatttccctatttatttcttgccaatttttggcattctttgccacaatttttaaccctttcttttgccaatttttgcacatttttgtgccaaatttccctatttatttcttgccaaatttttgcacatttttgtgccaaatttacctatttatttcttgccaatttcttgcatttgttttcgccattttctcattttaaaaatatttaaattcttggcattcctgtttttttcaaattaaaatatgggcgttctggtttttttcaaattaaaaaatatttcaaccctttgcattttttttt

SEQ ID NO: 22359 - DNA, 2716 bp, Heterodera glycines
atgtgcttattagacgttgaactatgtttatcatcgttttttatcacttttagactataaatcagtgataaatcatttgttgatagcgattcgattaagctcgtcgatcagctaaggggggcgcgtgatgtaacatttttattggaaggaaccatttttttcagaaaccttcttcttctaaaatttttaaaaaaattattatttaatataaattgatattaattaattatatttaaaaataaatagaaaaatttcttattaataagatttccattgttaccttataaaaaagtctttcaacacatatttagtcattgtaagattctttagcttaatataatgaaaaatttatatttaacaaaatttcaaaaaattcttcagtcttttttattgctaacgcaattttatatccatagatccaatacatgaaatttgggattttaaaaattattttatttaaataatatatttaagagattgttgcactggatgaagaataaaacgatattaatcatctttttttcaatcacttttacgagaaactttgcagaattttattaaaatactatttctcaaaaattgattcaatatttatcaaaaataaataaatcagtataaatagaaaaaattcttactaatatttttttatgaatttaaaaatgttaattttatttatttaaaaaaaattaactcaattttgtcatttgatattttttagcttgaataaaagaatatttaatattagaaattaaaaatgagttcattttatatcaactgtatttttatttccatattttgccgaaatgagtattgaggttttgggatttattgcatttaaataatgtttaaattatttttgctaaaaattttacaaaatatgtaaaatttaaaacaattttataataacctgctaaaatataatttagattttaattttttcattcatttcgaatgaattttccattccatttttttgggtaattttttttcattatttttttcacatttatgttatgaataactcagaaaactttatgcttcggttatggtggtgaaaaaatacaatcactactgaattccagaaaattattataaaaataaaaaaggaaatgttaaatatataataattatttattaagttaataataataataacaacaaatatacgttcattaaccaaaaaatgcatccataatattttcaaaaacattgaaaatttcatttttggcaataatttgattttccaattatttgacgaaatcaatttctctcaaaataaccattcacaagcccccacaaattgcttcattaccaattttcccatcagttacgttgccatgtttacatcaaagtcataaaattgaattcgtttaaagtcttaagccataatttttttcaagttcataccaatttcattctccattaatcaaaacaacctatttattgcgggtaaaatggaatagtgtactgtattcttgctacaggtatcagtacaggttcctgtaatttggcagaatggggccaataagggagaaacatgtttttgtaagaatttagacgaaattttgccaaaattgcattttccaaattagaaaatcacttaaaatccattgataactttttttaaggaaaaaaataaaattcagggaaaattcatgctaattagtaacttccggtacttatcaaaaaaaaaaatccattgcacgctcatgatcaaatcacttcttcagggtggccaagagtcaacaaaatatcagcatctctagtggactattagaaaaaatggtttttgaaaacaaaaaatatgtaaaaattatgatatataaattagagcaattttatcaaaagttaaatattacaaactattatgtaagtggattcaacttcaattatagcttggttttctggtgaaaatcatattcgagatcagcgatcataaagagcctcggagaatttcatggccattaccaaataaggggcccccaatccggaccaagaaaaaacgtcgccggacgaatttttggaccataacttttttctttatcaaccaaatgaaattttcttagtattcttcaaaagcatatgaaaaactctatcaacatgcaaattttcaaagatttttttttcatgtaaggtcgaaaaggtttttgagttccttctggccataacttttttgaggcttaacgaaaatttttgaaattttgcaaattaaaaactaaacacttagcgctatcgaacaacactaagaatgcttaatttgattgacaatgagaaagttatggtccaaaaagtcttccggcgacgttttggggtgcaactcccaaatctgcagtttttgccggttcaaaagaagtgatttctttattacgcaagacgttaaattaaattagaatatttcacacgaaattttcacaattcattaaaataaaattatggaataatgcaaactgtaaaaaaatttgccaaaaaaaccaaacggaaattctcacatttactagaaattgctttcaaaattttctctcatcagttaccgacgcgtttaaaaatgaatttttacataaaatgataattttcttttgtttaaatctatcaattttcacaccaactctcatattagataactttggttttcgcagattgtacttttcaaaatttatttaattgctagtcaactagtctacctcattacttacttatatatatatatatatatata

SEQ ID NO: 22360 - DNA, 704 bp, Heterodera glycines
ccatcaaacgtacaacttacaaggtatcgggccgcatttgcataatttccattgccaatgacacggaaaaattcgtaatcggccaccagtttgagctcacatcgattgccttttatttctttaaggggagaatggcattcaaaaaacggcaaaataagtataattggcacggcagcacaccttttaacgacgcattcaatggacaccaccaaatggaaaacagcaaaaaaaggatgagcaacaacaatgatgaaggcatggcaaatggtggaaaaggcaattatcaacaatatgtaaaacttgaaaaaacagtgaatcagtgccgtgttaagacatttgcggtccggacatttgcggtccggacatttgcggcctgctggaaatcggacatttgcggcccgacaaatgcggtcggacttttgcggtccggacatttgcggcccgtttcttaagggccattttcggacatttgcggccggacatttgcggcccaagggaaaatcggacatttgcggccaacgaaacgccaaattgtcattcctttttcaaattaattataccaaatatttttatttaacacatttcaccaattattttgttcaatgacttataataattttcaactaatttttcgaaatatttttaactttttttcacaatttgattatttaatttaaaagagcttgctgaaggctccaaccagc

SEQ ID NO: 22361 - DNA, 1636 bp, Heterodera glycines
ctggtaagaatgggggtctgagtgaaaaattagtgaacaataattggagtcaaagggaaaaataaaaaataataattaatatattctttaaaagtaacactgcccaagtgtgcaaatggcctaatggttagtctccttgactttcccttcttctttccccttgttcaatccctctacaggaattaaattattttgaattttctttttgtatactcgtgggtttcctatagagaaaatatgattcctcatagttttttttaaattgatacatattttatcattttttaaatgaaaatcctaccaattgagcttaataatcccaaaaaccaacctttttttgttgaaaatctgtaacaaattacacccaaatttcaaaatttcccccgacggcgcctatcggcaccgccggacccattctttcccaaaatttttttgaaaaagcgcgccgaaaaaatgttatgtgaaaagcaaatattaatttataataaaattcaatcatttagtccaaaaaatgattaattgtttgaaataattaaagaaatttgtttgaaaatttcattaatttaaattagctttaactttaagattttatggaataaaaaacaaaataaaaatttaattttgtattattttcagttgcaaaaaaaaaattaaaatttgaattttttaaaaatttttgaatttatttgaatttttaaaaattcccggttggtcccggttcccggtcccggtcagaaaaaaatagaggtcccggtcccggcttctcaggtcccggcaagtcccggtttttgcaaaaattcccggtcccgtggcactctagtttttcctggtttttcctttaggaaatttttgccatttttgaggatcttttaaagaaattacagttaccgtatatgctctaattatagcccatgggggattatttttcaacctcctcagaaaaggggggataattagagactgggggattatgatagagggattatttttcaaaacacctcgtagactgggggataattggagactgcgggattaatagagactgggctataattagagcatatacggtatgcccaaaaatcataaatttcacaattttatcgtatatgtttttattattttaaatattttgagaatttttgagtttagagttttcttgttaaaaattcaaaaaattgtaaaaaagaacctcaataaactgattttttttcaaaaaaaaagtagtaaaaataaatttttttaaatccctaaaacgtgattctaacaataagcctatttgggttatttttatggcattttgcgccctatttaacaaaacaaaatttaatttacatattctaatagatatgttttgggcgtttttgtacatttatattgctttatttctcaaccctggttaaggtgcaatacgacctctcaatacaaggtttaaaagagaaaattgaagaaaagtttggcattccgcttgaaagacaaaaattggctcatttgtataaaccagacaatgtttccgatagaacagaatttagttttggtgactgtcaaacaatgtacttctataacattgtaaaaggcgataccatttttgtgtcggaaaatgtttgaaatttccgtaaaataccaattctccattcct

SEQ ID NO: 22362 - DNA, 1189 bp, Heterodera glycines
ccccccccccccctcccatcagacaatgtttttttttttgaaatttcttgagacacccacaaatactcgaatttagtcattaacataatcagattttgttggctcggagtagcagcagtagcagcgtaagcaccgaaggagccgacaaattgcacaaaattggtccgccaacggcgcatgaaatggccaatacgctgaagagaaagcgaagaaaggccgaagaacactctccaaaggagaacatccgctcttccgtccctttgaaacattccgtctcttttgccgtcgattcctctggcggaagtcagctgttcattgaggacaccgacttcggattggtcactttggaagacgcgcaaaaggcgccgtttcagtcgaaggcattcgaatggaacggcgaaggaatggacaaacgacagcaaagaaaagtggcacgaggggagggagggcaaatgacgaagattaaagccgattaagagtattgttaaatgagtgctttttcagtgttcagtcctttccaatggctttgtctcttttccttcggctcaccagcaacacttcccatccgaattgaatgctcataactctgatcacttccacagccaccagttggacaacgaggcctttcaatatggtaattttaattaataaattgaatgtgcgttttagacaatcaaattcaaatcattaggctattgaaaattaaatttggtcttcccctaattttttttgagtaaatatttatttaatgcttagtctttttgtctagaatggtctattaattaattgcccatttaaattccctcccccctctcgtcaaatgtaataatacacatgcccccaccgctcattcagtacctttcttttcgctgcttttgttgttccatttgtcatcatcattctcccccccccctcggcgtatgatcgttattgcgagaaaatagggatcaggatcaggattacggactagatacacatacggatttacggacaataatctggaaaatccgtactccgtaaaaatgcgtatccaggaaaaatactgatccgtatacggatacggattttttaatcattgttgcatattcgatcacacaactagcaacatattggcaacaaatggaagtgagggtacatatttcagcatatgtaattaattaccggaagtgctttgactaaaaaaattaac

SEQ ID NO: 22363 - DNA, 1114 bp, Heterodera glycines
gcggtatgggctttttgctttgcaaaatgttttgttagataatttatttgtcaaactaggaagtcggatttgataaaatgggatatcaaattcgtgctcagagctccaaaaacaccggagaacaagttttgcacgaaatattataatcacaaacaaatgttgtaaaccaaaaaggtcaacaaccccctttgggtgatttttaataaaattcaaaagaaataaaactgatgaaaatagcgctctttcgatactctttttttcaaaatatatccattcaattccttgcagatacattggtcaacgtcccggtcaagatgggcatgccttggtgcaagagtttgtccaacagtctgctattcctgtccaattccgttcattggttgctgaacagcttaatcatattgtgacagctgcgcgcgcgaatgtgtaaatttggagagagagagagtgcctcgctgatctttttttgcgttattttattcattgattatcatttgaattaaataaaaaaaaattttttctctgtaaatgataaaaaataaaatatataaatatggaatgtttttttgtttgtttgtttaaattggttagttttttggtgctgggtcatcatcattcaaaaaccatcaaaaaggggacgctactcaaaaaatcgtaaaaaaggaagattcgattgcgcttaagtattttctagtgttctttctctcttggagcctgcaaaattcagaaattcatgtaacttttggccagaaaaactaaaaaaaaacgtgggcttttttgaacatttgtagctgttttgatgagtaaaacgcccattttgatagtttttgaataacgtctgtctcatttcgctgcatttgctgtactccttcatctccatttcatgtgtgttttgttgctttctgctgcgcttgctcatgcttccttctctccctcctccgtctcccccaagggcgagtgtccgggccatccgacaaaacgtaccttcaaaatttacgaattttgtgtaatttatatatattacaccaattttgccaccctaaaaggaagtgcaagattggggccaccactacaccccaaaatttcaaaggcgaaatttcgccgggacataatt

SEQ ID NO: 22364 - DNA, 1066 bp, Heterodera glycines
caaaaaaaaataaaaatttatgacatttttaaatttttaaaaaaaatctttcgggagttagcagctgtgccataaattaaaccgccaaatatttttgccctttttaggttctattatttattttactttctcggtcgaaaacgagaataaacgacaaatttaatttattttaagggtcaggattgggatcccaaaaaacaggattgtcccggggcaggattcaaattccgccaaaattgggattttaatctcggcaatccaacccaggctgcaagattccaatcccgaatccggacccgccatttttgtattatttttaaagttaaatatccttttttctattgaagtgatttttaaaattttttttacaatttaattaaaaaaatgcatcccttaaatgtgatttaaaacattgattgattttatggttgtcaaaaacgagcaaacagaaaattttcccacgttacatttttttattttttaaaaccctttccacttcatccaaaaaaaaattcttttttcgaatttctatgatacattaggatgaataagttcgacccaatatttcccaaaaaacccccttaattttttctggttggtccttaaccaaaggtaaaaaggaaaaaaaataattaaaaatttggggtttttgggaacagttgggaggggaaattttttaatcgggaaaaaaattttttttaaaattttaaaaaaaaaaaatttaaaaatgggccccaactcaaaaaaaaaaaatttggcaaattttcccctttaaaaagggggggggtttaaaaaaaaaaaaaaaaaaaaaatttttttttaaaaaaaaaaaaaaaaatttttatatttttttgtttttttttttgggctaaaaaaaaaaaaaaaaaaaaaaatttttttaaaaaaaaaaaaacgggggcccaaatttttttttttcgttttttttttttttttggccccaccagggagggggggggggaaaaaaaaatatttcccaaaaatttttttaaaatttttttttgaaaaaaaggggaaaaaaaaaataaaaaaaaaaaaaaaaaaaaaa

SEQ ID NO: 22365 - DNA, 1234 bp, Heterodera glycines
  misc_feature (96)..(96): n is a, c, g, or t
  misc_feature (131)..(131): n is a, c, g, or t
  misc_feature (148)..(148): n is a, c, g, or t
ggcgcatcggttcggggggactgccccgaaaacaaaaaaatcgatttttcaagtgtcctttggggtactcaaacaattatgggagcaaaatccacngcagaataaagtacaggctatagggaagctattcnggaaggattcggtctcnccataaatctgggcgcatcggtcggggggactgccccgaaaaccaaaaaatcgatttttcaagtgtccgttggggtactcaaacaattatggggagcaaaatccaacgcagaataaagtacaggctataggaagctattcggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaataaatcgattttttcaagtgtccgtttggggtactcaaacaattatggggagcaaaaatccaacgcagaattaaagtacaggctatagtgaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaaattttttagagctgagctagctcggcgctcatttcagtgtaagttagtccttt

SEQ ID NO: 22366 - DNA, 1421 bp, Heterodera glycines
  misc_feature (1292)..(1292): n is a, c, g, or t
  misc_feature (1373)..(1373): n is a, c, g, or t
actccgtctggccactccgtctcagcaatgttcaaaaagctataacttttttctttgttggccaaacttcacaatcatggtatcatttgaaagccctagatgtttagaagatatttataagctatttctcagtgattagtcagctctcaaaaaagttgtcagttgaaaaccgcaaaaaaggcagaattttcaaagttttttatttctatctttttttatagttcgaaattttctgtaatttttagtaggctaatagagcctgtgaagagctttcgaatgatatcaagattgtttgattcggtcaataacttcaagagttatattgactcaaagttgtctcagacggagttggccagacggagttggcccgttccgtcctgcgatgccgataggcttcgcctgggtaaattttgtaatttttaatgcgatttgttaacagttgaggaatttaggacccggcggcacctataggcaccgattccccaaaaaattcgaaaagaattcgttataccttgtctaaaattgttgaatttgaataaatattacattggctttaaaaatgtttgttctgcagagtctgattaccggtaccatctcgaaggcatcggctaaacaaagagctgaaagagcggggcgcacgcaggacggagtgtgctatcggttgtacagcgaacttgcatttgccaatcaaatgcttgagcacacaccgcccgaggtaaaaggaaaaggccaatacggtggtgaattgttggaagaagttctgctcaattgtctagaattgaagatcgagtaaagaaagatccgggcttttggacttcgcgagtcttgattctcatatttcataatttttctctaaatgttttgggcaaatgagatcaaaaattaaaattacattatcaaattggccagagctttactttcatgaacatttaaaaaatgcggtcgataatacagttcagtttagtgaggcatacatttgagaaatttccgtatatttatatatatatatatatatatatatatataaatttatgtctgaatcgggttaacgactaattttcacccaaaaattttattttggaattcactttacaaagtagttaaaattgaatccagaataactgggttgtatgccgacttatatttaataagctgaaatgctttttagattctttggtccgatctgacttcaatggtccttaaaatgaagtccattcccagtatttctgagcaccttggcgacctccgcttccgcgatcagccaccgaaagcggctattgtaagcgcattanaaaatctttattttctgggagcaatcgatggtaaatattttttttttttttgggcgaaatttatttttaattttttataanataaaaatttttcagtccggtcatttcccacaaaaaattttcaaaagg

SEQ ID NO: 22367 - DNA, 1176 bp, Heterodera glycines
tggcccatccctatggcattttttccaaataaagatggtgtccgaattggcccagtgcagtgatcagttgcgctcaaacggcgcttccactgcaatgtcagtggaggagtcggtgatggctgtcggcaacgaacttctcgtggccgcaaattccgtggaggccgtttcttacaaattggcacaaatgcgtccaagggaaattcatgcaagtttttggcttggaatttatttcaattttaattgataaattgctactggactgataattaacgacgcttttgcggcggaggagggcccggctctgatatgtcttgtattcttgggtcggtgcttccacgaggaacccatcgtgcagggcatatcagagtcggcacccttcgcatgttccgttgcccccgtcaaatgccgtgccattcctgcgcttctattccttcgacacttcaacattttaaatgaaattttttttgcaataatattgaaataaatacaataattttgctttttcaattttatcatttttcttttcagaaacctgatgagaacctaacgtacgatgagcaaattctttcgtccgctaagtcaatcactcaggccgtccaaacactcgtcaaagtaatctttggtttgtctaaatttgtttttcattcccatcggaaaaggccgcttcgtctgcgcagcaggaattggtggcccaggggcgagtggccgacccgggcccagcaaatggcagcgaagagcagcaatggactgcaggtggagaagccaaaactccgcagcataagctaacaaataagctaatcactcttttgccttaggtttggtctccgccgctaaactcgtcgccgctgcgactaaccaactttgtgaagctgccaacggattggttcagggccattcgacggaggaaaagctaatcgcagcggcgaaacaggtgaagaagacaaaggaggaaaatcaggggatttatcacggcaattattggacaaattatcgccataaatccggtacttttaatgcattgccttgttggcccatttgaggttgcttcttccaccgcccatctgttggtagcgtgcaaagtcaaatgcgacttgaacagccgagcaatgcaacgactccaaagtgccggtcagaaaataattaacaaaacgcaaaaatgggaagttatttttggat

SEQ ID NO: 22368 - DNA, 818 bp, Heterodera glycines
  misc_feature (13)..(13): n is a, c, g, or t
  misc_feature (72)..(72): n is a, c, g, or t
  misc_feature (74)..(74): n is a, c, g, or t
  misc_feature (124)..(124): n is a, c, g, or t
  misc_feature (540)..(540): n is a, c, g, or t
  misc_feature (553)..(553): n is a, c, g, or t
  misc_feature (564)..(564): n is a, c, g, or t
  misc_feature (566)..(566): n is a, c, g, or t
  misc_feature (594)..(594): n is a, c, g, or t
  misc_feature (599)..(599): n is a, c, g, or t
  misc_feature (601)..(601): n is a, c, g, or t
  misc_feature (610)..(610): n is a, c, g, or t
  misc_feature (616)..(616): n is a, c, g, or t
  misc_feature (626)..(626): n is a, c, g, or t
  misc_feature (633)..(633): n is a, c, g, or t
  misc_feature (641)..(641): n is a, c, g, or t
  misc_feature (660)..(660): n is a, c, g, or t
aaacaaaaaaatngattttttggagtgtccgttttggggtactcaaagaattatgaggagcaaaaatccaangnagaattaaagtagagggtatagggaaggtatttttgaaggattaggtatngatataaatttgggtggattggtttggggggagtggtatgaaaaaaaaaaaatagatttttttaagtgtaagtttggggtagttaaaaaattatggggaggaaaaattgaaagtagaattaaagtaaagggtatagggaaggtattttggaaggattgggtatttttataaatgtggggggattggttgggggggagtggtgagaaaaaaaaaaaatagatttttttaagtgtatgtttggggtagtgaaaaaattatggggagtaaaaatgtaagggagaattaaagtataggttatagggaagatatttaggaaggatttggtttttttataaatgtgggtgaattggttaggggggagtgaatagaaaaaaaaaaaatagatttttttaagtgtatgtttggggtagtaaaanaattatggggagnaaaaatagaangnagaattaaagtagagggtatagggaagntattntngaaggattnggtgtnttcataaatntgggtgnattggttnggggggaatgtgtagaaanaaaaaataaatagatttttttaagtgtgtgtttggggtactcaaacaattatggggagcaaaaatccaacgcagaattaaagtacaggctatagtgaagctattccggaaggattcggtctccccataaatctgggcgcatcggctcggggggactgc

SEQ ID NO: 22369 - DNA, 963 bp, Heterodera glycines
atgttcctttccatctgatcagtttccccccttctcttgtgcctctcccccgtctttcgtgtctctccccccttataatctgcgtcctccccctctctcctcccattcgctcccttcgcctgtcttttcctattcctcttctatctcttctgttcccttttaccaaataaccccaaattattaaagcaaaaattcccaattttaatgacatattttgttttttgacctaaatttgatcataaattattaagcaaataaaagtgatcaatttccgctttcatattcattgtgttttgcattttccctgcctttttggtttcctgctgtttccccccccccattttcagtggcttccctcatcaaaatgccattctctgcccggattcccatcaatgccaaaatgtgcaccaaaatattttagatggaaagcaaattgatgaagcaaatacagagagaggcggggggggggggtaaagggaggggggagggaaggaaaggggtgccctcagcgaatgtccaaattaataattaaagcgaggacattgcacgaatagagcaagcagatcattttccattttccaaagcccaccacacaaatgtacccatttggctgaggatctagctcatttagcaacatgaatatttcattattgatttttgacctacaaaaattaaaaaatacaatttttgaattgaatgcttttttgtcaaccaaattggacaatcttgctttcattcaaaagttcttgataaaaaaaagatttttctaaacaaatgctaagcaattgatgaactacaaaaaaaaataagcgttcgattataaaatctgtctgagaaaaaaagctatgatgatctaaaaaaattcaaattttctctattaacagagacaaacaaataatacgcccaaaccagaaatgctttttttctctacactctcttttcaaatctactagccttactttt

SEQ ID NO: 22370 - DNA, 608 bp, Heterodera glycines
gtgaattatgattaagaggggggggggggggggcacatgaggatgacaatttaataggaaatggcaaataaatacaataatttggaagagagggagggcaacgaagtttagggacaacaaaaggggacggggatggtaggggaagggcgtggtgaaaaggagggggggggggagaagcagttcggcttcttctcctctttcgtcgcctcctcctttgtcacattttctttcgctgcgcttttctctgctgattgatgtggctaatgattgattgtgccgttcgactcaaatcgttgccgatgttgcccattgtcgttatttgcatattcaaagtccgcccggggatgaaatgaaatggcattgagcgaaggcagggaattaaaaaactgtttaaagggttgtcttaggattgtcatatttgaccaggattttcttgctttctttaaactaaaaaatcggcaatttccgtcctcccaccccacccaaacgttccattcgctttacacaatccttggcacaaattaccccccccccccaatatattctcaattgaccagctcatcttcctaatgtccacctcaatattggccctcacaattattctcgcg

SEQ ID NO: 22371 - DNA, 1306 bp, Heterodera glycines
  misc_feature (12)..(12): n is a, c, g, or t
taattagtttgncgtgagaagtgaatgaatggaatggtccggtcgtgacttctcatggtgcttcgagccttccttttgttgtcagtgcacattaagggcacaccgaacgagcaaaacaagcaattaacggagcacgctcacgagaagcacacgcccggaccatcccccgaggggcaaacattcgcaatttgtgcagcattcagaaaattttttaaatattggtgcgcaaaaatttacgcaaaaatttttgctattttgtctactgaaattggtagtgtttacatgtattaaagccttgaagcttctttcatcatggtattggaacaattaaaatttaaaaatttgactaaatattcacccggtgaccatttgaacaccaaaaaagcactataacggcatgaaaaagcggcaaagtcgggaaaagaatccaattttgttaagaagattgcaaagagttctttctttttaaaataattataataattagctattcaaacattatcatcatcatcgtctcagactgacagtgaaaaacgaagagaaaaaacccctgaggggttggcattggcaccggtgggtggacaaatgatgtgccaaggatgacatattaaatattgcgccccgggggctgtgcctgcggtgaaaagcccaccaaaagcgacggtcggttgcccttgggtggcgcgtcgtatctcttcggcacggttgttatggttcccccccccccccacccgacccgacattcaacaacggtaccaataagtacattgtgccaacaacggacagaccgaccaacggatggacggacaaaatcttatgctttctttttgctttgccgtcgtttggtataatttttaatgaaatttctttaatattgccgcggtcggcggcgcctttgtcctagcaaaaggcgcccgcgggggggtgagagagttaattaaaaggtggaaaattaaattaaaaaaagagcggacaacatttaaaatgagcttaatgctcacttaaaatgtgaaaattcagaggtttgcacttttggattcagtcatttgaaacccaaaaaggtgaaatttttgattattttatcatttccggacacatttggcatcgttttgctagtgatgcttcccagtgcgtcttgaatgttgggagaatcactcaaattgcaattcgtcgtaatggcactttggctaaatgaagaaggaaactgtagctttagctgtgagaagcctctactgctgctgctttcgcctccacatattaataacagcgcattacaagcacaaggcacacaaaatcctttaagtga

SEQ ID NO: 22372 - DNA, 2111 bp, Heterodera glycines
atctgagtctttcgtttttatttattttttgcaaatctcactttgaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcgaaggcccaccacgaggccgcgaagaggccgagtgagtaccttcggtgcaggaaaattattaaattttaaaattttttaattgctttttaaatatgccaaaaaatgtaggcttaactttttttatgaaaaattcgatcactcatattttttgctaattgagcagaagcgtaccaaactatgcagggatactccccggtaaaggactaacttacactgaaatgagcgccgagctagctggctcaaaaaaaattttcgaaaatctgagtctttcgtttttatttattttttgcaaaattaattcataaatattttttcagaaagggttctgaaacgcaccaaattttatttacaagttaataaggctctctgatgctttttctatcaataatggaggtgaataaaattttaaaaattttttaattgctttttaaatatgccaaaaaatttaggcttaactttttagtgaaagtttgatcactcatattttttgctaattgagcagaagcataccaaactttgcagggatactccccggtaaaggactaacttacactgaaatgagcgccgagctagcttgctctaaaaaatttttcgaaaatctgagtctttcgtttttatttattttttgcaaaattaattcttaaatattttttcagaaagggttctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgaaaaaagatatggggagaccgaatccttccggaatagcttcact

SEQ ID NO: 22373 - DNA, 2357 bp, Heterodera glycines
acacgaaattggcattgacatctccaattttgccgcctaaagtgcactttgtgccgcattttgccgttacttttgggccaaatttcaccattttgccacacaaccaaaaaattaaagaataaatttttgtcactttcatgcccacaaaaaaaagttatcgtaatgacaccatcactcaacataattacccaactgatcaatcatcccattttgatcactacactgtttcctctgctgataattgtggcgatcagtggtgtgtcggtgcttgaagatgcacagaattgtgatgggaattgcattcaggaaatggagagggtaaaaaagatttaattggttgaaaaatgcttttcagtagttaaagtttaatggaaattattttatttttaatttatttgattctttatttattgccgaattacgggagcggaaaaaaggaacgctcaatttttaattttctcgttttccgtcaagcaaatttttttaaagggctataaaaagataattacagtatattctcaaattaattaaatttatttattattttggccgctctcagtaaaatacgtcatttcaattaagctaattgaggcaacgccctcctcaacggggctaagtgtgaacccatttgtgtacagtgcaggccaaaacttcatgcacaaattcttttcacgagtgtgcgagtcagtttcatgaattttatcatttacacaactgaatatttaaaaaaaaatacattatttggaatgataaaacagaaattttaaaagtgatcacgataaatatcttcttagaattttattttaattggaaaatatttaccgctaatagatttaccccatttaaattagtttaagctttgccggtatcaattcaaagctctactgtagaattgctgcacaaatcaaatgattcgtgcagctgcaaaagtttcttcatgaggtgcataaaagccataaagatgagtttttgagtacttttggcagtaattttttttgaattttgcttgctaaaattgttttcaagtgctttggatgagataaactttataaaaattgggctttttgtttaaaatcagtgcttatcgcggggtggacgagtgcatggtccgctgcgagtcgcgcagcaaacaggtgtccgagttgaaggcggcctactcgggactgcaatttgtgtgcaaagagcagcgcgagggtaatgaaaatgaacaaggattggatgattttattgggggaaaatcagaaaaataattaatgaatagacgcttaattaaataattgatggagatttttgcgaattaagtgcattattttcacttcagtgaaggaaatgcaagaaaaatttcattttaggtatttttgagactgaaaaatggcaattcgtaaaaacgaaagttgtggaaaaattgaaaataatttataatttagtgcttttaaaggcaaaatatagaaaaaaaatcggaaaattctaaagttacgggtataaagtatttttattgtgacaggtatcgaccggcttttaatcataaaacgtgacaattaaattattcttccattctgaaaattttgaactcataaatttttgtgctcaaaagtatatgctcaaaatattaatttttttttttctaagagctaagcttgaaatgagtttttcatgattcttagcttgttcaaagttcgcaaaaatttaagcatttgcttcaaaatccaattcctagtgctaggaacagatttagaaataatcagaacgatattcaattcttaaacttaattgccttaaggtcttattaatgtccaagccccccccccaaaaaaaaccgaatatatacaaaagtatgaataataatgtttacacttttagcgcttaatttccccattcccgaaaacactgacaccctaaaaatttatttgtaactgattcatcagatacggcattaattgacagttgtaaacataaaattaaactaatttaaaaatcatttagaattcttcagctctttgccctgcttgtcagagtaagtttttggaagagaattttaaaaatgcccatttttgaaaggaatgagtcgaagggcgctcaaagatgttctcttcaaattaaccaatcgcagtaagcatttttaggtgcttaatgaataatcaaataaaaatttttatagctagattatcctaaaaatatcggtaaaatcgcaattaaataatttattaattccaaaaataattatgtataaggtgtgaacagcgacaaataataatgtccacaaataccttatatgtaacaagaaaaaagagggctaaaaaagcgaaaaactaatggaattccgagactaaaatgcattcttctcctccgttccctaa

SEQ ID NO: 22374 - DNA, 2687 bp, Heterodera glycines
ttacacctgaatggcttggatcagccaaacggagtactgttgatcgtacagtgcccagaacattggcagcggagcgaacatgacgagaatacggatgagtgagcgaatgtcgtccaaaaagcgttccttcaaaaataataaatttgaaaacaaagtaaattttaattaattttctgaccctctcacaaagcgtttggtccattttacgctttttcaacatcatgcatttctcatttttggcacaaatgtgtgtgtccaaataatagtccaaccaattcgaacgctcttttctcgaccgttttttgtttttcagagcgacctaaaggaaaatttaaacctttaaaatgaacttttgaatttttaataatgttcaaatccttttaaaaaataaagattttcttttcaaaataaatacacgtaaaatgctatataaatccaaaaaacttataaattttgagattaattatttctttttgaggattttgaaagttttttcatgctcctttagatttttaattcaaaattatataaaattatttttgcatttctttcgacattaggaaataaaattaagtaaataaaatatatttttaatttattttaattaatatttaatttaattgtcaaagaatgctaccacaacagtgtcataaacatcagcaaacacattgccttttggtggatttttattgtacctaaaaaagataaatattttaaaatttattaaaaattaatgccatttaccgtccactcccagcgaagaaaattactgaaaaaatgtaaataaattgaatttttagaatttttgttacccgttgcgactaacatgaaaacagcggaaacggcaaatgacagaggataacctggagaaatcaaaatcaaaattaacaataaaattaatttattaaataagtcttgctcacatgaatcttggccaaggcaaggctttgagcgtaaaatcggcaacaaaaaagtggaaatgagtgcactgaaaaacaaacaattttttttaatgattatttgttttatgagcatttttgtagtttttaaatgcttaccattgacaagaattaatgtatttgattgcttctaatgaaaatatttatgcaaaatttatttttattttgcattttttaattcatttattatttgttcaataaaaaacaaaaagaaaaatactatcaatcgaaaataatatatttaaaaaaaaattattcaattagtcgcacattttgggcatttttcaattattacgacttgattaattaggcgaaggaattgcgggtagcgctgccaaatataatttagtttaaacttttttataaatagatttttaaagaaatggcgaggtcacacagagcacagagaaatattgttttaaaaatactattttatttttaaagatatatttttttctttttttttctcaccccgcattaatggcagcgtaaaaaatggagaaaaacacggagatcatccgctcctggtgcggctcgaactgatcgccgccaaacgaagcgacgcacggcacgatgaaaccgttgccgaccaaaatgatcagaatgccaatataatccaactgggaaagtgcaaaggaaaaaacaaattataacaaattaaaatttaaaaacagggcttggaattcagtaattagcgaatagaaagaatccgaagagcacatttttctcatccgctcagaaattttttttgtccaaaattataatttttgaaattttttgcctaacaaaaaatgtaaaaagttttcaagaatttaatcctctcttttaaaaatctttttcaacctatccaaaaaccagaaaaaaaggataaacttaagaattctgagccgtgcttaaataaccctgagcccgacaattcccaactgatgcctaattgtaaatataaacaatattttgcggcatacccacggatggaaaaaggccgattcaccgccaggctcaaatgcgacagctaattaagcaaaaatgattaagcaaattgaaatgttttttaatcgtaccgctgagaatgattttgccaactccgtaaataatggtgccataaagaattgtcctgaaaatggaaaataatttaaaaattgcacaaagtatacgatatttactcttcacttttttgatccttctctctaatgaaggcattaatttaaacaattaattaaaaattgtaaaaattttctccctgcggcctaacggcagtgccgcgtcgcctaatgttccccgaatttattttgaaattagcgaggaaaaaatttgttctccattaaattgtaaatttgatttgtctaattcagatgattagaaacatatgtatgaataaaaaattttgagaacaagcctgaatttgccaatgtaaccatccgccaccgccgagccgagcaaagcgaaaaaggcgccaatgattttcttcacattgatcagcaccgttgtctgaccgctgctcaacttcagcacgttcaaaaaataaaggcccatcacagctgaaaatgcggggaaaggggggatttaattttcgtgataaataaattaaatgtcaaattaaattgagaacgtgataacagattatccgatgcctcttggagtccaccacaaataagtccttcccggcaaataataaaaaatacactctaattattcttcatttattaataatgctcttagcgagccttt

SEQ ID NO: 22375 - DNA, 2558 bp, Heterodera glycines
  misc_feature (2521)..(2521): n is a, c, g, or t
  misc_feature (2540)..(2540): n is a, c, g, or t
tttttaaaaatttaggcaaaaatgaaaataacaacataaaatattttcaaaaacgtgtggattttattgaaattaacttattaaaataataataaatgattgtcaaaaaaattttttaaacttcgtccacatgagcgctggtggtttcagcataggatggaatgcggaggcacgaaaattttttaatttatatttttggtcgtatcttaggaaatgacatcatttcagaagctgttcgtgaattttaatgccatgcttcaataatcgcttaatcgaaaattcgtcgcaaaaacgcagttccgtttatttaatttaagaaaaatttatgattctctccttaaaatctatttctcgctttttgtatataactttttccattatatgcaaaatgtatataccatactttttaaactaattttaaaaactgtttatcttgcttaggacagggttcgtatccgtccttggtgccagggacgtccttgaaattgggcaaaataaaaaatgtccttggatgccaaggacttctttggaaatgtgcatttggaaaagttttaaaaaaattcaaagaaatttgaaaaattttgtaattttcaacaatattttgattaaattatggcattatctaaataaaatgcaaattttttctcatgattgagaatttttgaaattttatggcataaagtcactatttttcttaaaaaattagccaaaatcgcaaattttggtcatttttggacaaaaatctgtaaacaaatcgcattaaaaattacaaatttttcccggcagcgcctatcggcgccgccggacctcccccccccctctgtcccacaacatttttggaagaagcgcgccgcaaaaaaagcgtttgttttttttcttaataattttctgtcctttctgtttttctgtccaattattcatcatgttttttcctcttttcctaaaaagtgctccacctacgcctcctcccacttattgttccccaaaagtgctcctcccacgtttctttttctgctataagaagggaccaaaatccctcaatcatcactcacctttgtgcctttcattttcaataaatatttaaattggatattcgtctcgcccttcttcaccatgcccatattcggtgccgttccctctgctccttttgtccattcttagtccaaattcccgtggtcaccctttgcccgcccctttgtcctaacagcttaagcgacaagtggtgccgctagcaaatcaaaatcagatgtcttccgctaagctgcgcatgaccatcagccccgcggtgaccaggcttcgtcagcatgcgaccactgccgaaaatgccctggacgaagatgaaatggaccaggaagcgttggacacgctcagacaggagcaccaacacatcactcggattctcactcgcttggaatacgatctcaacgaatggaacgaggtcatacatcgactccaggggcctgcgcgagatgcagaagaagccatcttcacagccttcatcagagatgaccggcatttcacggaatggatggaagatgcccgagaagtgctggcgcatattgaagacgagctcaatggtccgcccgtcgccgcacaagcacatttggccgggggaggacaactgccaggagccagttgcaatgcacatattccgttgcctgcggccaaccagcaatttcagccagtcatagccgctaatgcacaaggagtcgtaaatgtcccaccacctccagccctgaatcagtttggcgcttggcgcgctgccagcctttgcagctaggcttcctcaactaagtcttccgaactttgatggagaccctcttgagtggcccgcattttggcagagtttcgagagtgctgttgaccgcctaccactcgaaccggttgacaagttcaattacttgcatgtatgcctacgaggaaaagcagctcgtgccgtaacctcctatcgtggcggagagaattatgcccatgccgttgctgctctcaaacgacttttcggtgatccatggaaaattgccgaagcgctccaatcagagttgatgaatctacggccagtggatgacgatgtccgatcactccaggattttctggagacatttgaacgagtgtgccggcaactctcaaatttggaaatgcctgacgatagcccattaatgtaccaagtcgtccgtagtaaattgcccgcaactgtgctctcagaattggtcaagatggagcgaagtgccggtgtcaaattgcacaccccacaactcagaactgggcttgccaaagtcataagcatacgtgaagaggttgagcggtgcctgcgcgaggccaagcctgaaggactgctacaactgaggcatgaacaccggccgaaccgacctcaacgacacgaacggagcgaacatgcgcgagttttttcggctgcgcaatcaggcaaaaaccaagtggacagacgcgtgccatcgtgccttttctgttctggtgaacattggattgcggactggtcataaagtaacagagcctgaggaacganagaggaacctaatgcacanaaccgatgtctgaattgc

SEQ ID NO: 22376 - DNA, 1435 bp, Heterodera glycines
ttattaccagggattctttttttatgtaaatacatgtttttttctggattcttcatagcctaattagtttgaaaaacactttcttttttgtgtttgttaacaaaagttggaactttttttacatatttttacatatttcgggatttttctacatattacatatgtacatattttggactttttcgcattttttcgaatatattttgaaatttttgaggattttttaaggaaattttcattaaatgttcccaaaaaaaacccaaaatttcacaattttttgtacatatttttaggatttttgagaagtgatagaaatttcatatgaaaaatttaattttttttttgaaaatatacccttaaaaatcgttttttcaaaaaagagataataaaaagggtgctgcttctaagcctattaggttatttttagggcattttgtacttatttcacccctttacgaagattttttttccaaaaaacaccatttaaaaaattttatttacatattttaagtacatatttggttctttttgtacatatttcatacatatttaagcattttttatacatattttatttacatattttgcgatttttcttacataaaaaaagaatccctgtttattacatataaaagccggattttttgaattaaatgcacaaatcagttccttaatgagtctctaatttttcctttctaattagtcgggaatactcctacattttatgagagaattttattttcaattacagagaataatgaacacattaatgaaaatggcaattcattcaattaagtcaatttcggatgcattttgtaattttccaaaacatttctgaatttctccagtttttaccaggctaacctaaacctgtagaatgaaatttgggtatccagtttagcgaatattttcgaattaatcgaaaggaatcgcagaaaggatttatgataaatattcaaaaaataaaatttcagaaatagtgaaagactgaataaattcactgaaaatttgagaatttattaccaaggcttcaaatttttatgtaagaaaaatcgcgaaatatgtaaataaaatatgtataaaaatgctaaattatgtatgaaatatgtacaaaaagcccaaaatatgtactaaaatatgtaaataaaaattttttaaaggttattttttggaaaaaaattcttcgtaaaaattggaacagaggcataaaatgccataaaaatgaccaaaataggtttagaatcacattttagtatttcaaaattaatttttgatatacatatcattttttgaaaaaaaaattcgatttttagggatacattttcaaaaaatttttttttaactttttacaaaaaattctataaattctcaaaaatcctcaaatatattaaaaaaatgaaatatagacgaaaaattgcgaaatatatatgaaaaa

SEQ ID NO: 22377 - DNA, 2223 bp, Heterodera glycines
gaaatggttttataaaaaaatataatttaaaatcgaatgtgttaataatttttttaaaaattataaaataaattccttcttttatttaaaaataaataagaaattaattttacattaaaacatttaattaaacaaacaatattaaattaattaaaataaataaataattaattttaaaacaaaacatttatttataaaaaaaatttaattcaaataaaaaaatataatttattattaataaaataaaaaatattttaaataaataaaacaatgaaaaaaatggtagttattaattaaaaacaacgttggaaattatttattgaatattcacttaatttgaaatgatattattttttacagataaaaaataataatgaaattatttattaaaaaaaaatttaaaatttacaaccaatcttcaaattaattaaaagcattgaaaaaaaactcaaaaataaatagaaaaataatgtacaccgtccggatccgaacctgccccctcccccctcagaatgatatctcagaatccccaatcacacagggattctgaggtcttgactatgtcaaaagtaaaatctgatcacgtattcgtgatcagcggcccaaataacccctaaagacatgtttttggaagatttttgttgaaaaaaatttttcactcaaaaatcctggtcacccccctttggtcccgactgccaaaatcacttttatttttgtatctttattttaaaagatgataaaaaggtcaaataaaatttatataatagagcaaaaaattgcggattttttaagtatttaaaatttcaaaaacacctttacagaaccgagttctgaatttttttctgaaaaatcgaaaatttccagaatttctggaataactttttttgtttttgcggtataaatttcaaataaatctcataaaattctcccgattttttgctattttttatgctttaaatgagctgaattggaccattttgaggcgagttatgaatttttatactttaggttgaattttcaagggccaaaaattattgatttttcaaaatttttttacctccctccaaaaaatccaaaacgcaatataaagtgcatattcgtgttcagcacctcaaattagcccagaaaagtattttttggcaattttaggagcaaaattatttttcataaaatgcaaaaccatggggtcccccctttggttttgcatttaaaaattcatttttgttttatatctttttttatattaaagataaaaataccggataaagcacattagatagagcttaaaattctctacaaaaatgctctaagacaatttttcgctaaaatcaacccctgacgagttataggcccgggactgaaatgtcccggtcaggccaaaaaatttttctatttccggaaaattttgaaattttttcaaaaatgccaccaatcgatagagctcgaaaaacggttgcttgaaagtggtctccgttttcctgggaaaaatcggcaaaaaataataaaattcaaaaacaaaaaattttcgagggggcctagctcgaaaaattctgaaaattttcaaaatctgaaaacgccatcggatgcagctttaaaaactgcacaaatgctcaagcggcgccaacccgctccgcttaacccccagcgagttattcccgaaaaacggaaaatgccgaaattgggtgccaaattttgccattttctgcagcattggcatttacagatagaacccccaaaccaacggcatgctgtgccaaacactccaacttgatttcctacctccaaacattttccgctcccgcttcttcccgcaaagttacaggccaccaaagacggacaaaaaaaatttcacgccgtttcagcgccgccggcgctgaaccgtccaccggagcggaaaacccatatttttcccagatgcgcctcaaaaagttgtaagacccttccactactttcagggcgctcccggccttcggccgggagattttgtttttgaagacgaaaccccctttttctctatgtatatataaactagggtggacagttggctatggtgtgcatgcgtggcttggtaatatatggccctcatttgttattttaaaacatacaaaacattatcaattgagttctgttgctgtggggaaagcgcttcgcgctcagggacgcggcttcaccgcgtcgctagaaattgatgtaatttagcaattcatcgcagcctcaggacgg

SEQ ID NO: 22378 - DNA, 1142 bp, Heterodera glycines
cagaaaaacacgatcctgaggatattgtggaatcggaagaagttcaccatgaagttgaagcagtaccggctccaattccaacagaaagacatgaactggatgacactgtggaaacggaagaagttgtacaagaagttgaagcagtatcggcaccaattccatctgaaagacgggaatctgatgatattgtggaatcagaagaagtccggcatgaaattgaaggagtaccggcatcaattccaacagaaatacatgaatctgatgatattgtggaatcggaagaagttcgccatgaagttgaagcagtaccggcgtcaattccaacagaaagacacgagcctgaggatattgtggaatcggaagaagttcgccatgaagttgaagcagtaccggctccaattccaacagaaagacatgaactggatgacactgtggaaacggaagaagttgtacaagaagttgaagcagtatcggcaccagaaacaatggcatcagaagaatgggctcgaccagcagcagcggaagaagttattgaatttggtgatttgtcaccaaaaagtgatcattttggtgatcagaaggatgaggaggaggcattggtcgagtcggaagacgtaaagccagacgaacaccgagataaagccgttgatgatcattttaaaactgctcaagaaactgatcagcaacgacctgattctttaatggtgcgctgggccggggatgagcagcgcgacgcggaagaaactcgcgcactttacaccgtcacggaacaacaagcaaatcagctggtcgaagaagcgctggagcgagtgctcagcgatgagtcatcgttgcggtaagtaattaaattttaataatttatattaatttttctaaattttatttatttgaattggctaattattttgcctttttaaattttgtatctccttaaaagtgttttcaaaaagtttatcaaaaaatcgctatttttatttcttgaaattttctaaaaaaaattttttttgaaaattttccaagtttgaaatttaaaaaatcggaggggagcgggaaggcgaggagggagggaacgtagtgcatcccatttaatcactcgttaagggagtagctataaaaaaatgccaaattctcaaattaattaa

SEQ ID NO: 22379 - DNA, 2169 bp, Heterodera glycines
  misc_feature (1958)..(1958): n is a, c, g, or t
  misc_feature (2041)..(2041): n is a, c, g, or t
gatcagggttgaaaaaacgggtgatcaaaaatattatatttttatgttctaaaccatttccatttcattgacatttttagtgacgaaatcccgtaaatacaggggtaggtaccgtaaaaagttccaggggatgggaaattttttttttaaatgggctcaaaatcgtaaaattttgtcattttttgaacaaaatcgttaagaaatcgcattaaaaattacaaatttttcgccgagccactgtccccaaaattttttggaagcgtgccgcaaaaaaaagcatttttaaaagcaaaagaagaattgcaaaatttggtaaatttttggacacaatttgttagcaattcgcattaaaaattacaaattttttccggcggcgcctagcggcaccgccggactctcttccctcacacattctcaaaaagttttttggaaaaagtgcaaaaaaaaaatcaaaaagttttttacgaaaatttcaagattaaatttttgaaaaaattttcagcgattttttctaaatgttttcgaaaaactattaattcctataaaaaattgaaaatccgtttcaaaattttttcaactttttttttacaagtacaaattaaaataattttttttggtgtgattaaatctattatttcaactgaccgatgttttttcaagttttcaaaaaatgcttaaatggttttaaaatacattcttattataaattagatatttttagacgttcacaagcaattaattgattttttcaagcatttgtttgttttttaaaacaaatttaaaaaaatccaggtccaggcctggatccaggtctcgaggagcctggatttttcctggacctggattttcctagatttttgtccagaaaatccaggtccaggtccaacatggaatccaggtccaggcttttttcaaaatgtcgatctctaaaaataattaatgattcctaattacgaacaatactattaaaatgagaatgtctaggctaaaaatgagtttttcgcgcatttctcagcgaaacaaagcagcaaaaatgttaaatattgtaactaaaatgcaatcccttctgtaagcatagctatttggccttataaattaattttcattgatattttcattcctcccatccttgagtcaaagattgtgccaccccaacattttgctttctttcccctctcttttctctcattttcgctcctttttttattatgtttgcaatttttgcatcgctaatttttaggtttctttctttgattttaaaatattttttcatcttttttaatttgtcctcatttgaatgtttaacttgtacttaaaaataaagataaactaattaaaaaacaaattctctcacttttatgatattttggcatcaattcttttttccatcttcgtaatgtttctttagaaatgcccaattccttcgcaaattctttttgtttgcctttatacaaccttttaaattcatcaaatcgttcaatgaattctttctttttctcttcataaaaaactatgtttcattattttgaatttaattttatttaaatttaattcatttttccatttgtatattttttcgcgatatatgcctaaaattcatccaatttttctttaattacttcaaattttcgaatgatttctcttttttgttgatcatttgggtctgtccccatttcttcacccatttgatcaactgatgctgattgtgagttatcatttcgctcatttcgttcagtttttatcaaaatttcttcacattcatttttgtcccattcttcgccgaatatttcattaaaatttgttcggattttgccggattcaattccaaaatcaaagaaaattgtaaaaaatatcattaaatgccacataatcttaggatatttattaatatatatataaaaaaatttatgaatttattccttcaaatgaatatatttaatgttaatattcattttaangttacttttcccgtttttggggccaaaattattttatttatttatttatttttttaatcacagagggcgcggagaattgctanagctactcaccaaattatttctgaggcataaatgccataatttgagttatatctcttcgaatggatctgcattctattagcttgctgttgatttaaaaaaaataatcagctttgccccaaaacgaaaa

SEQ ID NO: 22380 - DNA, 1865 bp, Heterodera glycines
  misc_feature (1833)..(1833): n is a, c, g, or t
gaggaacacgtcgcggcgagtgataaacacgcgccgacccgcaatttgcaagataaagtcggacgactggtgcgcaacgcaaactccgtgctgtacaagcaattcgcgcagcgcaacttgtacgacatcctccgatgtcatttccaacgcattccgaatgtgcacacagtgtttgaactgctccgcaacggtggccggcggttcagccgaactccgcggcgcattcttcggctcattttcgggcgctttgtccaaaagtgttccgtaccaaacctggcaaaattatggattttgtattatggttgttattctaatggtgccatgcctccaaatatgcatcagagaattgcactttccgtctaagtttttccatcgcgcgttgctcaacctctccgggctgttccgggaattgggcatagtccaaatccgtctcgttaatttctataggtcctaaacttaattgacctcataaatgtcggtttcgtcatgttgtgtcaccgctcaccgaattggccgtggctgacgaccgtcgcgccattcattgagacggggtgaaccatcaaaagtgggttttctgggaatgcataatggccaaatgagcaagtgccccgctgtcgttctgcctcacgacatgtttcgaacaattgaagtctgaaaatggttgatgaatgttaacaaattgggtgttaaattttctaattgggtctttttctcgcctgtactgatgcaactcttcgctcatcgacagttccaattcgttcagcgaaatgcccatgaccaatccgatgctttggtttaattccttctccgttttgtttccgcttggctctatcagaataagcaaagggaggaacagaaattgcaaactcgcgatgggtttgcgttcgtcataaagcttaaaaaagtgaatggcaaattaataaacgcagcactcagagaaagcgcttttccaaccaacttcgacatgcgttccgtcaagtccaatggtggaaaaaatgtaattggaaatgtcgttaagttgataggcgagagggtacctaatggccaatttgaaacccattaaaacaatgccaacaatcaccgcctccactcacttcctggcctggatgaacacgtcctgcttgagcagtgcgagtgccctctgtgccgggcattgaattggcagcagcacaccgttgggcaggtaaatgtcgaggaacatgggacgaatgaccgtggagtggtcggaagggacggcattttttgtttctccgcttccgattgaggtggtgttctgaaggatcagcagttcgccctccggtgaggtctcccaaattcggtgcaactgacgatgctgagcatcatcgatgttattgtaattgcattggtagttaagggcggtggttgagggaggcggaagggaagttgggtgaatttcggaattggacgaagaagggccgggctcactcgggtgcattgactggtgttataatacacaaacggcaaagaatacaaattgagttcaacttcacatgacataaaataatcaaagacaatttttcaatattgtttttggccagtaaaaagcaattacctaattttaaatttggcacttttttcgtttaattgaccaaatgctttttttgaaaaaaaaaaatcaaaggcggcgtttctttgttttgtgcccagcgattcttttgcaattcaaaaggttcccttaatccactaaataagaaaagtgcctgaaacttgatgtattaaatatgatatttatttagaaatattatgaaacgacacgaaaaaataacatacatagacacaacagatggtcaaataacatttacatattacttntttgtcaccattctcgtcccatttatttctct

SEQ ID NO: 22381 - DNA, 1770 bp, Heterodera glycines
  misc_feature (1707)..(1707): n is a, c, g, or t
  misc_feature (1726)..(1726): n is a, c, g, or t
  misc_feature (1744)..(1744): n is a, c, g, or t
cagcagttttttaaatttttccgtttttttctgtatttaaatgtgtcagatcaccatgaaggattaatctgatcatgttaatgcaaatgtaatctgcataaaaagtgaaattagagcatttttcagagctttttggcccataaatgaattgaattttcgtacataggcttaggctaggcctgagttttaggctaggtgttttttaaaatattccataaactattttcttacttttgcttcatttgaaaattagcaaaaattaattttacgatataattaagtttttgcatttaaaatacttatacctatattgatatttccaaatattttactttaatctaataattagattaaaatcaagtgcatgaatcaagtgcttgatttttgcacttttcgtcgatcgacatagcaccaaaaaaagttagaaatcgagacgaagagaaaatacagtcaatacggggcttatcccttcccaagccattgagtctaggaccaataaactaaatgtggcaaagtgccaaaatgccgtgttcaaagtgccgaacaaatcacccgcacaaccaactcactcgacatcgaatgagagaatgtcgagcagcagcacattcgggcccaacggcttcagcgttagtgagcgaggctttggaaggacgaaatgcgaaaagtgtgcaggtgaaaacagccctcggcaaagcattgcttttgaggccgaatttggacatgttgggcctcgtggttgaacacattgactaaagggagagagggcgaatagacggacggaaagcattcatttgatcactgatcagaggctaatgaatgctaatgagttttgagtcaaaagttttaaatatttgttagttagcaagtagcaagtaagaaaactgttgtattttgaaattaaaggctgttcaaaactcgtacagaatagccgagacgtctcctcaaagattggtggattgaatcgggcctgttcaaaaagtcaaataaatttagaaaattcataattaattatttataatttaagcaaataaagcttagaattggactcggatcctatcagaattttcacaggattctacttcttactcagcttttttttgaaaagtgcaccaagattaggtagggtccagaaaaaaattcgagaaaggcaaccgaagagctttttttgcatctccagtgttattgtttttaatttttcagcccaggggcgaaaaagcaggattttgtaggggtcaaattttcaaaaaattattgtttcaataggttttggcgggtgccgacaggcgccgtcgggaaaaatttttttgaattttaattgaatatgagaagaaaattagcaaaattttcaaaaattttgctcataggagtccagaaaaatcctgaacattttataataaaagttttcatatatttgctatattaaaaccactctttgctgtgctcactctgatcccaacaaattgtgccgtgtttggcattctgtccgtttcactgtcgtttttcccttcccttcgctcttttccctcaggcgtgatgtcggcttgcctttgatgttgatcgtcccgtttcgtcagaagtgccagaggggaaaatggtggcacaattaaattgttgttgttgctgttttcaagtgtggagacggcgatggcggggaaaagcgttggcaaagtgagcaaagcgccaacaaatggcaaatggggagatttncattatggcatttttccanaaatttctcaccaacggntggcggcgattccaacgtggtccatt

SEQ ID NO: 22382 - DNA, 1793 bp, Heterodera glycines
  misc_feature (1742)..(1742): n is a, c, g, or t
ctccccctctcacgtgttattaaagtcttcccttctcccccttcctagtttttcccaacttcattcaaaatatttggtcgtatggacttcttccctttgcttgacatttaatgataattgtttgctccaaataaaattatatataaactgttgtcggacacaacaccctcggattgacagtgttaaatgatctgtgtatttggggagacatcatccccacagactcatttctgttgttgggtcgccaatgaccctgacgaaattggttgggagagaaatttgttcctctcccttggaaattgttcctctgcatttgaggaggaaaatttcggggtttttcttccccacggaagacttgtgtacatctttgtacttcttccttcacttcaacaatggaagtgtttgccttgtgtaggtcggaacaatcaaatgttccacctgaacgcatttccttctccaccacttgagtgaggagatggtatggcaatttggactttatcgtggaggccatgaacttattttgttcattttctccaaaatctgacagctgctgacaaatcctttcaatggactctgagaactgcctcagagattgaaccgaatctgaaggttttggaagatggagcaactctgattggagtgtctccacaattgacttctcatccccaaatcttttcttgaggatttctaccactcgcgggtagttttcatctgaaggcgggtacaaatcaattgctctacgagcaactgacttctcgggaagacatcccaagagataaatgtgttttttgaagtcttcaatttgaagactttcaactgaagtctcaaacaacttccaaaacaaaggccattctcggggctcacccgagaactttggaagggaaatgggcggcagcatcacttcatgacgctgcggagccacaacaacttgtggctgaatgttttgagcaggttgttgaacctgagcatggtgaacgacatcgtccccttgctctgagaggcctaaagccctatcaatggtatcgacaagccctcgggcttggtcggcccattccatgaaggcttttccttcaggtttgtagtccttgtagttctgctcttcctcctgaagagcaggacctttaactctgtggaagactgcctcccacttgtcattgtttttctccaacaatgacactgctctacagagattttgtctctctgcgagcaaatctgttttgatttcctcagtcaaatcttttgtcagattttcctgagccgtctcaatgtacaacttgagacgcttcacaatcggcgcgattgtgattcgcaagagttcactcatctcttacgaatgttggacaagctttgttcaaagcttggacttctctcagttgagggggtaagctacgactggagcttgaccccaacggggctccaatttttgtcgcggaatggacaaaaaatcactggaaaggaaatctttccctctaagggaattctttcctttaggcttttccttcaggtttgtagtccttgtagttctgctcttcctcctgaagagcaggacctttaactcggtggaagactgcctcccacttgtcattgtttttctccaacaatgacactgctctacagagattttgtctctctgcgagcaaatctgttttgatttcctcagtcaaatcttttgtcagattttactgagccgtctcaatgtacaacttgagacgcttcacaatctgcgcgattgtgattcgcanagagttcactcatctcttacgaatgttggacaagctttgttcaaagctgga

SEQ ID NO: 22383 - DNA, 1349 bp, Heterodera glycines
  misc_feature (1187)..(1187): n is a, c, g, or t
  misc_feature (1217)..(1217): n is a, c, g, or t
ttcttttcatatcgaattacaatttacttttttatttacattgtttttttaaagagtcgattacggtatcccctttggtaattactgtatttttcgattatccaattttccaggcgggtgacgaccttcgccaggatgctgttgtgctgcagttggtccgcgcgatgagcgatatttggctgagtgagcagctcgaccttcgcatggtgctcttccgctgcttgccaaccggcagcaaaaagggattggttggtcacggcaatttgcctaattattgcaactattttgatatactggtttccattttagctgtttataattaaattaaaattagtctttttgaatgtttttctaatatttttaatttttcttctggcgctttaaaataatttttaaactttgtctcgtcaatttaaatgactatcataacatttttaacagattgagcttgtgcccagctgtaaaacattgcgcgagattcaaattgtcagctcgggtgccgctggcgtgttcaaagacgaagtgctcaacgaatggttggcccggcagaatccgtccgaattccaatataaggcggtcagtaattaagcaattttttcaggttttcaaattgattttcaaggctttggaaaatttccggcgttcgtgtgccggttggtgtgtggccacttatgtcctgggcattggcgaccggcacaacgacaacattttggtcactaccaatggccacgtgttccacatcgactttggcaaatacatgggcgactggcaaatggctgccggcttcaaacggtgtgcaatcattgtgattaaaatccattctctcaaatttaagaattcgaaaatggaactaatctattctattggattataaaatgaattgaaatttcaacgaaattttctttaaatcttgctggggaacagaatttggtagcctaatagaagacctaattttggttagatttctcttggtttatgtggtaattgttgtcaaaaatgtgaaaaattttataggccctaaaaatgcctaatttcttcgccattcccttaaagtgctcttttaaacgctgtttcacccttcagctaattaattaccaccccctccctaaattcgcttgcagagaccgtgtcccatttgtgttcactcccgaaatggcctatgtgatcaatgggggccaaagctcgancgaacacttccagcgatttgtggatgagtngtgccatgcgctgaatctcttgcgaaaaagtgcgccgaccgtactgaacataatgcgctttctgagctgctcggacatccggggaatgtccatggaatcagtagtaagctgaattataataataataaacta

SEQ ID NO: 22384 - DNA, 1480 bp, Heterodera glycines
gagcgacgcacaagccacaatgcttttcacccaaatgatcatggattcgctgcagagcaaattccctcggctgaatttcctcgcccacacattggcccaatttcggggaaatcccctcgggggccgaagcgaggacatgaacaggctcagcttcatctccgaactttacaagtgagccaggaaagtgatatcaatcagcagcataaggcacagcaagattcaaggacacaaaattgattaataacttaaaaggacattgaaacaatgcccaatcgggattcgggatttgagatggggttgccaattgaaatccaatgccaatgacgatcattagagctttgaccaaattgcatttgaagtgcacgactttgtcctaaataattcactccctctccaattactttaaatttaattgctaaattttaaatttttagcgaaaagaatgaaggtcgtcttgagtcggtgcatgtcaattcgtacgaaaaatggaaaaacccggagaaaatttatgtaagttttgttcatccgccatattccttaagcttaagcaatgacataagataaacggataataatggctcattttgcccccgccctttctcagatgtacaaattgttggtgaaacggcagcaggaaaatgtgaccacggtgatattccggtaataattaaaaccggaggaatgcagtaaaacaacccgtaatcagtgacttggaaatcaaaaatttaaaatcccgaaaattcttttccttacacaatgcccatgtgcgcaggtcctttgccgagttccaagagttgcactggaagctgtgctaccgcttctccagccgtgccattccccaactgtgccaaacggtgaccttcggccgcacaaacattcgcacggtcgccgtgcggcgtcaggtggacctgcagtacttcttgcagcgcttgttcgccctgtccgacgaggtggcacactcagagttggtctacacgttcatgcactccatctaccgcgacacggagcccgaggcacacaaacagagcggtaattattaattaattagttaattggcctataaatatagaaatttcataagccagtcactttccaggattgaacattagaaaaaattaattgaatgataattaattattaatttatcaccgtttaaactgtttggcagatttattttctatcaatttcatttttaaaaaattaaaattatccatttaaaagcgatttccgaaatttgtacggacggcgctttgtccacccaatgccaacttttgctgcgcttggcctgggaagaggcgcagaataagctacgcatttttgttgggcatgccaaaaacttgccgttggttggccgtgagcaggcgccagacagttacgtgaagagttacctcagatggacgggcaccttccgcggcacaggcgcgccaatggaagcgcaaaaacgcacgtggtgcgcaatgcgcagaatcccacgtacaac

SEQ ID NO: 22385 - DNA, 2141 bp, Heterodera glycines
caataggcgattggaataaatggacaaaaaagcaaagtcaaagacaaaaccttaaagcaataggcgattggaataaatggacaaaaagtcaaagacaaaaccttaaagcactaggcgattggaataaatggacaaaaaagcaaagtcaaagacaaaaccttaaagcaataggcgattggaataaatggacaaaaaagcaaagtcaagaacttatcctacctaatttcatggtggcaacgaggcatttgactcccttaagagagccttccttctcatgtacttgtacctaaaatgttgttggcacaaaaagtaaagggggaaaaagaagacaaatcatccgatcaaaggctaagtctcaacagatcgcagtgtaaaagctgctctactgctaacaaccccctgaccagtagtcaagtcgtatacaagtgattttgcgccccgacgttccaccatggcacacgagtgctacggctttggcaatgtgcgagcaattaagcacgcacatcgggccagatgctggggcatttgtgctgcaccgcaagcggcgcataagtagtgcctcccgacaccggggagcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggatcgataagccacgctttcgcggtccgtattcgtactgaaaatcaggatcaagtaagcatttgcctttttgctctacgagaggtttccgtcctctctgagcttgccttaggacacctgcgttacgctttgacagatgtaccgccccagtcaaactccccgcctgacactgtcatcggcgcgggtcgccgggccaccgggtggcccgacttaacaccaaaatggacaccctttcgggcgcactcccgttttaccgattaagtaaggaatcgatgaaagtagtggtatttcactggcgccttgcggctcccacttatgctacacctctcatgattcttcacaaagtcagactagagtcaagctcaacagggtcttctttccccgctaaatttgccaagcccgttcccttggctgtggtttcgctagatagtagatagggacagtgggaatctcgttgatccattcgtgcgcgtcggtagttagccgacgaggcatttggctaccttaagagagtcatagttactcccgccgtttacccgcgcttaatcaagtttccttggcttaacattcagagcactgggcagaaatcagacacggtccccctccacaagtttcatcctcctcctctcttctatttagacctccccctctctctatctctctcttccccccctccaccctctctcttcccctccccctctctctctctcgtcccctccccctctctctctctatttccctctctctctctctctctcttccccatctccgcattccgcgcattccatcgagcgaacacggcgaaagagtttgaaggatatgtatgggcggatgataatacgaccaattaacagatagggaagcggggggggggggggggggcggcagcggcgactcattcatccgcccgttttcaaagcgccttcagtcattcatagacggacactggaaggaatacaatgcatgatattccttgattctcttcccatctgttgcatccgatggggaaattgacggactgtattttttagcggtttttaaaaaattttaattaaaatttttgggaagagcgatgccgaagcgccgccagaattttttttttttatggaatttgttaacaaatttatttatttcaaattgtcaattgaggttttcttaaaaaccatca

SEQ ID NO: 22386 - DNA, 2602 bp, Heterodera glycines
agaatttcaaaatcgacaaaaaatgcatttaaatattaaattgctcaaatttcacaatattaagatttgacgcagaaatgctaaaaccctcactcgtctcaatgccattcatggccaagtgagcgcggagtgccgtccgttccgcgctcgaccggcacagcaaacagaacagccatggcgtgtctcgtggtccacagcgtggcatttgaaccaacaagcgtttggcgaacagttgagccatgccaacccggtaccaagtgctgagcacgcttcgatgcccaattatctcaggcaatttgtccaatacgccgcatgccatggcggcaccaagcccattgattttgccattaatcgccgactaaataattcacaaaaatgtgtaagaatttaaattgtttcttttaatttaaattttgtatagccaaacattcattgactgattaatgatgacctcaaaatgtataaactgtaagctccttgtgtacccatggtttgccaaactttgcagatgtgaaccaacgcaagagtctcgtgcaagtacaaatccaccatcgccagcatggacaatcggaaaaaggatttatttgttttggtaggacttggatttaattatttaattaatatttaagaattatttgattttttttttattaaaccttatttgagtttaagctagcgcaagtgtaatcaccaaatgtaccgagcaatttttcttcaccaactgatgatagtgtggtaatgccaacacattccgagatgtcttctatctaatttattatttttaatgtttaaaatttgaaaaaaattttgcatgggtctaagattataattgaaagtgtgctaaaccgaacccgaatttctggatccaggaagactgaaaatgggagttctcgtctttattttactaaaatcccggactcggatcaggaataattcttgtatctaaaaactctaatattcacgaattccctacgggctaaatttatgtttgaaaatattactaatatccatccatgctttttgcatccggccgcaattaattcaatgtcaccagctgggcatccatatgaatgtgtgacaatcactgctctgtacaaatagccaaaataattatttaataattatttattattaattatttattgttttaattatcactgaaaataatcggtcgtaattaatgataattctgattcagctttataaattttatatttgtttaaaattaaatgttttatgaaaaagtttattttgataacaaaaaatgcataattaaaggggcataaattaaaatggaaaattcattttccaatttgtaccctccaaaatcattgaaaatctacaaaattcttttgcaatttttctctcaatttttgaattgtttttcacttgatattttcctttttcttctttttttaattgcttcaaatgttctaattattctcttttttgttcagtatttggtcccatttttgtgttttgatcacttttggtaatattttgatcattttgcatttgatcaattaattcggttccattttctgtattttctttgccgaatattttattaaaatttggtcggattttgcaggattcaatttcaaaagcaaagaaaatattgtataaaaaatattatatgtcataaattcattttggaatatcgaatttattgcattaaatgaatttgtttaattttttgtccgctttttaatactaatattaattttatttgtattttctcttcaataaatcgtttccaattttaaaattgtcacgtaattccggcggtaaaatcaatttttcgctcagatgaaaaaagacttgccgtaaaaaaaaattaatttgttataaattttatattttaattcatttgaatttactcaaagcttcggtgagatgtaaattatttttgaattttattagatcagttgtataaattctaagacattgttgcaaaattgtggaccattagttaaaatttaataactcatttatatttatggcaattgaaattaattatttgagaggttaaaacaaaacggacaaaaaaattaactggaagaattagacgattatctacctctaaaagtcggtgttttttttatttttctattttttaatataatttttaggtgtagtttttttttaaaaaagcaatattatttttttagtaaaggttacttcttaatagggcgcaaaattacataaagttaaatttatttatttattaaataaaataaattcgtaaacttcctttttttaaaaaagactttcataacattttcccccttaatatggacatagataatttacatagaagcttcaagccaagataaaatatatttttgtccgtttaagacagtccatgaaaaaaatggaatttcattataattttacgccccagtcaaaacttttccaagatttttccgtgcctggttttctgagttgccgctcgtaacagcagagaccaacttggattatagtcccattcatcagcagagtcaacaaacacgggattggcaccaacattgaggacggcatttgagacagcaacaaatgttatggacggcatcaaaacatcggcacccggtccaatgttagc

SEQ ID NO: 22387 - DNA, 1804 bp, Heterodera glycines
gccgtgatgagacatttgcgccgcgccatttgcgccgcacagcaaaagtggacacttgcgccgcgccacttgcgccgcgccacttgcgccgcacagttgcgccgcggatattttcgccgcccagcaaaaatggacttttgcgccgcgctgtcaaaaatattatattcataaaaattccactattatcaataagttttactaaaactataagccatcgacaaaaataactaattgaaaattcgaaaaaattactagtcacataggttcatcaaagatatgaaaaaatgattaagaatacaaactaacaaaaaactgaaaaaaaaagaattttctgtagaaaccccaattatttttttgcttcgaaaaaagaatgaaattcaattcctttgtaattaattttctcaataagttattttcatcgattttattttaatttcattgaaaaaacgcactgattttcaaattttcgctcctattttaccatttttcgcattatttcgaaatttttatgcccttatttatttacctatttttttcgtttaaaatccgccgcttaatgatcaggcaatacgaaggcttgttatcgcatatggtcccaatgaaaaccaaaatgatcaagatttgatcaatcattacatgcacttcaatatggaattgacatgaaaggcttcgaaaaaggaattaataatgaatatctatcattattctattaagcacataaatttattttaatcagagcgcaaatgtcttttttcgctgtacggcgcaaatgtcgcggcgcaaaagtcggctaaccattctgaaaagctcgcatgaattctattctataaattttttatgaatttttaaatgtatgcatatttttagcgccttttttgatggctttttttataacgacatagcaccggggcagggctgcacgaaaactctaaaaaaaaattttcgtatacgaaaacgaaacgaaaaataaaattttgaaaaccgaaaacgaaaccaaaaaattttggcggacgaaaacgaaaacgaaaaaataaccattttcgtacgaaacgaaaaaaccgaaaattttttaacttatttcattcataattaagaaacgtaaatctttaaaattatatcctcaaactgagtgtatgcagatcatagtaggtggaaaagcggatatggctctagtacaggggtgtgtgattgaaaatttttcgaaaaaataacaccaaggaaaaaataaaattttgagtcaaaaataaggaatttttcaaaattgcttcagctcagttatttttataactgatccatcaaaatgcacataatattatattttcacatcccattatccattttaaacaattttggggaagaaattaacaaataatacatttcagagcaatagggttaaatcagattttaaacaattttttgttgcggcgcattttttcagaaaacttgaggaacgtggtgggcccggcggtgccgataggcgccgctggggaaaattttgagaatttaagtgtaatttgttaacagatttagtaattaaaatagtaaattaaatgaaaaaaaacggtaaaataaagtgcgggcatatgggatcgaacccatattaaaaaaacaacaaaaatctgaaggtgcacgactaaactacaacggttcgatgaaaccacttattttttactaaaaaagtcgttcttaagggtgtaaatattttcgtctttttcgtcgaaattctgtctgacgaaaacgaaaagaaacgaaaatttaaaaggtgaaaccacgaaaacgaaacacgaaacgaaaaatgaaattt

SEQ ID NO: 22388 - DNA, 1064 bp, Heterodera glycines
cgcaaaaaaagagtttttaaaagcaaaaaaggccgtcactttgatgatgagactcctacgcaaaagttcggtttgcgctacccctttttatgtgtttatgatcttaaaaaaatacacttgaattaatttcattaagatttctcgattcccgagtcgagaaataccgtttcccgggatcatttctcggttctcgtatcgtttctcggggtcatttctcggttctcgtatcatttctcggggtcatttctcggttcccggtaaaaatcacttctcgcacagccctattgtttagtaaacaatgttctgcttcggatgatttaaaagcagtctttcagttttactttagatgtcacttggttttggtttcgattcgtttatttcagttaattggtttgctaaacccatttattcggtttagatttagttaaatcattctgtagatttcagttcaggtttgcatcgtttaaacctgtcactcggttttgttctgttaaccaattcacttataaattagttcaacgatttaaccgctttttattggttagtcgcggtcccacgaaatgtccaaaagagtaaaaagctgaaatttccaaattctataagctcataaaaacccggaaaatgagtctaatttaggattttcggggtcgcgaaatacaaatatgacctttaattgcccaattcctactgttaagccaagtatgaatataaaatagcaaagattaatctgatagcttctacaccgtagggtgaccagaattcgaacaagttcatggttcctaggtgatcagaattctatctctatacacactctcaacttcatgtctagaaaataaatttattaaaatttccataaaattcatcatagaacaatgaaaatcgaagcatcagattttttcgaaaactcggtcaaggcgccttgaattttgacttttctgtttaaaatttttgaaatcaaatgcaactataccattcgatacctcgtaaaaaatgctacaaaatacaaccatatatttaggctttaattgcaatttacagttacaatgacaagaaaaacaaataaa

SEQ ID NO: 22389 - DNA, 1304 bp, Heterodera glycines
aaaaattagcgctttactttaaataagtctgttcaatatttattagtgtcggggttgtatgaatcgttttccttggttctgtctgcatttggcttgctaacgaaaattcgaatttttgaaaattctcactattccataaaattgattaaaaagggctaaaagtagtcacaaatcattgaaacatcaaaaaaatgatcttatcatattcgtgatcggcgacctcgaaaacccccgggtacttggtttcaggactttttaaagcgaaaaaaattgaaaaaaaatttaaaccaaaaaaaagtgcaaaaaatttttttgagctctctttttaaatagcgccattatccctttcttgtcaagaaaacaaataaatacattttggaaaaaattggtaaaacctaaaaatgtcatccaaaattatgagacacaatatgatatttttgattggtttcttacagtttttttctgaaaaaagattccattaataaagagacaatttttttatatggtagtcgactaagagccacataaattggccattaacacaccgtttcagtttttgcctcccagttccaaaaagatttgaatttttgtctcagtggtatatgtgctagtcaccaaaaggggggttccaggttcgaatccgatgcatgttaacggacgtttttggtgattttaagcaaaaaacgacttataaaatgacaaataaatattctgaaaaataaacaaaaatgataaaacattttgtttcttcactttttttttgaaaatcatcctttaatccaaatttgttaaattacatcaatttggcattcgtcatcaatttcttccgccacttcttcatccgtgtcatcctcgcccttcctttcttcataattctaaagatagtacgccaaaaggagacaaaaaattagagaaaaaaagataatgtttttctctggcactctctatttattggtacacatctcgttttttgaaacggtgtgtaaaatatgtataaaaaacactaaaatatgtatgaaatatgtacaaaaatccagaaatatgtactaaaatatgtaaataaaattttttaaattgtgatttttttgggaaaaaattcctactaaagggtgaaacaggcacaaattgccataaaaatgacctaaataggcttagaatcaatcatcttttagtatttaaaaaaaagttagtttttgatatcccatttcaaaaaaaaaaaaaattatttttttggagcacactttcaaaaaatttttacttttcacaaaaaattctataaattctcaaatttttgaaaaaattgc

SEQ ID NO: 22390 - DNA, 2411 bp, Heterodera glycines
  misc_feature (11)..(11): n is a, c, g, or t
gttaacaaaantttgtcaaaaaattatcgaaattttttgttaaatttgcggttttaggctgtttaaaaaaagagaaaaaaataatttttaaattgaaatattttttattaattacaatttcaattgaaaaataatttaaagaaattataaaaaaaattctgtaccgttgaggaattgaacccaagagaaaaataatgaaaggcaaaaggtttagccaccagaccatatttgaattggagctatataaaaatagagaagacattaactaggagagaaagagatttatgattttcgcgtaaatttgaaaatttttctgactgctcaaaagttcaatctttagggggtgtattttcaactctcgcctctcgtcccaaaaaacgagagacgagaggcgagagtaccaaaaatggcgagagttggcgagagacgagaggcgagagttgtcccacccctgttgtgtacctacctattttggaattttttaaagcctaaaaatgccatatacgcggacccggttattgtacaaatagccgggcctaacctaccctaaaaactaaaatagttcaattgcttaaataaatgaaattcttaagaaaacgtggaaataagaaaaaaaatatacaaaaaataaatgaaaaatatatttttatacaaagtaattaattaaaattaaagaaattataatcggtctacaataaataattagtagtataatgcgtataaattcaaaaattttaattggactttataaaaatgatcaattaatctaaaaaataaaaataaaagtaataataattattatcttatgcgaatgaatcgccgctagagataacttaaacgatatagttaaaaagtaaattacctacttaatatgctgattgcacgcaatgaactctttttcctaatggaaaaatgagaaaattagaaatattcgaaattataaaaaattttctgatcaaaaatgttacacatattttatcacttttataaattttttaaatatataaaaaatttaatgaaaatccatttgatcaaataattaaaaaaatacaaaaaaaacaaatagttaactttacccttataaaaaataaagacaactattattgaaaattaatattaatttctataaaataaaaattaaaattcgaaatgaatgaatatgttatattttaagcaaaaagaaatttataacgtacttaaaaaataaatatactcaaacatataaactaatttgaagaacctatttcttttagttaaagaactaatttatatcttgaaaaaattagcttaaccacgacacgaaatccaaaataaaatgccaaatgtaagaaaaaaactcaaaaagaattgaaataaataaataaaattattgatacaaataaacacttcatgccataaattccacatacactcgagcatctaatatttatggggagcatgatgaaaaagccaaattggacgtgaaatttttaatattcaattatcttactatttaattattccaaaaaagtaaattttagcaaattattcaataaaaaataaaaccggtaaaataaagaatgaaaatttataaacatatcggcataaataaaataatacttaaaacaaaatgacttaactttatttcaaaaattagaaagcagacaattaacgttaaaacagataattgaattaaacatcattttaatatgagactgcgatttttaaacattaaaacatttgaaaaagtattaaaatattcaaaaagaaagtaaatataatactatcgataagaattgatgataaaaatataaaaagtgtaaaaatccaattaattcttaataaaacaaggagaaagataaccgtggaatttgaattaaggagccgatgaacattcccgaaagcttatcatgtaaaaacataaaaaagtaataatcaataattcaaattcaattaaaaaaattaatgaattattttagtgttgaatataatatttttgctggctttgtatgcgaagcgtaaacttaaacctgtattatatgatcaaaaaaataaaattaaacaaacataaattaaaacaaagtagattttgaacttttacatatattttcatttttatccaaaacctcaaaaatgactaaatttgctattaaaaataacattaaaattaaatattacaaaattatatcattttttttgttatcaggaaaataatacaactaaaaaataataattttggtatcggaaaaattaatccatttttaaaacaacaatcaaccttttcatgatcagtttatcatattctttaaattaaaaataataaataattcaataatttccaataaaaaaatttttgattgctcaaataaaaaaacataatttcgcaataaatagaagaaaaataaaaattttaatttttttttatttagcca

SEQ ID NO: 22391 - DNA, 1566 bp, Heterodera glycines
ttctgttgaaatgtgcgatatttacgctctcaattcgtaggtttttagggttttgcttatttgtcaccctttgattttttacagaagcggtctttcatcggtttcaaattccccagtcgcaatgtgtttttcttgacaatggattcttatcaaagcgttatcgtgcttcgacggattcgttcaataagtcatccgaatgggtgtgagttttaacttttgttcattttttttttgcgatttgtccacttgcttagaaaagcactaagacgtttattattttttgatcataagttttttagcgcttaattgattggtttttataaacgaataaccgaatttattttgcaaggcgaaagtacgggcatttgtcttttctggagcttaacataccatgtgaagaatatgatgaagacgaggaaaatgaaatcgaacaaacagaaagtatataaatgtcattaaaaagtgccaaaaaggtatgattaattagccgaaagttaaaaaaaaaacctttgtaaacaaaatttataaaacaattaattttgcttagaaaaagtaaaatattttttgtcatttttgatcaacaaaaattttttttgttagattcctagccttagtgatcagaatatgaatgagttcaaacgaaatcataacaatttttattgtacataaatgaaaagaaaacaaaatgagtgaaaaagatgaagtggctttggtttgaatgtgtccttttcactacgaaatgaatgtctcttttttggtgatttgtctgtccttcgtaatgctcctcctcctcttccctttgctctccccttcccttcatattttatcctttggcacttgcttcggaagcgcaattccatgtgatttttccatctgaaacgttcatttcagcagaaattcaatttttttttttcatacctttctggccagcgattggagggtcacacaaacagagaaaaggtcccgaccttcaagcaaatccacggattggaaagtctcttggtcgatgactcccattttacgggcctcgcttacctaagaaaaaagcctctctcaaaataggacaaaacttatgccgacccattaattgaattatgggttaaagaaatataaataaagagaaagctgacaaattggttgatgttctccatacaactgaacgggagggaattgagcaaagggagggaaatgaccagcaaaatcacttgaaatttgaaatcggcttcataactttcttcacaattccgggctccactgcattcaaaaacctgccaaattttcaatgtccgctggtcactgccattccattcacctgcacagcaaagtcccatctttcaattgctcccaaaaattcgtgcgctgtccggcagtggaaatctgcgagtctttcaccttttcgtttatccactcgagcagatattgcccttctaactcgttgtatttggacttctgcttgtccagcactgctcctgccatcccttaaaccatcggtcggttgcctctgtctgataagcgaatcgaattcccaccactaacctccggggcggggacgatgcgtgtaacttg

SEQ ID NO: 22392 - DNA, 1008 bp, Heterodera glycines
  misc_feature (916)..(917): n is a, c, g, or t
  misc_feature (927)..(927): n is a, c, g, or t
ttagcgtgtcccggtgggaatattagccgattaacccccccccccccatcgtcaattagcaataatttgattcccttcaatttcagctgaactttgtcttctgtcaatcgaccgcgggtcgtgcggggggcgtcaaacgcgttatgcttttgaccggcaaaaagtggcgtaaattaaaattcgaaattaaagtgtcaattcagtcccaatgcgtgccatttgagtacagcggatgcgggggaaacctcaacaattttctgacaatgcaagaatgccagcaaatttgtgggaatgtgcggagctgaaatcacggctaaacggccattgttcaaatttttctcagaaaaaatttataaaataatgaaaatatttttccgaatgttttttcggaattcactgaccaaaaccggggatcacagaaacaatttgaaaagtaaaggcaaaaaatgtccgttcttttcctccgttccgtcggtcacctgagtgagcacccgtcgtagtgggacacaaattcgaattccttttccggaaagtgcacaattgtgcgccatgaaagctgaattgttttgtttttgtttgcgttggcattctgttggctttcgccaaatcctccgacctttgccgcctttgccattcgcattttcgcaactttgcaatgaataccttcgattttgggcaacgcgcatttgaccgggccaggacagaagttgggctttctgttcttctgtgaatagaaaattcggttgtaacagtcgaccatcatcggcaggtaattctgcgcggtgggcaatcgtcggaacgtttcgccgtgggcggagagcattcgaacgaacgcggactgaacacgcgcgagctgacgcgcgtttatgaggtcggacagacgcgagagggggccgaaagactgtcgaaggattgnngcaaaagtgngagagaacggaagggcgtcgaatggcatccgattcatttcgatatgccccattaatctccgtttatcccccctcaccaatt

SEQ ID NO: 22393 - DNA, 1597 bp, Heterodera glycines
agaaatgctctggatgtagaaaatttgaagctgaactccgaaaatttcggtaaatttcgagagtgctcaacacaatttgccaccgctccatgtaaaagagcggactgaaacaggcggcgacgccaaaacgccgcgaggaaaaggccaatcggaaggggatctgaacaagcaatcggagagaaatgaatctccccaaaataataatgttatggtggtacatcgacggagtgcgaattgaccgtcgtgtcggagagcgacagccgtaaaaggttcggcagagtttggcaaatgccaacgtacgccgtccatttgcaaatgcccaccggctgatatgcccaacggatctgtgctcgactgactctgaaaggcaaaatcgaccaatcccaaagcttcgcactttgcttctcactttgtgtgcgttccatttttggccgtgcaaatcaaagctcgtctcagccttagaatctttgttaaaattttatggtaaaattccttaataattgaaacagattaaaatgcgcgagaggtaattgaagcggatgattggccttcgccggtccccccccccccccggccattcttcgcttttgccctttgcttctcaaatttcccacctcagcggggctcttccccatccgtagtcttctgcgttgatcagactgactgccgtgtgtggttcatatcttcagttgttttggtggagaataaccttacaattatcataaaaaatttgggttaattacatcgccgaattttgatagacagtggtggagatgaacaccaaatgatgttcgatgcggtcgaagaagaagttgagggaggtgaccaggagcagaaagtacaaagtgagctgagcatttggcggagggtcggcgcgcattttgacactgtcaaaggcaattaaggaaaattaattaataaaattaattaattaacgtggcgagatccatttggcaaaacttaggcaattagcggcgaataagaaaggatgtgcttgggagtgcccaaagcgataagaaaaggcccctcgggggctttcccccctttccccccattcaccgccgttcaatcgcgcggattgtccatgcaaaagttcgccagaagagccgaaaaacgataagctcaagcgaacagcaaaaaaagcggaggaatcggagccgacggatgggaaaacgcattttcaatgaatggggcggagggattggcggggggcgggagggaagggcaaaccgacgccctcgacggaatgggcgcttaaactcgtccctcccagcccacccaagtgaggagccggttctcgacttgagtaagtgtcccgtatttccaagaaaaattgaaaaaaacagaaaaagcatttgtcattcaattgtgccattgtatgaaatttttataataaatccaacaatattattaatattgatgcactttctaaattgggaacagaattaaatgaatgccaaaattagccaatggaagagggccaattgtttgccaattgctgcgccgcttttgccgttgcaatttacatccatcaccacaccaactttggctcttttttgcgaaatcccaccccaccactctaaattgcccatctttc

SEQ ID NO: 22394 - DNA, 1303 bp, Heterodera glycines
  misc_feature (837)..(837): n is a, c, g, or t
  misc_feature (893)..(893): n is a, c, g, or t
gggtggggaggaggcagtgacgttttaacccccccccccatccctcggggaggaaatcaatctgagcggacaaaaagaagcaaaagggacagaattggacaggggcgtgttgccagagggcggctaatttgaaaggggaaaatggggggaggataagcaaattatgcacttaaattagcaatgcttttctatttggtaaacctatcaaattaaaggaaaataaaatcataaagtaatcagaagaattatcaaagtgttaaaatgcaattgatctctgcccgaagttggcatttccttccgatcagttccaattggttccattggtcctctgtaagaccaattaatcgctttccgttcattttgtccccatttccctcctttcgctcacctttcggcttccgtccgtctccctatatttgtttgggtcgtggtaaattgtcgcgatgggatgccatgcaatttcttcttccagatccttaaaattcctccgcacgcaattcgtttctctttttttgttttactttttctgcttcgtcccatccgtgcccataagccacgagcggatacgcttcttccccgtgcttccaaatgtcgattcccttctgctcaatttcgggcgcaactcgaaatttgccaattattttgaggagtccaaagacggggagaacgacggcggaggaccaaacgataatggccaaggaggagagaatgttccagccgagttgcttcatcggcggagggtaattaggcgggggaaaagcattcgattaccgccagagaacgaacgatggccaatccatcgccggtggccaaagacggcacgacgccacggccagnggaagtgctgaccaaacagacggaaaccaatccccagagaccgcctcccgaatggnacgcgaacgcgtccaatggatcatcgatgcgcaatctgagcggacaaatgaaagaaaaaagagacaaagtgtaaaaatgagagagagaaactcaagagaaaaaagagagataatgagagaaagggaaagagagagggagaaaagagagagagagagagagacggagcaaagagatataaaaagtcattattttgatgtttttgcatttacttgccttagcataagtcctgaaagtgccatgtaaataagcccggcgccgacccccgtcacaattgtgccccacgcgtccatctgattgcatcctgcacatgcggcaatctgaacaatgtttctgaccgtaagtgccgggtcatttggatgccattcattcgaccaatggctttggcatttattcgatgctttcccccccc

SEQ ID NO: 22395 - DNA, 1202 bp, Heterodera glycines
aaaaaatgccaataataattttcaacaaatattcgcatggataattggcaaacatgcacccgattttaaaaccaaaataattaaaaacaaagtgaacacaaacaagacatctttctatgcatttgaatcattttctttttggcacatttaaagttttattctaatttggtgcaggttcgcatcgggtcgagaatgtagggatttgaatcgggtcagaaaaataaattttttatgaaattagatttggcccagcagggtcgttgcgaatgttcgggtgatgaggtctccgatttcgtaaaagcgactcattttgtatcaactcgataggtgccgccaggaagaattttataatttttagtgcaatttgttaacagactttgtccaaaaaaaaacgactccgtgccatccccgacctccatattcgaacatttggtccaaaattaaaaattctcaaactaaatgaatatgatcaacaatgtgtcaaaattagagcaattaattttcgcatggacaaatttttttacgtcgatctgatgatacatattctaccgaaatggaccaattaaataatttcattgcttaaaaacttcaagaaaaggttttaatagatagaaaaataggaaataaaattttttatttactatttttttgtggaaaaaagcaaacaaaagggaaaattttggttcgatttctgtgtaaacgaataattattattttgaatattttcttagaaaatattgacattttaaattaaaaattttgttaataaaaaaaataaataaatttttggtcgattcttatgggtatattttttggttttattgcatttttgttaataattttttaaaatcttaaaataggtaacaaaaatgccgaaatatgtataaaaggggtacctaggtaataggtagaaaaactctaaaatagctaaagatagatattataaatgtcatcgtagacaccagggatgacccaaatcggaaaataaaatgcgaaacccgaaacgcgaaatttgcgaaagtaaaaaatgcgaatgcgaaattttttctacaacttttttaatagtcaaaatcataaagcaaaaatcatttttttgtatttattacaaattttaaaaatcaataaaaagcttttttgaggcgcgctttttccaaaaaatttttggaaacaaggggcaggcggcgccggtatgtggcgccggg

SEQ ID NO: 22396 - DNA, 1393 bp, Heterodera glycines
gaccagatttactttttgaaatcccggagaacgggtggttcccccactgcaccgttagcaaagcgtattttcgattaaccaatttgggttacttacacaacttgttttagcgtgcaaaaagtccattttcgggcagaatggccgcggaattggagtgttccaagttcaactttcatgggaaaacgttccacgtcgaatgctcaaaactcgcgaatgacaaagtgtgattgtcaagatctctattgtgttatttccgtcataataatgtttatgtacctctctctccctgtgttttctttaatacccaagtgctaattattggtccgaaattcttcaatttgtatgcgtttcgtgccaactgtttaattttaacgctgcgtttttgatttaaatttttggcattagtttcaatttttcacttaggtatgtttggtcagtcattaatttaggtaaccgattcgaaaatttggacaatctaccgtagtataatggtccaattaaaattcacattgaaatagatttttttcgtgcatccattcagcatataaatttttacaatttgaaagtgcggccccaaaagcacccaaaaagcgctgatttagaagacaattttgtggttttcactaacagccaaaaccaattcactaaaactcaaaataaatttgtgccaaccaaaggcatccaaaacaaagatcctttgctccatttctcattttaaataaagagagatttcatgtgtattcgccaaaattaggaacaaacaaaaaaaaaatgcaaaaatgtagcagaaggggggggggacctttcactcaacggatttctctcgttccatcgcttttcgttgcaaaattatgaaaaatgaaacagcagcaaaatttgcatttttccgccgatctttagcaaattttggagggattccgaagaaattgaatttggcaacttttctgcttttgttggtcgtcctatgccggcaaaaactttttgaaattcaagtgagaattgttatgagattttgcactaaaattgcctttttctatggggatccatccctaattctaaaattgtaaaatgttgccaaaatttttttgtatctaaattctctgttggataagtttaatgaaaacatttaaattaaattctttcttgacaagcaaacgataaatttagtcactttttgtgctaatttttgaaaatggcaaacaaaaactgacaaatttcaacaacatttggccaacaaaactgacagattcaacaaatttataaaagaagagagagaaaacgaaaataaaatttgaaataaaaaatgaatttttgaaatttttaaggaaattgggggggggggggggggaattttggaaaaatgagagggaagaaaaggccaaaaattcaacaa

SEQ ID NO: 22397 - DNA, 952 bp, Heterodera glycines
aatccaacttgtcattgaaaactaaacatttttggggattttcatacgaatatccgctgaatttactcactttggacgacaaccccaaaaagaacaacgacgatggcgacatctgaaggcaattggtcatctccgtttctttcccccgactcgctaataagccccgcagagagtttatgggggggggggtgaagggattggtgacccaatttgggcgggggcgggaaagagtcgtcgtgtttccccctcccctcattagccgtctccgtcgtcgctagccgccgccgttcctttctcttttcccacccatccgtcccttcccttcccttctctccctttgttttatgagtatccatcagtcggtggttgtcttctttatcgctctgatttaatttgatttgatttgatctaattcgcgcggtaccaagcaggaaaattgtttgattttatcttcaacggaatgtgaaaagaaaaaaaaatcaatttaaaaaaaaattgagtaatttagtagaggggactaacaatttaatttagggttttaaaatttaaaaaacgaaaaaaaatggatgtgtaaatttatttaaaattctaaatttggcttaggaatgcgctgtcggatcagaagagttcgctcgagttattggacttgagcttcaattgtttttcgcaagtgccttccgccactctgcgcaactgtgccgagctcaaatggctgagtttggccggcaattccatcgaaggcattgtgaagatgcagttcatgtcgttgcccaatttgatggaacttcgactgcactctaacggactgaaacgaattgctgctaatgggttcattaatgtgccggcgttgcgtcatttgttcctgcagaacaacaagttgggctcgctggaccagggaacgctgcaggcgttcaacaacttcaattggtcgaccttagcaacaacaattttc

SEQ ID NO: 22398 - DNA, 1273 bp, Heterodera glycines
ttatttatttgatctatttatatgttcatagggaacatgtttcgcgcatttggggcatagccagaaatcatcaaaaaatgatgtaccgaaatgcaaaagactgtggcttttacatctcttacaaatctcgtaatgacaaggacagtaatgacaacatttaattttatgcgggcagttcatttttcaattttgttttatttttgtttgctatttatagaaggggtatataaaggggatgaaaggaccatttgattggtacattgtatcaaaaatgcaaaaaccgataatcgtaaatataattgctctcgctaatctcggtaccggtattaaactaaactctctgacgatcaccgaatgcgaatttaagtataaccctagaaaattcaatgccgcagttataaaatgcacagttcccatcaaagccacggcattattatgggaatccgggaaaatgatatgtctggggacgaaaagtctgatagactgtgaaaatgctattaaaaaatttatagaaataattaagggctcggggtgtccggggcttcttacaccggacacacggttgaaaatattgtttcgacctttaaattcggacgtgaaattgaactgaacgagtttcgaaaaaatcgtcgtgcattttatgaaccggaaatattttgcggtttaaatttcaagcggagtaaaagcatgacagcgttaattttctggaccggtaaagtcgtaattacgggaactaaaaacaattctgaaattgaggaaatgtatcattatatgcttccctatctgaaaatggctcaaaagaagttagggagacgataaaaaaattttcatttattgggacggtcccccaatttatagttctgttgggtatttattttgttatcgattacttcgcgcggcgccggcatcgcggcgcaccggcggggcggagaggaaatgcatggttttggcaaattttcaaaattcataaaaatcatcataaaaaaatctcaggatttgagaaaataaaaccgccccaaaagaaagatacgggatttgggatttattttgcaaaataaaaaattgaatttccttcacctgccacatttgtgacaggtggatgattgatgacggcgctgcgcggcggcggaatcgcggcgcaggaagggaggggagggagggggcatgataaaaaaccgcacggttttggcaattttcaaaatgagttgatttcaggtaaaaattatgataaaaaatcttaggatttgagaaaataccccaaaaggtttgggat

SEQ ID NO: 22399 - DNA, 2337 bp, Heterodera glycines
cccctggctacgggccggtgcgtatgctgtttatgctcaagacacatagatgaaagaaaaaaactttaaaaattttttttgaaatgttcgaatccgggttcggggttcagaatcggtcaaaaataaggtcggattcgtgctcagcacagtaaaatagccctaaaaaatttttccatgatttttaaagaaaaaaaaaaacgggaccagtaaactccatgattgcccataagacaacaacggttatttccgaatatgttcacactaatcaacatacataaatacaacacaatgttatgcaatttcaattttgttcgccttttcccccttttctgctgctgcatcatttcgacctttctccgtgcatccattctttggccttctcaatgcatctgatcacttcttcgtcggtggtttggcaaaatttgacgtaaaaggacccgacggcgttgaaagtgggcggcgtcgccacacaaatcacttcgaatccttcggcacgaagctggtctggatgtaatgacaagaatcattcgtctcgcagttttgcttttattcccaccaaaagtgtagagcgacccaacgggaacgcccaaaataattctgacaatatcatccaaaagagaaatggacagaatccccgatcaaaatcgcattcaacaaaacagctcgtaataatttaccattatactgtagttggacaaatgttttaaagtgccagaaagttatgaccactgctgggataatgccaatttgtaaaataatacataattaattgtttagtgccaaaggacgggtaccaaaaatggaaggatgcgatagaaagtggtgccgctttgataatgtgagaatgatctttttaagtttagttgattttcggagcgattgtcgtagtttcagccgagttttttatacaaaaaaaaaatgggggcgggtggaagccgtaaatccgtaaatggaagccggagttatggggaagcgcaaatccgaaggcaaaagtacaagaataaaggggacgacagaatgttaattttaaaattttattttttttccaaaaagcaaaaaaacaaatttttttaaattcattttcttactgtgacagggaggtcacctgtgttcgatttgaatttgtcgatgaaatggtggaaggacagaatggcattgcgattgcagatgatgagtttggcggtagtgccagtttcattcataaaatttggcatattttttaaaatttattttaccccaatttgtagcctgcggcgtgtccccagtgggccgtggcggaggatggcaattccttcagctggcaatgaatgaccaacggtgcacgaatgtaattttggcagtatttaaaatatttgcattcattttgcctctgtttccccatttttttgccaatgttttttttttgcaattctttcccctcgggatttgctaagtcttgtgattgggtattgggtataagaggttttttgaaaaattggcatcggcttggcaaaagtcgggattagtgggatcccggatacttttggtcgtccaactcaatcattagtgaatttattttgaaaatgattaagaattttaacatgtccgtcattgcttgccatgaattgatgcacgcgcttggctttcatcatgagcaaagccgaagtgatgcccggaattacatcattttatgggaaaaggacggagtaattaacaaatattttcaataatttttcatctggttctttatatgtaaagcaatcggaaattgacccatacacccaaaactttggcttcccttacgatttcggttcggtaatgcattatccatctgggggcgatcatgaagagtaagaaaaaatttaattttaatgaagtaaaattggaattaaagaggcttatacgacctgatcactttgccacggttttaccaacaaacgattggccaaaatgaacgaatctctttcaaagacgcggccataattaaccaaatttattgcaaaggcacataaatttaaataaatttcagaaaattatcatttgttcagactcatgcaaaggccatgaggacaagtgccaaaacgggggctatttgaatccgaatgattgcacaaaatgccattgtccggacggatacggtggcaaatactgtaaagaactcgaagagagtgagcaattaatcaattcaattaaaaataaattataaataaataaatttgaagatttgaattgcgaggatttgagtggaattccgagagaattggtggccaatcattcagcagtgttattgaagacgaaggccaaatgtggggggaatgagccgtgccggtgccattggcgaattaaggcaataaataa

SEQ ID NO: 22400 - DNA, 1745 bp, Heterodera glycines
taaatcccccctttgttacaccaaaagcgcccccccctcccccctttttttgggttaacctcgctgattttggattgttccaccaagggtcattctgatcccattttgtgaagttcatttcaagccgaatgcatgaatataagtcattatttgagcgttttggcggtatctttatcaaggtagtacgacaggccattcttatcaatgcacatcagttccccaatataattcaagacagtgtttggccttacgcatatttcaatgggacaaattaggcggaattaaaaaacaaatgatagtggtgactctaatgatgagaagcatgctctagaagatttctataaaattattatttttttaataagtgaaatgggtaatcactgagtaaaccgtgagtaaaaaagaaactatagatttattattctctaaaagaatgaaactaaaaattttcataaagcaattttcgaaaatatttaaaaaaattttttgaagtttatctttcttaggttttcgaaaaaacattcaaagatgtttgattgcatggagcattcttttggaattgtttaatataaacacaaattttagacattttaatttccaattggtaaatttcttgcgaaatgccccccctcccctctcgcacttcgcccaacacccaagccaacaccaccaccacgcacacacacacctacagcaacagtcatgtcatgaatgagcatggggacgaaagtgaaacgaactgcctgacggtatggggcaaaggaaggaagtagggaagggaagggaagggaaaggaagggaagggaaaggaaaggaagggaaaggaagggaagggaaaggaagggaaaggaagggaagggaatggaagggaagggaaaggaaaggaagggaagggaatggaagggaagggaaaggaaaggaaaggaagggaatggaagggaaaggaagggaaagaaaaggaagggaagggaagggaatggaagggaagggaaaggaaaggaagggaaagaaaaggaagggaatggaaaggaagggaaaggaaaggaagggaaaggaagggaagggaagggaagggaagggaatggaaaggaagggaaaggaaaggaagggaaagggaagggaaaggaagggaagggaaaaaaaagaaaaggaagggaagggaatggaaaggaagggaaaggaaaggaagggaagggaagggaaaggaaaggaaaggaagggaaaggaagggaaaggaaaggaagggaagggaagggaaaggaaaggaagggaaaggaagggaacggaaaggaagggaaaggaaaggaagggaagggaagggaagggaagggaaaggaaaggaagggaatggaagggaagggaaggagcgagtttcaaaacaacccgcctgtagagaataaaacgtaaaatgatgctgggaggaagaggatcatctgtgagaacgaagaaaatatttttagggtctgtttttgggttttgattgaagcataagggcggctttttcttttttggacggcttaaaagagaaaaagcgattaaaaagaaattatttgctgtatttttgagtgatccgaaatatccgatccttctcttttttggggaatgaggtcactaaatggcgcaaagaatcagcagaagaaagaaaaatctgaattgttgagggaaggcggtgaataaatgtgcgcagaagaggcgacaaatataatttgtacgcgttttacttggtgtgcgatgggagcggaggg

SEQ ID NO: 22401 - DNA, 2027 bp, Heterodera glycines
cccccgcccttcagagcacgacaaatatttcaacaagaatttttaaaaattgactagagcaatcgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaaattttggtgcactttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcgggggtactgccccgaaaacaaaaaaatcgatttattcaagtgtccgtttggggtactcaaacaattatggggagcaaaaatccaacgcagaattaaagtacaggctatagggaaggtattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaaattttttagagcaagctagctcggcgctcatttcagtgtaagttagtcctttaccggggagtatccctgcaaagtttggtatgcttctgctcaattagcaaaaaatatgagtgatcaaactttcactaaaaagttaagcctaaattttttggcatatttaaaaagcaattaaaaaatttttaaaattttattcacctccattattgatagaaaaagcatcagagagccttattaacttgtaaataaaatttggtgcgtttcagaaccctttctgaaaaaatatttatgaattaattttgcaaaaaataaataaaaacgaaagactcagattttcgaaaattttttttgagccagctagctcggcgctcatttcagtgtaagttagtcctttaccggggagtatccctgcatagtttggtacgcttctgctcaattagcaaaaaatatgagtgatcgaattttcactaaaaaagttaagcctacattttttggcatatttaaaaagcaattaaaaaattttaaaatttaataattttcctgcacccgaaggtactcactccgcctcttcgcggcctcggggagggccttcgcccccccccctcccccgccctt

SEQ ID NO: 22402 - DNA, 1401 bp, Heterodera glycines
  misc_feature (1312)..(1312): n is a, c, g, or t
ttagtgatgctcgagagtctcggtctcgagtctcgactcgagaaaagtctcgggtttttttggtctcggtctcgagtctcgatctcgggttttcaagtctcggtctcgattttcgagactcgagaccgagaccgagacttttttacacccctaatgattgttggcctttggtaacttctatttttataaattttaggttcttttttgttcaaatttgttaatatatgcgtggtccagcgggttgtgttcttggttttgttccttatttttgcgttggatcagttcccctccaagtattattttttcttctcatttttcaaaattaatgtttttttcgatgggagttcaaacacaattttaacaattaaatcgtaaaaatgtcatttttggactaaatctatcaacaaagtgcactaaaaatttcaaaattttctccggcggcgcctaacggcaccgccggcacccaaaactcttacttttattttaaaaaagtagctcaaagacgcaaaatttggtcattttttggacaaaatccgttaacaaattgcagtaaaattaaaaaaaattttcccggcggcgcctatcggcaccgccggaccctgttcccgaaacatttttttgaaaaagagcaccacaaaaaatggtgtaaaaaagtcaatcatatgaaaaggaaaaatgtatggtagcttaaataaggaaaaaaaacaaaaatttttgagaaaaaagctcaaaagattgattttttcgatttttaagtgtgtaagaaaaaatttttgaaaaaagtctagggtttttttggtctcggtctcggggttttgggtctcggtctcgagtctcggggtcgagtcccggtctcggggtcgagtctcggtctcggtctcgagtctcgagtctcgggaaatttttggtctcgagcatcactacaatttttctgcttctgctgttgtgttcattcatcattcagttctatgaagtcacaaaaatgtttttttttgttaaattatttttttacaaaaatccaaattttctcattatcagcacaattatttatcaaattattaattatacacaaaatgaatttgcttggtttttgctgatttcacatttcatcgttattattttcatatttttttttcaagttttacgacctccaaaaatgtgttcactccgttcgcaatgacaaaaatatttttgtgatgatattatgccctcgcaaaatgttccaccccatcaccatcctaatcatttaatcaccacactaatcaaccacatcccacaattttttttttatcatttggtggcctttttgagngggggggggggttggtgtcccgtgacaaaattttgagaggaaaaaccttttattggagtgctcccccccccccccccccctcggagact

SEQ ID NO: 22403 - DNA, 1638 bp, Heterodera glycines
taacgatagagtagctcgcgacggggcccagtcgggaattcccgaaccttcaggcttgtgtccaggtttttgaaaaagtagaacccggccaacggaagggcagccgagaccagtgctggacataattacggactatggcatttttagacctccgtaatagcgaattatggatctccgtaattaaaaaacgccgtaatgacggattgcttagttccgtaattgaaaatcagttacgttcagccatggccgagaccaaccgggaaaatgacatcattgttaaggatttgggaaaattttcgggttttctcggtcgcaggtcaatgccggcccggttttcccaaaaatcgcgaaccgagccactctatttaacatcaagaacattcgaaaattaaattgctttaaatgatgtaatgtatgcattgtttctaaatattaattattaaaaaaatattcagcagttgagatggctaatcaaattatacaaaggtattgattataaaaaattgggcaagaaactatcattaatatcatagaaaacaattaataaattaaattgttccaatacatttatccaattcataataataaaaataatcataattaattttatttttaaatatgcgaaaacttgataacaaatggtaaaaatgcttaatttgcaatctcttctttttttcctcttattttttggctaaaatttttgtaacatgcttcgtttttatcagattttttaatttttcaaaataattgaccaaattcatagggttttggaaatgcgcttgcagtcaaaaacaattgttttacaaaatttggtgttcaaaaagtcttgcactattatttcctctctgaattcattcaagaatgcgccagattgcattgccagattaattttataagacgagctttcattgacttgcttactggtgaagacgccatcaaagccgaaacttgaaattattgggatcaaatttttcaaattagagcttgagggggcggtacttaccgtaaatactctaattacccccccccccccctccccgcccccacgtgtgggtaatggggaataatcataccggaagtaaaattttggattctctaggtggattattctttaaactaattagaaaacccaaatcgtacttccggtaggatcccactctttctgaggaggtcgcaaaatcatccactcgggtggagataattagagagtatttacggtatgcgggattcccgaacggggctcccgtttacgggtttcttaataatatttggttttttgattttctttttaagaaattcttgccttgattcaaagttgaattttccatccgccgctgcttttgaaatatttaatccgtgccattctctgtcgcccatcacttcggcacattccgtgaaattctttttcccattttttcttaatcctgcaccaaaaccccgtccaacttttgcatttggattacccaatgggctttggtagcagacgagaatcctcaaaaaacatttttatgttaatacataataaaaaacatgctactgtcggcaagctttttcaaacaggatcagtccttttttcagtcctttgttgttataacatggtctccaataagcaccgactgatgtcaatgaaattactta

SEQ ID NO: 22404 - DNA, 937 bp, Heterodera glycines
tttttttgaggcgcttttcccaaaaaacttttggggcgcaaggggggccggcggtgccgaaaggcgccgccgggaaaaattttgtaattttcaatgcgatttgttaacagattttgtccgaaaaatgaccaaattttgcgattttgagcaaatttttgcttgtagggaaaaattaagaattttaaccatatttttagcatattttcattaaaaaattctttaaattgccaaacattatgccaatttatcaaaatttaaaatcttctgaggattttccccaaaagcctcaaaaatcctcaaaatttctcaaaaagccacaaaatgaggataaatcctcagatctggcaaccctgcctaaaacgcatgaaaaaagttccaaatttttcaatattaatttaatttgtaggttgtttttttagaaattaataaattttaaattctatttttttctcaaatggtttactaacattttcagccatttatagatttttgtttatatgtatattaatttttaatgaaattgaagaaattttagaaaatttaccctttaatttgggaaagaaaacggatgcccctatttttgtaattttatctccaaatttcactatttttgttccctattttatggccaaatttcgtaattatttgtaaattcatataattacaagcccaaaagcgtacggagtgtgaagagagttagtccgaatgagaatcagaaaagccaaaataaagaaggcgaacaaaatgcaaaaacggacgcaaaaagtgtgcaaattcctgtaaaagtacaaaacaatcaaacaatgttcatctccaatttggatttacatatgacaaaggcgcgaatttttagttacggaaaatcccaaaaagttaattaattactaattaataattagtagggatgcaaattataggggacccacccgtttgggcg

SEQ ID NO: 22405 - DNA, 2636 bp, Heterodera glycines
  misc_feature (46)..(46): n is a, c, g, or t
tgggatttcgattaacgcaattaggtaattagatgcatttatttcncattaatatcaataaaataatttaataaccaaaaaatagacgacgacaaagaaggagaagacaaagaaaaaggaggaaaaggaaagggaggagatgaaaatgaaaatggaaatggaggtggcggtgtgccgcaaccgccaagcgcaggaggaggtggcacttgcacggacaaaggcaccggatgtgagccaggcttttgtagcagcacagactttgctcgggcgcactgtgccggcacatgcaaacacgttttgcaagagtgcagtcatttggcttcggtgcccgacccaggtgggtgatgaaattttaagcatagaaatctggtttctgttatatttttttgtccccgaaaagcaaattcaaaaacaaaaaagaataaatatatatatatatatatgtcgagaattgcgattgagggacagaaaagtctcgaacttggtggtattttacaaaaatattaattaattaattaatttttgacatagtaatgttcttgcctattcagccaaatcatgcaccgaaacggccgagaactgtggcactataccggacatttgcaccgtatgttttttgtcgtttttttaatttattggtttagtcagctagactatgttccctggtctctcttgaaaattaaaaaaacgacaaaatctcgcccggtgggactcgaacccacggcctttcctcaccttggaatgctctaacagactgagctacgggcgctcccttttttaggatgacactttggccgtttgtggttgtgctcacacgtgcaatcgttgccatcaccaggcttcatatatggcacaaggaaggtgcaagaatgtgcagtaatgggatcaattggcacacagattacagtaatggtctgaaagcattggccctatcgtttcccatcatgtaattctaccggacatacaacaaaaataattcatttttaaatctatttttctccaagcttgtcattagggtgtttatttataaagacatattttataaaatatgaaaagatttctaagtaacagaatcatataaaattcaagcccagaagcttattaaaaggcgattagacattaacaataaaattgattaaacaattaatattacttttcgtccccactacagttgggtatcatcatttgccgaaaggtcttccaattatcgcaaaacaataaaagcagcctttgtcacaagccatggatcttcatcccccaattgtccataaactttgtcatgaatttttttgaatgccccataagagaagcaattgctttgccgatcaattcattatttgacgtccccacagggaagcgtttctccgttaccgtaatgcaatttctgattgagtaaagggtgaacgggattttctcaagagattcctctcaaaaaggcgcctaattattaattaatattagatttaaatttataataaaaatgtaccactatttcacgattaatcattttcagttgagaattttttcggcccccgcaaacaaaaaatgtccatcttccaaactttgttgttcatattcttttctcattgataaatacaattgaatgtcacgggttatttccttaaaaataataaaatttaatgaataaaaatttgataaattactcatctaaaatcaaagactgatatattgctccacttttgttacaaggaaaaaacatagcagaaagaccgtccccacagtttacacgtttccgaaacatccaaatacgcgcctttttaatcacgtccccacgttgaccattgcaagcctaatatggtatacaaaaattttttaaaattacataaaataaacaactaatttaccacaagacgtagcatagcaacgtttctgaccaaaaccaaattttttaggcaagttgcctctcctttttaaaaaataaagaatactagaagaatcattacttttttaatcacaccagtatagttttcaattgaagctattgaaattgtccccacactatcatgcacacttgctattcttttaacataagtttgtcccgtaaatgaaagccgcgccgccgctctgttatgcttttgacaaatggccttataaatttgtttttttcgctctggtaataaatatgggccattgttctcgtccccacgaatggtgattgagctttttgctattttaagttttttccgcaaatgtccgtccgcaaatgtccgtccgcaaatgtccgtccgcaaatgtctggtagccaaaacttcttgcccataaaaataataataaatgtattgaaacctcattcaaaaaaattataaaaagacctttgcaatttaatggttgagcggctgagaaagtctcgagggtgggagcaaaaataaaataaatttaaaataatttgagcggcataatgatttccgtgacagtcggtcggcctctgtgcgcgcagggcaaagttcatcaaaaattgtgcgccaaatactagggcagatttttatgtaagagagaaaaaaacgctaattataagtattaaataattatacattgaatagccaaaagatcagttttaaaaaaaatttattaacacagaaatcttagccctttaaaatatgcccaaaaaaaataaa

SEQ ID NO: 22406 - DNA, 979 bp, Heterodera glycines
ccataatttggtttgagtaccccaaacggacacttgaaaaaatgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatgcgcacccgtccgatctggcaagtaagcaacgattgctgactagccaaaaggttcggtgccgtgatgaaacgaaccagcactgct

SEQ ID NO: 22407 - DNA, 1510 bp, Heterodera glycines
aagcagtacctgaagctgaactcagaaaagcggcaacgactcggagaaaccgggcaatttggtccccggagcggtatgaaccacgaaagcgaggcgcaattcgaccaagaatggggatggcactgttgatcatgctcatcaaccttgccggaacgatcagcggccaaccacccattcgagcatcgggaatggacccgaaccttccatttcgagagggcccaagagtcccatgcaccaaggagtgtgcagaacgagttcaacacaacgaggcgcaatgccaatcggaaaacgggttcgaaaacccgttgctacaactcatggacacacgcttcggagcttcaactgtcaaggggcgccgcgggcaatgtcgccaattttttcattggcgacgagaaggcgggtcaatccccgcctattgcacaaatgaacgggacgggactcaatcgaagcaaaaagaatgagggatgttcttggagaagatcggggcgagtcccgattcatcaattcattcaaaattgatcattcctaatttttgccccttttccatccaatttctcatatgcatttctccatttcgtaccattcacattttgcccgttcctttgtcccatttttgccccatcgcatcccttcacaattcaaatcttttctcatcggttggctcatcttcggccaactttgtgctcagcaaatttcctttcacaatttctcacttttcacatctgccaattcacattcaatttttgtgcacccatttcctttgttcgcaattcgcttctagaattttctgtccattttttgtccctctcacaatttgtccacgtgcattgccttttgcccgcccccttcgaaaattgtctatttaagcgcccccggccaaggggtcgctctcctctcttctcttctcttgcttccactccccttcgcttcatattcggtctgcctgtgaccaattcctccaattcccccgtcccatcgcccaattcgatcaattcgtcgcttttattcattattcgttttgctttaataaattcgtgctgaaacggcttggaggactcggaaaggagggaaaagcaccctccacactccatcacattcggcaaattctcgtgcggggccaaacggaggcgcccattcacgtcttgaccccttcctttcctggcagccctcgtcgttctcccccaatcctcccgatcccagttcctttccctttggcattggagaatccgggagttggcccggagcgtcagcgaatttcaagcagttcagactcccgcagccggagtctcgcggatcggtgtcagtctcccgccagccggagcagccgtagggacgggggcgaattcccgtcgtcgacgaaaccaagcaggggcagagagggaaggaagagccgagcggtgccaaacccgtccaccgaaaggggcaggccccgttcgtcgccgctaatcccaccagcccggaaaagcgcgcatcgccgggagtcagtctcccgccagccggaacatccaca

SEQ ID NO: 22408 - DNA, 1323 bp, Heterodera glycines
  misc_feature (1256)..(1256): n is a, c, g, or t
taatcagtagttattaataaccaaaaagtgatttcattgatcagagtaaaagcgaagaaaatgctttgataattgactcattagttgaaagataaattaaaaatggcttatgaccagttacagagattctaatcaatagggctgagatttttaggcatcgcaaaataagtaaaaaggcaaaaaaaaaaatcccgctaattaggcaattaattaaaagcctcgaataggcactaaaacatgcaaataacatttttattaacacttttaggataacaaaacaaataaaaatttaaataaaaaacttcattttggtcaattgtaaatgaaattattaaatattttaaaattttttcgaaaatggataaaaaaatatattttatgagaacattttcaattcttagggtatttttttgattgtatttttaaaggattttctcgaaaattctgaaataagcactaaaaatgaagaaaaaggcataaaaatggccccctaggcattaaacacaaaaaaagaagcaaaaaataggcatcataagattgatcatagaagcctcaaaccaagcttaaaattcattttttttttgttcttttctcaatgcacgcaaattttaggaatttgcctaagaatcccagccctactaatcaatgttcattaacatattggatcactttttaggatggaaaatctatgagcaatgataatttatcacgcatatcataacagtcctgctcatttgtcaagctcatgtgattagaaccccaaatctattctataaaacagcaagaatttgaacatccgtgcggcgtttgtgcacgttttgggcgacctcgtccaatcgctgggcgttctgatcgctgctctgatcatcaaattcaccggctatgccatagccgaccccatctgcacgttcatgttctccattttggttctcgtcaccactgtgcccgtctttggcgacactttgacaattttggtaattaattttttcttagattctattttaattttaaataaacatatttaaatagtcattttgatattcattttgtttaccgaagtatgttttgcaaattcataatcattcatcttttgagtacataaaatctgaacttaattttctaataattaaatcatttcttaacatttttcaatttaaaattaattaaattttaatttatgtttattgatgtcgaacttttgttttttaaatgatttgtgatttaaaactgaatttgaaatcatttcagaataattntcagatggaaagcacccccccgccagatgatctcccaaaagtgtacatgatctgatcggcttgcccg

SEQ ID NO: 22409 - DNA, 3401 bp, Heterodera glycines
aattactgagttagcaccattttttctgatctttttctttcgtcaaattaattttgatcttaatctccaaaataaattttgcttgatcatttttagattttatccgtcaaaaattcacagttctgaaaaattgaatgaattgcagcagtcaatctttacaaaattgatcacttgcactgtgaacaaagccaacaaacaccatggcacaacaaatgatgactttttgtccaaattgcattttgacgttttggcacaaatctgtgaagcggatgatcaaatgaaagaaaatgtgttgaaaaacagtaagccgcaaaaaatttaaaaataaaaatttagtaatttagaaattcatttgaaggattttttaaacgcaaattggtacaaaaaatttttggatttacttgagaaggtaagaattattttttcttcatttgttaatttgttgttacattttggcaaatgctttttccaaaaatacttattttgaatagcaacgaaaatgccaatagaaaagtctaaattttcgcgatttatgttaaaacgttatggccaaaaactatcaaaaaaattataaaaatcctcaaacgtaataaagaataaaaaaatttatcttttttatttaggaggatgaatatttttctgtatccgaaagttttaacgaatctgacggttcagaaaatgaaatatttgatgacccatcagaaacaatcattgaggaaaatgaaaattcaaagaatttaatggaaaaacattcaattaaaaatatgaattttgaatttggtgaaaaaagtgcagaaaaatgtgaaaacaaaaatttcaaaaacaatttaacaacaacaaaaatggatgaaaaaaacagtgacgacgaatttttggcattaaatacagaaaatgaagaacaatggacaaagaaaaaagagcagcagaacaaaaaagcaaaaaatattaatgtaagaaaaaataaaaataataataattcggagaaagaaatgacggaacaaaaaaggaaaggaaaaaatggcaaaaataaattggaagaaaatgatgagaatttaaatttaaataaaaaaaattatggtaaaaagaaaatgatggaaaattttaatgctgaaaatgaacagttaattgagaagaaaaatggaaaaatttgcaagaaaatttttagtgaaattggcgtcaataaattaggaggcaatatttttttcaatttatttttcgtttttttaaattttttattttgtttcaattttaggtataaatttttcaattattaacgctaaattttcttggggtttttgggaaagaaattgtcaaaataaatttttgtttttgcagaaaataaaagtgtcgcttatttttatatttttaacgcttattgcttttttcaatgatttaaaattaaaataatttttattttttaaagaaacatattttaatttatttttttagatttgctggatgaatcaattttcaaaaagatttttcaaaattttttggaaaaacattgggaacctcaaagcatggagaagcaatgcttggaatatttaggcacaattgcattatttgccagagcaattcaagcaaaaatgaattttattgaacaaatgtcgaaacattgggcaaataaatcggtgaatggaattgccaaaaaatgggaacattttatttttaatgaagaaattatattcgaattacaacagcaaaatcaatttgtacaaatcaaattgtattttctgcacaatcagcttgatgaatatgcttttgagtaaatatattactaattcacaaattaattcataaatttgttgcacataaaaaaatggcatttttcgtttccttttagataatagttttgaaattttaatttaataagcacctgtaacacgaaatttgatattttttaacaattaattagcgggaaaatttttaatttgaaagcgtcttttgagggttttcataaagcatcgatgaagaattgttatttattatttgaaactcattatgaaaatatatttaaaaaaattaatttagtctaatatttgtttcaggcaattaataaattttcttgaaaaattttttcatttttcattttgttgggtagggcggggaattcctcccaatttcccccttgacttcgggcctgattataataatttattttagtctattctaaatttttatttatttatttattttattcaggcaatcaataaattttcttgaaaattttattcaaataattgatgaaaatgagacagacaaaatcaaaaattatgggaattattcacctcaatcaccaaataatcaccaaacaacccaatttggcacatataattctgatgaattcaatgcaatttttgccacattggaaatgcatgaatgttcgatgctaattgcaaaaggagtgatcaattttgaaatgatcaaacaaataaaattggcccattatttaaacggtgaaacattttcaaatgcgggaaatccgccgtcaaaaaaatgcttatgtgttgatgctaaaattgagcagcaatatgtcgacaagctaaagaaaatgctaaatcagaaaaaattgggtattttttttaagtttcactaatttaatgttttttgatagttattcaaaatcaaaatttttatattataacttttgtggcaaataattgccaattatgtaattactcgaaactttttattattcatttttaaagtatctatttttagatttatatttacaaacccaaaatttttctgatcccgaatttggtcattacagtatgataagaacaaagatgaaaaatcgcgaaatagaaaaacaaatttctaaggaggttaatttaaattgaaaataataatttttaaatatttgcatttttagattcaaaattttgtgtcacccaaaattaatccgattaaaaaagaagcaataaatatattaaaactaaatatcaaaacatcagtagagaagtggacagctcaatttacagcaattagtaataattattaattaaaattaactaattgatatttcaatttattatttgttttagaacctcgattgcttgttggtggttcacttttaatgaatggctttgtggatggatctgacatggatttgctctgtgttttaccagacgaaattaaatttgaccaattatttaatgaagaggataattgcttatacaaatttcttaaaaaagtaaatttaaaaaaatattataaaaacactacagaaataaattaatttaaatttttaaatatattggctaaaaataatttgaaaattatatttaaataaatttattctttaatcttttgaaaagaaatatattgagtgatttacttttgttttccacactaaaatgcatctaattaattttgaaaagaataataaataattattt

SEQ ID NO: 22410 - DNA, 1207 bp, Heterodera glycines
agaagggtcttcagggcggccccccccccccccaaaaatttttctagatacgccctgccgcccgataagaaaaacttcgaaaatggaaacaaaaaagagcttcccagactcggataaatttcatggttaatccggcaccttttctttaaaaaacataacaaaaaaatcgctgaaaatcttttcaaatttctaaaaatcgctgaaaatcttttcaaaaatttctaattgtaaaactttttttaaaatttctatagctacgggcttgagtgtatcaccgtttttttctgcaggtcctcgccggcgaggaaatagcagagaaccgtctgcggctgagccaacgcgtcaatttccgcaatgtccgcgtcttctacatggaggacctcaagtcgttggtcagccaagggctgtcgccggaaatgcgcgacgccgtgcgaaaagtgagtcagggtgtcctactgattgtgcatatttttttacaaatttacccaatggcgtcgccgcggaaaattttggaaatttttttttttgctttttagaaaaagacaaaaagttcaatataatgggcgggcgggcatcaagacgaaaacccaaaactttcattacattttttttcaaaagaaattaaaaattatttttttactggaaaacatcccactaattgtaagaaatttcatttcgaacaattaaaaaatttcaattttaagggggagggaatgaaattcccccgggtgcttttgtgatgcaatttccaattttttttaactgcagaccgccaagtatttcgagaagaagtacgatttgtgcgcccatcggttggatttgccggtggtccatcgggcgttcgagattttcttggccagcatgaacgaggaggagcacgacaacctgggcaaggccatgtccaacttcgcggtccgtttttggcattttcacatcggaatgggacaacacacaaattgttttttggatttcccataaaattattcacttagaaatgttcggaaaaatccatcaaaaatggaaaaaaaacgaaaattttttagacgaaaggggaaacattttaaataaaacaaaatatgtaagaaatattagaaaaaccccaaaatatttaaacaaaatttttttttatggttttctgaacaaaaatttaggcgagtgaataagcgcaaaatattttaagaatttccataaattcgaaactctttaa

SEQ ID NO: 22411 - DNA, 1567 bp, Heterodera glycines
  misc_feature (35)..(35): n is a, c, g, or t
  misc_feature (1492)..(1492): n is a, c, g, or t
  misc_feature (1503)..(1504): n is a, c, g, or t
  misc_feature (1512)..(1513): n is a, c, g, or t
  misc_feature (1515)..(1516): n is a, c, g, or t
  misc_feature (1518)..(1518): n is a, c, g, or t
ccattttgccaatttttattaaataaagaaaattntgcctttaattatgacatgtattgtggtgtattggttagtgcatcactctgacattactgtctttcataagttcgataaccattgacgttctcatttttaatttatttttttgtgattaatactagagttcgggtacggaccggatccgtatacggatttttacggatccgtagtccgtattttttgggccgatacggatttttacggactacggatttttagtccgtaatccgtatgggtgcctagtccgtactcttggtccttatccgtattttctcaaaataccgatctctaattaatacattttttaaacaaaattatcaataaaaatagaccattcttggcataattgttaacagactaaacccaaattttcaaaaaatttttactttcgttgaaatttaaaattcaattttcatgactaaataaatcatgaaaacaatatatttcaaaatattgacaaaatatcgaaacaattaaatttcaaaattcgcttggccgagtccaaaaattcgtaaatcttattaaaaaaattggctcaaaatcgaaaatattcagcactttttgggcaaaatctgttaacagacccatgcaaattttcaaaaattttcccggcggcgcctatcggcaccgccggacccctttctcctgaaaagtctttagaaaaagcgcgccgagaaaaaaagatggtttgaaaaagaaaaaagtaatcagaaatttttgatcattttttgaataagattcacttttttcaaattgccggatccgaaaccggtttccggattgggaaaaatttaaattttcacatgttaattaatatttgtaaaaaccggcaaaatttcatttattaatatagaaattcgatgcaccagaaatgtcgccgccaaaaagacataatgttgccgacaaaataaaaaattttaaaattttcaagatattaaagcatacaaaaatatttatgataaaaaataaataaataaatataaacaaataaaactttattatggaaattataaaaaattttgactatatggcataaggtaaaaatttaaaaaccccgaaccccgaccccgacccgaacaatttggtcgaccccgaccccgaacgattttgttaaccccgaccccgaccccgaacttgctgactccgacaaccccgaaccccgacttttctaaccccgacgttcgggggtgcaaccctaaaataaagaaaggggctcaaaaatagcatttctgcgttaaaattttttggtttgctgaaggtttttagtccatataaatccatattttgggggttttcgggaataaatccatatttagccatttttgtgtttttagtccatatttcgtccatttttggcaaattttctcaagagaatgcaagaaacagggaaaaatagcaccccctaaagattgattttttggaaattttaaaaattacatcccttaaaaggaanaaaaaaaaaannaaaaaaannannangacctggtagagggaggaggaggcaaaagtgaactgagggacggagaag

SEQ ID NO: 22412 - DNA, 2156 bp, Heterodera glycines
cccacacagctataatgtgctttttcaagcaaacaaattgtttttttcaatgcctttttctttgagttatacgggtgctaattaatttttttcaccgtcaaaagcacggactctccgatggcttatttttttttgtttgaaaaaaattttccaaatttttaaaattaattttaactgttaaaggaattttgtttcctcgaaaaaagcaaatatcatatcgtgtcccgacatttgcggccccgacatttgcgcctttgtccaaaatctggttcaaaactaagttttttcaatcactgatcgcataaatagctttaaataagcgattaaaagtgattgtacatgatcatttgatcttcaaaaaaatgttgaaaaaataataaaattttcaaacaaaaaattattgatcataatgaaccataaaaccgtgttttcttaattttaatgcttattaggctatcaggggttgaaaaaattcaactttgagtccgattttggacataggcgcaaatgtcggggccgcaaaagtcggaccgcaaatgtcggggccgcaaatgtcggggctccgttagaaacctgttttcaatacaaatttaaaccaaaaaattcttttgtcttttttcagcgtctcatacaaacagcggtgtactgtgagggcggttcggtgggctttttccgtggcgacatccgtttgcttgctgacgacatcaaaacattgcgccccactgtgttgccggtggtcccccgtgtgctcaaccgaatctatgacaaagtgttcggcgaagcaaacaaatccgtcttcacgcgactgctctttgacgccgctgttgggctgaaaacgcgcgagctgaacaagtgggttggggtttttttaattttaatgagtgttttttcgttttctgaaattaatgcccccggacatttccagtcccataaccatggggcagaagggtcgtgtaagtagttaacatcccgtacttgtcgtcagtgcgcgaaatgtttttcgcgcacaaacgccagggtgtcgggcggttttgtgtttgaagttgccgcttttggcatgtgttcgggattggtgggggcgggattctctttgaaggggccgacatcccgagggtattggcgggtttcgggaagtgattgattgattgatttatggtcgggagagggggagggggtgctaattgcgcgaaattttgattgatttatggactcgaaaaagggagggtggtggtagggggaatggggaatgcagcgcgagttatcgcaatgcgcgaaaacaatagggaagaaattaaagagggggaggggggggggattaattaatgaaatttgatggtgactgtacgatggattagaaagaatggaaataagcaattctctcattttttttgctcaaacaatttctttttctggggggggggatagattttgaggtcaatgagtgaccattggacgcctttaactattctccaattgattttcgttgcgtaatgccgtccaatggtcatccattggagtcaaaaatctcaccaaaaactttatttatttttttgcttcttttttgttttttgattctcacataattaattgaaataaaaaatttttttcttttacagacaaattgtcggtggcttcaaaacggacctgcgcttccaaccaaatgcgacaacaattttttctacaacgactggggcgggaaattacaccgccaggcgatttgccagcaccaaaaagaaggaagacaacggcatcgcaacggggctgttccgattacatctgcattggtctcagaccaaattgttcaacgaagatcggcaattgtataataaactttacgacaaccgcaccaccgaatatgacgacatcgaaccaacaaatctgcggcgccgttgtccaacatgtcaccaaacataccgatttgtcctggcccgcttctcttccttccgcttccaaacaccttggttgccgaagatgcagaaacaccagtcccgaaaagccggctggattttgttggatgtgtcttttttggtgggttcgattattattattatttgtttttgaaaatttcatgaaataaaggtaaattttgaaaaataaataaatgcttaaacgcataaccatttgttaacccaatttttaaaaattttaaaatttag

SEQ ID NO: 22413 - DNA, 2140 bp, Heterodera glycines
atccgatgagagtaaatttttagcacacacttctttctttgctagcgctagtttaggcaatttttatgattcccaccaaaccgccgccgacactaaaaatcccagaagaatggagcgaaatgtttcaagaattcattgcaatttgcttggtgaagaacccagatgatcgggcagatgccgattcccttttaaaggttcgagtaagaaagacttttctagcgagttttacattttagcacctatttatccaaagcgctaaaggcccaaaagttgtgcgggaaatgatagcaaatgctcaggacattgcggcacagtatttgctgcaaaacgcggtgagcatttgtatattgtaaatttgacgagaaaagattttcagcattatgccaaggcagctaaaggcattgattattacgcgcaactgaacgaggcggcggagggccaaattgagcgggacgcggaggagagaacaatttcgacaaagacgggcctaatgacttatgacggagggacactaatccaacacggagaacagtcgctgaaggcaacggcaggtcgaataacgaataaaataaaaccaaaaaggcaattcagaaaattgtggggtttcggtctctcaaaaggcattccatccgtcggcactctctcagccaattgatgacaatgttagtccaatgaaatcgcattcaaacagaagttaaatgttcattcaggcagaaatgactcaaacggaagccgcaaaaatgaacgttttgtcggcggaattgtcaatggttaaattaacggtggaccaaaagataccaaacactttggacagtcgtcacggagacggcacagttgaattttgggaccagtcgccaagcgcaacatgggaaacgagcggttataacagtgccatggacacggcgtttagacgggcgatgaacggccaaagcgactacagttttgtgagtgttcattatttgggcgggaggggttaatggacgagtttactattgtggggtaactttttaaaaggaagcccccctttccctgagaaagaaaaaacgcgtaattagcaacccgaaacctctgggaatactatgtttattagtttcaaaacaaaattgtcgatgatattaccatctttttatgattgtaaaatttaagctgagggacctttcaacagaagaattggtgaaacggaaggagattttggagaaagagatggagacagaactgaacgagttgcaagcacggtaccacgccaaacgcaaggcgattctcgacgcgatagcactcaaaaggaatgggactgttcagttctgactgcagtataacgcctaggcattttgataacctaccgaatgctattctgtttctttgtcctcctcttggtgagtgtgggatgattataaataatttatggtgtcattaaaattacagcttgctccgtcgttcatttgtaatttataactctctcgatttgatgttatttattaatacagtttcaatcattggccataattactctttgtttatagttctcttcagtttaaattattgtacaaatttatttttcattatttaaatgcatttattagtaatacataaaacaatggtgtgaaataaatgaagcatatctagcgatccaactcacttattaattagcacacgcgatgtgaatgagcaagacgaaaacaaaaagcatggactattctaattaatttcaatcaattgcaaagcaattggacaaaaggttaaggccctatagcccatttggggatggcgccacaatatttttcctacgcgtgtcctccaaacactcgaactgttcagtaaatccctgaggaaagaataaaggtgcaaaaaacaattattgcccgaatatattgaaaatttctcatgagagggggggggggggaacccgcgaagtacgaccaatcattttgctgttaaaaatgaatggcaacggaagagttcagtccgccaatggtcagttgggagcctcgcagaagcgaatggagctgaagtcggctcgcgacttcgtcttttctttgctgccataaaagcacagtgttttccaagtcttttgggctaatagcgtaaggaagacaggcgaagacggctgaatggaaggaaagcataaggaactggaagaaat

SEQ ID NO: 22414 - DNA, 1313 bp, Heterodera glycines
attactgtcaatgggatcatggacaaaaacagggtaagcctccatttttggcattggcaattttcccatggatgatatcatgcttaaaatccgctctcggctgtcatttagcactgaaaatcaattcttgacaggattttgagcattttttgaggaatattttgttaaaattttttctatgaagtataactgatatagaaattttcaatagtttaaaagataataactgccgtatttctcaaaaaatacaaccctccataaataattccccctaagtggtaatgaaaattaagcgccccgccccaaaaaacataaataatttttgatttagcggtgttatatgcatttcattccattttaaatgataatttttccttgttattattaacccgttttttattagaattattcaaatttaatcgattaacaatttgggtaactacaaggcagaattattaatccgaaagtgcctttgacatgctattcaaaccccgtttttcttgccatggtgattacctaaacatttgggatactgtgggacaaatgccgtgccacgaagcgcaaattaaaacccgccggggactaagacgtggaaataaaaggcccatttaaggacgccagtgcgaccatattcgcggcaccaatgtacttctgggaaaaggtaatgctaaaaaaggatataattagtctttttgttttaggtaggcaaaagctcaaaactgaaaaatggcgtacaatttggcattatgtcactatttttgacatttaatttaaaattgttgctatgtagtagagttgagcgggaccgggaccggggcgggaaatcccgggtttttcaggtcccggtcccgtgaaccaaagaaggagtttgggggccgaggagtcggctgcatcagacgccataaaaggtgctggttgatatagagagcaggacggcggccatggaagtcggaatccgctaaggagtgtgtaacaactcacctgccgaatcaactagccctgaaaatggatggcgctggagcgggccacctatactccaccgtcattggcttgtacacgtgcttgtcgcgtagtctggccatgacgtgtaggagggtcgtggtggttgcgttgaaggctttgggcgtgggcccggccggagcttccaccagtgcagatcttggtggtagtagcaaatattcaagtgagatccttgaagactgaagtggagaagggttccacgtgaacagcagttgaatgtgggtcagccgatcctaaggcaccggctagcgccgtaacacactacggatgacgacttttctgtgcttgcgcag

SEQ ID NO: 22415 - DNA, 2849 bp, Heterodera glycines
cggcagaatttgcttctgttttggatcccaagcgactacctaaacgaacggaaaacaaaataaagcattttcagtttcatttgcttccacctctccgtcggcaatgaaatcagtcacttcaccccttttcagtgcgtccggaaagcgtcgcgcaacatccgggaatttgccggtgtggtcctcctggtttctactgaatattttaaaggtgccatccgacaaaagatgaatctgcaactttttaaatgcaatagtgatataaatttcactattccccagcatttcaaagggttcacctgacaccgttcgccgtcatatttccattcgcatgcaaattcagcagtgccaaaacggtccaacaactcttgaatgcctttggtcgggtgcgccaacattggcttcagcggaatgccaggggtcagacggcattcatccgccaatgaagaaatgccggaacggagagccacctcaatgatacggtcgaagttgggacactcactgaaaaaagagaacgattcgaaaacagggatataaaaaatgtaatattttacgaaaactgagactatagaaaattcagaaaacatgagctatgcttaaatctttaggaaaacagtgcctcaactcgctgagattaacgaaacggacgtacccatgacaaatcccgaaaaaaatatattcaactctcccacctgtaaactgttttcaatgtttgcgcatcttcagccatccgatctttgagtttttcgtcgcttaattttttctctggaaattgaactttgtgcatttcatttgactcaataaatcacttttttctctaagttctgtcttagtaaatgcattggccaacgcgacgatcaaagactgttcggccaatccgatgcgcagtttggcttgcaaacagcggacgaggaagcgcgcctcgcattcgatgcacgggacgagcaaagcttggattgccttcactttcttgtccatagactaagtaagcgcaaaacgaaggattcggtccattgactttttaatttaaaggatcataaaaatggggatggtaatactggcacattttcttgaaatcgaaattttaaaatttcgactatttgttggatttcagattcatatttagtcaaaatttcatatttgtaatcagggaatccggaaacttaagaaagttttgaatttgcttattaacctgaactactcttcaaattaccgaccgaaatgccagccattttggcaatttcacgcaaccgattgaagacaagcggcacagtcagtggcggcggtttggccaacattcgctgcgtggaccgactttgttgggccacaatgccaaggtcacccttcactttgaggtcctttttgatcatgtctacctaaaactcattcaaattgataacaatattgaaaatctaaggaatttgaactaattttttttaatagcgataaatcgccaaagtctatgcatttgaccactaaccgttcgcccggtggccccggccaacgctttgataaggtacgcctcggcgatacccagctcaagtccctcatagctcggcccgagtttgttgagacataaatgaactgcgggactcaaatcggacggagaaaggcgaatagcagcgccgaaaaaaccactgagaatgcgaatctgaagatgagaagaaagtaaaaagggtgcgcccggacgaaagattcaagaataaattattcagggcaatttctatcgataaaagcttgacttaaacacaacagacattttccaaccgagaggaggtcgcctcaatgcgctccaatgttttagcaagtgcaagataaggaattctggaagaagagaaagtcatgagcagaaattggcatgaatgcaaatgcccaattggtaacaatatgaaattctaaaaaccaacttctgtccgtccttccatttggtcgtctcaataatctcttcaatggatgccattctgttaatttttataaattgaaagcgtcgaaaattcggcaaaaaagggacgccgcgagcaaatgcaaaggcaagggatgaaaaattgttgacgaatatattgaagacgacaaacgacaaaacaaacaattgattttcagaagaattcaagcgaagtcgttatcctttctagaattcgggtttttggagtgagtgggaaaaagggagagtaaatggcaaaggaaaagaaacgagagtaaaagaaagggaagggagatacagagggaaatttgtctcgcatccctcccttttttacatcccattttttattgcctagtactatctcccgttttctttttctttataattttttctgactttagcgtactatctctttataatagaaagacagcatttgcttcgtgacgtttaaatttttttctgcatgttattgggttggcgcataattattgtcgtttttttgtttaaaccaaaaaaaacttaaagtttagctgagaaaaattttttttttgtatcattttaataaatttatctgttttctacaaaatagcatcaaaaaattttggccaactttcaggagtgtggagaaaaaaattcttgaaccggtttgggtcgaaacggccaaaacttgtttttccagttttaaaccggtctgtggcccagaaacccattgttttttagaactgtcgtattgctgagcttttttcacgtcgaacccaaaaaaccggattcgaatcgatcaatcattcgggtttttatgattttttttttacatttacttgaaaagcacgaaaaattgttttgaaaagttataagataaaactagagtgccacgggaccgggccgggaattcccggtcatccgaggtcccggttcccggtcccgggttttg

SEQ ID NO: 22416 - DNA, 1705 bp, Heterodera glycines
  misc_feature (1653)..(1653): n is a, c, g, or t
gtgacagacgatccaacatctcaagcagcaccctttattcatcttccacaaactcattgcgctcttgtgccagcctgtacggtccatcgagtacaggtggctgcgagttttcgtcacggttttggctcatgatttgtttttgtgtctaaaattttaaaaattaattctttaaatttgaacaaatatttattttgttgaaaaaacacaaaatggtaaaaattgggacaataaaaaaaaaattttaacaaaatttggagtgatagatgcaaaataattcttaataaatggacaaataataaataaattttggcgaaattattatcagactggtgtcaaattacataaatgaatggcacagcggtgtggcgcaagacaaattccagacaatctttttaatttttaacgaaaagataaaagaaacggtgtcaaattacacaaatgagcaggtgtgagggggggcaaagtaaagatgtgaaattaaaaattattggtcaaataaacaaacgcccaacacctgaaagggtgctgtaattatttttaaggagataaaaaattaacagacaaatcaataattaaacttaaatgtatttgttaattcactgaaaaatatttatattattttagaagtaataaaaaatttattttaggaaaataattaattaattaaccttttaattattttaatttctaaattatattttattatacggtcccccatttctttttgcttttaaaagagaaaattgtgaattcaataattgatttttttacttgacccctcccgccttctcgccgcccgctctcgccccccccctgcccccgctgatgacgtcaaattttccctttatgagagcaaattaatgtttattatccattgccaatgtggccgagtggttagtgcgtcagtctggccgcccccctggggttcggatccgcttggtgcggggaatttttggagaattttaaatgaatttaaattcaacgtctttgacctttaagacatttaaaataatttaaaattaaataaatttaattaaaataatttgcataaagtcgcgcagtcaaaaaagtcgcgcaccccccctgcaataggtttgggtttgcaagaaaaaagtcgcgcaataggtttgggtttcaagaaaaagtcgcgcaataggttttggcttcagtactgaaaagtctggcgctcagatggcccgcgctcacctggcggcgctcaaatggctggcgctcagttggccatacacccctcccacacctatggggggctaccgtaatccggtgaaatggtcgcctctaactactcgcagttatcaaatgtacaagcccgatcaaagccaccgcattattatgggaatccgggaaaatgatatgtctggggacaaaaagtctgatagactgtgaaaatgctataaaaatttttatagaaataattaagggttcggggtgcccgggggcttcttacaccggacacactgttgaaaatattgtttcgacctttaaattcggtcatgaaattgaactgaacgaatttagaaaaaatcgtcgtgccttttacgaacccgaaatattttgcggtttaaatttcaagcggggtaaaagcatgacagcgttaattttctggaccggtaaagtcgtaattacgggaactanaaacaattctgaaattgatgaaatgtatcattatatgcttccctatctgaaa

SEQ ID NO: 22417 - DNA, 2034 bp, Heterodera glycines
aaaaaattctggaaatgaacccatgattcaaatttataaatttgcaatatttcttatagccggtattgtaaacaaaccagttttggcacttcccaccaatttgggttcggcaccaattgacggcaccgcagaaggatccattatgagaggatgctgatgcgcgacacgaagagatggactaaattgatgaatgaaaaatgaatgactgtttgttatttagaagaaggggcaaataaagcgggaaaatgccaaaatattgtttttggcattgtcattttagtctaggcggattatgggcaggaatccctttgaacatggcacaaattgccgacgtcggcacgcgccgtttcggatttgaagccgtaccattaccaaatttccagcaattgtaattaattttcaatgcttggccaaatgccccggtgaaaaccttcacgaaatatgccaaaaaaaaaaacaaatttcacttgtaaacaacggattaattaatggcaaattaataatttgggacaaatcaactattaatcatgtatgattcatcagactcatatctgttgtgaaattcaaaaataaaagcatcagaagtcgagcaagtttttttgtaatccttgacttcttttagtacgagaatatttataaaaatggtttttagaaaatatttattttataaaaatggttttataaaatatttattttttcattttaaagaaagtttataaaaattattttgaaaactttcatttttatgattttttcggaaatttttaataaaaattttacataaagaaattatgtgatatttggattaatgagtcaattttcatttgctacagtaatcgccggcacacttaccgtagctcggcttgtcgaaccagcaaaatgatgatggtaacagcgatatataggcatttcaatcaacggaaagcttgtgaaaattgaaattaaatgggaataaatgggaaacccgagacgaattaatgcggtggtggtgttggcgaaacgcccacataaaacacaattttttaaaacaattagccacgagaatgggcccaaaaaacggaacggcacgccgacggggcacggcacttgttgttaattatgttgaattggtgcagctgctgttgctgttaccataccaacacaaaggaaaagccgccccgaagcaatgtgccaaatttcagccggtcgcagccagttgaacgccgccgtttgggcgccgtataaatttgaaaagagaaagctgagttgggcggttaaaatgccgacaaatttgctggactgggtacgacccattgaagaaacaaagagttgttagtgagctttggtttttaaccttgtttgaatcaacttttgaacaataattatcgagaattagggcgaaagggctgcaatttaacggtaggggtcaactccgtctggccaactccgtcacagcaatgttcaaaaagctataacttttttctttgttggccaaactttacaatcataatatcattcgaaagccctagatgtttagaagatatttataagctatttttcagtgattaatcagctctcaaaaaagttgtcagtttaaaaccgcaaaaaaggcagaattttcaaagttttttatttctatctttttttatagttcgaaattttctgtaatttttagtaggctaatagagcctgtgaagagctttcgaatgatatcaagattgtttgattcggtcaataacttcaagagttatattgactcaaagttggctcagacggagttggccagacggagttggcccgttccggcaatttaaggcgcccgagaaattttttcaaatttatgtatttatatgttgtagagtgtttgaggccggaaatttgcgtaaaagtcgggacctgtagcatggcctgaaccgagttttgtttttcatttaaaaaacaattaatttttgttcaatcagaaaattttgcaaactcatcctcacacaaatcaaatccatcattttttgaccggtactttctttttttggggccccaattcacataaaaaaatca

SEQ ID NO: 22418 - DNA, 1414 bp, Heterodera glycines
  misc_feature (66)..(66): n is a, c, g, or t
gaacaaaaagcagtgtcaacaaagcgcagtgaaacgcaaattgaaggcagcagcagaacaacttancagcgcaaagcccacgacaaacaactcacaatggcaagcctaatccagaagggcatcacattcacactcaaggcgctggataatgccagaacaaccacggcactttcactacatccagacgccgacctctcaaactgggaaaacgcagtcaaattggaggctcaatgcacacgcgtcagcagagaagtccaaacaattgaagcacaactggacaatctacgcgacctctccaacaattggattgacctactaaaccgcctcgaaggatcagaaaaagacaaaggcgagaaagaatacgtcaaattcgacacgtatgagaaaattgctgaacgccatgacgcagccacaaccaaacttcgggatctgcgggatctcgaagcaacgctcagtgccgatgccaaactttaccgaggcagagcagaaagagaagcaagagcggatcagcaagcaaatccgccaccacaaattgcaacgccaccaatggcagctcctacattcacggcaccgctctatcaattccagccaatccagctggacaaattcttcggtcaaaagcgaaaatggcccgaattctacgagtccttcaaatcggccatcggcagccaatcaatcagcaaagcacagaagctgaacttgctccgcaatcttctgggcggagaagcacgggaactcatcgctgggttccgcctggaggaccaaaactacgagacggtccttcagttgctgaaggacacttacggcgcacctgaagagcacatcagggcgctacactttgagctggccaatctcaagacgtgccgaagtctccgagacacaaaagacttcctgcttcagctcgaacgactgacaagagagctgaacaatgccggagaggacatcgagggaccgcaggtgttcctcatgttggagaaaaagctgactccagcattcctacgcaacatcctcaacaaaaagggagaggatccggcaaattggacaacaacaaaattccgggacgtacttaacgaagcagtccgcaaggaagtccaaattcaagaggtgatgggtgagtacggacaccaccatcagcaactcaatcgaccagcaaggccgcaaacacaagcacatcaaactcagcgagcacgcataccgacagcaaatttccggaacagaaatgcatctcccgccaatcgggaacgcactttcatgtcctcaacaattgaggaggttcagcaacgaatgaaccacagaccgcaactgcgaaagtcccaacagaggggatcaaggccaactcaagtgccttacaacgtgccaatccggaatggcacagcagaagcagggtcaaggaatccgccttcaccctgcatct

SEQ ID NO: 22419 - DNA, 1366 bp, Heterodera glycines
ttatttttataaaatactttttcagaacagagttctgaatttttttctgaaaaatcgaatttttccagaaattctggaataacttatttattttggaagatagcaattccaaatgaatctcataaaattctcctaattttttgctatttttcaaactttattccactaaatttgatcaaaaacgaagagagttatgaattttcgaaatttcactggattttccggggctcaaattttgacgatttttcaaaatttgtaaccaccttccaaaaagtctgaaaccaaaaataaagtatatattcgtcttcagcaccataaattaggccataaaaatgcattttggctaatttaggagcaaaaaaatttttcatgaaatgcaaaaccatggggtcccccctttggttttgaatttcaaaattcatttttattttataactttttttaaattcaagataaaaacatgagataaagcacattatattgggctttaaattctctacaaaaatgctcttagacgattttttgataaaatcaactcctgacaagttattgcgccagaactgaaattgaggcctagcaaccaaatttttctatttccaaaaaaattttgaaaaatttttctgaaaatcacactaatcgatagagcatgaaaaacggttgcttgaaagtggtcttggtttttccgagaaaaatcagcaaaaaatactaaaattcaaaaaccccaaaagtgacaagggggcctagctggaaaatttctgaaaattttcagaatttaaaaaattcacaagatagagctcggcgagctgtacaataagttcgctggtgacgacccgctcagcgtaacccccagcgagttattcccgaaaaccgaaaatccggtttttggcttttcaatttttagccacgcgtaccgggaatacggtaggtcgtagagaaaaatgtttgctggcgaacttgtagggcacacttcaacttaaaatcctcccagcaagcattttttgatcagagcaaaacccatcgtttcacaggctcttgaaaaaacgaaaaagccatttcagcgccgctggcgctcagttggccaccggaccggaatgcccctatttttcccggatgcgccgtcaaaagttacccctgcctgcaaaatttcagatccccccgattagccgttcccgagatttttgttttagcaatgagttgcactgttgttctaaggtatataaactagcgtgttggaattgacgggggcggcgtaggcaattggcttttggatgaagagaaaatggacatgctcatttgttattttaaaacatacaaaacattaattgcattagtgtgctgttttaaagcgctatcgcgctatgggacg

SEQ ID NO: 22420 - DNA, 2712 bp, Heterodera glycines
  misc_feature (670)..(670): n is a, c, g, or t
  misc_feature (676)..(676): n is a, c, g, or t
  misc_feature (839)..(839): n is a, c, g, or t
  misc_feature (842)..(843): n is a, c, g, or t
  misc_feature (938)..(938): n is a, c, g, or t
tgagcagcccgtactgcttgaagtgctctgctgctgggaacgccgtcgcctgtggcaacggtgggcaaatttggccacgccgttgcgccgctgccatctgctgggcctcggatggcaatgcctcagcagacggagtacggtatcgcgcaaaagggcacggtagcgacgggagacgagacagtacaggcagaaattgagggaagcgttcagaaacaccaactgctgactgatgcacgtgtagaggacggcgcccgtgtcataataatggccatgccttgggttgaaattcaatagtgatcgaatgatttaaaaatttggcattccgtcccaccattcgtaaaggaggcgagccggcacttgtgggccaatgcagacaaacagcagaagcacaaccgcaaaaagcatcgcatttgcgttcagtctttgctgctgctgctgggcatggccatcctcgagaataatctgaaggaaaagccggggaaagtgacgaagcgaatgggaaagaaggaaggacgacgcaagggggcaatgctcctccccatttgtacgttgaattgaaactcggaaaattgacggaggattaactgccggcaccgctggctacacacgaagaaaaaatggcatgaaaattcaatgatgggggggagtgcccggaagcgaactcaatgcncaaggngggatttctttacgaaatcattcatgggttgaaaaagtacatttgtaacgacgactccgccgctccgttcttccgcaactgcgactgttgttgcagtgccagcggaggcggaagagtcgcgccgaacgatgcgacggagggtgaaaacgagctgaaagttganggnnacggagaggagaaggatggggagccaagttgaacagcacaagggacaaccaatccatcagacggtaataagcctttaaccgggggaaaacagagnggggtaattaagggagaagtaattagagggagggacaattcacaaggggagaattgtgggccataagggaattgaaatgccatcaaaatggaagggtttcagcatagtcaatagatggagtattggtcattcacaatgcactcgtttgggatgccgtggcactttcggcacaatttcaaaacaatcgttagccttttaattttccacttccattcgccccttttcaatcgaccttcctcccttcactgacttggagtgtttgcgactgtcgaatggttaccaccttatagaagaagggaattgaattgaattgttccgacatcaacaagttctgtccgtttcgcttttcagtctcaccgaaaagtgctgctgctgctcttcccccggctgctcattcccttcgccctcacattggaccacagtccatgccaatggccaaaagcatttaaaattgaatttcaattcaaaatcactctctccactctcttaccattgcacactgcaaatcattcccaaggccaatgccccgccgacgacggccaacgcttttccccctcccaccaaaatgcgcgcgcggtgggcccaaagcggacgacaaacgcacagatagcgctccacattaaaagcgaccacaattctgacgaggaaagtgaattattattaggcaatttatttcattttttaatttgaaattggacggacaaaatggacgccttgtaaaaagtggaggcgaacattcgaatgatcagaacgacacgcgtgtggacggcgatcaaatggggcgaaagagtgggcaaaagggaggtcggagtgagctcgaggacggcgaagagcagaaaaagtgagtcgaacaaagccaaagagaccaacagatgcctaaaggggcgatgattggcggaactgattattgccatggcatggacaaagaaagaagtgatcagctgatcagaagcaaactcatggcaccgactgaccaggacggcatccgccgagcctccgacgtagccaaaaccaaaaggttgagtccgttgcaaaggaggccgacagtggcgataacccaaaggaatggacaatgactttaaatgcaaatatttgcactgaattgataccggaagtgacaccgaattggtccaccaaagcacagaaaggacggcactctgatgatttaaaatgcaattggaccaccatttgaaaagtgatcggacagttcattcacctcgtgcaacgacgggtcgtccgccatttcgttgtcccccgcctcatcggaatgaatggcacaagcggagggcaaagacaactctgatcggtggtgccttccgccgaccattgaactgatcgaaaaggacaaagtgcgcgagagagggggggggggggggggaattgttgagaaagtgggaggggccgagtgaatcaacaaacgaatgagtgaacagcaaatgcagtgccccccccctgtgtctgtcccccctttctttcgcccgccccgtcgttgtccattcttccgtccaatttttgtttgaacagtcccttccccaccccttttatccattgcgcttttgaagaatgaataaatttggtgagcagggaaaagcgttgatgctggtgacggagatgaacatgacagaatgacagagaatgaatgaatgatcgcattgtgctgatgatccgcaaacgaaaacaaagtgtaaagcatttgccacgattcatttgttgtttttgagcggattgatcgctttttgaatttgaatttaaagtgatggaaagcaatcaatga

SEQ ID NO: 22421 - DNA, 1245 bp, Heterodera glycines
  misc_feature (79)..(79): n is a, c, g, or t
ccagcaaatgtcgcaccacgataaaatccagtatataactttttaaatttactttcttattcttttctatcaaaaattnggcgtaaaagatttgttttacgcaaaatttatcccaaataattaatattcaaaaatttttaatttttcaaataaaaaactaaaaatataattgctaaaatccagtaccaacggcgggcgaaagcgtcgtgaatgaaccattgtgtcgtaattaataatgacctcattttatttttgattttatgatatttttggcattttgttttaatgtttgtgatttcgtttttgttttcttttttgtcctcggactttaatttggaattgcctgacataaaataataaggctttattctgtgtgcttcaattgtgtgtaagtgctgaactgttcgacgtgctgctgagtaaaatcaaattatttgtacgtggcgctcctgcaaaaaggtgtggtcgacgcgggttttatacggggaattgtagaagtaggaaattctacaaagtcttcaactactgcggcgacaaaaaagtaaaaagtgaaaagaaattcaccaacgatttgtcagctcggtaaagtaattccgtctacaaagctgattcgacaaaaagggtaaagtaattcccatcgacatttcatcttctacagaacggaaattttgtgaaattcatcagttttcttctcaccgaattcgacaagtgaaattttgtggaaaagggcgaagtaatgcctaatcttcggtcgcctccgcttactcgtcaaagagcactcaacctcggcattcgtctaaataacaacgcaaaccagcagggggggcaacaaattgtagaaccacagcacctagcagaccgacgtttggaaaacgaggctcgccataattctgtctcttcagttgcttcatcacttttggacccaactgaaattcgccgacgcctgctcatgtctggaattggagaaaatgctgctggagttgagaacggaccgcaagatgagcaacaattcgacgcactgctgaaccagcatggtaacgacttgtttcaaaatgaaaatcggggagaaaattttgagagggacgtttttcaaccggtggtcagagaaccgccgttgcaattttcggaaaattttgaaaatggtccgaggcaatatgagttagttggggtacggcctgttgtgacttcgacgccccatgccgtgcaaccacaaagggcgacaaactctgaaaccctaaacccggg

SEQ ID NO: 22422 - DNA, 1405 bp, Heterodera glycines
  misc_feature (1277)..(1277): n is a, c, g, or t
  misc_feature (1355)..(1355): n is a, c, g, or t
  misc_feature (1366)..(1366): n is a, c, g, or t
tggaggctgtaattttctgtagtcatttgatatgcatctgctatttttctagtcacaaccaccaatatttttcggcccgaattttataggcgtgaaaaagtactgatttccaacttctttctattcggatacacccaaaattgaaaaagcatctgtaattcagcctcttttaaatcttaatttttctgaaacccgaatttagaaaatatgaatgtatttctgcgacgctttctatacttaattcatccataatgggccaaaaatcataggttaagaccaaaagagggattttagtttcagccggaatttctataaaaatgttcgtgtgtaacctatctttgtctattcggataagtaagaaattgaaatattcgtattactttgcctcccttaaagctttataatgaaagcgtcgttgtctatttaggatttgccgtcgcaattctgtaattccactttggaatccaaaggaatttgattcgcttttacaaaatagacagtgccgaaatttgtagatcggctaaaccttaactgaaacataccatatcagcgagacgccatgctgatttgttgtaatcataataaaaaggcccctattgtttaattctgcctttcctataagcacaatgtgtttgatgggctctacaaaatattgcttgtgcaaagcaattattttcttggaggctgtaattttctgtagtcatttgatatgcatctgctatttttctagtcacaaacaccaatatttttcggcccgaattttataggcgtgaaaagtactgatttccaacttctttctattcggatacacccaaaatttgaaaagcatctgtaatttagcctcttttaaatcttaattttctgaaacccgaatttagaaaatatgaatgtatttctgcgacgccttctatacttaattcatccataatgggccaaaaatcataggttaagaccaaaagagggattttagtttcagccggaatttctataaaaatgttcgtgtgtaacctatctttgtctattcggataagtaagaaattgaaatattcgtattactttttctcccttaaagctttataatgaaagcgtcgttgtctatttaggatttgccgtcgcaattctgtaattccactttggaatccaaaggaatttgattcgcttttacaaaatagacagtgccgaaatttgtagatcggctaaaccttaactgaacataccatatcagcgagacgccatgctgatttgttgtaatcatataaaaaggcccctatttgttnaaatctgctttcctatatagcacatgtgtttgatgggctctacaaaatattgcttgtgcaaagcaatattttcttggnagggctgtaantttctgagtcatttgatatgcatctgctatttttctagt

SEQ ID NO: 22423 - DNA, 1836 bp, Heterodera glycines
  misc_feature (148)..(148): n is a, c, g, or t
  misc_feature (152)..(153): n is a, c, g, or t
  misc_feature (157)..(157): n is a, c, g, or t
catctcccttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaggngggnntagngcaagctagctcggcgctcatttcagtgtaagttagtcctttaccggggagtatccctgcaaagtttggtatgcttctgctcaagtagcaaaaaatatgagtgatcaaactttcactaaaaagttaagcctaaattttttggcatatttaaaaagcaattaaaaaatttttaaaattttattcacctccattattgatagaaaaagcatcagagagccttattaacttgtaaataaaatttggtgcgtttcagaaccctttctgaaaaaatatttatgaattaattttgcaaaaaataaataaaaacgaaagactcagattttcgaaaattttttttgagccagctagctcggcgctcatttcagtgtaagttagtcctttaccggggagtatccctgcatagtttggtacgcttctgctcaattagcaaaaaatatgagtgatcgaattttcactaaaaaagttaagcctacattttttggcatatttaaaaagcaattaaaaaattttaaaatttaataattttcctgcaccgaaggtactcactcggcctcttcgcggcctcgtggtgggccttcgcccccccccctcccacgcccttcagagcacgacaaatatttcaacaaaaattttgaaatcatgtttcccactcccttctcccaggggtattattttgtaaagtctttttttccccaataaacttgtcaaaccccatttttcgcaccgtgaatgttatttttattgaattctgaaccgttttgagtagattagactataaaaaattgaaaattttgaaatcatgtttcccactcccttctcccaggggtattattttgtaaagtcttttttcccaaataaacttttcaaaccccttttttcgcaccgtgaatgttatttttattgaattctgagccggtttgagtagattagactagaaaaaattgaaaattttgaaatcatgtttcccactcccttctcccaggggtattattttgtaaagtctttttttccccaataaacttgtcaaaccccatttttcgcaccgtgaatgttatttttattgaattctgaaccggtttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattatactagaaaaaattgaaaattttgaaatcatgtttcccactcccttctcccaggggtattattttgtaaagtctttttttcccaataaacttttcaaaccccatttttttcaccccgaatgttatttttattgaattctgaaaccgttttgagtagattatactaaaaaaaaatgaaaattttgaaatcatgtttcccactcccctctcccccggggattattttgtgaagctttttttccccataaaattggcaaaccccctttttcgccccgggaatgttattttatttgaattctgaaccgttttgagaaaattaaactataaaaaaattgaaaattttgaaaacatgtttccccctccctttctcccaggggtatatttttgaaaagctttttttccccaaaaaatcttgcaaccccctttttttc

SEQ ID NO: 22424 - DNA, 1409 bp, Heterodera glycines
  misc_feature (1239)..(1240): n is a, c, g, or t
tttcttggtgcttgattcttttcaatggtgaccaccatcaatcgtctgcgaatgtcttcttcgtccattatttcttctgaaaagtttgaatttccgtgtctttccccaatataaatcccgcgagttcaacaggagagatcggtggaaaattttggatttgctgattttgaaacccgttccctctgtcatttcgttcgtttagttgcgaatcgtgttgccgttcgttatccattgaatttgctcttcttggattcagctgatttccgtctcggtcgacaacaacaccagtattaatgcacgctgacgtgtcaaaattgggcttcttccaaaaaccatctttctctcgttatgaggcaaactaagcaccggcccggtgtcaatagttctttcggtgatgaagacagaaaaagaggttcggcccgaactcaacttttccgacacaagtttattttggtgaacgatgatttttggctttccggcccggaatagccaattctccactccaatttatatcgtccgatccggactgatatttttcacgcaacaaagttaaaccccttttcaaaacaatttctccgatctcaccctaactcttattttgtcaccaccacttttgtacctgttcctcaggagcgccaaattgtaatttttccgggtcttttgggttgagaggcagggataaaaccgaataaggataccggagtcaattcaaatcactttaatcacaacacaaaatttaaaagagaaagagaacaaacaaatttggttgaagtcaatcaaaaagaaaagattgagaagaataaaaagaacaattcttaattgaaaaaaataacgccataacaaaagaaaatacattaagccaagaaatatttaaataattatagtcaattaattatcaaaatacaacatccctcaacaatcaaaaaaaggcgtccccgcctttcagcctttttgaaccgaaaggggtgtccaacaggtagttcaacggcgggtggggcgaaactcgcggtggcgcctattgtttggatcgctgtggtcaatttcataaggccgatagcgagtgtttgaacggtcagcggcacgaatttgcccggagctcgaaacaactcgacgatgatcggcccgatctctcgccgattgtcccaagttcacatttcccgatcggtgatcggcacgatctcccgacggaatgacgacagtggagcggattgtgcggatgtgcatgtcaatgtcacctgnngaaagggggtttgtgacagaatccatgcacgaagtgcgcgacatcctgcatttttcattttcccattctcttccaccatatgcatattgaaatgctctccaaagcgggagatttccaatgccgaacgggcatttggcggcggtacaaatttggaaggattttgaggggg

SEQ ID NO: 22425 - DNA, 1628 bp, Heterodera glycines
ctttatcgagagttccgataaaatgggaccaagtagagttaaagagtaaggaagatgtgccttttttgttaacaattgacgaagatcagagaattgacaagcaaatgttggaaaaggagactgtggtggacccaattttggcccaagttattagtaaagtgaaggataattgggcggaaccagtgaatgaagatttaaatccgtttttcagggaaagagcaaatttatttttggaaggaaatttaatccggaaaaggccgggaatgcaaattgtaattccccacagaatgcaaaaccaaattctaaaattaattcatagggcccattttggtattgtgcgaagcaaggcaagggcaagaggcattgtatggtggccgaatttagcgaatgagatggaaaattatgtaaaaagttgtgaaatttgccaaagaaatgcgccaagcgcaccgagaacagacccggagtacaaatggccagaagccagatatccgttcgagcgggtacatatggaccttgcagggccaatttggggaacgaatttcctaattttggttgactcatattcaaaatatccatttgtatgccaaatgcaatcaactcactcaacatcagtaataaattaccttagggaaatatttggaatgtttggctctcctaaatgtttggtcaccgacaatggtcggcaatttgtgtcagaagagtttgagagttttatgactaatgagggagttaggcatttgacgacagcaacatatcacccagcatcaaatggggaagccgaaagatttgtgagaacatttaaagagagtatggttaaattgctggcagagggaatgaatataaaggtcgcccaattcacgtttttgcaagaatatagagcgaccccgtcggcagtaaatgaaggggaaagtccggcacatcaatttttgggcaaagagttgcgtaccgcgctggataaaataagaatgcctcaaatgcctgaggcgaatagggatggaactcatactggagaaccaatccaaaagggggagcaaatgcaacagcagggaaatttgaaaaattttgaccctggagaccctatatggtacaaggaaccgaatggaaaatgggtacgggctgtacttatacaaccgttgggggagaggatgtgggagatccaaacagaaggaagcaccatgaccagaagggtccatttggaccaaataaaagggaggcgaattggtccggcgcgccatatttgagcattagcatgaaagagcgttgctgactttgtatataaaacaaaaagccccattgctttgtataatttccctatatatataaaaaaaaaaagaaagaaaaacttttttaattaatttaagcatttttctcccatttatcagtaatccttaccaaaaaaaaaaattaataataatgagtgctgaaacaccttccaattcggcggacatttcaaaaatggaaaaggaattattagctaccatgaaaacaaaagggcgtgaacagctgagaaaggacatcggcgccatgtttgaccaactgcaaaatgttgtgggagaggaaattgccggcctatgggctaaaattgagccatgtctgactgagcaggtgggagtcaaaaaaaaaaaaat

SEQ ID NO: 22426 - DNA, 1535 bp, Heterodera glycines
ccccccccccccgaaaacatcaaaaagtaaaaaattttcagtaaattttttgaaattttaagcaatcttcttaacaaaattgcattaaaatactcaaaaattttccaggcgacgcctatcggcaccgccggacccccattttaccatatttttaaaaaattgaggccaaaatggcaaaaaatagtaattttttggcgaaaacggcgaaaatttttgcaaaatataccccctaattcgggattcaaaaaagcaaaaatacacccctaaaaatcgaatttttgtcttcagcctcccccccccgaagccaagggtctggctacgcccttgggtcaaagggatgggccaatcaaagcaatgaatgaacttcccgcgcatgcatattcccatcaatccaaaacatgcgttttttgagcacttttctcaagttttttggttatgctccgaattgacgtctatgggaaaatctgtccgttatatctcatctagagcttttaaatgataccaaattagtcatttttcgatccttttaaaaatcccccctctatataagtcagaagtgccgaaacagccaaaaagtgacaaagtgaaaatttcacattttgattagtttatatatgcgcacacatcaacaataatacatatagatacaattcaaatgatcgggtgtattgacaattacaatatggggcattatgacagtttatgggcacgccgacaaaacaatttcaagtgatcgggggtatagacaattacaatatggggcattatgacagtttatggacacggtgacaacgcaatacattcgcaaatgatcatattccatcctgacgatccctccgtcatcggccggcccggcgacgtcagcagcagctcagccccgtcgcatggtggagttcagtgcctgcacgagggcgttgagcgcgttcacgttgatgttcagctttgacgccttgttttgtgcataactgaaaaaattaaaatttcatttttgttgatgcaaatttgaaaacccaccgaagaatcacgaagtaaatgtagaggtactggtcgagcgtctgtatgctttgcgatcgttggcgccggaggtcacggatgagagcgaagatgttgagaggctggccgaggtgcagcgtttggttggccaagtacaccgccacgagcgttccagtgcgtccgatgcctgcaatgggaaaaatgattaatttttcaatgtttttgtttccgttaactcaccagctgaacagtgcacaaccgctcgggggacgccgatcacatggtacagcaggcgcagtggagcaaggtcgctgtggggcactccgcggtcgggccattgtcgccagtggaagtgttgaacgcgcaagtggccctgtcgcatctgcggtgctccaacgatgaggtccgtcctgtagagcgcgccttccacgtggtattcgcgcccgaatttgacaatgagagggttgttggcgaagcacatgagctaggagggaatcgggggagattaattgttaaattgggtaaaatttcaaaacccacct

SEQ ID NO: 22427 - DNA, 1818 bp, Heterodera glycines
tccctcttctctttttctctctctctctctcttcctctctttagtgtttttctctctctctcttcctctctctccttctctttttctctctctctctctcctcttctctccctcctcttttctctctctctctcctcttttctatctctctcctcttgtctctccttttttctttctctctctctcctcttttctatctctctcctcttctctccctcctcttctctctctctctactccttctatctctctccttttttctttctctctcccccctctctctcgcttctcttatttttatctctctctttctcttatttgtctctgtctcattcactcccatactttctctctcttttttcctgtttctctaatcatttctctctcctttactctccgctctttgttcctaactgtcttcatctctctctcttcttcactctttcttacaatacaacttatctctattatctctgttttttcacttcatttcttccatccaaataaaaacaatcgcgtcaaaactttatttaaattttttgtttaatttgtgacatacattacgaagattttatataggataccctaaaagcggagtaaaataaatttaaaaaaaaatcggtttatgcagtttacgggccacaattttaattcacatttagacaaaaggcgttaaaaaatacagagcaattgaccaagaaccaatcaatatattttaaatggaccgtttcgttttattccgaaatttaatttttaaaaatgtagcccattagctgcataagtgacccaaaagtccttagcgaaatattcgtgagtacatcttataggtatgtcagccttttctggctgttttgttgttttcgatttttccaataatgaagaaatatgtgctcgctcataacacaaaaaagacgtaaacaacaaacagaaaagaaaaaaagactgaactattttccaaaaggaattcgtttcgataaattgtttacttttaaatgtattagttacagcgcaaaattaatatatagatgcgatataattaggagggggcgggggtgggggatggaaaaaaaaattcaaattactatacaaaggatggtaaaaataacaattcaagcatttaatttaaaaaccaaattataatttgacacataggatacgcaaggggggttcatggaaaattattaattctttaattaaaaatgtcagttcaagaaaaggaacataaatttttcgttttttaatattttacgaaaattaattctcaactaatgtttttttttaattttatgaaaggaagtataaagacaaaaatattttaaaaaattagaataaaacaatgattgtggtggtggaaagatgaggaggaggagaaggcttctcgaatgaaaagcgcaacacataatttgttggttgggatgacaactaacaacaaacaagcaaatgtatgtgtgtgtgtgtgtgagatgtgatctctcccgcttggtcgtctctttttggtcaattgagttgccttcccggcgccatgccgcccccgccccgaggggcgactgctgtgtttatcggtgaaaagacacccccacccccacccacccacgccacacgcaaaaggacacaacgacgaggcgcgaaattaacgccaattatgtatcgacctgctgctgcttgaatccaactgttactggttggtggtggtgggtggtagtgcactcactgctcactcacttactcactcaaccgcaagcagtatggaaataaaatttagggtcgaagaaatttccctaattaattaattgttagggtatggaagcgtagggagga

SEQ ID NO: 22428 - DNA, 2312 bp, Heterodera glycines
  misc_feature (55)..(55): n is a, c, g, or t
  misc_feature (57)..(57): n is a, c, g, or t
taaattacaaataaatatttaaatgcacagtgcaccctcttggaacacgaacagngnacgaaaccatgagggaaatatactttattaaatattttataagatgtaatgaataaaaaataactcaagattaatttttcaattaaagaattaaataatttttctcataaaatttttattaattttggaatttttttaaatatcctattaaacattcaaaataataataataattttggcagaagagacattttcacacaatgaatattataattgcttaaaatgttgaattgtacatatttttagagctcgttaaaaaataatttacgggagcgggagccgggagcgtgagttcgaagtcttacgggagcgggagcggcaatcccgtaaactcccgctctcgtgaaaatcccgtcatttttaacgggagtcccgggcgggagtaattcgaaaatttaattaaaaactcacaaaaatatttttaatgcacaaatttgaaggacaatctttttattaaaggaaaaatatgtaagcagaaaactagaaaaatcagattttgggtcgaaaaccagaaaattttttcaaattagttcaaataaattttttttataattattctaacaaaaaaaaattttaactttatattttcgacttcctttcttaatgttaacaactttttacggcgtattttttgaaaaaaaaatttttgtgcatcaggtaggaggtgggagataatgaaattaaaatgataaaaaactaaattatccttaaatataaattgattttatatttagcatagaaatttaaaattttttatttaaggcggaagaagcacatcaaaacaaaattttattaacaagtaaatcattgagaaaagcatcatcaacttacttcagtgaaggaaacaatttaaaaaaataaaaaataaattaatacttattattattataaattaatagagattttgaacaattttttaatcacatcacaaattatactatataaacaattaattcaataataattattagtcttaaacatataaatataagaataaagcttttagttttaaatgattatgttgtaaaccaattgatgacaatctaaaaatgtttaacttctaaaatggtgctgctccaaaaaatattggataaatacaaaagaattttcataaattatctaattattttatggaaaatcagtacaggatgtttaattttgcacattttttccgcattaatttcaaaattttttagggtttctaaattagtatctaaatattgtgatattattgcatttaataatataatgaatgaaaaaatttgtgcaataatttactactatacaaactgaatttcattatttataataagtgatataactgaatatgctaattatcatttaattaaaattactaatgattaaaatctaatttatcaaaattaatttcttaaaatatacattttatgatattagttaaaaccccaaacaaaaattctctgccaaagaagaacgacgaaaactggacatgtatgtgcatgtaatgattttatatcattagaaattgaaaacaatatttttaaaaaagtttattacatatagattattaaaataatacaatgtttattaaattttaccttatgggcaaaaatttttatattacctttttatatttgaaatatctttacattagattaatttgaaccctcaaaagtttattggagatttcttgccaaaaattacattgaagaaatttattaatatattaattgattaatagaaaatattaattaataagtaaaaatctagatttgatattgttgatgaaaaaataattttatttcattaattatttcctaatcaataattaaaaatatgaaatcatcccaacttgaattttaataattcaaaatgaattttttttctgatattaacataaaaaataaaaatcagacttattcaataaaaaatgacgattaaggaaaatttattttttgatcccatattaaaaagttatttgaaaaatttacaatatttaaaaaatattctggactaatttggaaattttctataatgtgccaattcttaagaaaaacataaaaatcaaaaaattaaaatctttgaataataattattatatatacatatatatatatatttttttaatatgtataattaacttcgaaattacatattttaaattaatgacttataaatgaatttaaaataaaagtggaaaaacctataaataaggtttatcaaaattgaatacaaaaatatacatttttaattatgcaattttataaaaaattcca

SEQ ID NO: 22429 - DNA, 2034 bp, Heterodera glycines
ggtcatccatatgcaattcaaaaattcttcatatggtttcctgcgggcaaacattccgcgcatcaaataaatcttttctttcatcatggtcatttttctcttctaattccaatcttgctttatctggaggcttgtgcacgtacttatgcaaatactttactgaactgacactattaaccttttcaagattaatgtgacacatgaacatcttcaacaggtataggttgtgcgggacaacccacctgttgtctaatgcatgcctttttccatttgcaaatacttcaacagttcttccatcatttggccttgcatacaaagccaaaccattttcaagaacaattgtctcatcctgaaaggttttcgggtatcccttagaacatttccttcctctcagtccattcttatcaacaaactattccatgcatgggcaatttgggttcaaatcgccacatggtccatggatcataaaccttttaaccaaagcatacaaatcagtttctaattctttgtctggtattctcgcactaatcccttttttctcaacatcttcaccattaatcattttatcttgctctgtcaaagtcaaaagcaaatggatgtgcggcagtccccttccttggttctccaccgggtacatccatgcaataacttctccaaaaaacttgccttaacaatttcattcatcataactttaactttcaagttaaaaactctaacaaccaaatcaggtctatcacatgaagtctgttcatgaaacaaattctcagaaatctcatcccaatgcgggttacacgtcatagtcaaaaacatatcaggcttaccaaaccgtcggacaacggccatagcatcctgaaaatgcttctcaacataccttggactgtttgttacacttggaggaagaatgaccttccttcccagtggcaaaccttgttcttgtgctcatctcattaacatattatcaacattcttatatgcatcagccaaaatctttttctgattacactttatccaattcattctgtctccttcaatcttaacatattcatcaacacaatactgttgaaagagctttccaccgtacaaaattgggttaaactctctttctctaattgcgactgtataggaaacatattgtaatctcgttactcttctattactatttctatgcttcatttcagggtgccaaccaagcgtaccacgcggataaaacagtgggtaagtcattggagtcaccattgaatctgtactcttcaaaatcttaaattcctttccacgttctctcaccacaatcttggcattaggtacttcaccgtcagccccaggtacataaactgcagcaacttcattcgctcgaggtacattgtaccccaagcgtctgtccaattgccttccggtctcaaacaaaagcttgatctcggctggctctctgttctcatttcttgctctttcaacttcttcatcttcttcttctttcatcatcatatatgcttcagcaaacggattcacatttctaatcacttcataagcagttctcagcaattgagggtcaatatcgacattggcatgcctcattgctctcattgcatgctcagtatctacgatgaaaatctgcccataagcaggatcatcgccatcttctggattcaaagctaaattcattctatggtaaatctgaccgtaaatgcggaagcaatacggacctcggttatttggatatctatatctcaacggattcattgaagcaaacgacacactactattcaaatgtctaatattctcaaaaaaattcacgtgtctcgcatcaaatttcataaacaaatccctcaattcctcaggaaaatcctgctcaggaatctcgggaaacaaaacttttccatagtggcagcaatccttgaaagaatgcctcggccactcattttttcttttcacaaatgcaaagcatcacaaaatgcacatctaacattcataggtccaagtctggtttcatgagcattcacataggatcccgctgcataacattaccacaccttgtct

SEQ ID NO: 22430 - DNA, 944 bp, Heterodera glycines
tttaaaatcagaaaataattttttttaaatttttccattttagtttcaaaaaaacaaacaaaaaaatgttcccaatttttaaaacgaaatagtgcacaaaaaggggggatggttagaagacgagagtaattttttaaaggatcgcaccccatcgaatatttccttatttctttttcattactgtccaaaggtgactgctgacattgactcttctgtagtccttaaggtacttggactttccacagtaaaatgtggcacaaattttggaactgtcccgcctcacggtgggacttaaaaacattgaaaagccaagttcaaaacttcagagaattatttgttctaaaaattacagtttaatttcttagagtcaaaagattcgaaacagaagcattatttaaaatcaaaataattctactaaatttttacattttagtttcaaaaaaacaaaacaaaaaaatgttcccaatttttaaaacgaaatagtgcacaaaaaggggggatggttagaagacgagagtaattttttaaaggatcgcaccccatcgaatatttccttatttctttttcataactgtccaaaggtgactgctgacattgactcttctgtagtccttaaggtacttggactttccacagtaaaatgtggcacaaattttggaactgtcccgcctcacggtgggacttaaaaacattgaaaagccaagttcaaaacttcagagaattatttgttctaaaaattacagtttaatttcttagagtcaaaagattcgaaacagaagcattatataaaatcaaaataattctagtaaatttttacattttagtttcaaaaaaacaaacaaaaaaatggtcccaatttttaaaacgaaatagtgcacaaaagggggggatggttatgaagagagaggaattttttaaaggatcgcaccccatctgatatttcc

SEQ ID NO: 22431 - DNA, 688 bp, Heterodera glycines
tttctgaaaaaaatatttatgaattaattatgcaaaaataaataaaaatttctaaaaatttgatcgtccataaataatttgtaattgatcaggggctcaccaaattttgcagggatacgtatcggaacactacaaatgcttactaattttcctagattttttaaacccggtgaaaattttttgcagacaccaccattttgcacttaaaaaaatttcaaaaaactttaaaaattcatagaaaatttaaattcataggtactactgctaaatcaacgcagagacgcctttccttgacctttttaggcccctgcaaaatctggtgcgcttctgatcactactcgaaaaatgagtgattgaattttcactaaaaagttaagcctaaactttttggcctgtttaaaaaggaattaaaaatttttaaaaattttattcatctcccaatttgatagaaaaagcatcagagtgcctaaactaacatgtaaataaaatttggtgcgtttcagaaccctttctgaaaaaaatatttataaattaattatgcaaaaaacaaataaataatgaactctcttccttaataattttcctgcaccgaaggtactcactcggccgcttcgcggcctcgtggtgtgccttcggcgccgggaaattattaaggaagcgagtccatgatttttaacatgcccctacc

SEQ ID NO: 22432 - DNA, 1505 bp, Heterodera glycines
gcattttttgaacaggtttaattttaaaaaaaaattttttttcgatttttggtttcaataaatcactcctccagtttcccaacagtcgcccatttcccaagaccacatttccaaaaaaaaattcacaattccgctactcttatttttaaacaatttttttttgacaattcaccgcctaattcaaaaaaattcccttccggcttccatcgacaatgcccaaaattcgcaaaaatttttaagtctattttcgggggtttggaattggtcaaatgaattgttagtacggcatgtacactccatgtccagttggccaaccgtgtgcctaaaatgcgttccggcgtgcctcaaaaaaaaatttacataaaaattctgtcgggcgtttcttccgactttttcccaattttcttattaaacagatggttaggagagccggtgatctgacggatgcgtttgttgtggaggtcggaccgggcccaggtggcatcacccgaggtttgtttttatttctccaatttttttttgtatttaaatcttgcctcagaaatttaaaaaaatttctaaatttgaaattaaaaaaaaattttctgtggcgatactttgtctcggcgagatttggtcccgtcccccttttttccgtcacccaaaagtgccatgccataatatcctattttgtgccatgctcttccccttcaaatttgccgctttcccgtttcagcaattcttgagcagccgtgcaaacgattggacgtggtcgaaattgacaaacaatttttgatgcctttgcaggttggtggcgcgagaaacgcaaaatcccttataaaaacacgaaataaacaatttttccggcagcgccagaaataataccaattttttcgattccatccggttctcaatttattgtctcaatacttgtagaaaatttttttatttatcagagaaattttcggggttttctgttatgtctccacaccgtttatccataaaagcgcaattttttaccaaaaaacgcaatttttgtctgttacctctcaaacatcaatcaatccgatttttaaaaaatttattccccctctttccattagcatttgagcaatcattccatggagcggatgaatgtccatcgggcggatgtgttgaaatttgacattgaacaaatgtggacggatgcgggggcggccaaatgttcatgggttgaggtgggcaccgggggcggacgcacaattcactcccccaaaaaaacaatttttattgaaaaaattgagcaatttttaaaaagagacaaacaaacaccaattttgaatcggattgaaatttttttatttgccaattgcacaggaacatccgaattttcacatcattggcaatttgccttttcaagtctctacgccgctggtcataaagtgagttggtggcatgggttagtacggcgtaacccaaacaacttttaaaaaattgaagtttttttttgaaatttaacgaaattttgcccgatgataaggaacaca

SEQ ID NO: 22433 - DNA, 1482 bp, Heterodera glycines
ctcatcaattaattattaatttagtcagcttaaaatgatatagttaataatcaacagatgacgaatgattataataggaaaagcagcgaccaaacagaacattaaaatgaatagaaatcgacaatttataaaattataaaaattgtagaaaaaatatttaacgattggataaaaagataacgaacttttaatatatttgaataaaaatttaattgtaaatattcataaatatataactagaaaagtagtggaagaattgtcttttataatatttttaattttaaagtcttttttattattaatttcacctacaaatatttttttatattatttatttattattgaaatcgattaccttcatttattttgagaaaaacacaattcaacatcccatgtttttttgcgctgcctatggcccgcagggtccaaacttcattagaattattgatggtgaattaagaatttattcatattttacaatttgtattttcgagttttgttttcatattttatttagattgaattattacggtttaaataggttaattataacattaaatagaaatttaattcttttgaatttgttgattttaattatgtaatttaaataaaattctagttgttggattcaaggatttaatttttcattttttttattcaactataagtatcattttgagtaccaatcttgtttgcctgcttggttttcgctcccgctaggatgtgacctgaattaatttaatttatttgaatgtttattatttaaattttttgtaatttcagtgaatttttttttaataaaattatataattaatcaaacaaattgtaaaaataaattcatgataattacaatgagctttatttcaaaatgttttttttaaattttcttttattagttaatattttaaattgagaatttaatttgcgttgctttactcttcatgttcagcataattttttttcaaataattgatttgcatttatctttttattgtttggtttcttaggttcattttttttcaaaatatagtactaaataacagaaagtatataagtgctgaatattattataccaaatttatttcatttaatacttttaaaagcaaaaaaatgaagaaagggtaaataacaattattaacagcatattcatgagtatgtacttaaatttcggatgatacgataaaactcgcttcccaataacggatataatggttttagtaacagattttgcacaaaaaaatgccataaaataataaaaatattggtataaaattataaaaaactataaaatagtgaacgcatcgcgaggatgatgagcgggggtgggtatccactgtgacgtcaatcgagttggaggaggcgcttcgcaacgggtaccggtgtacggcctattatcgctccgtcgagtgggacgatacgcggtggagcgaccgcgtttttcgaggctacgttgccgaattcatggccatgaaaacgcatg

SEQ ID NO: 22434 - DNA, 2172 bp, Heterodera glycines
aaacgatccaaaatgaaatggaaatgcttaacgacctaattatcccatgtttatattttgttaaggtgcgcgaaaacaaaagcaaatgggcaagaatgtcaactgattgccacccaagcacttttcttcatttctcgcatattatctccaacagtaaacaaacaaattaatcagtcaattaattatttaattagaaggaagaccaaaaaaataacatcaattaactcggcattaaataaattataaatatgaaaagtaaatattgcaagcaatgaaataaagaaatatttattctttatagcagcgtatcttttaacattcggatgttaatgttaagtgtttatcgaaatattaatatcgttcaatcattttactgtccgtaaagcttggagccgtctctgaaaaccaacatgcactgaacaggagagaaaaagcctaggaatttgaaaattaattaattctttaaatgaaaaaaagtaacttacaatttctttcatattttttggcctgaacaggaccaaattgtcgccgacgcttttccaaccgaacaaatttattggaaaagtcggcaaatttaaacattggcggtggaacagtgaccaattgaagcacaatatctttggggtcactaaaataaaaagttgtaaatttttgtagggattctattacagtatactgtaaaaactaaaattcctaccgtaatgcgttggagaagtaaattctgtcgttggttgagcctagtggaagtgatcgaccgatgctgatcagatcaaaaagcatggctaacatcagcagaaaggaaaagcagcgacagaaagaggggcgaatttggcggaggacgaaggaaggaaaagagaggaaaagcatttcgaaatttggaaatatttaaaaaatgattatccttaattttataaaacatttgaaatttgtcatgagtagagaaaataggcgcgttccagtgaataaaatatccttgtgaatagccaaaagctttttaatgacaaaagttgggcgcactgaatgtataaatacgaaatgacaaacaatgggcagtagtcgagcttttattatgggaattttatgggcaattggcactcttttttggcacattcggatgccattttcgtttttctatgcccaatgtgaaactttctctcaaataaaaagagtaaattaaatttttttttcttcgtatctgccaaattcagcatatccaaccaagcataagactgactgacattcattacctttgagccaatgttcagaggcaatttattcaaaaatttttgttctctaattggtatgtaggtcgaaataaaatggaatatataaaaatattaaacatttatttattatccattttattaaactcctatcttaaatttatttttattttttaaaggatttcatatgaaaaatttatggcctaaattggcacacacacagaaaccaccaaagaaaaggttttgattaaatttaattgcacacatatggattgcatgaaaaattatttgaaaagaagaagctgtcctggccttggttggggggggcctttcaaaatgccagacggagtcactaattaattttaattttggcgttgctttacataaccaattagtattatgcggacttttttttgagcagccaagtaaaaggttttcctttttaaatttaattaaacaaataaacgaacttttaaaatggttagaagcccggccgccggccgcgtaaataaaaattagtcaaattttctgaaattttcttcttttcctatcatcaaattaaaaattatttcatataactttgctcgaaagaagcaaattttaattctctaggccattcgatagcccgaatttgtaagaattctctatttacttgtttcaaaaaataaaaatgatcaatttttgtggttttgagacaattggcgaccattttccattcaaaaggcttttttgcggcaatttttcaaaagactttcttttttaggcggggagtccggcggtgccggtaggcgccaacgggaatttttttgggatttttcatgaatttttaatggctgatcgaaaatagctgtgggagctgaaagcgctgtgggagcaaaaccaacaggggcctaaatgaaggaaagatgaccccaaaacaacaggcatccctcaagtggtggatgtgggt

SEQ ID NO: 22435 - DNA, 1100 bp, Heterodera glycines
catgcagctgcagcagaggcaatggtgcttggacgagtttcacatcagaataaagaatatagtgtgatttatttataaaaattaataaaattctattattactacttgtgtgttattttaatttaaaaccaaaatatttttgtaaatttttattattataaatttctttttttaatgaatcccttttgtaatttagatggctcaattgaaaaaagcatggcacgaatatttggagcgtgttaaaatgtttatggacaaattggaagaggccgatttgtttaatgaacaaaatgtggcaagggtctgcattcacgaggccggacacaccctgccgaaagcacacgcagccagatgatggccgagatcgcatgttattatggaggcaaaattgccgaactcttattttgcaagaaaagtattggccacggagatgatatgaggcaagccaagaaattggctcgaaaggcaaattttaattataataaattcgtgaaaaagcaaaaatttatttgaattttttgaaaaagaaaagtaaagctctggaaaagcaaatttctttttttaagcttgctggtgtggaggccaacccaaccacccgcagtgcacgaaggcaggtcaagctgatcctggacgaggctgaagaattggcggaaacagtgctcattccgcgcgaaaaaatgattaagaaggtgaattttatcctgcagttttaaatcctatcaaattttacgagtccaatcaaaaaacagttgtgttttacatatgccatttttttataatcagacaaattttcattaaaacgaatggactcataattggttggactcataaaagtcgattggtcttaaaaagaaggagaataatttcctatgaacaatagaatttgatccacttttacatattcagttggccatcaaagtatacaaagaaaaaacgatggactttgatgccgtaaaaaaagttagtttttatatactgtatacacttgtcacgtgtttacataaggctcccggacatttggacagtggacatctggacagtggacattacgacagtggacatttggacagtgaagtcatttggacagaaccggacaattg

SEQ ID NO: 22436 - DNA, 855 bp, Heterodera glycines
ggaaatggttattaaaaagtaagattaaatatgtgaatgtaattaatagattttaaaaaataaaataaatttccttttattaattaaaaagaaagttggaaatgtacaaggattgaatatttatttaaattgaaattaattttacaaattctaatttaaaaaatacaggagttctttaataaaagtaaataaattattattttaatttaaaacatttttcacaaaaaaacaatttaatttaaatttaaaaattttatttttattaagaaaaaaacactcttttaaatgaattaaaacattaaaaataacccaaaaatacatagaaaataatatacaccgcgcggattcgaacttcgcccccaccaaaaaaaaaatgatgcctcagaatccccaatcacacagggattctaaggtcttaacgatgttagaagtaaaatctgatcacgtattcgtgatcagcggcccaaataacccctaaaggcatgtttttggaatattttcggtaaaaaaatttttccactcaaaaatcctggtcacccccctttggtcccgaatgccaaaatcacttttatttttataacaattcttaaaaaagtgataaaaatgccaaataaaatttatataatagagtaaaaaattgcggatttttgtagtattttacttttacagtatgacttttcagaaccgagttctgaatttttttctgaaaaatcgaaaatttccagaatctctggaataactttttttgtttttatggtataaatttcaaataaacctcataaaattctcacgattttttgctatttttaaagctttatttcatcaaaattggtcaaaccttaggccagactctag

SEQ ID NO: 22437 - DNA, 1147 bp, Heterodera glycines
  misc_feature (1029)..(1029): n is a, c, g, or t
aatgatcgaagaaaatttttttgacccgaagagcaaaaaaaaagatcttgagcaggcaaaaaatttgaaaaaatggtcgatcgtaatggaaatgggctctgacccccccctggggggccaaagtcgatcgtaagacctcttggctgacgctccccttgcacaggtatgaattaactaaacccaactaacaataagtaatgccacagaacaatccaacaatttagccatcctgcgccctaattaaattataaaaaagtaatcccctgttcctgttcatattatgttcgtcgtaccgatggacttgtacttctcagaggtggagtcgaacacaacggaagtgctgtgtccgcccgctagggtagcgggcgttgtctcctcgtcgtcgctgctggtgccatcattgttgtactgctctgacttgacgaaatgcattttgtccgtctccgtctgcttcagccgacgagctttagccagcatggcgttcagttcgtcctccgcctcgtcctcaatgattgtcggcaggtgtgctgccgtgccatttgcaatgtgtgggaattcgtcctcctcctcttcctcccccacttcatcttgctcctcatttttcattttgtccgccaacgcggtgagtaagtccatgttcacattggcccgcgcgctcttccatttgttcttttctggaataattagtattcagttttttaatatttttaccatttttctgatagcactttgtctgattgtaaaatattttatgtccctttctttgttcgcaagactcattaaaaataatttgcactcgccaaatcatatagaaaaatactatttttaaaacctctaaaatttcagccgtagctcggagatttttagggtcaaaatccggaccttggttaaaagtgttttccaaaagcgatctctaataatttgaattggtaaaagtggtgatgtgtaaaaaaatgaggaaatgtaataaaaaaagcaagtccattgttattgattggcatttgttttgtcccattttctcgccttgcncttgtggtggttgtactccttcggcctgtgctgcgtgcgcctcgtcgccgcggtgtttccgcttccgtcccttcccatcatcggtggcgccgttccgctgcgccctctcctcctccat

SEQ ID NO: 22438 - DNA, 1443 bp, Heterodera glycines
  misc_feature (24)..(24): n is a, c, g, or t
  misc_feature (63)..(63): n is a, c, g, or t
  misc_feature (75)..(75): n is a, c, g, or t
  misc_feature (99)..(99): n is a, c, g, or t
aaaatcttagtcgacccatcagcnccttttaatgcatcccgccagcccctaaaaaatttattnttcagcattttntgatttttggaaattttttgaatntaattgaaattttttcgaattctccaaaaatcccgcaatgcgcacgggatcccgcaaattttaaatgcgggattttcgggattgcgggatttgcgggattaaccccgcgggatcccatcccgcaaaaaattttgagttccagtcccgcagcgggatccgcaaatttgaaatttccggtctctaggcataatatttaaattcttatttatggggaaataattatctcagattaatattaatttttttttctaattttaagaacaaatttggcggaagtgttaagcccgtgctaaatgttgtgcacacagcagaaccgccgcccacatacaacagaacgaacaaattcacctccgtgttccagggcattgttgattcgtacggcattgccagctatttggaattaaatccaggcaacaaatatttatttatttgtttaatgaaaatctcattatttgatttatttaaaaggattgaatcattctcacctagaaaaacctgataaaattgttaaaatgagcttaaatttctcaaaaaattctccattattttaaaaatttgtcaagaaaaatgaattaaaatataaacaaatttttgtcgaaccaaaatttttataattttcttaaagtgaccaaaaaaactcaattttttttttgtacctttttgaaaaatttattataaaactttcataaaatttttttaaaaaattaggaaaaaatccatcttttatggatttgtaaatagggatgggattcttaggtttttatttattttttctgcggctttaactcgacgaaaaatgcacgaaaaacacatattcttcgttttaacgcccctatccgaccctaggaatccctattttgagtgttcgccctaaaataagttcttactcctattttggcgtttcgcccttattttcgcccttatttcgcgattttttaaatttttttatagaaattcacaaattctttaacaaaaatgcaatgaaaaaaaattaatttttttttgacgcgatcacattcgcgaattttttgcccctatttaggtccctattttggacttttagcccctaaaaatcccatccctatttacaaacaggcgagtattttcaaaatcattgcagaaaaaaaagatatatttgtaaaatttttaaaatttaaaaataatttttctttatttcttttaatttttgttttagccccctacacaatcatcactttcccatttctattctccattatgttcggtgatttgggtcatggaattttgatgttcttttgcggactgtttttggtgcttcgtgagaaaaatttggaggctcgccaaattaaggatgaggtgaaatat

SEQ ID NO: 22439 - DNA, 1483 bp, Heterodera glycines
  misc_feature (43)..(43): n is a, c, g, or t
acgcgggcgtgcgcggcctgtcgcagcagccgcgcctgtaaanagcggtgttgaaagcaaaaaaggtcattgatttacattaatttacatggccggagaccccttcgcaaaattggaaaattggccgctgatcccttgttttgcaataatctgaattttgagctctacatctgaattttagtgttctttatcctgaatttgaaaaaaaaacttggtcaccctcaatatacatatacttctgaacaattctaatgctaaaaacaggcactcgcgcgaaaactgaataaaaattttgtatttgaaaaatttccaaaaatttttacgttggaaaattaccggtttttaccggtaccggtaccggtggaaaaagttggtaccggtaccggtttttgcattaccggtcagtaccggtactggtttttttacaattaccgattaccgctcaactctagtcgaattgatttatttggggtaaagtaaaactccccgaaatctcatcatttgcaaaatattctcctatttggtggtcctcttatgtgcgttccctttttcttccgatccgtcgtcattttatgtcaaaatgtttccgcgccttccgtttttggcaatgatttttcgcctcctattggcacttgtccaacccctcgagcccattggcaacagttgaagctgaactggttcaaaattgttttaataaaatgcgattctcgtgtttttctcatcaagtattatccgtaaaaaataggaaaaccctaaaaatccaggctttatccaacgcaattatttttctgctatttgtgtgacatcattcgaaattcaacagcaaattgtgctaattgccaaaaatgaaccgacggtaatgaattttaaaagtcacaaattcgtcgtttatttgactaaactgttttcccatttcagttggatttgcaacgacgtttggatggacattttcccctcttttgaccgtcctcaactcggcctcaaattggcacttctttcgccacgtttcaatgcgttggtggacaaacattttgatggcaaaagcgaattgacaatttggagaacgatcgaaattcgtcgcaaggacaaaggaccaggaccgaagctgtctgtacaaatggatgacaaatctttgccggaccgtccgttgcccagcaaaatccgttttaaatggcttcggattgagtaattcggaatcagagatttatggcaataaaagcattcatcccatttttaggtacatcgatcactccgtcatcgcttttcttcgttcaaatcatcaaattttcgacaaaagaggcaccaatttatatttgtggattccatcatcacaccctacgaatggccaaccaatttgggacatttttggtcgtgaaatttggccaattttttcggcaaacattcgccacttgcgctttaacgatggtgatcagttggacaatttgcttcgtcaaatttcgccgacaattttaagggatcttaa

SEQ ID NO: 22440 - DNA, 2378 bp, Heterodera glycines
  misc_feature (2313)..(2313): n is a, c, g, or t
gaatttcctccttcgctcccggccgattaaaatttgaattcgaatttctattggcactgacacaaaaaaaaccattgtaaatccaatttgaaaaaaatggtcaaagacaaatttatataatttttttccacaatttctgcttctcaaaaagcccaccaaagacaatttgttttcggccataaattatacgaggcatatcacataaaatgaccggacgagcgccagccgaagcaaaggccaaaaatgccaaaaatgagggggggggggaatggtcccgaagggcatatatttttattatgaaaaattggactgcaataagaccaactcattgttatgcatcgatttgtcacaaaaacgattcagtaatgcccgaggcttttaaaggagacgaaaggccaaaacggcggatggccccgcggcatttggaagcagtgccaagaaaacatttggcaattcacaaaagtttccaatgacaacatatgttgttgtgtgccatggatgctatgacaatgaccgatgaatgccattggaagggataattctccccccccccccccatttttgcgtgggcttcggaatcaaatttccctcccccactcggtgaataaacaaatcgctaaaaattgctttttttccgttgtgcctttctttgccaatggcactgctcctcggcgccccacccacacttttggcacacatttttttgcttttgttgcaaatggtaatgcgataagcgcgggatgacaccggacaattaattggagagaaacggcggaaagggacaaagaaaagacacggaatgaaaacaaaatggaggaaagcagcagcagtgattgtgagggaatgataagcggaggatagggcattaaagcatcaaatgattgttgggagtgataagagagggaaatgggacggtatttaaggggggataagccgaaaagtgacagacggaaataaacggaaagtcgagaatcgggtggagaaagttaagtcgggaattggttgaggaagagacaaaaggcatttttaggccaatgcttaaaaaataaagggaatgcgagagttttaaatgttcagactctgattttgatttcgaaattaaagtggcgataacaaatcggttttccacggcacagaaagtgtccatccgtccggccgtcgtcactcttttgggcaccaaaaccaccaccaattcaattcgcttctccgtccgcccgtccgctgtttgccatgtccatttttaataaagatgggctgccctgtgcccaatttcatcctttcccttcccccctcccctcgtcatttcctgctgcaacagaagcaccagcgaaagcagcagaagcactgagagtgtcccctctccgtcagtcgcccgtccaaattaaattttacccgccaccgccggtgagaaaggaagggaatgaaatgggatatggacgaaggaaagaaaagggggaaagggaggggggggggggggagggaaatgccggtgccatcgaaaaagggagggcaaaaagagggccaaatctgtgcgactgatgcgaaaatggaaaatcaaacaaatacatttcaacagcttaataagagaattagcaaaggtttaattgtcaaattctgatcaaatttaggcgcccaccgccaaagccaaacagttaattattattggggataaacgaaattcatcaaaatcaaaattcatactaaatttataagtatatctgttatcaccaaaagcgaattattgatgaagtttgaaaattgttttgttttcagaaaataccgtataaatattcaattttgatttaaaaatcttagaaacattatgccattaataaattcaaaaaggaaaagcataaaaattaattaggttcaagcacaaacaagcaaaagcatcaattaataaatttcaaattttctctcttttaaaggatgttaattggttcattaataaacaacaaaaatcgacaaattttgcagttttcttccttttcttcaattttatttaataaaagccgcaaaaaacaactcaattttcttcatttaaattttttaaggaggtaaaagagttaatctacacttaagtatcaccatttacctcatttaattcgttaattttttgcttttcccataaaatagtacttctgcttcatcttcgtgcgtcgagtcttttcccgaatggcggcatcaaaatatgtccaacgaattttgtccgtcaaattggccaattcttccgacgactgttcagcccgactcggagcagttcaaacagaatgaagccgaaatggcagaatcggtgcggaaattaaatctgtnaaccgggaaattaattcattatattcagataagcgaatcaaaaatgtggtcgatgcggtgatcga

SEQ ID NO: 22441 - DNA, 2030 bp, Heterodera glycines
tggaccacaccagggacaatcggcttgccattggcttcaccagcggtcggataagcgtcgtttccgcaaacacacaacccggcgtaaagttggcgcaaattcaatgcattggcgcagcaaaagttctaactttaaggtatttgcgaggcgaagatattcgggaggcgcagaaaggcatcaattgtttggattggaattttaatgattcgtcacgactctgtgcagcctatgaaaggtaaatgcaaactgtgaattcagagttgggagaaatggggcgatgtacagttggtgatgggggggatgtggccaagtagggtaacgcgactgacgaaatcactattttccattttataatttgtgatctcatcatcaggaaacacgtccttttcccaagttaaaatattcgtttaattccatgtttaggaatcgtggtactgatcatgccgtcgttgtgtacgatttgaatcggacgacgcgcaatgtgcgagaagtgccaatgtcaattttcgaggctaattttgctgaaaaagtgctcagtgtctgttggttcaggttcctccccatgcttctgtttccaattctctcctcttccattggcttgccctttttagagacgacccaaatttgctgctgatcaacgcaagtcgcggaattcgaattgcggacattcgcgagcacggcaatttccacagcactttgagtgtccaaaatccgatgatgggcctttgcagtgagcccaactttggctttcggttccgaaaaatgaattcattcactcagtcatccattttcaatttagttttgcttgtttcgctcacaatttggtttttgtttacgatcggcgttctttgggctctgcgccattgcacgaaattgaagcttgtgtaagtaaatgggtgttgttttgtttttaaatgcattttaaataatatttttattgaataatgggagtcggctaatataaacaaaagatggggaagcgacagccatgaagtaatggtttttggattatttagagttattctgttctttcactgcatttttcgcccttttagtcaaattccaaaatgttaaacaaattggcgtggcacaaccgccgtctcttccatctgacagctttggccaaagattgtggcaatctcttcaatttttccatttcatcctccgccttttctgaccgtcaaaaaaatttgactggcgctgccgacccatcgtcgaacatttacagtcaattggacccatcacaacggaagggactcgacattgatggtcactcatacggagttcatttttactcggtttggattgttttttgatttaacttattgttgtaaatcattctttgaattcagctgcccggaatgtcgtctttgacctccttcgactggcacccgaccatcagtgatcggttggcacttttacctgcccaagaaaagccaatagcttttgcccattcggtcgcctctacaaaacgaattgccataattaaagtatgtcttgcttcttatttttttcactagttttctgttgtgtttagcttcgtgatgacgtcaattccgtcatcggtccttccggtgacttttgcatttcggcggggccgcagctgaactttgaaaacggcgagaaattgttggccaaacccaactgcacttctgacattgacactgaaacactgttcaaacgacgggtgctcgtcggctacggctacggaaattcactgaacgcattggcaagtgagtgaaaggcattcattcagtcggaaggattcaattatttgttccaaaaaagcactgctcgaatattcgaagaaggccattgagagagatcaattcgcttcggatgacttacgcttttgctgggattggctttggatgcaattccaatcggcggatgctaacgaagtgcagaagaattacgggaccatgtgcgaagcattttttggatgtcctcaattaatttactttcattttaaggttcgctggcgttaaacacattttgaagggcacaaagtccagttcgaccatcaaaca

SEQ ID NO: 22442 - DNA, 985 bp, Heterodera glycines
  misc_feature (914)..(914): n is a, c, g, or t
  misc_feature (935)..(935): n is a, c, g, or t
  misc_feature (970)..(971): n is a, c, g, or t
cccccccccccctcccacgcccttcagagcacgacaaatatttcaacaaaaattttgaaaaattgactagagcaatcgaacgctaacggacgacctaatggaaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaaattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcnggctcggggggactgccccgnaaacaaaaaatcgatttttttcagtgtccgtttgnngtactcaaacaatt

SEQ ID NO: 22443 - DNA, 1869 bp, Heterodera glycines
  misc_feature (1861)..(1861): n is a, c, g, or t
ttcaattttttcccggcggcaataactgggcgctggcttcttctcccatgttcccaaaaagttttttggaaaaagcgcgccacaaaaacatttttattgattttttcatttgtaataaaaaaaatttttggcaaatgtatatgtatgacgacaacactgttttttaattttttggggaaatcttcaatttaattttatttcaaaaccctgcatccccatgggggggggaccacgacaaattataaaatgcgggtttttttcgcggggatcaaacccgtcccgtaaaaaaaaaattaaaaaatttcaatcccgcagcggaatccatgaatttgatttatccaactttagtaaaaacaatctgccaatgaatgggatttgcaaaatgtcatgcaaacgcagaaatcaagtacattaagatcatttacccttcaccaaggcggcgtcatggcagttcgtaaatttttttttaatttttaataaaacctagaaattttcctcaaaaaaatgagattaatttacaaatcgagaaaaccctaagattttaaaaaatttttacaagttttgaaaaataagcaaaaaaaaaatagattttttttggcttttatagatttgaaaattcattctagaaaaaattctaggtaatataaaaaaaactcaattgtatgaactgccattgaccatccaccaagacacatttcatcgtttaaaaaagttttctccgtatgcgtgctaatctaatcccaataattaatttgtggcgcaagagacagaaaaatttgccgagactctcgagcatcgtgaccacaaattaatgatggtgtgatgggggaaatcccaaatttggaagtcaataaattacagaaatacaccaattgaaaagaaaacatacacaaaaatgccgaaaaaataatactgcgaatattggagaagaaagacaggcatttacaaaaacaaaggcatactgtaaacagagggctcagcccgttttttttttgctccaaaaattgttaattaattttgtgaatctgttttgaagaaaaatttcgtcaaacagtcaaaattgggagtataaaaaaaggagtgagagagaaaggagacttgggaaggagccttggatactgtagaatttaaaaaaaaagtaaagaatttttttatagaaaacctaatgaaacgagcaaatatggacaggggcatgagagatgatagatagggccgtcaaaagttgcaaaaaatcgcaaaatatgagtataaatgtgaaaaatatacacccaaattaaggacaaagttttccaaaaaacttcttcaatttagttaaataagctaaaagtcgagaaaatagctagctatggtatgaaaaatcatttttgaagaaaaaacacaaaataaaacgaaaattattaatttttgaagaaaatttcatgcgtttcacccctcccacaattcagggaaaaaatgcatgtgcatatttttttgacagtcctaatgataagataataatggaagacattactaattgaaagaagccagtggagagaaaggggcggagaaaaaagaaaaacagagagagtaatgcacaggagaagcaacaaatgaatgaatggatgaatgggtgtgacctcggcgtgacaaagccaattaggagtaattaatcaagcaattaattacctaccaattagctaatttcgcacatatcaatgggagaaagaagaaacaatgtacaaaaaaattaataataatatgttgcggaagcaatcaatacaaataaacataaaagcatttagcacctaattaaataataccaaaacttttaaacaaatcagtttttaccgaccagatccctaattctctatttaattcccanaaatttga

SEQ ID NO: 22444 - DNA, 1072 bp, Heterodera glycines
ggagctgatgccgagaatgaaaagcatagagaagaaaaggaaagaccaaagtgacgacaaaggcatgcgactcatcgcctgaaaagccaccgatactttggaattgcaattcggacagaaatgcctcggggtaagcgacgaaggccaaaccggtgccactttggaccacttggtcaatgggctggtccaactgtttggccatgaagccaagcacactgaacactgctgtcccaccaaaaaccgacataaaacctgggaaagatttaaatggcaatgattaaaagattaattaattacctaattaattaattaatccgtggaaagaaaaaagtcggaaaacaaatggaaaaaaagaaaaagaatattcgtttttgtctgtccttcattttggtaccatcagcagcagtgataatcagcgcatcagtgaaacagttgtgggaatgcgaattgaaagaggacaaagacaaaatgccaccgaagccgacggacagcgaaaagcacacgtgggtggcagcggcacgccaagtctttttttgggaaggggcgtcgctttaaagtgttttcgggtggggggggggagagtttggcagcaaatcactgtcaaaacataggccaaaatgaatgatcctccaaaggaatggcgaattaatcggaaaagtttgtgattgcccgtgggactgaccgcggggtcgaaaatgacgctaaaattgggccggaaaagataaaagtccaagcccaactgagcaccgtccaaggaaattcctgtggaaaggggggaaatggacaagacaaatggaaaaactgaggaaaaggtcaaaccacgaaggaacagaacgacaatgatggcataagggacagtggcagtgaaataagcgactctaaaaaaaggggaaaatggcaaatgggggggggggggtaattagcggatgggggggggggaaaataattcaaatggggtataaatcgacaattattggatttctaggcttgtatgtcttcccaatcacttccccatcattttgacccttttgacgactacttatgtcgatgacaattcatgtcgagccgagag

SEQ ID NO: 22445 - DNA, 1591 bp, Heterodera glycines
aaattaaaacagcgaagtcgcatcaataaccattgatttcatttcataaaaatctgttccttaaatattaatacattagcaaagtgctctgaaaatggaaaaaacaaaattcaccaatttgtttaaaaatattaataatcaaaaataaaaaaaaacaataaaattcataaattttattaaaagcctccgaattttgtttctctttttaaataagccccactttgcgagggattatttacttttttgacataattttcataacatctaatcaaacatcaaaattttcattgaaattttccgggttttaccattttcattttcagaattttggccaggggaaagatcgtcacaatgaatgacgaattgccaaatttgacgattggcgttgtttgatcagaggagaggaccggtacaggcacaatttggcacatggtctaaatatcatacccaatttaagaatttaaataatttaaattcaaatatacagtgaatggtagaaatggggaaaatttctgtttttatataaaatcacaaaaatcacttttttggatagagcaaattgttttattgttccaacaaaatctgtcgagttgccttccccccccccccctcccccctcaactaatgagaaaaattttaatgatgtacatcacaaagcggcacaaattattacgagagcaaattttgtgatacatttaaatgttttttttattttaattaaaaagtgggaaagggaaattaataatttcattttaaaatgcggctttagctgtgcacaaaaattgtttaatttattaaaccatttaatattgctcttgcctttgaattgtttaataatataaaaattttaactagaaaaaataatttaattttttttaattttaatttttttcttgaaaaattcctcttttcatttttgcctaattgaaaataaaactcctatttaaataatttgtgttttttaatcctatcagtcgatttgtatggcaaaatttgagcgcattaaaaataaatccgttccctggtaataagttactgtaaaatttacttattttaaaattattaataattttctctgagatttgagttggcaatttgaaattttaacactgacattttgcaggcattttctagtgatggtggacaagagtgcttaagtgtaagcagaatgcgtacgcgccgagaaaaatgccagattttgatttatgccgttgcattttccacatttgagaccgcttgaaattggtcagtaaaaataattcaaatttcaacatttttgtttttgtagtcattttgcgatgattcttttaagctgtaatggtgccaaaaattgaattttgtgtgcaagtggtgccaaagtcggtcagctgctgatggcacattatcacgtaattatcatttggcacttatcgtggctttaatatgttttcgaaacaaaataaaaattcaattttttaaatatttgtttttggattttttttgcagactgaatcaatttttttgataatttaaaaagaattattattttttatagtctctgagttcgtcactttataaagtaggtttaaactttgaactttatatctaatga

SEQ ID NO: 22446 - DNA, 1529 bp, Heterodera glycines
tggggcctgatcaggactctaaaattgattagcgacttgtgcaacacagacaacccctgaaaagtcggtctgccactctgatccccctcttcccatggtccaagccccgaaagcatagggagggaaccatccggtgctaccagtaaagccgtgatgtcccatacccagtgcttatgagggaaatagtccagaggagccctcttacgcgtccgtaattaggccccgcagggcttggaagggaagggatgttgatggatgcctgggggtacctcccaggcggggatcgattagccattccactgaatgactcccgactgaactccgactgtccctttggctggttatccgttgccttttaagcgcccctcgggatgggaggagccctatcggagagataaaatgggggggggggaagggtaaaggccatttccggtcccggccttacacctccggccctccaaaagaccgtccctggtcgttaaaatttaaataatttccaaatttgaatgaagtcctcagacttttctttcttttgatttgttttacgatgagaaatttgttttgattttaagccaaaactgaaaataaaataattcaaatatttatttaattactcaaaataaaaatggaaaatgccgagcctctaatgggaatgaacccattcctccaaccaatccacagaagctctgtcattgagctactaaaagaaatccgccctttttaaattaattttcttgaaattctgattcaattggatttgaattaaattggcattgcttttcaaattatgagacaagagaaaatctgatgaaatttaaaacttttaaaattatataaatttaataattgttttatttaatttccaatcgactaaaatttggatttttgatataatttggtgtgactgtatgactatacctccccttcatatctgaggatcgtccctgatccaagaacttaaatcccacgggattcatataccaatactacattcatttatttaatttaaatattatttttttttttttaatttatgtattaaacttttcccttaataatcatttctcacttgttgtgtttttttttgtgtttatttaatttaatcagctccgcagagcttagacaaatttgtgtgaatatatataagtagagtagctccgcagagcttattttaaaccatcaaatataaatgcgagaaataacaaatgaaccattgggacgaatgatgtcagggtgccatcggaaaggtgaatttccgggcaaaataaaggatgggtgaattttaattccagatgagagctgaacacttttgagaacaacattgacttgatgatctcttctgaagtgttcaagcggaaaatttgcttgacgtcgtatgacctttgttgggcaagacgctgatgccgaagtagtcatcacatattttggaatgacctcggtgggtgtaaagggttcattgatttcgccaattgtgccaatctcaactataaggtcagattgccacatttttatggtaaaatatatataaa

SEQ ID NO: 22447 - DNA, 1578 bp, Heterodera glycines
aaaaaattggggtaccaggggggcggtcgggcggtgccgatagccgccgccgggggaaaaaaaattaaaaatttgtgtgtgatttgttaacagatatacaccaaaaaattacaaagttttacgattttaaggatttttatggactggtgggaagatttttatagatttttacaatcatattaaacaattttcaccaaaaaattattatattagatcaacttttggatatttttggtgggtttggaatctgacggtgtctataggcgccgcaaagaaaagcaaaaaattttaaacacttgaaattgtataaattttcaaaaattccgaaattcatctttaaacttttaaataaaagatatttcgccaaaaaattattatttattcaaatttgggtagtttcattggtgaaatttagcccggtgaaaatgaccgggcccgggcggcccggcagaaaaagtccgttttaccgggcggcccggacccgttttttttgaaaatttaccgggtccggcaaaagcccggcgggcgcccgggcccgtccggtcgctaaaaaatattaatttcatgtggcgcattcgggtgggggacagtttagtctggccggtttagtctgagccaagtttaatgaaccataacttttttctcagctgaccaaatttcataaatttagcatcattcgaaagtcctacatgtttagaagcttttgataaggtattcctaagcgattgaacaagttataaaaaagttgcaagatgaatactaccaaaaagtcagaatttttgcatatttttacttataacttttttatatgtcggtatatccttgtggtttttgggaagccgatagagcttgttaagagctttcgaatgataccaatattgttggatttggtcaacaaagaaaagagttatgatgctctaaacttggttcagactaaactgtcccagtccgaagttttaaatgtatccaaatgagctaaaattggcacctttcgatttgcctcgttgatccgcaccgaaatgttagaatttgtttaattaaaaataagtttttactcgattcaattgcttaggctaggcctatgctttgggctaggcttaggcctaggtttcattttgtaaattttattgtacgagttgccatttacccaatcaaccaaaaaaattattttgttatattgtttttttcaattgtttgttgtcattttttctgtaaaaaaaacatttttatacaacaacaacctaataggtttatatacaattaattaattgggtggcaaaagtgaattggtatcatttgctcgcagtttgtgattttgtatttaattgggcgtcgttatcaactaatttcaattctttttcgtcttcttcttcgtcgtcgtcttttgcatgttgttcattgtcagaaagacgtgctgaactctggccaaagtcatactcttttggcggatgaattccctgacgaaatctctgaatgtttaaatttagcgtattcagtggcatggccttataatattattgcaatatctacgaaaaggcatactttgatgaaataaatgcgaatttctatttatatttt

SEQ ID NO: 22448 - DNA, 2623 bp, Heterodera glycines
  misc_feature (14)..(14): n is a, c, g, or t
aaaataatgacacnttagatcataagcaattttattgtctaatttatttatctattttactttattattaattctatcatctcttttgatggtaagatctacccattctcaaattataatgatttttaactaaaattagttttcttttttaaatgtaatatttttatattatatttttgggtttttcttgctgcttgactcaagtgaaacagacaatggcggattattattaattgttcttttctcaaatattaatatatctaaaaattcatattgttcgaaatatatataaagtttaaacttcttcttcattaattttcattgaaatatttctatactatcgcataattagcataatttacctatatatatttttggaaaaaatttgggttttttcttttttacttattttatgtcacatttacaatatacagtgagggatgcgcactgtgccccccagaccaaccgcaccgtctatcccggatggaacatgggagggaatggggaaagccatggccagtgactaagccccaaaatcccaacgactcattgactgtcgatatatttattcactcgttgttggatttacacgaagcgagaaaaggaataataattgaagtctgttccacaactaactgactaactgatcactggggaaggagaaatgtgaagagaatgggcggagaaacattacaatgagaaaaggaaaaacgtgtgaaaaggataaatgtgattgaattgataatggccaatgggaaataattaaatgaggaaatgcgtcgaataatccttacaatactttaaataatttccataccaagtttttacattaaattaataattttgtttaaattaaacttttcggactttatctttaggctttgaatcaaatgaaaacagtatgtctaagtgtgtctttatgtcaatttgcattcatttttatattttgtaattaataattttttattaagaattgaaaattatattaatttattttaaaaaagctttcataaattcaaaaaaatgttcaattttctttttaaaatataaaaaaattaaaaacatattaatatttcctgcattattttattttaatattgttttttttcttcatatgagaattctttgtatttttttgcctgaaaacacatacaatgccttttttgtttttttaaccttacaatgcgcgcattgtttatgcgtggcggattttcgagaaaacccattcgtcatctcgagtcccagtacaccctcgctcaaacactattcgcgaatagatataaatatcttcttcaatgataacaaagctttacgaagtgaatataatgtgaattattcaaaaaagttggttccttatttaatacctaatttaatgttgagtcattttctttcttggaaggaatagttctaaatttttatttatgtctttaatcgaaacgataaaaattttaattctttgtgagataaaatagagaagaggtacgcctttttgccagtaaaataaataatttattattaatttctattttttatgtgtttgttttatccaattgctattttaactgatttaggtacatcttgtactccttgtttcatttgttccatggagtatgaagaatattaaataaatcgattttgaatgatgaattaatactttctcactaatatttgttttatagattttataaattttattttaagccaattatgcgacatacgaagtgaagcaaactataggagatgatagtgtatattaatttatcgcagcacatcgaaatttattgcattgccgacattcatattttttcaatgaaaataattaaattggtattttgaattttttaatatttctttttttaaaatatgctattttggaattgtaaatttatttctttcatttaatatataataattaaataaatattctaataaaaatattgatttagttatcatgattatcctttataaaaaaaatttatacaattcaaatttttactataaatttgtaaaagtattcaatatttttacaggtttccaaagatacgcattagtttcctttaatttataataagtataacaattttagaaattgtaaaatagcttttgtattctttacgttatattgttttattattggcttacctaaactttaattttaacaaaaagttatggcttcttaaacttccttggcacggaaacgtgcgcacggaattgagatcaaaccccttttatttattaggcttctgaggttttgctctcgatcactttttacacctctgacaatttagaagaatcttgaattttcttttaaatctttgttaagaaggcaaaacaaatcaaaaagttatagtttcaaaaatttatttaagcagcatttactttatcgtgatttatttgtttttttagagaaccatttattaaattataattattcgaaatatttatttatttgccctttttagtatattaatcaaagaaagccaataaatatgttcaaaaactttaatatagttctctgatctttgtctttatttcgacgatttcattgaaaaacatttcaaattatttctgaattaatgcttatatttttcatttaaattaagtgtcttctttatatttcaaa

SEQ ID NO: 22449 - DNA, 1187 bp, Heterodera glycines
cagatatttataactaaaaaataaaataaataagcaaatagaaacaatcctatagctattctaatttattgaacgagccaatttctagtataactacaatttataatacaaccattgggacaggtaaaaaaaaataataatgcaaatatagatgtttaaggctctaacctactggatttttgaaataatgaatttggaaggattagagtaaaaacatagatgattattgtaagtcgaaaaaattaaacatttcaatttattttattgtttggtttcttcgttgatttgaagtcaattttatcaattaatagatatggatgaaacagtgagaatttccaaggaccatgagaaaaaaaaattgtgatgccgtgcaaaaaaaaaaatggatgaaaaaattacggccaaaaacacttacaaattacttctattattggatatgtcaaaattagattatgtgagtaaaagaaaataaaattttaggactaaaatttcctgggaattgggattggtggtttgattaccaattttcaaaattattgggtttgttgcatgcctgataaaattatttcggttatgcaaaatcacaaaataatgcttgtagtgggcatgtaaattcttaggaaataacccaaaaatgggagccctagtaattttgcaatccattggtataattacaggaaagaaaattttcgtttaaataagaccaaaaaatgaacattatttttcacgtgaaaaggttaaatacaagactaatgtcctaaataaaaaacttataccttgataatgatttcaaataagcaaattaaaaataatattttgtgcgcttgcttcaaaattatttggaactgaattaatcctaaaggcgccatatcaatgtagcacgagttttagtactagcgtagcgatccaatgttaaaaaaaacttcccaaaataaatgaatgacattatcaacagattatagggcgtttttattctagcagcgtatcgaaaacatgaaaaataaatgataaatgtttttttataaatttagcttatagcacaaaaaaaaaacaaagattcggttgaacctaagtccatcgactaggaaaatagtcaggtaaggggtgcatctacttcaaaagtaaactatatggctatcactaatattttatattgacgaaaaaaaatttaaaccacattccaggat

SEQ ID NO: 22450 - DNA, 1559 bp, Heterodera glycines
tcagtaaaaaatttaaataattaatttatcaggaaaaaatattaatattatcgtggagctcattcgtaaattttattaactccaatcatcagaagcaataaatttattaatattttaattttactgagcttggtgtggaagatagtgttgacaaacaaatgatgtaaaaattatatgtatatatatttttattatttataacgttggcaaacaaatgatgtaaaaattatatgtatatatatttttattatttataacgttggcaaacaaatgatgtaaaaattatatgtatatatatttttattatttataacgttggcaaacaactgacataaacattttttaataaataaatatatttgttttgcagtttttaagaaacgcccacttggcagtttttaagaaacgcccatagtggcagtttttaagaaacgcccacttggcagtttttaagaaacgcctatagtggcagtttttaagaaacgcccacttggcagtttttaagaaacgcccatagtggcagtttttaagaaacgacctagcaccgtttaacgaaaaataataaatcctactcaatcgcaaataataatagttttcattaataattttatcctactgaccaaaataattgctaattcgtaaaatgatttaataaaaattttccattaattaaaattccaatcctattatgtttcaatagaaatcatagagagatttaaatttaaaaaaattcatattaataattaataattaaaaacttgactccacggattggttacgaatagggcttatattttcaggctctaaaacccgctaaaataggcaggctttaggctctaaaaaacccataacataggcattaaaaaaagaaaatatgctctaaaagtctctggtgtaaaatgatctaattttatgcaaaaacaacaaattattcgtcaaaaattcaataataagttataaaagactctaaaaaagacaaacgaattaatataaaaattaactaattttacaaaaaatgagcatatgtgatttcacagattggaaattgcattgtatcagagcttaaatattatttttagcggtttttgatttcgaatgagctttaaattgaatcgaaactttaattaatttaagacttagtaaattattcttttaagaattagcaattattttggtcagtagaataaaatattaacgaaaatattattattttttctaaaaaattacgtggaatttccttattttattcgttaaataagtagagttatgattttctcgaaaacctattttgagacgacaaaatgaaattatctcggatttaaattttatatttttgaattattttttcaaaaatttatttacgattaaattatgcatgcaatcactttaagctcttgtattaagcagctgcttagagcatctagaatttaaaaattaagtttgagcccgattttcgatctatggtttttcatcaatatttgattttttcttctacgttaaatacttaaaacacttattattcatacaaaaacaattcgtacaatatttatttatacaaa

SEQ ID NO: 22451 - DNA, 1003 bp, Heterodera glycines
gagtgagtccttcggtgcaggaaaattattaaggaagagagttcattatttatttatttttgcaaaattaattcataaatttttttcagaaactgctctgaaacgcaccaaatgttaattaaaagttaaataaggctctctgatgctttttctatcaaaagggagatgaataaaatttttaaaaatttttaattcctttttaaacaggccaaaaagtttaggcttatattttaaaaagtttcatctaacctagcgcactaaaatcgatataatctctccaaattttgcaggccttctccattgtaaaggactaacttaacctgaaaaaatgccaacgcttgttgtttttaaaatttttcgaaattctgactttttcattaattatttattttttgcaaaattaattcataagtattttttcagaaagtgctctgaaacacacaaaactttatttacaggttagtttaggcactctgatgctttttctatcaaaaagggagatgaataaaatttttaaaaatttttaattcctttttaaacaggccaaaaagtttaggcttaacttttttttcagaaactgatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagcctgtactttaattctgcgttggatttatgctccccataattgtttgagtaccccaaacggacacttgaaaaaatcgatttttttgttttcggggcagtccccccgacccgatgcgccccagatttatggggagaccgaatccttcgggagagcttccctatagcctgtactttattctgcgttggattttgctcccataaattgttgagtaccccaaacgacacttgaaa

SEQ ID NO: 22452 - DNA, 892 bp, Heterodera glycines
  misc_feature (18)..(19): n is a, c, g, or t
gtagaaagcgttaacacnnaaaatggcagaagactctgtcttttggttgttaagggccgaatgaacggaagccaacagcagaaaacagtgccaagatctgctgctgctgcgtctgtgctattatctctccttctgttaggccgacgaaatgccaattggatggcttcagagtgtgaaaattaatcgcaggggattatctctgccaaacgacgggggtcatacgtacatagaacgaaaaatgaacaaaaatccataattgcgaactaacatatatatgtcctagaattaaaaaaaaataaaaattaaaagataatatgatgaataagtctgtaacaaagttactataggtaatactgtaattaatcccctcctttttttgaaaaatttttaaaaatttaatataaaaaaaattgtcgcgggttttagagaatatcacaaatctgtcatcaaaatgcgtcaaatttcgaacctggaagacccgaatttgaacaaaaagtcgcaagtttacaagttttcgaatttgcatacagtattaccaagattatagcttcaggagtttcttctgatatttcacatacttcctattagccaatcgggctgaaatttttaccaaataaacttttcccttaaaaattaagaagcacccaaaaaattggaaagatagaagaaaaaaaaattagtgaattttttccaaaaattcctccaaatttgctgtatatagcttcatttcgatgctggttgaaaaagtcaattccacaatagtgaccagatcattccttaagtgtgatcgagtgatcagaattttatgattttaaaaaatccctaaggggctggaaaagttattcgtgaaagacgaatatgacagcaaaaagagcctaaaatttgctacata

SEQ ID NO: 22453 - DNA, 616 bp, Heterodera glycines
ttttttgttttctataatcaatacacatgcgctctatggttttctaaaaggtcagttaaaacatttttagacataaatgaaaaacaaaatttgaatttctgcttttggttcgaaaaatctaatccgaagttcggaattggttgaaatggaggccggattcgagataaatgacctcgaaaaaccctggaagcgtgtttttatgactagaaaacaaaaagaaaattctttaaaaaatgtgcgcaaccatccgtactaacccagtaatgcttaagaacaatgattccaatgaatatttcgcaactaaaaaaacctttttttagtggattatcattgttcttaagatcacctaaacacaaacaaacaataattttgatcacctaaacacaaacaaacaataattttctaatggtgctggtggtggttttcatccagctgacgaaaaacacggtacgccccccccccccgggcacgccaatcttgaacttaagcttgctaaaagaatttatttacgaattataaattgttcagacagcccacattttgtagatgcagtcatctaccggacatttgtaaaaaaaacagcgtttttgttcgtggtagggattgatcgcaacgt

SEQ ID NO: 22454 - DNA, 1555 bp, Heterodera glycines
atttcctaaattttcgctgagggcgcctaacagcagcatgggaccatatacaaccaacaatttggtaatttttagtcaaattctataatagtagttaaactccgcatcatcttccgatgttgcactgctcacctcgcccaccatcggtttgcccacgtgcacaactcggcattcgcccaccggcagtgccatccgcgcccaaccgccccaaacaacttcctgctcattaaactcatgacgccacggcttcattctgaacagaacatcctcaatgtcctggcgaatttcatcttaaaacacccaaatgagcgatcgcctgagaaattcaccgacaaatggactccatgcggaacaaattgaaattcctcaataagtaatcatgcaaagtcaaaaattgcagattgagtttgttgagtggcagcacatttttgccgtcgtaatgttcgtaaggaacggactaaactcacaaaactcattttgcatttacgggatgttttccatttcgcccgaccttttcatcccaaaggattgcttcggtgggatacaaaggttctgcgtttagtttttgcagttgagaagggtgacgttcgcattggaaaatgatcgcttctcgtaaaaatgtcggatcgtcaaaacgaccgtaattttggtccaaatgagaaaccaattgacgagcactttcatctccgttaatttcgtcgtgatttttgtcagggattagtcgtaaatatttggcaatgtgttgaagttcctccaaactaaaatacttaagtttgctatttcaatccttttttaccgtaatgtgccgagatgctcacgcaaaaatttgctggtgtcaacggatgcaattggcagaagacaaaactcgcccaatttgtccttcaaaaatttaaaagtcgctttttggagatcggaaatcgaatcgtagtgacgtttagtgaccttcaaacagataagaataaatgataaaggcatttccaaacaaacttcagccgcggtcagttgctgcccatttacgtcgtcaatttcaaaacgaacataaaagcgcaacaaagtgactaattcacagaaaagagagccatgttcagagagaataaactgagaaaggaggcaatggctgatggcgtgactcgagcggagcagcgcattgaaaaaacgcctagcaaagcacaaaacggtttaaggattccattctcaaattttcagttaaagcatcattcagggaaacaaatgttcatgatttttggaaaacaaataacttaaaaaatatggtgggtaaacaataccatttattatactacttgacatttcatttaccggaaataaaaaaaacataataagtcctttttattgccgccctccccccccccccccagtcaagggcgtagccagacccttggctttgggggggggctgaaatcaaaaattcgatttttagggtgtatttttttcagtcgatttttaggggtgtatttttgcttttttgaaatcccgaattagggggtgtatttaacataatttttcgccttttttcgcaaaaaaattaatatttttt

SEQ ID NO: 22455 - DNA, 2450 bp, Heterodera glycines
ccggggatctctagagtcttattatttcaaagtggtgaccgcttacaaggccattccattggaaacgtttgtgaaaaatggcgacgaacaaaacgatgagtgctcaatatgtctcggtgagattaagccggggacaatggtcagaccgttgccgtgtaaggtaataaatacaaatcttgaattttttaatttacttatatgttacttattttagcacatttttgacgacgcatgcattgaaaaatggtacaataaatctgctttttagagatttctggctaagaaatacacaaaaaaaaaatttaggttcatgggcggaaatatcacatgtcctttatgccgtgaaaagttgcaaatatcgcaaacggcacaaacaatgacaatggctaaccatttaggtaattaggcattaaattttgaaagggatgaactgcaagataaaagggaatttctgtttttgatcccttaaaaagtgatctttttttcggaatctggcaacacttgccttccagttcaccatttttcgttagcggaaagtaatatgattaaattaatagaaattaaggtgttatggcaccaccgggtggcattgtagcaccgagagttcaggtaagtggtggcactaatgagggacaagttcggcatggaacggttaccgcagaccagcatgaagttgtcatcgatattggcacgaatgccaatcagaatgatggaaatactggtggaggaacggagagtcaagttccagaaacaccacggcatgaagcaactgaaaataccggaggaacaatgaatcacgggaccgcaacaccacggcatgaagcaactgaaactcggctgaataatggctccgaaaatgagacaaaatgatgcatgagcaatttaaagtggattaacgaaaagctgtaatgtttaaattgaaaatttttaatgataaacaattttctaaaatttctaacttcggttttaggcacctgatgaaacagctgacaaaaaaccaatcgacggaccgattatttctaccacccaaccctacaattatttaccattttttgttttttttcttcatcccatccatttgaagaaaatcactgctgttgtacgaatttctgtttttcctcttataaattacaattctatcaaaacagggttcagctgggtttctgctgctactttttatattcaagaggcttagaatttagaaatgtgattattgggacagagttgtaggcaaaaactgaaactagcaaaatagcaaaaatgaaataaaagctttaatatactcaaattgatttttaaaaaaatgcagggccggtatatttagtttcgaaattttcttccttataaagctataaaattctattgaaaaatcctgtcaaaatattgattcacaaaattttaatcattcaattgctatcaatgtgtgatggaaatacaatgatcagaaagtcctttattgaataaataacaatacaaaatatgtgaattgaatagtttaccataaattaaattgattcagaactgggatacaacatattcccattaaaaattataaaaattttaattatttccgactgactgatcaatgcatgtatttctgcctcaaaactcccgaagtcccttcgcctcaagcagcgataatactcgagtcgccactcctccagaaacgtgacaggcgcgcatcccatcccccggctcaaaatcaagttcaggaagagccgggcggttcgcccgttgccgtcaaaaaatgcgtgaattctgaccttagaaataatcccaatttttttccattaagcagcccaaaaagcccaggtggacacgttttcccattttatatgaaaaaatcttataaaaacaaaagttttcgaaatttaaatcatagcaaataccatagttagtcccagaaaggagcgtttaatgaatacctttggaaggggaatcatatttaaatttgaaatttttagtaaaattcaaacatttagattttgatctgatcatctgacatttcgccacagttattctttcttttttcagtttgatacttgttggatccagttaaaatggattcgagaagtattgtaatttaaattcgcgtatcaaaaaacataaaattcgcttaaattgaattggacaataattacagaggtttatattttggttgaggtcgattgggccgctaatatcttttatggctgatggcagcaaaagtttgactacaaatatcgaggcaccagttttacaaaaggggtggagccaagtaaagcgacggtttttatgcttttcaaagacctttttgcggtgcgcttttttcaaaaaactttttttgtaagtataaaaatttccaatttcctctgacggagcctaccggcaccgccggaaccctctcgttgatcaaaaactttttgaaaaaggacggcgcgaaaaagcgaatagaaaagaaaaagccgtcg

SEQ ID NO: 22456 - DNA, 1866 bp, Heterodera glycines
tccaatccagcaatttcccgtagaaaagatgtggtttttcccatctaaattctaaaatcgagaggaaattgacaaaaaacccacgggttcttgaacatcctcttgaggtccaccttttctttgcctgaaaatggcaaggatataaaattaagttcatatatgtaaatttgcaaggaagtacttaatttgccataaaaatctgtcttattattaagttaaaagcctatcgttaacattggaaaaaaacgtggagaatttgatttgttccaacactcacagtaagggcatgtctgcaatttgcccaccacacaccatccgcggatgcaaaactcgtggaatacgtggttacatgccaaagcatacgtctaaaaagaaagtgtcaaaaaaacgaacaaaaccgtgacaaactttttcttctggcagttcaacagcttcggtcatcactcctccattcgcttcgtccaacgaattgaaattgttttggttggacgacggtttatgcaaattattcccgcagacggcgcacatatccgactcgagaaccctaaaatggtggaaaaaaaacagtgaacaattccgttttgttggtaccgttttggcaatccgtcatgagtaaaatactagaaaaataataataatgtgttaatctctccatttcatttttaaaaccccgattttgcaggccaatctgtcggtcagagaatgtgccaaatcacgtccaagcacaccgtaataaaggccataaaacaacaaatgcacgccaaaatccaagctcagattactgctaattccttaaaaagccttttttgaatttttagaaaatttaattttaccgaacaccgaatttattccaatgacagtaaagacgagtgaaaagtaaccgacaataccaaaaatgtaactgagtttatgcatgaacaaaaagtatttgtagacgagcctaaaagggaaatggacgaatttcccttttttgcgtaaaacccactgaaaacctgggagttgatccggaaattgccggctgattgaccctccgccaaacgtaaaatattgaagaagtgaacacagtccaggaaagaatgaatcgccaccagccatttttaagtgacaccataaaagggattagccaaagaccgaccaaagtggcgaactgaaccaaaatcatcttattgttagataaagccctttcagcgaaaccaccacccgttttttacctggtatgagcgaaaatgtcttctcttccacaacatcaagattatttgtgccacaaccattgagacaatgaaaatgatgaacatttccgcatgcatcgcatcgtggccctacaaaaattaactttgttataaatgaacgacagttttttaaggaaaattaaattaccctgtgttttctgtgcatttcctcgtgttctcgacgccattgaagttcttcctgaaaagttaatgttttttttagaaattaagccaaattatccagcctcatcttcttgcacggacattgctacaatggtaagtatgatggaaaagaaaagaagaaaagcaaacgctaacaaataagctaaaaaaaagaaaagaataatgctaaaatttgttgggatcggtactcttttgtccgcccactttattttcatatctttatttctctccccttgtttctctcctctctctctcttcgtccatgttccccataaatacccccgcgtcctctgacctccccgtctttcattcatttgtcatccatttatttgtgcttatattgtgcaatcaatatttgccctttgccctccgtccctcttcgcttatttttttattttgtgtcttcacaacttgaataaaataattgtttattcacttcgccggtttgtgattt

SEQ ID NO: 22457 - DNA, 1411 bp, Heterodera glycines
attaaatttttactaaaattataagcctaaaaaatcgtctaatgattttgaatattttttcaataaatcgcccatttctggcactatgccaagtttgggcgggacagacctaacggggagatataaagtatagggaatatcaaatctattcccgaaggattcatcctcccgaaactgtctgactgttcgaaaattttttttaaattaagcctaaaaaatttgtaattattttaaatagtttttcaaaaaatcgcccttataaattgcattggatattttcaagacaatttagtcctgtactggggagtatccctgcaaaaattggtggggttctgatcgcttttccaaaaattactttgaattaaatttttactaaaattataagcctaaaaaataaggttaattattttaaatattttttcaataaatcgcccatttccggcactatgccaattttgggcgggacagacctaacggggagatataaagtatagggaatatcaaatctattcccgaaggattcatcctcccgaaactgtctgactgttcgaaaattttttttaaattaagcctaaaaaatttgtctaattattttaaatattttttcaaaaaatcgcccttataaattgcattggatattttcaagacaatttagtcctgtactggggagtatccctgcaaaaattggtggggttctgattgcttttccaaaaattacttggaattaaatttttactaaaattataagcctaaaaaataaggttaattattttgaatattttttcaaaaaatcgcccttataaattagcattggaatattttcaagagaattgagtcctgtactggggagtatccctgcaaaaattggtggggttctgatcgcttttccaaaaattacttggaattaaatttttactaaaattataagcctaaaaaataaggttaattattttgaatattttttcaataaatcgcccatttccggcactatgccaagtttgggcgggacagacctaacggggagatataaagtatagggaatatcaaatctattcccgaaggattcatcctcccgaaactgtctgactgttcgaaaattttttttaaattaagcctaaaaaatttgtctaattattttaaatagttttttaaaaaatcgcccttataaattgcattggatattttcaagacaatttagtcctgtactggggagtatccctgcaaaaattggtggggttctgatcgcttttccaaaaattacttggaattaaattttactaaaattataagcctaaaaaatatgcctaattattttgaatattttttcaataaatcgcccatttccggcactatgccaagtttgggcgggacagacctaacggggagatataaagtatagggaatatcaaat

SEQ ID NO: 22458 - DNA, 1030 bp, Heterodera glycines
cagcaaaggaacagtcaaagaataattacgaaaagtggcaaaaagtcaattagagatggtccattgctttacctccccctcccccgccgcatccgcaaccaccgccgcccccgccgccacaacagccgccgcctcctccaccaccgccacagcagccgccgcctcctccactgggacaacacataggcataggacaacacatttggccaccaaagcccaaggcatcagaaagggcgaccaatgccagcaaagaacagccgatcagaaggactaattttggcatggcgtaacttaacaaagaaaggctttttttcgattacaatcacttttaaatcaaaaatttagtcgcttttataatgattaagagcaaatattgaacagaaggaattgtcattttggaaagaatggtcggaagcacaaaaatttgctgatctgaatgtgcagaagactgcaaatggctttttgagctggataatctgcttccgagcacccgcctccgttgggtaggcggagattgcccgaggccggctggcttcccccccccccccccctcaatggtccgtcgtcgccattttgcccggggcggaacagcgagtgctgccgcaatgtttcgcaatggaacgagcattagacgaatggttttgctccgggagactgaggcgagaaatgcttcgctccatcaatccacgcgaaggaagcgccgagcggaaaaatgcgaattcggtggctcatctccgccgctggtgcatgttttgtgatggaacaaagcaaaagacgtgaaaactcgtttccgacgactgttgaatttgaagaaacaaagaaacggttaaggaagacccagaatggcaaaaaggcgaattcaatcaaaaccaattcgattttttctggcgtgccgaaatttatggcattgccatcgccattcccgtacttacggacacgtcaagaaatattgccccaagcatggaattcagcagaaaaatatatagtgtaaagattaggcttggacatgatcggaaagaaatttcggact

SEQ ID NO: 22459 - DNA, 1111 bp, Heterodera glycines
  misc_feature (1098)..(1098): n is a, c, g, or t
gtcatcaagaacgcggagggtgacgtgcacattccgagcttaatggctgccagaccgattaagaaggcaaacgattggcatttgcatgcaaattgtgccccttttattgcagtttcacttcggcatggacattattcaacagagtgagcatgacgctgactggagacgtccggttatgattctgaagatgcccgcccattgtgtgtttttggtcgcagtgcgtactctgtcgcccaccgcgtgaaaatttactcaataagtatattcctatgcttatgaatttcagaagtgctccgagttggctcgcattagcagtcggctatggcttggtgaatgcgctgaactcattgcatgagaagggattcatccatcgttttgtgacgccgtggaatttcatggttccgatgccattcaccatggacaacattaccaaaaagatgattatcatggacttgagtttggccaaacgatgggaccccaactcgtaagggaaattaaatgtcgtaattaaatagcatcttttctacagcattagtgatgtctcagttcgcttttctggcaccgttaagtacagttcactgagggcactcaattttcgaaccgttgggccggccgatgacttaatttcagtcattttcatcgttgctgagttgatcagcgggaagtgcgttctttgtttggaaattgatttttaacttgcctttgtagaattccctggcgttcggtctcaaaaattgaaaaatgcatcgcgctgcgacagaagttcgcggagtccatcgaatttaggcgccttccaagagaacttcggaaactttatacgtatgttcaatttcagaatgaaattatataaaaattaaatttatcctatttagagatctctgcaacacttctcccgctgattgtcctgcgatcgataatgtgaaagaggcgttcgaatccgcactgaagcgacgagatggcgatgactggagtatcaagccaatgcctgactggttggagatgcctactgaatagaaaaagatgaataccttttaggctgttttgtatgtattagtgtgtgtatttattgtattgtgcgtataatatgttttgctaganttatatacatatg

SEQ ID NO: 22460 - DNA, 2477 bp, Heterodera glycines
agggggagcaggaccaattctgtttcaaagaaggcggatctctttttgcctatgttttcatcgcctgttttcattacttaattttttggtataaattaaggtctgatacatgccaatcacgggagctccgcgattgattatctgtctgaccaactcagccgtgcttcgacgagtgccgttcgtcacggcgcatgtctgggacttggattggccgcactgggcacacgtaatgaacgtgtttacgaacacttgagggatgtgctgtaccagaacgaagcggtgtcaggagaagcagctggaactgccatgggcttagtcatggctggatcgatgaaccaaatggttttaattgtcttttatttggtttttgaaatcgatttcttacaccttaaacgtcaggccttcgacgaaatgtaccagtacattcttgacactcaccacgacaaaatccaacggggacttcgcacgggaatttctatgttagcttatggagttgcagaaagagctgaagagtgagagcaatttgtttccttccttttttcttaatttgttgtttagttggattcggttgctttataacagtccttacgcaattattcggcagacgggtgtttgcatggtcggtttatcccttttttacttccaatatttcaaaattcgttttcagattgctttggcttacgcgggtacgggaagtgcgtcggtgatcaaaagacttctcgagagagtcgcatcggatccaaatgatgaagtgaaacgatttgcaaccattgcaattggatttgtcctgtcaaagttaacatttttttgttttccaaatcatgtttaccctatttagtaatccgcaacaatgccttgattacgtcgaacttttgacagaacattttaacggtcacattcgatatggcgcagcgattgctttggcaatttcatgcgctggcactgggtacaaagtgagtactgaagtggccacttggcatctgggacattacctcctcccctttaaggaggccatcgcattgcttgaaccgttgctgcaagcgaaggaaaattacgttcgacagggggcgttggtttccctcgcttttgtcctcattcaacaaacgacatcgacctgcccaaaagtcgcagactttcgaaaaactttgattaaaatggttggagagaagggagaagacacaataacaaaggcatgccgaattctattatattttcatgacaaattgtttagttcggtgccgttgttgcacagggcatattggacgcgggcggtcgtaacgtcactctttcgctgcacaaccagaacaaccaaaacgacatgccgtctgtattggggatttttgtgtttttgcaacattggcattggcactcgatgactcatttcatttcattggcacttcgtcctacttgtgtgattggcctcaacaaggatttaaaagtatgactaaacttcattttatctacatacattaaaacatgcgcagatgccaaaaatggacttccgctgcaatgccaagcagtcgatgttcgcatatccgcaaccaattgaagaaaaacgcaaagaagggatggaaaaggtggaaacggcagttctctcgaccacaaaaaagaagccgaatttggagaagaaagcagaggatgccggttagcagaaaaccaatctttctttcggtcacaatttaatttttgacaattcagacggaaaagccgaagagaaaatggaggtggaccagaaaagcgaagaaaagtccaataataatataattcaattaaaaatatgattattttaagaccgaaagaagtcccggagccctccttccacactctttccaacccttctcgtgtcgtgcgtcttcaattgcgcgctttgactatgcctgatgactcaccatacaaaccaatgaagccgataaaccacggaggcattgcgatgttccaaaacacagacccaaacaaagcggacgaaattgttgaattggctgtcgccggaggaatggtcgctgaggggcccaaggaaaccgagccaatcaagccacacgagtcgtttgaattcaatttcggaagctattgacacttattacctgatgtccttgttcatgttcattttgttaaactattatatctacgtcatttcatgcactcggaattattataaagctgattgattttatatgaattgacgagttgtttggcatggtttggttggccgtggcacaaaccgtgttaggttttttcctgttccagacctgactacagcaaccctcattccagcatcgctgctaatatttaatctaaaaattaatttggatgggacgcataaaacggttcccggtgatttcgtcagtggacttaattcacaaaaaagcgtacacctagccaaattttacaaaaaaattcaaaaagtcgagtcataagaacaggcttgtaaatattctaacgagtcacaatttgcaaaaccctctgtaagtattctcaaa

SEQ ID NO: 22461 - DNA, 1087 bp, Heterodera glycines
  misc_feature (20)..(21): n is a, c, g, or t
cacgatcgctttaattcccnnttaagaattgatttcccccccccatttaaaatatgttttatcccataatttttaccggttccaattctttcactttcatttccacgattcctccaatgtttataattttgttcgaaattggcctcggcatttcgaagaactaaaaatggatttttccaatcatttttggcattatgttttgtccgacttcgttcgaatttgtaaacagcagggaaacattgcgcataatttgtttcagcggggggaaattttggccaaatgcttcagcaataacaggctcctaaaagataaatttaattttttatttttaaataaaattagcattttatatatttttttgcttgcttacctcatacgaagccatcacattgttcaaatacaaccaatcgtacaaatcatttataaaattcacaaatcgttccacaaaattcattttgtgacctccattcaatggcgtgaataaaccttttttgtaaattatttttaattcagcttttagctttaattgttttaaacaaatgtcaaaattagttaatgatatatgtgtaataaaaaaatgttttaaaaaattaaccttaaattttaacgaaaaaattcagtgagtttctcttatgattttttaaaatccaatgaattaaaattgaaatttagttttcgacactctattttctaaattataattaatcaaatgattaaattaatgaattaaatgccttcccccctttggcactttcactcacttgtcacgtaactgctcagcgttgggatgccaaagggacggacaaccgtttgatacaacggcaccgctacagtgccaagttttgttttgacgccaatccgatggaaaagtgccatgggacacggatcataaagttcagcaagtacaacatcaaattgttctgcgtgaagacggcggagcagctcaacgtcatttacgagttcgaaaagtgaaggaaaggaaaaattaaattactaattaatcaattagtatttcctactaattacctcggcatatttcgcataaaattttaccaaattgttcaataatgttctgtaatttttgttt

SEQ ID NO: 22462 - DNA, 2338 bp, Heterodera glycines
  misc_feature (2306)..(2306): n is a, c, g, or t
ttatttagcaaatataataaaaataataaataaatttaaatatttcattaattgatacttttgtaacttcatcctagcatcttttgtaacaataaattgtttgcggaaattgttttcagtttcttaggctcggtcgttttctattttctgaacttattggttcaaatgccattggtatggttgtttttccaatttatcaagtctttcttatgtcttcaaaatttaatttacctcttaactaaaggaaaatttgaaaatttagttaggtaagatgtctaataagcttttatatatttccctttgtcttttcttcgttttagcccatcaaattttgtcattaaatattcataattggcgctctgtttttgatggaattcaaatcaaagaatattttcggcattttgccatcatcgtttgctcgtcgagtatttttaacatttacgtcacaaagtgtggttaccaaaagagcaaaattcggcaaaatttgttggggtgggccgagtcggaagaagtggccaaaaatgtgaagcgataccaagcaattccgagctttgagcaaaaaatgttgtgcgcagataaaaatgaggcttcttcagcgaaatcagagtaaataaaattaaaattaatataattagggcagttttttccgattttaaaaggaccaataagtaattttcagagatttaacagaaaaaattgaaatatttttatttaagtacaaaatcagctcttctttgtactctttggctcattggactgacggcgcatgacgaatttaatgaacatttcagtgacaatttgccgtcaatttatcaccacgagattgacaaacaaaaaattgaaaaattattcgttgagtcaatttttacgaattccgaaaatttagatgcaacgtaatttaagtttaataatttaaaaattaatttaaaaaatttagaattgaaacattaaaattcaaattaacagaacaagaaaatgcgcaaaagaatgtcctttaacacaatgcgaccataatgaagcgagaattataaaaagaaaaatattttgttaaatcatttgactctttttttgtacttaaaaagtccgagctttattaataattataaaaaagatcaaaattttgccaaaggattaattattactaaaaacaaaggccaatgagaaaaatgtcctcatttttggtgctagggtgcttccggtaacatttgagcgattcttaaatccgccaagggttaataaaataaaataaaaaagatggtatcattaatagctttgattatacactacctgaatatttaaattcaaaaaatattaaaacaataaaaaaaagttaaatttccaaaaattcgaaatagaaatttcaaactttcaagaataactttttgaaaagatgaagattttttgacaatcaaagctttcgaatgataaaagaatgtcaaaaaatttccttttcgacaagtgatgtctttatttggaaatattttgatgaaagactgtataaataaattactgatcagtctccgattccgtcatccgatgtcaatgactgatattctaaggcaattgctacccaatttcttcatcttcttcccattttgcccatttgttttcatcctgcgcaattggatgtgctcccggaaaatggacatttagaaaataaaaggaattatcataaaattgcataattataccaaagagcaattttccggtgttaaatttgccgttggttttgtctttattaaaaataatttatttgcttttttaatccatttttggcagttatttggctatattttcgcatatacccaacaaatcatcagatttaaaacgccagggactgaaaggttcggccatgaattaacaattatttgttagaaaatactttttataaatagggctgccaattttatgtaaatacatatttttttcctggcttctccttgctctaaatagcaggaaaaacactttcttttttgtgtttgcgaacaaaaaccgggacttttatttacatatttttacatatttcgggattttcttacatatttgtacatattttggatttttttcatatatattttcatttttttttacatattttgagtattttttacggaaatttttggaaatcctcaaaaaaaaatccaaaatttcggcaaatatttttgtacatattttcatttttttacatattttgaaaatttataaagaaaaaataagtttgaaaatgttgcctaaaaataccaaaaaaagtcatttttatgtcattttgtggctatttcatactttacggggattttctttcccanaaaaataccattaaaaaaaattttatttacat

SEQ ID NO: 22463 - DNA, 2721 bp, Heterodera glycines
cctttttgatagaaaagcatcagagtgcctaaactaacatgtaaataaaatttggtgcgtttcagagcattttctgaaaaaaaatatttatgaattaataccacacaagtattatttttttttaattatttttttcatttatcacccaacgttctagactgatcagaagctcaccaaattttgcagggaaactgctgagaaccctacaaatgcttataaattttcttagaattttttgcctggaggaacacagttcttcacacttaccacaccagcattatttttttttaattatttttttcattttatcacccaacgttctagactgatcagaagctcaccaaattttgcagggaaactgctgagaaccctacaaatgcttataaattttcttagaattttttgcctggaggaacacagttcttcacacttaccacaccagcattatttttttttaattatttttttcattttatcacccaacgttctagactgatcagaagctcaccaaattttgcagggaaactgctgagaaccctacaaatgcttataaattttcttagaattttttgcctggaggaacacagttcttcacacttaccacaccagcattatttttttttaattatttttttcattttatcacccaacgttctagactgatcagaagctcaccaaattttgcagggaaactgctgagaacccttcaaatgcttataaattttcttagaattttttgcctggaggaacacagttcttcacacttaccacaccagcattatttttttttaattatttttttcatttatcacccaacgttctagactgatcagaagctcaccaaattttgcagggaaactgctgagaacccttcaaatgcttataaattttcttagaattttttgcctggaggaacacagttcttcacacttaccacatcagtcttaattcttaataattattttttgcattcattccccttggttcttgactgatcgacaagctcgccaaattggcagggcaaatcttcgaagcgtttactattcggaattgaggtcctgaaaaatgattctttgtaattcgcaagtctctttttttaggcctaaaaaatgattcagtcccgaatatggaggggctgggtcgttctgtgaatgacggtcaggcatcgaactgagttggtttcgtgaaaaaaaaatttttgttgtggacagtaattaagaaagattgcccaccgaagtaccaaaaaatcgaaaacctaggcctggatgtgccttggctctattagagtcttaggcctataattttttttacaattgcttacatagaaattgagaatgaaataggtggtaaagttggggcccaacaggtctttgatcgactctttgcacattgaccactccttaacaccgacaatgttcggactgttgttgctgttttccacatccattttgcacatttttggtagaacgaaaagaaaatgagcaaaatttatgtaaataaatctaaatttaattttattgtttatatacaatttttagtaaatttttgcaaaagttagcgaattgctggggaagggatttggcacagaattttggagaattttgtttttaggattgaagaaatttgcgagggttttttcaccgattccatcttttttttttgccaaatagcgctaatttaaaaattaagttggcggtttcccacgcatttgctgggtttgggtcgatttactaatttttattaaaaattagtagagaacggaccggaccgggcccggaaaccggtccggcgattttagggaaaattccggtttgaccggtttttgagaggccggcaccggaaaccggtcattttgaaaatgccaaaccgttccggaaactgacattttgtaccggtttttaccggtttatgatatagccaaaaattcttcatttttatacaatttctgttaataaattgcatcgaaattttcaaaaatttctcggcggcgcctatcggcaacgccggaccctaaaaatccttaattttcttagaaaaatttgctcaaaatcgcaatttttttttatttccaaacagaaatttcaaaatcttaaaaaattttccacaaatatctaagaaagaaattttttttctttttatggagaattacttactaggttttccggtactaatgcactttacaaaaaatttttcaaaaaattctttaaattttttttatttttttgaaattttattattgaagaggtcatttattgacgcctaaagtgaaatagagccgaaattttacatctggcacgatttatggtaattttgggtgaaatacatgtgaaaatttaaatttttaccaaaccggaaaccggttccgggcccggcaatttgaaaatccggttttccggttgaccggtttttgagaggccgggcccggaaaccggttgcttctgaaaatatcagaccggtccggtccggcacttttggaaatctcggtctctagtaaaaacccacgggccaggtcgttttcgtattacgagcacatgttttttgactataacttttttctttgtcgaccaaatccaacgatcttaatatcattcgagagcccttcagatgctctattagcctgcaaattttcaaaaaatttcgttaagtttctaaaaaaagttcgtgccaaaaaaagttggaaaatctggttgtatgaattcttctggccataacttttttgaa

SEQ ID NO: 22464 - DNA, 2209 bp, Heterodera glycines
  misc_feature (1274)..(1274): n is a, c, g, or t
attggagtgtttcggatttataatttggcggttcgtaaaataatttgaaatccctcattatcccggcgggaggggttcccaattctcgaccttctcgacctattactgtccctgatcagactccgaacttccatacccaaaataccgattcgcaccatctttgccattgaaggagtgccggggagggatcccaatttaaaattaaaattccgtttttttggctaataaatatttttcagaaaaataatcccgggcatttatttgtaataaactgaggaatagaaaatgcggtcaaaaacagacaattggacgcaagtttaagggatttgttctgattaatctgctggcaccgaatcttccctttggctgtcagtgattgaacgtccaccaccaaatcaaaccaatggataaaacccaaaagccccaaaagctccccccccccccccatcgatcacttcgcattgtgtcaatttccctttgcttttccaatcaccccgcttaaaggaatggcggggggggggggcagaagccgttcgcttttcctccattgctatgcttcttcaaaacggagaattccaaaaagagaaaaatgtgttggaattttctcgccaataaatcgcaaaataaaaacaaaaataaataaatttgcatgtatttttaagtccctttttatgtgttggttttgctgaccaatgttttgctatgtttgttatcacttatcatttttcgtttcagtgtttgcttttcgcatttattggagagggaaaatgaccgaaaggtcagaaaaaggcaaatgaaagtgaaagaacggataaaaagaaggaaaatgaaaaagacggacggacgcaatttaataggggaaaatatggtaaaaaggcatgaaaatattgaaaatttggcaattttttatttattttaaacttactaaatcatttcaaaatatttttttcaacatttcgaactcatttttattcttttgagcaaatcggagagtgaaaagaagaaatcaaaggcttggtaaaacattgaaaaagtttcgactttgaaatcaaaaattttgatcaattaagttaaagcatagaagaaagttttttttttttttagtaaatttcggttaaatttctcaatttctgaaaaaggcactaaaaattacaaaataataaaaaatgcattgtcaaaagtcaaacaaatgccaaataaaattgataaaatggttactgctgttcaatttaagacagtttaagactttaggacaacatcaaattgctttttgngaaaaatattatttaagaataaatcaacaatttgttcgagtgaattcggttaaatgcgatgggcggggggggggagccgagggacaaagcaacgatggcccggcacggcgcctttccccggtgccaccaaatttatgaaatttcttttttcattcattcattttttgctgtcagtgtggcctgccattcattgaatttacagcagggaatccccagtttaattcgacagattgtgagttcgttttattgtattccaaggtcaaattgagaatttcttcatttacctatcccagagtcttcgtgtccattcgaaggacgacaatgagattgatggttgcgagtttagttagacaaatgctcggctcatatttataagaggtcaagttgaaggatttatcaccgggaatatcgtcattctgatccttcatccgttcctctttctgatcgtctctgtcttcccttttctcttccccttcaactctttccgttctattcccatttctccattctcttccccttagccttttgttcccattcgccttctgctcctcttcctcttctgttcctcttcccctttctcttcctcctcttccccttctcttcctcttcgccttttgctcctcttcctcttctgttcctcttcccctttctcttcctcctcttccccttctcttcctcttcgccttttgctcctcttcctcttctgttcctcttcccctttctcttcctcctcttccccttctcttcctcttcgccttttgctcctctccctttctcttttttttgtggatcgactcagcacggatgaaaaggaaggaataaaggccaatgaaaggggaagtcatcgctgaaggcaatgggcggggataagcaattacaataggaataaatgcagaagaatgggagaaaaattgtagagaaaatagtaggcaaag

SEQ ID NO: 22465 - DNA, 1440 bp, Heterodera glycines
  misc_feature (601)..(601): n is a, c, g, or t
aacagttaccgcccgccctccttcactccgcgtctgtccactctattggaaaagttatttctgaccagcgaccgttcagaatggcatttcgttgtccttttgaattctttgccttttcacctttcatttttccctttgctttagtccctccattatcattctgtgcatagaaaatgagcgtaaagtgtcaataaatgtgcacaaaagcgttaagcatgactaattgcatatttaaaatcattttcaaaaagttattagccttcggcagacaaaatctcccgcaactgttcgatgtccgaagggcgaaaacgaaaggtggcgccggagaatgaattaaaaaacaatccgttgattttggttttcggagttcatttttgctgctttttttaccacatccattctcttcttcaattatttgaaaaagacaattaaactatttattaaaataaataatgtaatcccttgtttcaaaatcatgaaaaaggaaatctaaattagagtttctatatgaaaacaaaaagtgcgagaattaatgctaaaaaaataaattattgcttattataaacacgtttctgggagagaaagaatgaagtggggaggnggggggggacactgacaaatcggcattcggtcgagaagactttcttttttgaattcgcaaaaatgccaaattcattttcattattctcatacaattagccaattatcatctattctttgctggtgctggcaaaaggggaattaaaaagggaggagaaagggagggaaacccgagagagagagaaagggacaagaaaaggcaataatggagacagacagacagatagagaaagagagggaaagagacgggaaaacagagaaaaatcaaatattatgtgtataatattctaaagaattcgacggaagttcagccccgccgcaaagtcactcatcggaaatgcgacacgaatttgaatcgggcgcacatccgtcgtattcgaccagcgacggatggccaaggtcccctcgacccgtgtcaatgtcggaggaaagcagcgaatggccaaagtttttaacacaaacgcctaaattgtcatggaatctcgctttttgagcaaatccagtctcggcctttggttcgagtgacccgggaacagtgggccaacgttgtttagattttttcagagatttctgctcatggattgattgtccgtggcttatccatcaccccaccaacgaacatttgtgctctttgaagccgggactgaacagcttcctggggacgcccaccttaaagaatcagaatttgaaaagtcttctaaagaaaaaaattaaaaaaaattcaagcaacttttttgaaaaaacttaataataagataattcttagtttgtcccgaaacccgacccaaagtcatcgggtccgggacgagaaaaatgtcgggattccggtgacccgaaaaa

SEQ ID NO: 22466 - DNA, 1731 bp, Heterodera glycines
cagcagcgactgttctctgagttcgtccgctttcttccgcttcgctttttccatgcgttcgttcaccttaaaagggtttccattctctcaatttgccattttctgttttttcgaccctttgcattttttcggttggccgtcccttcgcgtcgaaatattcgccgtccaaaagtccgacgaggcgatattccctctcgtaaaaggccacccaatcgaacacactgagcaattcactctccgacaattcatttgcgtccgaacaatcgccggagggggaaaagtcgccggagacaaacgaaacggtggcatccctccctaaaaaggcaaatagacaatgggaaagaaatgattgaataaagcgcaaaccggcaaaaaagttataggtgccgccaatcccatagtgtcttctgcccttttcaacgtcgaacactcggcccaaaatggccaaataaatcggcttcgatgggtcacttccgtcgtggagggccaaccgatcgatggtgaaaagtggcaattgatctgctgagcattggcaatttgctccaatttctttcccgttttcggttttatttattcgtgtaattcccgtatttaagtgggaatataatcctggaaaaacaatcgtccattttttcctaattcctttgagggctgttcgtctcctcccccttcctttgtccttcttcaccttttcgtgctaactttccgttggcataattttgctctctccgccgccgtttcaatccatcatttgctaaaagtgattttctgctgggcaaaaaagggccaatgcgattgtcaaaagtcagaagcaaatcatgaacaaatggagcctaaaaagaacattttaccattagaaataaattgggcatttccatcaaacagtaaatgcttttttattttttatgaaaatttaatgcttttttgaatataaataatttccatgtcgtccgattgaccaattacaacctgacgaattcgctgctgcacccaaaccattgccggaccgaaaggaattttaacttcgtaaaaagaaagtaaagcagacagaaaaatgatttgaagagccaacaaaaccaacggttttgaatagagtctgctgctgttgtcagtgtttggaattacgcaaaaattcgtaactcttcccattaaaaccgactaaaaatgttttttttattacgacaattaaaatagataattatttaacaataaatgatcacattacttactaccaaaaaagcaatcacgatatttgaccttttcttaatagtaattttgttttttaaaaagggcacataaataaataaattcagtttcgaagacaaaaggtcggcttatgggcgatgacgtcactcggtggtcagctgctgccattgctctcttctgaggaagtcgatcgcttccgtttcctcctccgctccctctccttttccctcttctcctttctctcccgcttctctttcttcctcttttccttcttcgtctttctcttcctcttctttgttccctcttcttcttcgtcgtcttcttcctcacttttcaccgttatcactattttttcttcgccatttttctcttacgttccatttgtgcctttggccaacaaaaattcattgggtggcattgccgggccgtacacattctcgtcctaaaccaagtcgttgatggtgatcacctctgtcctccgcaccattttttcccctccgtttggctgatcagtttcgtgtcgat

SEQ ID NO: 22467 - DNA, 2119 bp, Heterodera glycines
tttaatccaaaacatgtgtcaaacctgataagcgcaccatttacgtgtgcaaatgttgcggagtaaacaaaaattgcgaagtatgtaaaacaaatgaaagaatgctaacatggtcagtagctgatggtataaacccgctggagaaatttattaattggatattagaatttaaattttctaatactgttgcttttggtcattacgcaggttttgatagacatcgattttcttaattaagattatttaggaagatatgattcacatttcgtgcttaacgaattaacacaaatagaaattcatttagaaattaacaatttcatataaattagcgttagcataaattaatgatgtaatttgattaaaattttttctaatttacatatctaacaactgagacaaatgctgttatatgtatacatttaatatagtaaattaaaaaatttactaatagcaataagcaaaattgtaaaattctataaaaatattatcttaatacacatttttaacaaattaattaatcgaatatccataaaaattctgaacgtaagatattctatctcgccaaaaaatcatcaaaaaacatgcttcttccatgccgagaattaatggaagcttaataattaagttttttgaagttattaatataaattataattaatatatcttctcacatataattacaattttaaaaatattaatcgataataattatcaaagctagtttcagataaatatttataatacacattaactaaaatttattaaacttttgaaaaaatatttaattttaagtgtgccttttccactaataatttaacaaagtttcatataagcaacaaaaaacaactaacaaagtgcattaaacttgaggaaaatgatttaataaattttaatcgtattgatgaattaagtttcccgttatttccttggtaaacagcaattgaaaaagagcatttattggtgaatttaatttttagaaagacatttttttatttccgtttaaaagatgggcggaattatggattctatactactaatgtgttttcaagcggtgctaggacgaagtgacaaaagtatcaatgttcgtaataattaaatttaattattattttaattttattttctaaataataaatcataacttagcttaaacttaatcaaatttaaatgtagctctacatatcctcaactatttgtgtaattattaaatttagtaaaattttacaaaaagttataaccaaaaaagctcgaaaaacttagaaaaacaattttgaccctaagttttttgaaattcaataaaattttttgaaattttaagccaataatagagaaatttcggttatcttttcatatcaagtgcggtgtgaattaattgatgttggaacaagtagtattattttaataaataaaatttatatcttatgggagttaaatgatcaaaaaactgtttgggtgttatacattttaacattaattttattttaactagtaactttaatgaaaataataatcaggcgatgcggataaacaccaaaataattgtttatatatttagaaaaaggtttatattattaagtgtttctttatttttctttaaaaaataattaataaaagcattccaacaagtatttgcagttattttatggtcttggtataataaaatctaaaattagttaaaaaaagttttggggttctgttggatgtgttgatatttaatattattaagtttcgacacgaatacttttattgattagttatttgttgatggtcctctcccatcgactcattctttgcatttgtgttattttacatttcggtgtttattttcggactctctaatttgactccgtcgttattttattattattttgtgattctaattttattgtttattcatttaataaatttatcttgtttgtgtgttagcaaaacacaacaactggcgacgcccgtgcatttttgcgcttaaccgtgaattcaccaaaaaagcgactctgacggccccctcacataacccataacaaacaagttattccccatctgtcgtagcccgaagagtttctcagtattttgactgagcaaagctaagtgtgggatcggtttttgccaattttgctag

SEQ ID NO: 22468 - DNA, 2333 bp, Heterodera glycines
  misc_feature (18)..(18): n is a, c, g, or t
  misc_feature (1689)..(1689): n is a, c, g, or t
tagtaattattattttancagatgctgaaccattctttaaacgaacttcaagaagcgctttcttctgccgcatttttggacgattttatgccattggttttggcattcgaatttggcgcaacattttgcaccgaaaacggcggaaccaccaaattgttcaaagagaaagtccaatttcatatatataattctcaatttaattaattatttttttagtgcctttcccaatcattggtcgccacaaaaacaaaggcaccgtttgttggcccaaccaaattccatcgcacaacaaccacttttggcattgtgccaacaactgaacaaacctttggctttgtgccgcttgtgcgtcatgtggaccattttggcacgaattgtacgaacattttcttcccgacggaagtggacaaatttttgttgaacatcaccataactccatatgatattggatgtaaaaagtatcaacggcctttgaaaatgaatgatccggaaggtccgcccagcgaaaagcaccgctatttcgatgcttgtaacaaagttccaacggaagaaaaatgcggaaagtaaacgaaattagtggtatttttggtaaaacattcgtcattaattagtgaaacagccattgattaatgaacttggcacagatttattacgttccttaaaattgggtcgcgtcactttggagcggcacattttggcgctaccaatggaaatggcgctaaaatctcaataaaagcagtttttagttcttttgccatatggtccaacaagtttaattttaatagacaaataaaaaatatggtagcgtttgcatcaaaaacggtgacaaagtcacctaacacaaaatcaaaattagaacatgctttaatgatgaatacattcagttccgaagagctgatcgggtgctataaaagctcgaaaaaatggcccggaaacagtccaatcgtcgaaatatgccaaaaacattaggaaggaatttcgggtggggccgatgccaatgcaaatgttgccggattcattataaaaatttgtgttcaccgtaacgaaaacgatctcgtcattgagtcaaccttcaacatttccttctccaatgaaacgtataaaattattatttttgatatttataaattaattaagcaatacaaatattagtcgattcagtgccgaaccaatttttggcaattttaacaaaatttttgaaatcttatggtaggtagagagaatcattagtgcaattgaatgatactcagaatattcaaaattatttgcttctcaacagagtatgagccgttaaattattgaatcgtcgatacaaaattaaaataataaaaataaaaatatttaatattcaattgtaattaaaaacattaagttgcaagcggacgcgaacatttccaatttcgttggagaaaataacagacataacaaattggatgccaacattcttaatcgaatttggcaccgaccagaggaacagcgcaattcgtgaaaaaagcgacaaaaaagaatttgcgaagaattgaaaacggtaaaaaattcgaaataattaaaaattcattaattttttacagagcgatggcattggcaccgtgcttaatgacaatgaaccgcaaatgatcgacggtactttgggaaaaatgatccattttgtgccaccatcgaatgatgacaaaatgctcccatttttcncaattgaaaggcccaaatattcaaaactcataaccatccgtacaaaattgttatcctaccaagatgatccgaataaattcagtcagtaaaaaattaaatttaattttttttaaattaacttcggcacttattaagacagtttagacccatgtgatgaatacggcgcagattgtgtgccgatcagaaatttgttgctgaaaattgaggcattagaatactgtggaaagaatgaaagcgaaaacaatgcggtgaaataaaaataaaaataaaaaaatataaaaaataatttaagaatttcaaaaagccagactgggccccacttgcgccagaaatcccatggaaaaagccatccgaaacattaatatgcgatgaggatatggcatgtgacaaacgaacgctgcaagaacagtacaaccgattgagagagagtgcgtttattttggaaatttaattaattaagtaattaaattaattttaaaaaattaaaaattcaaattaaaattcagtttgtgggcttaagcccgaagaaatagaaagtccgcggaaaaaacgacaatacaacgcacaacaaaatggaccgaatccactatcaaaatctcattcgacaaaagagctcgtaatattttgccattatagtgtagttt

SEQ ID NO: 22469 - DNA, 1241 bp, Heterodera glycines
agaagaagaagctgaaaaagagcgatctcagaagcgatctctaaactcaaacaaatgcaaaacaaacgaaagaacaaacgaacaaaaagcaaaatccatttcaaattgtgcaaaataattttaaattaaatttataaatgattaatcatctcttttttgcctttttttacaatgggcgaacgaatgaaagcagcagcagaagaaaaagaagaagcacataattaatacgttaccaaagcgtaattactaattagctaattgagttggaagcatttcgcacgcgttttttagaaaattgatttaacgttaattggccctttaacaatttggccaaagtcacccccattggatataaaaagacaagtaagttgtttttacgtgatctgctgtccattttttgttgcgtgccattatttttgtctgtgcccattttttttgtccctttcggcgatatgcttccgtccgaccgcaacatttgttttttcttccctttgccttccgccgtttgtttttccttcctctgaaactccagcaaaacccaaggacttctcattgcccgcaagtgttgatcatcatcctcatcattattatcaccacgccctcataatggctgctcctccgtcggcttttcctttggcccctctgccggtgaaacctgtcgtccgtcgtcttccgtcttcgtccggggtccctccccctccgttttccgttgggttccgttcatttgtcaatccgtcgccccccctttcttttctcacttttgctgtggcacatgtgtcccctgctcatcaaccacagcacccttctctttttctgcttcaccgtctcggaaataactttcatcgcactttttgtcattcattccgtcccctcccaccgcaaaaagtgtaaaaaattatgtgtaaaaagtgccaacccacggaacggcgacattctccaaaaaacgcggattcgtcggcacttttcatttggctgtaaaagacccaaaatgtgtgttctctttcactttctcatttctgactcattgcctcccccgcccccgcatttctccactcccttccgttttccatcatttgaatgtttcgtctggacaaatcgccaaattccccgcccccaaagggcatttatttaaatggatcgcgttttccacgaccaatttactgcattcaaagcgacgattgaggcggaaggaaatgcgggaccaacaggaaagtgtggaaaagcgagaggggagggggaaa

SEQ ID NO: 22470 - DNA, 1410 bp, Heterodera glycines
accattcgtccgagcagcacttccaattgcttaaccatggaccgccgtcgacttcgagcagttcggaccaagaaacagcggagcagcaagaccaatttggaagagacaaatttattaacaacgcaatcagagaagacgaacaggaggaggaggaagaagggagagaagaaggggatgaacagacgaagaagggagatggaggaggggagaagagaggcgggggcagccgaaagagacgacggaaacccgagggtaaggggagagaaaatgccggagggaatgacgagaagggcgggggagagaatgccgagggggggggagacgaaacgaaatgccagaaaagggtgtaggggaaaagcggaggagggggggggggggtcaaaaggcaattgggaccaatgcaaaagtcgttctgatcagtcagtgcctttgtgcttaatcggcttttccaatcacagccaaagacatcgtccgaatggtggtcacttctccgctgggcgtcggcgccgtttctcttccgtccgaaaatgttggccaaacagcgcttttgcccccatcggacgatgatgtcccgcagcaaaacggcccaccgctgatccgtccctcgtccgccgttgatcgccaccgcccacttcgccttgatcatccgcccatttcggtgccctccgctccgtccctcccttttccttccgcgcgtgccatcgaagcctttttccgacggggcagtgccattggcaccgccgggtcgcttccgtcacctccgacacgaaatgtgccgcctcccttcaacctcggaggactgttcatgctgaatgggggctcatcgacgggcggaagcgacggagggacgggtgaagaggagaagaaaatggcagaaacggaggaggaagaagcggaaggagaagaagaggaacaacggaaggacgaggaggaaaagcggcgggaagacgacgaagtgagtgggtaaaatgccacggcatttggccatggaattcccatttttccgctggactgtcgtgctccttcaggaaattgtccgctgctcctccctcctttttggcactccgtcccatccctcggtgcttaaaatgtgcggcagttcgtcgccctcgggtgtctcctcttccgcctcctctttgccgcgaagcgtttcgccgatagcctccggcaaaatggcgcatggacaggcgccgcattcgctgtccggaagacgatccggtaaggaactggccaactgagtaccgaccatttgtcattgtaggactcaatcggccacaaccacttccatttgttagatatttctgactgatttcaaaggttcagagggtggcaaaaagtgctgtccgacgcccggctgcgacgggtcgggccatcagacgggcctttacacgcaccaccgatcgttgagcg

SEQ ID NO: 22471 - DNA, 738 bp, Heterodera glycines
aaaatgtccaaggcgggtttttcgggttttagataggttatcagacaagcaattccggtttttagacctccccctaatatctgcgatttttctgcatacaatgcaagaatccgcattcggcatcatctactcttcgattcaataggacatcaggaaatttggctggaaaatgtcttaaaaagttgtgtcttttcatcagtactttgggaacagtcgatcatttctctgctgtaatttgtccccctctcccgacacacagatcattttgctagctgtatagcattgaactcgtgatcggctcttctattactacaaaggataagccccaaaaaagtgtaagtttcgcaaagttacggcgttctgattattcaatacataatcaacctgtttgcactgagagcaccaaagaggcccgatgagctaaatatatgcgggggggggtaatggtcgaatgaatggaaacggtgattatggtggggtggtggtacattgccaattgggaatgaattccttttaaaaattctcggaattttgaaaaacttaggtgccttccccctaataaatttgacggatgtgccaatgccaaacattccttccccctttcccctctcttttgcctaattctttcgccgtgccgatttccgatgggatgagattaatgtccccccccccctctctcgttcaatgtttgccctcagccccaaaatgaattcgtcctcctttctcctccctttgcct

SEQ ID NO: 22472 - DNA, 1449 bp, Heterodera glycines
tagtagcattctggaattttttttaatgatcggcttttttcatatttggcaaagataattagtgaaacatttgggaaattattgcaaaatcccattggaattggtgaatggcgtgacgtttaattggaaatttaaccaattttaaagggagaggagggctaacttgacctcgtgtttgtgtgcatagttcggatgcaccgagtgggcctggtcagcgctgaccatgaaggaacggccgagggaacactcaaaggcggttgggtggtccacggaggacaaaacgcggcgcagcaaccactcgaaacagtgcgactgggccccctgggcactgcgactgccaacctaaaacggaggaaattcgcttccacgggttgctctacccaccaatccccccgcccctttccaagtccaaacccattccccggatacgggtgcacttcatttcccctacattgtttcaccacgaaaataaaattttttttctttaaaaagtttttcgggaggaaacgacccgggagtgggggggggacggcgggagaaccagcggtggagcaggtcgtctcacccccgtcgtttttccgcaaactctgtccggatgcagcatttacgagagacaaattacgaaacttttcggtgtcgatgatgccaaattaagattcttgtatacacccacctcttcgttgtcaaaacaggcgaccattcgcacatttgggtccgtatcaaaagcgtcggtgtcctccaaactttcgacaagtcctttgatggcggtgtacgtggagaccaaattgtccagccgagcgccggaaatgaattcttcgttcagtccggacaaagtctaaatttaaaaaataattggggtggtcaaaccgatgctttttcttcgcttaattgcgtacagctggttgtgtgtcgtagaggaacatgtccatgtccaaaatatgctccgtcttgcaacccgccgcagcagcaaccgccttgagagagaaaaatttattttcactttttcggaagagttttttctcataaaatccatgtcagcaggcccgtagccagggggagggagggggcgaggaatccctaaaaaattttcaagaaaatgggaaaattttgaaaatttgactcaattttattaacaattccatttaaatccccagaatttcccacggaggcgcctaacggcaccgccggaacgccatttttcgtatttttggaaatttaacttcataatggtttggtgagttttcagcgaaaaacggggcgctacttgcaaagttaccgatttttgaaaattttttcaaaaggtgggacccttttgttctgcaaaacttttttgtgatagtcataaatttattctctggggtttttggggtccccgatcacgaatctttcaattattttgatcaattccgatttcctaatctaaatttgacaatttctattgttattcac

SEQ ID NO: 22473 - DNA, 1063 bp, Heterodera glycines
tagtattaagtctgtataccagggaaggggggggggggatccctttccccccccgaaacgaaaaattttttttaatatttcgccaatttttccccaaaaatgcaaagaaatggaccctttttctattaatatgcactctattgcttgtgtgataacttctgatcaaccacctgaagaaattgttcggaggtctttttggagacgggcttaatgcgcaagcaaggactgaaagaaagcgaaaattcattttgggagaaaccactgacataaatttggcatgaaatgccctccccgccaacctgtcagtgtgcgcgacgacaatggaaacccccgcttcggacggtttaaaggcaccgccagcagcaaaagcaaaaatggaagtctcgcttctgaaaatttttcaaatgttaaaattgaaattgaattgccgaaaaccctaaatgtccgtgccaaggaatatcttcgataattagtcctactttttgacatagaaacgatcctttggttgaatttgaagcttgtcatactcggacttttgaacaaaattggcactcttcagaatggcctcgaccgattcgacagctaaaaatggacgaataaaaggacaaattacggcacaaaataactcataaattagataaattaaatgaaaaactatgcattttataggaaattaattgaccatggaaaggggtgaccgatttgttgaggaactgaagaaaagcgagcgcagaagaacgaaaggcagcgggggaagaagaagttgtcatttgtgatggtggacaacaattatcaaccacaacagaagaagaatgagaagacatttttatttatcacagaaacacaaagaaacgggagatacgaaaaggtggtggacttttgcagccttttgaaaaaaagtcgaattggattcgaagtcttagcgactatgaaaaacccggggaatgagtgttgttcattctttttttgtttcttttaaaagacagatttttcaactacaggcaccacatgtagatgatctcattatccaatatattttgatgataatttgtgtgagtgaagg

SEQ ID NO: 22474 - DNA, 1974 bp, Heterodera glycines
  misc_feature (140)..(140): n is a, c, g, or t
  misc_feature (175)..(175): n is a, c, g, or t
  misc_feature (206)..(206): n is a, c, g, or t
aaaaaattctgtatttttttaatgaattttggcacttgaaaaacttcttgatttatggttacgattacaataatattgttatttaaagatacgaagaataaatttagaattttggtttctgaaaacagtagacgaattgntttttaaaaaaacaacaataaaatataatagtttntaatgcataaagcagccacagccattcgttntagcgaaaataaattgaatttgcttgggttccattccttttatatgtagttattcttcgagacatttttttttctgttaggtacttcacaaccagggttgtcagatctgaggatttatcctcattttgtggctttttgagaaattttgaggcttttggggaaaatcctcagaatcttttaaattttgataaattgacaaaatgttttacaaatatttaataagtgggtttttaatagagcatcaaaacgaaaatctcacccaaattttccaaaaaatttgctaaattttttataaaaaccaaaaaagaaccaatttttttttccaaaaaatcacaaaattaataattttttaatgaaagtctgctaaaaatatgggcaaaattctcaatttttcccctggcggcgcctatcggcaccgccagcccctaaaagtcctttatttttgttggagatggatgttgatgttggattttaattaatttgaattagcgccatacagtaacagtgatgttcctgtttgtttctccgcgccacatttccagtcattattttccctccgttgttttctccccattcattaattattttattcttaatttttcggttctaaattaaatctgttttgctccttccattttcgtcattcctctgactccgtcgtcatcttttatttatttattgatttcatttgtctttccacaataaatttaattctgttgttccttgtggacacaacattggcgacgcccgagtgcatattttgtgcattaccgtgaacttaccaaaaagctactctgacggccacctcacataacccataacactaaagttattccccatctgaccgcaagcctgaagagtttctcagtatattgactgagtaaagctaagtgtgtgttcggtatttgccaaatattgcaagtggcataaatttaattttatatttgttattgtcactttgaattcattctctctataatgacgacgaaggaagacctcaaaaatattttggaagcgcagcaaaaacagtttttggatttgatttcaaaaattttgcctcaaaatacggcaccaagtgccagttcttcggaccttttcagtcaaatcaacagtcaacttccgcaattccactacgaccccgaggcagatgaaacattctcactttggtgggatcgttttggacaatttgtcgagaaggacggtaaggatttgaccggcgacatgaaagtgcgtttgattttgggtaagctctcggcaacggattatttgaggtatgaacagcaagttcttcctaagaagccagccgaaatcgaatttcagcttacaatttccactcttaagtcactttttggcgacactaaatcaatttttgtcaggcgcttcgaatgctttcagctgtcgtgtggcccctcacaaaatgtcatggagtttggcgccatggtcaacgctcgctgtgaacgcgccgacatgactctgtcaaaggaggaagtcaaatgcttgattttcatcacaggtctgagcgacgcgcacaaagaactccgacaagagtgtctccgccaaatggaaaaagcgcgaaagtcaacgccaccgaggtccatgactttggaagcacttctggaagagtgccgctccatccaatcgcttcaaaattcggccgccgctttgtctggtcccgggcaaattcattcggtgcaggtccgaccacaaagagtaagcgatggaagtaagaagtcaaatcgaagtaaaacggtcaatcaaaagagcaata

SEQ ID NO: 22475 - DNA, 1675 bp, Heterodera glycines
attggccgtaaatgccaatttcagttacacgtggcgaatgtgcggctgctttcagccttgggctgtcggctacgccactcaactggttctgacggaaaatgtggacgctttgatcggtccgccttgtgtgaccagtaatgcctttttgtttgacactttgccaaaaattgcgtaaatgaaaaaggtgccatcgccgcgggatacgtggcctccttctacaacattccactgtatttgtggggtgctactgtggcctcggaattttacaacactaccgtataccctacactgaacaacgtgaacgttaactcggacatgtcagtggagaaaatattcttcgccttccatcccctaaaattattatttctaccaataaaataaactaaaatggatttgctttacgagccgtcacaaaatcaaatgaccaatgatttcttattaatttcaacaattattgcaggttggcgttggccttacaaagtgtgttggtgcaattcaattggacagaagtgtccttcgtgtacactccggacaatgagcgaatgtaagaattattttgaataattaattaattaattagctattaatataatttaattagggtctgtaactcggtgaaacagagtctcacaaatgtgctcaacgtgaccaatgtgaccattgttttccagcatcagatggagtccaatgtggacagtatgaaggcgacgctgagaaatctgcgcaaccgatcgcgaagtgatgggataattaatttgatagcatcgctaattaccatcaattagttgtgctttcctgtttcgatgtcgaggttgaccgtcgcaactttctgttgtccattttcgacactggtcttgctgcggacaacgaatttgtgttcatcatgggatccctgcgcaaccagggcatgctccagcagggtaattaggcaaaatggccaaatattgctccagcaggctaattaggcaatttggccaaattatggaaggggtaattaattataaattgttttcagtttcatccagtgaggacggcagtgtcaaatatgcgaacatttgggtggacaaaaacagcccgagcgatgggcgcgactcggacgcgctcgccgcgacaaaacacgtgatcatggtcggtcaatcatggcaaagagaccaagagcaaatctaagtgcagggctcgcattcgtccttgaatggcaagtacgtccttgaaattgagccctctcacttgaaaactacacaatactcttgaattcaagatgtcattgaaaatgagcactttgcatatgacaaaaaattttactggcccttggatttcacgaaatttcccgttatgtccttggaaatcagtatacccgtccttggaaaacgagtttttccaatgatagtcctgtttaagtgcctttatagtagtcttcgttgttcagattgatctggaaaaccaatcgagtgatcagatcgatgaattcaaccgaaatttgactaccaaattcggcacttatccctttttatgcaacggaagttgcatgggcgacgcaggagaacaatcggttgcaatttaccgtataaaaataaaaattacaaaacatttaattgttattttttatccgtcacaatacgccagggctttgttcgacacaacatacgcatattttagagcattgaatcgcacaatg

SEQ ID NO: 22476 - DNA, 1578 bp, Heterodera glycines
  misc_feature (1512)..(1512): n is a, c, g, or t
tatagtaaaaagaaaaccaaacaaaattcgaatgggagcgctggactcaattagctaagcgcggtaggccagacccagttagttgatttcagatttgtcccgttaaacaaatccgaaaataaaatatgatcaatcgagcccaacatattctcaccttttccatcatccggcgccgccgtctcctcctcttcggtggaagtgtcgtcgccattgtccggcttcgtcgccgtcggcgcgcctagcgccgtcagtgtgatctgttgctgcgtcgatgggccgtcattgtcgtcggcgttggcgctcagttcttcagcgcccgcctcggcatgacattcgaccagcgcctcgacaatgcaagcgccggcccccggcgccgccgtcgccgtcggtgttgtcgccgcggccagcggtgccgtgctgaccgcggatgcggacaggttaagcgaggaggcggaacgcgagttctcctgcgaattgttctcctccccgtcagcgcatggaatgcggagagtgccaccgctggaaaagaaagggagcaaaaatgatcgaccagaggagcaattttaatgagagcaaaagtgatcgaccaggggagcaatttacatgatcaaaatcccatcaaacgaatttgatcaatgatcaaacagagttaatcggcttgacaaattgattaaattcgaaatcagttttattcgcgaggaagtgatcaaaccaaaacctgatgatctagttggcttaatagttttgcacattggtcaacaaaactgtgggattgatcaaattagatcgcctttcgtccaatcaatcaaataatgttagagggggagagggatgcttaatgggttcgatacgattcaaaaatacagtaacctaacaaatacagtcaatcagaatctaagggatggtgaccaattaccgtaattctgaccacgaatggtgtactatacaacacacacaacacacagagcatcagagcatcagagctcacctgtcctccgtttcctcctcagcgccgtagaagaagcagcccatggcaccggcgcccaacatgttcaacgagtcggtgcggtttatccagcggatgtcaaagctatacaagaaatggcaatatcatagcattatcacttttaagcggggatcaagaggaggaaattccccgacagaacttatttgccggtttttcctccagggatcttcaaaatgacgaaactcactcattgatgccgttgttgttgatttccaacggcgattttcgggcccaattacggcactccatttgttgttctgatttgttggcacgcaacgacgatgacctgttgctgtccatgctggttgcggaacctaatggcgcgcattgaacctttttttcttgccagcctagagtaggtctcgaaaatctcgatctcgaatctcggaatctagcctagtaagttttgagtctcgggacctagctcaaacgtaggtctcaagagtctcggtcctgagcctagacaccaaaacccggaatctagnctagagcaggtcttgagtctcgggacctagcttcagatgtaggtctcaagagtctcggtctcgagc

SEQ ID NO: 22477 - DNA, 1538 bp, Heterodera glycines
ttaaaaattttgaaaaaaatcaaatacttgatgaataatcaaagataaaatcagtgattttgcaaaatctgagctcagattcggaatcagcacattttttcatcccaggaaaaacaaaaataaaatttttaagtttattttctgtcaattctacacctttgccgatagtgtcccatcagtagaagttcaaaatgtcttcctcctcctcctctccattgttttcttcattgttcaattgtgatgattccaacctttgtttccccgtccattcgtcgtccgtccattttttgcgttcgcccgaccatttttacaacacattactggtccgtttttccgatgtatttgcaaatgttttttaattttggtttcatcaaatccaatttcgtgattttctcatttcgttttcttccccccccccatgtgaatctcgaaagattttaattctcgactttttattcgaattcgggtcctggattcagaattggtcaaatggatgtcgggatgttaattagcgaccccgttaaagccttggaaacatttctatgacacttgaaaacaaaagaaaaaaatttttcgaaaaatgtgggggggggggggggggtgtagctccctatttcccggttttttaaagaaattttctgtctaccactaaaaacctaaaagaaacactaaaaaaacattaattcatatatctaagaaaatttttctggtcatttttttttgtttttaattcccaaccagccataattcggagatttggcccatgatttttctatttgcttttaaaattcccccgctttttcagcaacgcgttgagtccgcaaagcgtcgcgttgtgctgtccgccctctatttgggcaccgacgcgttggagcagcgattggtccatcggttggcggtcgcggcaaaaagtgtggcgaccaaacgccccgtcaaagttcgcattttgctcgactttttccgtgccacgcgcggcgcaaccgccgacggaaaatcgtccacgacaatgctggcaccgctgtgcatctacgacaatgtggaggtgtgtaaattttcatttgctacctccccccttttccttttttttgaaaaatttgctgaattttttttgaacgctccgcataaaagtagagtgaaaagcaaaaaatataaacgaccaccaaggaccagggggttcactacatttcaccctgttacccgacatttgcgcctatgacccaaaaacgggttcaaacttaagtttttttcaatccctaatggaataaactgctttaaatactatcagcagaaggggttgaaaaaaatgtgagtttttttttggtttttaatcaaaaattcctcaatgcttttagcattcattagtttttatgccttaactccgcgaattttcaagttttgctctaacaaaattgcttctttttttgtattgacattcagtgcattctttggggatgatagttgcggtttttggcctacgaaattgcatcaaaaaaaggtgaaaaatttcataaaattttcccaaatcaaaacgctcacat

SEQ ID NO: 22478 - DNA, 1102 bp, Heterodera glycines
accaacagcacaatcaagggactcaatccgccagcatttcaatcactggggcatcaattctcctgcatttcaatcactgggactcaacccaccaacattccaatcaacggggactcaacccaccagcattcaatcactgggactcaaccctccagcatttcaatctctgggactcaaatctccggcattccaaacaatggactcaaatctccggcattctaaacactgggactcactcaacccaccaactttcaatgacattccaatctctgggactcaacccaccacatttcaatctctgagactcaattatctgactttccaatcgctgggactcaacccaccagcatttcactggactcaatccaccaacattccaatcactgggactcaatccaccaacattccaatcaacgggactcaacccaccaacattccaatcactgggactcaatccaccaacattccattcaacgggactcaacccaccaacattccattcaacgggactcaacccaccaacatttcaatctctgggactcaaatctccggcattccaaacaatggactcaaatctccggcattctaaacactgggactcaacccaccaacttcaacgggactcaatccaccagcatttcaatcactgggactcaatccaccaacattccaatcaacgggactcaatccaccagtatttcaatcactgggactcaatccaccaacattccaatcattgggactcaacccaccagcattccaatcactggcactcaattctcctacatttcaatcactgggactcaatccaccaacattccaatcactggcactcaattctcctacatttcaatcactgggactcaatccaccaacattccattcaacgggactcaacccaccagcattccaatcactggcactcaacccaccaacattccaatcactgggactcaatccaccaacattccattcaacgggactcaacccaccaacattccattcaacgggactcaacccaccaacatttcaatctctgggactcaacccaccaacttcaacgggactcaatccaccagcatttcaatcactgtgactcaat

SEQ ID NO: 22479 - DNA, 1096 bp, Heterodera glycines
gggattctgagtcatctttatgaggaggcggggggggcgacaggttcggtaacggaaaggtatattaagtttctattcatatatgggttatattcactgattataattaatttgaagatttgttttaaattatttaaatttatttttttttttaattaaagaaattattttttgttttattattattaacaaaattattttaattaaatttaattttttcttttgaaaaatagatttatttttaagcaaaattagatttaaaaatttggatgcataataattcatttcaaaataaagtaaaataaattattccgtttattaattaaaaaataaacttttacattttttattattttgtttttttaaaatttttaaataaacctaattctataaaattatatttaaaattatgaaattatttttgtacatctcataacaagttagacttttgtacctcttctaatcactgttgtacctttctaatcacttttgtacctcttctaatcacttttgtacctcttttaatcactgttgtaccttttctaatcgcttttgtacttgtacctcttctaatcacttttgtacctcttttaatcactgttgtacctcttttagtcacttttgtacctcttctaatcactgttgtatctcttctaatcactgttgtacctcttctaatcactgttgtacctcttctaatctctgtaaggccaacaaaatttgaataacgggcgcgaagcgcccgtatgaaccaacaaactttaaataacgggcgcgaagcgcccgtccaaggccaacaaatttaaaaacgggcgcgaagcgcccgtctgagtccatcaaaatttaataacgggcgcgaagcgcccgtccgactcaacacaatttaaaaaacggccgcgaagcggccgaaaagcacaacaaaaattagaaacgggcgctaagcgcccgtctgagtccatcaaaatttaataacgggcgcgaagcgcccgtccgactcaacacaatttaaaaaacggccgcgaagcggccgaaaagcacaacaaaaattagaaacgggcgcgaaccgcccgtctgagtccatccaaattttaataac

SEQ ID NO: 22480 - DNA, 1014 bp, Heterodera glycines
aaaaaattccaaatctccacaacaagagctaatttctaataattgttgtacctcttttaatcacttttgacgtcttttaatcactgttgtacttcttttaatcactttttacctcttttaatcactgttgtacttcttttaatcactttttacctcttttaatcactgttgaacctcttctaatcactggaagcggcctaaaaacccctaacatttttttaaaaattccaaatctccaaaaccagagctaatctaggaagctctatcgaatggtgtgccatatggcaggaaattttcaaaaattttcgagctaggccccctagaaattttcgaaaattttttttgggttaaaaatgagggtcaaaaatatttttctggggtattttgatgtgctgagcacgaatatgatgtttatttttcgttttaaaatttttggaattttttaaaaattccaaaatattttccaattttttggcccacgggattttgggcgaatattgaaaaattcatatctagcctaagggttgatcaattttacaggaataaagccttaaaaatagagaaaaatcgggagaattttatgggctttatttggaatttctatctaaaaaaggaaaaaagttattccagaatttctggaaaaattcgaattttcagaaaaaaattcataactcggttctgaaaagatattctggaaaaataaaatacttcaaaaatccgcaatttttttctctataatataaattttatttggcaattttatctcttttttgagagatgttacaaaaataaaagtgattttggcattcgagaccaaagggggtggacaggatttttgagtaaaaaatttttttcaacaaaaatcttccaaaaacatgtctttaggggttatttgggccgctgatcatgaatacgtaatcagtttttactttagacatcgttaagacctcagaatccctgtgtgattggggattatgggacatgttctgagggggggggcaggttcgaatccgg

SEQ ID NO: 22481 - DNA, 2084 bp, Heterodera glycines
aaaacaattctgtccttaaaatattgatcacaaaggtcgcagcatttgcattttctaaaatgttttccacaattttgaaagtttctccatttttaattataaaaaatcttttttgaaaatttatattgtctttttacaatttttttcccaaatacatactaaatatatctccgatggttccattaactgaaaatttcataattaaaagcatttataaaatggaaatctttgacgaatttattgttgttgacgaaaaagcgatcagccaattaactgttgcccattttaattccagctccaactgtacttttcgtgatgtgacccaatttgccgcactgtaatttcacttttttaaatttgatttacatggtgccgccggggaaaaaattgaatttttttttgcatttttaataaattttttcgaaaattgtgaaattggttctaaaaggcagaaataggtttctagtgccaaatgcctttttaaatcacttacatattttagtaaatttatgacaagctgtgccatattgaaaatcaaggacattggcaatgcttccaagccaaatgaggagccattggcacaaattgtccattggtattgggacaaaaatggcgcacaacagatcaatgatgtaagaaaaaaaaaagattaaactttaaaatgattaactaataaattattttagacccatacacttaacaagggcagtgaaattaattgtgcctgtgccaatgcttcatcaattgttatccgaattctcaaaaagcgggagaagaagcccgatgaaaagtaaacgttacaattattgtcaaaagttatgattttgggttcggattcaaggactaattgaatgcctgctcctctgatcactaaacatttgttgttccccaattaagttcgttcccggcgccttccaacagctcaactgatcacgacgaattgacagtgaaaattggtgacaaacaggtgaaaccgaagaagagcatcacttttttaaatttaaataagaaattcgtaataatcaactttttgtagaatttgatcaaggtcgccttatattctgagcagatttttaaaagagattataaccatttcactggtcatcttgatcagattgaatgataacttgatcagtatgctaaatttaatcagatcactaagaaatcttgatcaaatcgttaattaatcttggtgatcagatcgctgtgtccgcccattggctgatgtccgtttccccggtgatcagtcgcatgctcagcgtggagatgaaggagaagcagcagcgaatgatcactttggacgaattgggcgtggacatggaccaattcatggagtttttggaggccatcacttatcaaagcacaacttttctgccaaatcgtaattccatgatactgtatttattctactataacccctgaggggttgaaaatataattttaatttttttgtaaattttgacttctcaatttcccaacttttagccaaaaatgtgctgatgctgctcaaattggccgactatttccaggtgggtgccattacgatatttctctaaaattaccataaattcaattgattttcaaaaaatgatacttaaatttgaatatcctttatcaaagagagtttacccataattttcaataaaaaattactttttactcatttttaaattcattaggctaattattaggggcactaattgctccgttttgaggttgccgcgttgaagtcgcgctgcgaaacgcatctgatcaattgtgttgaaattccgctgatcgaccgttttcttttgattgagcgttttgcactcgactatttgaaagtgatttaattttttaatatttttaaataatttttaaatgatttaattgcttttcccacattttagaattattttttgcattttgatgtcaacaaattccgtgccttttttaatgcgaaccatgaacagtttttgcctgttatcagcaaagaatttttgtacgctttgtctgtccgactgtccgaacaatgagcgggctttgatcaaattgattttgatattttcatagaatttgatcaaattgattttgatattttcata

SEQ ID NO: 22482 - DNA, 2514 bp, Heterodera glycines
  misc_feature (1619)..(1619): n is a, c, g, or t
  misc_feature (1626)..(1626): n is a, c, g, or t
ttggtatcattcgaaagcttaacctgtttaaagctttttctaaactctcttgcttcgcgattagacaattaccaaaaaagttatacatgaaaattgcgaaaaaatcgaaatttttcataataactttttcagaaaccaaaaaatctttttgctttttgtatggctaatagagcatgtaaagagccttcgaattataccaacaatttgggttttgataacaaaaataagtggaaaaaccgttactttttaaatttcagttttgctgaacacgatcaaaattccaattaggaacgtggttaatattttcgtcagtaaacattttcgtcagtgaaagttttcgtctgtgtactatttttatttatttcacagttttccatttttttcgtcagtgttccaattcggcagtgaatattttcgtcagtggattcataaaattaaaatgtgcttcatttttggttaaactatttaatacagtatttatcgcttcttgcgtatggtacttctaagcaaaataaaatgattaattgtgctttaataaatgatttacataaaaagaaattgtactttaaaactgttgaatattattagtaaatttacttctccaacttcttatctcgccatcgttcccatgcgttctcgagtgcctatttgcatatttgcttagtccttatctagtttttgcaatgcatttggcacttggactttcacgcacgaataacagccttgaaggctggcatgcaacgtgttgtttcatatcactatatttaattcataatacagagaatttaatattacaaatcaaatagctttacaaaatttttggtttaaaaatgtgtgattaaatgtatggcaaaactaaaaaaaaatgaaagcaaggccattggctgtgatcggtcatcaatgggggataaagtcaaatcattaattagtaagcgatgggcggaaaacaaagcggaaatgaacatttcccgcgatcagtgatcagacaaagtatttgtgctgcagacattcaaccgcagtcggccgttcgtgcggattaaattgcaaaattgccgtgagcaactcaacaccggaggcgggcaaatattggggcatctgattggcaaacggaggtgttatgtgcggagagttttcggcgtagaaagaatgagggacaattgcatcggcgggccaaacagagacggacggagtgccgagttttctgaggggggggggagaaatattcgactcgacagggcaataaaattgaaaaaaaaaaattttttgcggcagcattttttgaaaaactcactcaaaaatgatgcgcaattgctccgcctccgtatcccctctgaagagcgcgtcgcgcgtgtacagctccgccaaaatgcaaccggcggaccaaagatcgaccgcagtaccgtacttgcactggagcagcagctcagggctacggtaccacagggtgaccacctcggtggtgaaggtggcatgcagaccgtagttccgagacagtccgaaatcggcgatctgaaaacagagaggtaagcgaattaatcatttacaaagcttttcgaaatttgagcagaataaaaaaataaataaatttactcacccgcaaagtgtgtcttgttcaccanaatgttntgaggctaaaaattgggggaaaaaagtgtcaaaaaggacgccatgaaacccttaaggtcacggtgaataatactgttggcatgaaggaaatcctaaacaaaaactgacataaatgaaaatgtcggaaaaggcaattaagtaattgctttcttaattgtcaaaaacaaatcaattcctcacaatgcccgtcattatttgacgtgcaaaatatttgcactgcgcgtcgcacatatttttcggaatttttcgcaaaaagtcgcacaagtcccagtcgcacttttcgcagacgatgttcaaactgatggtgccgccctttcggcgaatgaatgcgtcgtggagccttagaaaagaacacagacttttaatcttttacttttaataatttggatgtgtgaataattaaactgcaaaaacagaaatttgcctgagaatatttgggtgtttcatctgtttgagtgcgacgagagaagcgacctgaatttgtttcggtgattttgccatgccaaagcggtttagtggaaatgccatccgaaagaagcaaaaacggattcactgcctttttacctctctgacgacactctgcggaattccctcctccgtcgctttaacgggaatttttttcatggcgaacttaaacacgttcagttgaacaatcagcagaacgacttctcccccgcccttccccacctgctctctctcattttctttgctggtcaccaaccaaacttcgccgtacgcgccttggccaagtacgcggatcgggcgataatcctcgtcaacgggtggccgcattctgcacaaatttaaaaattttcgcggacatgttcaaattcttcaaaggacccgaatattacatcgattgccattgcattactttgaataaaattt

SEQ ID NO: 22483 - DNA, 2616 bp, Heterodera glycines
  misc_feature (133)..(133): n is a, c, g, or t
gatgccgttttccgctccctcctccactttaattggaaattgtcgcgtggctccacgcgccaatgtccggcctcgccacgtacgtcagccgacccgcgtcgatgtccgcctgactgacccgctccaaccgccncagggagccgttgagcagctgaacagaagcggacaacagtcccgagcagttctcggaaagccattcaccagtcggccgtgcattggctgctttgtcaggtggaaaatgactttttcgaccggtattttccctccgccggtcgccttcagcaaattaggaccgatcaccgcagggacacccggcgcagtgccgagtttggcgtttcgttcaatttttggcccaattgcgacacttggcacaggcaaatgaattgtcggtgtactgctcaatgtcgactgagttggcattgtgccgtcctcttttttgcttggcaatatttcgtcaaattgcaacaagaaaaattcggggcccaattgatggcgaccgtcgtttaacagaaaatggaagcccattttcgtgtcctataaaagtcgatgttgattttggccctggcaaaaagcaaaccggcacgcccttcgcctcgtcaatttcaaagcggacaaagccgtggtccaattccttttgcgtgaaagtgtccatggtcgtgttcagtcccttttgaagtgcgccgccctgttgttgccataccataaaatggagttcactcggcatttttgaagggtgctgaacagtttcaagcacaattaccgtaggaagtgggacacagtgaccgttaccgtagcttggagatgatctgcagtgattggcacacttttttgtcccttttgtaccttcaatggaacattgtggacaattgttggcactgcaaaaaaaggacagaaaatatcatttttacaggtaagtataccgtactcaccctgtgcttcgtctcggccaaaatgaattcgaaggtcggcggttctgctgcatttcgcactgtgagaaggtggttcaatgcacacgcggagttttatttttacaatctttgaattaagaaattaacagccaattaattgaaaccaaatcaaagtcgagctttggggaagaatccaaaagtggcttcttttaagccatggattggcaaattcaaatgccaaaatatttttgagggtaattcacaatgtccatggtgctgttttgttgtgctttacctcctcttccactgctctttggcccatcgccaccatcgcaatgtctccggccgacagttggccatggctaaagccactcgaaataggctgcccaatgcgtcggttgaacagcgccagagatgggctcttttggacgaggcgaaactctgcctgagcgatgtccaatggcacattcggtgggatggaaacgcgcaaaaaatgttcctccaaaagcattccctcagagtttggcactccgtcgagaaaagcggcgcggaatttgatcagtgagggagtgaccaattggagctgaagggaaggaaaatagatgaagaataaaacgcgtcgtttaagtgaattttatgtgccgaaatccctgctaattgcacctgagtgtcggcataaatgcgaatcggcacgcggaatgggcccaattggaggaagaagtcgccttgggctccctccccctccgccttctgctggcggtgctctccgtctcctctccgccgcttctcccatcgttggacggttattttcacttcgaaatggtcatctttttccgcctccgccattggcatttgtccattatttttgtacagttgtctgctgttgtgcacatattgcagcgagccgaaggtgagcagtggcggaagggcgaagctgagcaacggaatgccgtaattggcggagggagcggcgactgatcaaaggggggcaaaagccgatcaaaagaacaaagtgaccgtgcaaaaggggcacccaccctgtttctttctctggaaaatgacttggccacgcttcggtgccgtcacaatatgatgtttggccacgaattggtgccgctgttcgtgcagttgtgccacgattggaatgtgccattcaatgggcgcacttccgccctgggcgacgaccaatggcgggagaagcccttcttcccgttgctgatcaatcccatcactgtcccccaattggtcaatcgaatggacggaaagagcgatcgcttccaattatttgtctttaaacaattgtttgttgtgcttcactcacaaattggcacttttggcgcatccctttgctctttagtttcgtcctgtgccaagctgaacacgaccacccgtttttgttcagcagctgtcgtcctgcttctgctcccccctacgtccctcgtaattattttaatcggaatcgctttttcttcgctttcttcggcttcatttttgtcaaaagcaaagaatattttgttgttgaatatttccttaaatggattatatttaattaatttttattataatttttgaccatttgattaaatcgccgcactttcgccaattttccgtccgtttttaaacgccaaaaaggcgaacgaaaaagtggcggcatttcaaattcaaggcaggcatcgtgcacattttcgtttgtttctgcacgaaaatg

SEQ ID NO: 22484 - DNA, 1687 bp, Heterodera glycines
aattatttattattatttttattttttttattttttaaataataatttttatttttttcaaattttttattcgaaaaattctgccgcagactagcgggctcgaacttttggtctgccaccaatccaacacactaccactctgccacgcaaacacttgccagaaaaaggataattgtccactatatgctgcaaagatgatgacgtcaccactgcgaggggtactgtagtccagggaaaatcgcaataaataatccgcagccaaaaggattcgaacttttggtctgccattaatccaacacactaccactctgccacgcaaacacttgccagaaaaaggataattgtccatcccactttgggcggtctttctgtcgtaagtctttctctcttttgccaaattgttcttcaattttttctcggcttttagccaatgcaaatggcaactgccgtctgagcgatggctcgaaatgttgagaattgaattttaagttgttaaacacattttgttaatttggtcactgccatttaactaattttttaattattcattccatgttttttactgttgcattctattaaaaataataattaatttcacaaaactactcattatattaatttggtttaatatttgccaattatttacatattttcattaacattttcccgagggcgggacctccataacattcgtagtgtagcggggggcccttttcccagtcgcatccccagtacaaatggtataccgtcaacaatagtcctttattgggtaataataaaggggtacaactggggggccccagcccagaacgtcctcgggaacagagggacgcctgagggggtccctctcgcaaagttggattggccaaatccgaaaagtgatcagaggagaacgacggcgggaggataacaattgaagggaccgccccgtttcgccccagggacatttgttaatgatagattagggggaacaattaaatgtgttaaatgagtaaattatcgtatctcacatggatgtcgctagaatcacaatgtcccgaaacccagcatttttcttgtcccgaatcccggcccccgtcctgacccggatccccggattcttaccacactcgaaatcgactcgacagttttctcaacccgcggcaacctaatgaatgcgcttatccttttgattatttgtccacattttacagttggaggagggagcagatccccaccaaatgtgccttaggaaaatcaacgacatttacaaattttgtaagcaaatttttattgtgggacaatgtaaaggggaatggatggcatcgagactgggatttcattttccaattagttgggacctgattggacaaggatcgcaatcattttcatcaaaatttcttcatcatttccgggatgatcaccgcgaaaacaaggatttcgaagctcagtccaaaccgggagctctgatcctgtataattttactgtaaatcgtttccaactattgattacactggattgattgggatttcatgtctttaaaatcgaagtcggattcgaaaaaagtgggatttcgggattatcccattccggagctcggatcccgtttaacccatttacaaattctccaaccccatgcaaatgttaatgagttttgtgtttgccagatgccacccctctttgggttgcggcatcgtacggccattt

SEQ ID NO: 22485 - DNA, 1990 bp, Heterodera glycines
ctgaaatcagatttcagttttgaccacgttaagacctcagaattcccgtgtgattggggattctggggcatcattttgaggggggggggggggtgcgggttcggacccggacggtgtaaattacttttatttttattttataattttttcattgttttaatacatttaaattattaacaaaaaaaattaatattttaaataaattatttttctgtgtgaaagtcattcttttaacacccaaaattttcggaattttttttgggccacaaggggggtgaaaaatatttttctggagtattttgagcacgaatacgatgtttgttttgcgtctcagaatttttaaaaaaattttgcaaaaatttgcaattttttgcccttgggaatttgggttaaaatttgaaaattcataatcataacttatgactgagttgctcaatttaattgttttaaagctttaaaaatagagaaaaatcaggaaaattttatgggaattatttgtaattgaaatctctaaaagaaaaaaagttattccagaatttctggaaaaattcgaatttttagaaaaaaattcataactcggttctgaaaagatattctggaaaaataaaatgctacaaaaatccgcagtttttttctctattttataaattttatttggcatttttataatttattagaaaaaagttataaaaacaaaagtgattttgggattccagaccaaaggggggtgacaggatttttgagtggaaaaattttttcccaaaaaactttcaaaaacatgtcattagggctattttatgacgctgatcacgaatacgtgatcagattttacttttaacatcgataagacctcagaatccctgtgtgattggggattctgagcatcattttgagggggaggggggaagttcgaatccgggcggtatacattattttttatgtgtttttttgcttatttttacgtttttaataatttcaagttaataataaaaaattattatcttttaaaataaaaaacttttgaagaattaatttttcaaaattcctttaaattttcaatatgatgaaacatatttcactatatgttacatgctaagagaggaaattcatgaactccctccgttttcatgtaacatgtaacatattttgaagcgggcgcgaagcaccgaggccacgaagtgttcttatgagccccacaaatttagaaatgggcgcgaagcgcccatcttagggcgtaaagctgcctacaaccccttaataacttttcaaaaatcattgcatttcattatgttaatacatgttacatgttagatgctaagagaggaaattcatgaactccctccgttttcatgtaacatgtaacatgtaacatattttgaagcgtgcgcgaagcaccgaggccacgaagtgttctaatgagcccgataaatttagaaatgggcgcgaagcgcccatcttagggcgtaaagctgcctacaaccccttaataacttttcaaaaatcattgcatttcattatgttaatacatgttacatgttagatgctaagagaggaaattcatgaactccctccgttttcatgtaacatgtaacatgtaacatattttgaagcgtgcgcgaagcaccgaggccacgaagtgttctaatgagcccgataaatttagaaatgggcgcgaagcgcccatcttagggcgtaaacctgcctacaaccccttaataatatttcaaaaattcattgctttcattagttaatacatgttacatgttacatgctcagagaggaaattcatgaactccctccgttttcatgtaacatgtaacatgtaacatattttgaagcgtgcgcgaagcaccgaggccacgaagtgttcttatgagcccccaaattaagaaatgggcgcgaagcgccccatctaaggccgcaaagctgcctacaaccccttaataacttttcaaaatttcattgcatttcattatattaatacatgtta

SEQ ID NO: 22486 - DNA, 1738 bp, Heterodera glycines
caaaaaaacatatatctaattcaaaattatttcaaaagaatatttgatataaatccaaattgatttagagccttaacatctggtaggtttatgtccaagttaaagaaaaaacattgaatgcatctttatatataaatttgataatttgaatagacataaaagatttttcaaaagcattgaaaataacaataaatataaaatatttgttcgaatttttgtgagcatcaaaaaattaaataaatttataattactaggatatatgaataatttttccagtttttttttgaaaaattcgtagaatatgttagcttataagagataaaaattttaaaattttaaaaaaataaaaataacattttcttttaattcataaattccgaatagtaatctaattaatttattttaaaattatttattgttggatataaaatattatataaaaatttgtaaattaattacagaaagaagattattgaataaatattaattgaaaaattttgaaaaaattaaatatttataaatatattaaagaattgaaatttttcaaaaaattttaaagtaaaatacaacataatttaaatacttttttcaatcttataaaaaaattaataaaaattataaaattgttagaaaggaaaaaataataaatatttataatgaatttatttaatttttgaaaaaaatttaaaataacattaataataatttatattttcaatcttacaatggataattaacaaaaagaataagttttttaatttaaatttttaattttatgacaaatttgagataaaatataaattgtaataccagaaaaaaacagcagttaaattcactaatactattttgcattttaaatattatctttttttattaatagaatttaaaattaaggatataattcttataaataaaaaatatttaaaaattctgtttcaattattatatatatgttagaatgataaggggtttcgtttcaaaaactaatttgagaagttcgggaatagctgcggggctgaaattttgcagcaaggggtaactcgagacggcgcatctgggaaaactataggttttttggtccgaggcccaactgagtaccagggaccgatttcccgtttttgctcgcagttcaaggcccgtaactttttttctgacactctaatcaaaaaatgtccgctggtaggaaactaagttgaagtgttgactaaaaaacaaaaaaaaatccaggcctctacctataataggaagggctgcagaaaaatggagaaattcagtaccaactttgtccagttcagtcccggttgaataactcattagggtttgatctgggcgggggatggccagcgagcttattatagagctcaatgagctcgatttttccaaattttaaaatttcaaaaattttcaaaaatttccgagttaggcctaaaagtaggttttggggtttttgaattttaggattttttaacgatttttccaaaaaaatcggagaccactttcaagcaacagtttttcaagctctatcgactggtatttttttcggaaaaatttcgattttttctcggaaatagaaaaaatttttggcctgagcgggacatttgagtcccgggcccataactcgtcaggggttgcttttagccaaaaatggccttagagcaaaattgtagaactttttaagctctatcgaatggtgtgcaatgtggcaggaaattttcaaaaattttcgagctaggcccc

SEQ ID NO: 22487 - DNA, 1997 bp, Heterodera glycines
tttgtatttttaccccgaaaaaaatcacaaaaaaaaggaattagttacaaaactgagaggaaaaataaaaagagaagagggggttgaaatgaataccaccggaaaattttgcaaaatgaccgacacttttggatgccgaattatcatcttttcacatataactttttcttttatccgaccacaacaacgctggagcgatcggtcgtcggttggggaatgtgatgaaaagatggtcattgtccggggttctcctttggcttgggtttggagttcctcccctttcctttgtgtcagccctctcatcactttttgtcccctcaattgaccaactgcccctcccctttctgccaccctcaattcccctggcccgttcgttcattcattctgttaattgttcaactttgtttcgcttggcttggttttccactcagcaaataaagaggacatcgaaaagcggatttgggggcttggtgttttgggccatttttggcccgcccggagctgcgacgaggggccccattttgggtgtccccgagtcccaacagtctccagagtagggctttgtcacccgggttccgttaacccgggttaaaaaattttgaaaatcgcgttgctcgtctttaacccgggttaaataaacccgggttaagcaaacccgggtttattgagtttttaaataatttatattaataaaaataattaagaattgtgattaatatatttggtacgaaaggcttcggcacttttaaagcgatgttttcattatttaaattttcctattgctcattttcggtttcttcttcaataaatataccgcaaatattagaattaagcttttattaataatttaaaattttttatagttttttaatattccaggacattttttaataatgaaataacagatattatttacctaccaatcaacatttaaatatgtattacaaattaagaaagattcagaaacactttttgggttcaatcccaccattaagatggaaattctattattttcttaaacttatttttagggatgtcaattttatgtaaatacatatttttttccttgctttctttcttttttgtgtttgcattacatatttcggggttttatacatatttacatatttcgggcttttatacatatttggtacatattttggactttttcggactttttcatacattttttacatattttgtggattttttacagaaattttcggaaattctcaaaaaaaaatccaaaatttcggcaaatttttcgtacataatttcaaatttttattgcatattttgagaatttttggaaatttataaaatttctagtgaaaaataaaaattaaccaaactaatttttaaaatactaaactgtgattttaggcttatttaggtcatttttattgcattttgtgtctatttcaccctttccgaagaattttttttccaaaaaataaccattttaaaaattttatttacatatttgatacatattttgggtttttcttacatatttcgggattttttttacatatttatgtacatattttgacaaatttttgtacatatttttgacatccctacttattatcaccgcaactcaatcgcttcgatttgccataatttctcggtgtatgcaaccatttggacaacgcttggccagcagaacttgcatttgtcttatcatcatcaatcaaatcgggcaacagggttggaaatggattgtattcaactggctgagttcgtagagaattgtcggtgaaatcagaggatgcaaattgtcaaacacaatctttggcacccaattacggcacggcattaattatggccaactacccttaggccttcatttttccacactaccactgacttccttcgcttctgatccggcacattctttggcaccccattacggcattaattacggccaccttcgcttctgatccggcacattctttggcaccccattacggcattaattacggacaactaccctt

SEQ ID NO: 22488 - DNA, 2182 bp, Heterodera glycines
  misc_feature (2139)..(2139): n is a, c, g, or t
cgctgactggcccctcggggcatgtgtcgcaccaatgaggttcgctgactggcccctcggggcatgtgtcgcaccaatgcggttcgctgacttgcccctcggggcatgtgtcgcaccaatgcggttcgctgactggcccctcgtggcatgtgtcgcaccaatgcggttgctgactggcccttggggcatgtgtcgcaccaatacggttcgctgactggtccctcggggcacgtgtcgcaccaatgcggttcgctgactggcccctcggggcatgtgtcgcaccaatggggttcgctgactggcccctcggggcatgtgtcgcaccaatgcggttcgctgactggcccctcgtggcatgtgtcgcaccaatgcggttcgctgactggccctcggggcatgtgtcgcaccaatacgattcgctgactggcccctcggggcatgtgtcgcaccaatacggttcgctgactggcccctcggggcatgtgtcgcaccaatacggttcgctgacaggccctcggggcatttgtcgcaccaaagcggtttgctgactggccctttgggcatgtgtcgcaccaaagcggttcgctgactggccctttgggcacgtgtcgcaccaaagcggtcgctgactggccctttgggcatgtgttgcaccaacttttggatctgcattcttaatgggatgtgtgagccctggctgatggatttcagcacaggatgactacactccatggcgaagaatgatgtctttgatctttatttgtgcattttggttaataaatttttaacttgtgtgcatttattggttaattacctcatatttttgccgcatttgctattccttcctgattttttgtttcagatgccttctaagcaagaaaaattgcggaaaaaagagcaagagcgttatcagcggcggacggagaaatctgtcagtcgggataactcacccgtcccagacgggagtgcagatgggaatggagaggcatcggcatctctccagggcaccagcaccccaagcttaagtgctttgcaaataagcacgccggcttcttccattggaagtaaaaaaaggggaagacccttgagagccggagcgaagccaattttggcaacgcaagaaactgtgtctgcaattgacacacctcgagctgctttcactcaaagtgaccaaggttcgccgtgcaaaaaaataggaaaggtcgccgagtgcgaccaaccaacgtttgccaatgaagctattgcttcaacgcctgtttcgactcaaagtcgtagagggcgaccagttaagcaactgggagggcatgccggtaaaggaagaggcaaaaccaacgagtctatgagcaaatgctctgaaatggaccaaagtgtggaaaacgctctaagtccggcaccctcgcatattgtgtttgaaaaaattgatttcagcactgtgcaaattaatttcgccacatcgcgaaattttgcctgtaaaatttggagatgggcagcaattggcctttatgagcgtgatggcgaaacagcacttggcccacgctctggcccaagattcattgagacctgctggaacaggccaaatgaatggctaaatgacagctttattgttgcctatttagcttacattgcaagcatttcacaacgaaagacagtagttgtggattctttggcatcgagaactgatgtttctcgattttccaacgtgaagaattacactttcggctatgatccgaatgctgttcctgaagttgtgcttatgccgcttcacttcccaaatcactggactctcattgtctacgatgttgcacatggtgcatacttcgttgactcgctgcatatgagcagcttgagtgatgagagaatggcactcatccagtcaataattgctgagatagtgcccgggagtccgtcattagctgttgaatacgtacagcaattgacaaagcaaaatgatggtaacagctgcgggtacttcgtgtgcctgtatgctgaatcgtggcttatgaacaattgcacttttgttctgccggacttgaacatcaattatgagaagaagcgcattttatggcacataaatgagctttacggctctgatattgtgccgtttcatccaaggggaagggtgtttcacatctttcgctngtgtgtctcatcacaatgggggatgtagcgcaaacttcctcca

SEQ ID NO: 22489 - DNA, 3057 bp, Heterodera glycines
ataagggttttttcaccagtcgaattagactaatttcattaacaaattaaaaaatgatattcggacagacccaaaccaattggcggagttgcgagtcgctgtcggagtgagccgtaagctcaaaaataattcggtttttgctttgttccgtcagtgttgtccatgtttacaattagctgttgcttattattcgactttgcatttaaattcgccaatttcagccgaagcgacggaggacgcttttccatgagagggactcacaatcagtcgaccaaaggacaaccgaaggcgagcgcagcgaaagccgtcgttcagcagcaaagccctgaaatggtggcatggctcagacggaaagagtacgacccgcggaaggcggcggcagaccaaagccaaagggaagcgcaacagagacagcagcagtgcgttggtggggtgggaggcaaaaaaagtgaaagcggcattttccgaaagggcgcgccttgcgccattggcactccccgaggaaaccctcaatggtgtggggaacgagtgggtttttagtgaaaaatgtatttgttggtggttggaaagtcagtcccctgaatgtctatgcttttctaccattttcttctttcaattgagtttcgtctcgtttttttcatcctcattgtgttttccattccctttgtgaccttctctattgcttaggaactctttcatggcttgtcggtttttctccacctcggcgaatgccaaaacgcccttcgcccgatggcgtcaaaatcgcaagagtcagcagacgatggccgaccaacgaagcaaccgttcccacgacgatttgagccgtctaggggaaagtatggacgacgagtcgcttcatggcgtggctgtcgatccctgctcggttttgttttacccgcgacgctaatttataaccaataaaaaattgcagaattcgctccaacggacggtggacgaattgacgcaaaagtgccacaagtcgattgaacttttgaagtcagttgtttcaaatgaaccaaacttctggttttaccattgtcccctcccccacagattgtgcaaccaatccggcctttcttcgtccgtggagcaactgctcgagaaggtcgtcgaaggaagcgcgggcgaagcccaagtgcattttggaagtgcggattctggtgcaaaggcaaacaatgagaacatttccgatcgcttggagcgcctttcttccgtaagacgcaaatcatttttaatttaattttctcattgccaaaggcatttgacgccatccaaaaatacttggaggagcagacgacaatgagcagttctcgtgtctcattagctgctttaactgggttcgatactttttaccaattaaatttaatttgtttttagtgggaaaatggcgacgacaaatgatgtgaaaaagcaaacgcagggaaataaagagcaataaaacaaatgcttactcctttggtagaattattttattgtaacaatttttacttatcaaatatttaattttccattattttattcattgaaataaataatatttttaaaccatctctccgcataatttgctaatcagtaggaatattttaaacgactcgtgagattttctgttttttagtttaacaattttatataaggacaccattttaacggtcgtttgtttcctccccattgattgttcgtctgtcatcggttttccttcaaaaaagggttctgtccgtcgttggcccctccgccgatagtttcgaatccttcgccgttttcgtcgtcggtgggggcaaatgaaaagtgcccattgaagccaattcgaagatgacgttttgtcagaagcaaaaagagagtgattatatttgtaatcacaaggacaaaaacgaggacgaaaagagcggtcgaaaggacaaaatttggggggaaaggcgtcgctgggcgagagcaataaccgtcacacaataaagaataattagtgcgcatggcaaaacgaaaataattgcttttaaagagctgaaaaattgtgaagggagaggcggtaattattataattatttgatttgattgtcctcccatcaaagactgtccatttgcaaacgatggaaatggggggggaagggtttcactcacctccaaaagtgactgataggcatcggtcggtgagcgaatgccccgccggcgccacccctccccccttatctgtgcaaggagagaacggaagagcaatcactgacggaggagcacccgcagaaagcgcaccccccccccgccacaatttgcattttattcccattgcctcggaatgtccgtccgattaatcgccgccgtttcgacgcttttgcttctctcagctgtcgcaaatcgaagcttagcgaagccaagcggcacaatcgctgagacgaaaggagcacaaatggaggaggaaaaggaagagccatcgccggccaattttaagggggaaaatcgacaacgacagagggaattgtcgcgggacactttcctccgcctgcacccaaacccacggggagagacggacgaaggaattggccaaaacaatgccaacggagagaaagcggaggaaggcaagcaaagggggggggggggaattcgagagggaatcgaatcgaccattttcccacagtcgaagacggaagtgaattgccactccgagacggagacacacttttggcattcacttcggacgacgctttgatcgaaaggactgcccaattgaacaattgtcgaggcgatctgttcaaacacaaagtacgcttgcccgggtgccggccgaaaacaattgtgaacaggtggcagaagaggaggggggaaaggcacagtgaaaggaaaggcactcgcagattctgccacgggaattgtgcctcgttttacatcccgagaatgcgttccaaaaagctgaaggccaccttccaaagttgtgccgcttgtgtgccgactgagactgacctcgtccaggtcggccctccagtgggaattcgaatatcttgacttatacgatgttttttctaagtggaccacatctacgactgaatgatggtacctagtcgactagct

SEQ ID NO: 22490 - DNA, 351 bp, Heterodera glycines
tgtgtgtgtgggtgtgggtggaaaatagctgaatatgcgaactaaaaatgattcaattggtccgagaggaaggtcggctgccgccgcaacacacgagccgatgagaaaaaaagcgcgtcgcttcgattgattggcgaggaaggtcggctggcgcaacatgagagacaatttggcgaaagagacaaattttggagaaagggaaaaaaatgaattttaggggggggggggaggaaggaggggtgaatgaaggagggtagggggggggtgaacttggggacaaatttggggcaaaatttttcagggggggggggtttggtaagggaaggaggggggggggggaatttgtaagga

SEQ ID NO: 22491 - DNA, 1592 bp, Heterodera glycines
tgttaaatagttcaatatgctgaatggaaatttactgggtttttataatcaaaaaggaaaaacttgctagttaaataatcataatatctaaaaaattcgcagctaaacattctctataaaaactggtaatgatggatttgtaaaataaatttatttttattatataaaaacagaattaatatgcataaagttttgataataaacaaaaaaatcaaaagaataaataaacaaaatatgttgcattctcaaataaataataaaataatgctaattattgggctaatataaggatcattaataacacatttttaaattgtattaatttataatttacaatttaaaaacgaataagataaactaaattttttccttacacgcaaaaattatggcaatttgttcgatgtacaacttcaacatctgaactattaactagggttgctccccgaccctcggggcaaaatgtcgggggtcgggtcgggggaagctaaattgtcgggattcgggtaccacgatagggtaattatgatcaaatatttttaaagaaaaaaaccaaaattttctttttaaatgctcgtatttaaagtttacgaaattggtaatatatattttttatacttaagtaaaaaaatttataaaattattctgatagagaacaatcaaaggttaaaaaatgggataacgaaattttaatttggttgaatttggcaaagttattttgttttcaaacccatttgcagaatttaaaaacgcgcaaaacaattttggcgatttaagaaacgcgccgccagacggctgtggactattcttgcaatttttgacattcgggaaaacgacctgtgttttcatttcattccaccaggaaaagaagtcttcgttgactgcaaacatcctgaaaactaatattttcacgaatcttactaaatattatgaaaccctttattgcgaaagttaacgacgttgaaaagacgttatttataaggaaaattaatattaaaaatctgataaatatttaataaattattatcatcatcttgtttaaaattgaataggactgataaaaaattttaaataaacaagtatttaattcaagtgtactcaattaacgccaaaaaatatatacaaattaaaaaatatatatgtaatgaaagaaaatatacagttaaatagaagctaaaagacatgaatcctaaaaaagctataattacatttaataattagaaactatgatttttagtaaatgccccaaatatatgtgccggatttttcctgcaaaaaaccgtttcaaaaaatctcggttaaaaattatttctgcttaagaaaaattaaaaatatttatatatgctcgtttcagaaaaaagatttttgtctttattattaagaaatctcaagcagcgtggaacaaaaaccgctccagtggacaattgaaaatagatctcttatattaaacaaataataatcaaattataatataaatgaaaatttacattttaaattactttcgctcttacaaactttttaattgtcttattcttttctattaaaataaagaagcaaaagaaaaaataaataaaagttaaaattaaatgtttgtc

SEQ ID NO: 22492 - DNA, 1767 bp, Heterodera glycines
aattttaataattgtgaaataatttcaaacttttgaattaacacaaaataaaacattacttatttttaattcatgtttcaaaaaccctaagattttcaagatatttttaaactgctgaagtttgagaagtaaagtcataatagtgctcctcggccaaataattttttacggctaaaactcgttgaaagaaaattctgtacttcaaggattataatctcgcaatcaacctatggatcagtcaagattaaaaaaatgagaacaataatgatgacagtacaatacgaaaaaaaatcgtgattcaaaatgtcgctatgccgatttctgaaatggcattcaaaattgtagcctttgggcattccgtcaagttgaaatgcacaagcatgcaaatattcccacaaaatatttgttttttatttctttgaccatttttattttcggaagagatctctgaatttttatttcctgttttacttctcttagatcttttttttattttgtcatgtaaaccttttttttgaaggtgaaacaattagtaaatttattttgattgtctgaaaaaggcacagtacatacacttaacagagacttgccgtataacaatgatccaaaatggtttcctagtaaatactgcgttagtttctaccagattgtttttctacagttttttttcttccaatcaccaatgattttttttccccgtttcaccgaataaaaccgatgtacccattaaaaatatgccaagtccgtccagttcagcaaggtttccgggtttaatttagtacaagaccttgaaaggggtcattttatattgctcaactttttttttggcatgttgataaaatagatgttgtgaccaggtccccgttgggtcgcatgcttttaatatttatggcgaaggtattcttggtaaaaattacagcccattagattataggaagtattaaaaaacttgataatttatcaacagactgtaatgttggcagttgcctattcgacggtttaaaatcacggtcttcggacattccgtcaagaattaatgagccgaatctcatattgatactcataacatcacataattcaaaatcttaaatttctctgttctaaaccaagcagtcagaaatgatgcctcaagaccttaaccgaagaaaatttggatgaagaaaaagtttattttgggtactttctaaaaattcaaatcgatgtttttctttaaaatattttatttatctcaggctgttttcttttgatttagtcatgcaaacttaattaattttattttaattgagggagaaataataggaaacttattaattttttttgagcaattttggttcggttttataagtattatttgatcattatttacattcgggttgacattaattttcattgggagaattacatttaatttaaaaaagaaagtatttattatcatttatatgcctttggctttcgggcctgccgtcatgcatgttctggaagaagaaaccaatattttactcattagcaaaacttataaaaaaaggggttgcgcaaatccgaccaatttcagtcctaaacaggtactcacgcgaaaacgtaccccacgcgaaaacgtaccccagccacgcgaaaacgtccccacgcgaaaacggccacgcgaaaatggccacgcgaaaacggccacgtgaaaacgaccccgaccgtaggccaaatagcataatggcgtaatttttgcgcgctaattcaaaatttacactggtaaatgccttttgtattttttatttt

SEQ ID NO: 22493 - DNA, 2669 bp, Heterodera glycines
tacattcttctgtgaattgaggaaatgccaattgacctccaggacgatgttttggcacaagataaacaaaaagaaacttagaaaaaatttaatttctaatattatttgtatttggaaattcgtttattcatataaagcaagtctctttatattttgttgtgcggtttgtgcagataaccccaaagctgacaatgcttaaatattattttagattaatccttacatttattgaatgcgaaagaaataaaatttaaaaaatgaaactccacccggaaccgaaccgatggctaaaatgcttatagtaataaccattcaagtagcacgggaccgcgaatcttgtgaaaaaccgggaccggaaaaattccggaaattttctgtcataaaatttaaaaaaaaattaatttattttttcaagtgaaaagtcaaatattggggctgatgaatttagaaaaaaatcattgatttcaataactccgcctaatttttgacccatatttggcataattccattaagaattaaataatatttatgaatttttttcaaatattacaaatttatcccgaaaaattttgcgtcaacatattaataagtaattaattattgtgacatttttcaaggtttatatttattaattcttcggttaaataattgctttcccattttaacacttctttgatcattcttctgttcagccgctggtggtgcccgaaatgatgcaatttttgccatcgcctttcgatccgacgtcgaaactgcgcaacattggcggctccttttgctggttgttgccttggaattcggcacacactttcttcgacccggtgatttgcacatttttgatggttgccacatcaccataattctcgttgaggccacacaacagcgttttcagcccagtcactttaatgttctccagcacaaactttcgtttttggcattgcgttttgcagttgccgcatgcgcgcgccaatttgccaatgccttccgcctgaaattaatgccaaaatgcacaccataattactttagcttagttctatgattggcgggaaatgcgaaattgatttcataatataagttataataagtccgagaaaactgataaattttaccacaaaatttttgatcgtcaaagtgccaccgccgttcatttggaacactttgtctttggcatttttcacaccgccgcctgtgaccgtgaaactgtactccttgcacccgctgctgctccggaaagtggccgcgtcttctccaaccttctcccaccacacattttgcagagtgcacccgtcatagcaatgaataccgtccgccccgttttggccaatgatcaaatttttgatcactgcgttcttttcggcacggatcaatgctttttggccctccgactgatcaccgctacccaatgccgaagaggcggtcaaccgtttgaagccaaagtctttgacgcctcccgaaactttgattgttgccttaacagtttcttcactagttgcctttggccattgttgcccaaaagcatttgttgccaaattggcaaaaagaatggtcagtacaagaaaggaatgcattgattaattaatttttattcaatttattaattgatgtttttattgtggaatttcaaaaaagttaatcgcttttaaacaaaaattttgttgcgcttaggagaaccaaagtttgttaaaatttgaacaaaaaatttgtttagctgaactttctttttagccagacattcaattatgccaatttatatcgattaaaattatttaaaatttatgttaaaaaatttttatgcacttgacagttgactaaactaaacttttgtttcgagttgacggaaaaccaaaaaatttgaacaaaatttgtttagctgaactatttatcatttggccaatttctaatgttaatttggccaatagaaattttcatcaattaaatttgtttgcttctcattattgggctcagacgccatcattagtttggtcgttttaattaaatttaattgactttttgaatgatcactcgggtaataaaagctaaacagataaaattaaaaaattctatccataattataagctaaaagaaagcgtgctgagtcaaaaaacagaaaagtgcacactcaaattgaataaattgaaatttaataaaggaattattttaaaataaaaataagaaaatttgaaaagttggaaaagttattgtgctttattcaattttgagcaaagtaaaaaaaaattataaacaaaattaaacgaaaattgaaaacaatacattagaacggaaagtgccaaatttgaattcatattcttttttcagacttctttttctttagcattttggcaatataattttcattttttgttgatgagtgttaaataaaataaataatattcaattacgctgttttcatccttaatgacccaattaaaatatctttacttgaaaattgaaaaattaaatataaagcccttaatcttttatttcatcaattcttacagttgtaaagaattatatagtccagcagaatagaaatagttaaaagtggaatggataattcgttaaaaatatacattccgaaatttgttaaaatttctatgctttcggtagcatttttacacttttaaaatcattttattttaaatccttatttgatgcccaagcatccc

SEQ ID NO: 22494 - DNA, 3240 bp, Heterodera glycines
  misc_feature (1517)..(1517): n is a, c, g, or t
ttgttattttatattttcatttaaaaggtaaatgctcctctaaattggaccgttaaataatttttaaaaaaattagtctgtaactattgtaaaagcccgagaaatcgacacgaaacacaaactcaaaaaaaaaaagctgcgactcgacttttctcgggttgagacagagattctcgagccaaaattattattaaaatgattcgaagccgaatggccgcgctgggtctattacatccatttaggtcaaaaatgtctgtagcaactgctaccgtatgcttgccgtccgccacttaccgtgtgccgtaccagtcgttgtaccggtaggccgggttctggtagtattggcgggacaacgcttcgccaaaaaattctggcgcctgctcttgattaccggtgcccaaatagggcgcgtcgccggtcaatgccttcagctcggccattccgccgaccgcggcacattgcgggaggacaagagaagcagcgacgatgatgagcagagcagaagcagctttaaatggatcctctcattaaacattggttttattcctgatccttaatctacgagattctcgagcgaaaaaaagcattttgggattaagaatctgatggataacaataacatttggaaaatttaaccataaaaaaaactcattcctcttaatctgcatcaattcccagcttctgctggtgagaatattctatgattaatttttaaattcttggcctttacaattacttaccatgctattaatgctattacctgctctaagtgtcgtcgagtttggcgctgaacatctcctgttgctgctgctactgctgttcatgttcatgttcggctccgttcgtatgtatgtgaaattattttcttccgaacagcacagagttttgccaatggcccttccgaaatttgctaaaaatggacaaatgttggccctttaaatacgcgcgcgcgttcagccttttggccattcgttcgttgtttggacaacaacaaaaaaaaatggaggacaaattttattgggcgccggcggaccgaacattttacgcgttgacgtcaaacgacgccgccccgacaaattgaggccaatttttgtgtcagagggcgcgcagaaagcgaaacgaactctccaaacagaaaactctccgccgccaactcgcgcacccccccccggcattattcccaaaaagtgtcattcgtccgtcgtcgtcggcggcagcggcggttggatgaagaaaataaaattgttgtcccccgccccgtcctctcccaaaaatttgcggctgctgctctatgtttaaccaaaaaagggggagaagaatgggggaatttggttttggtcttcctcctcctccccccacttttcgtttttccccccccccccagtaaggaaaggaagaatgggagaatggtggttgtgatgatggatgaacttggggatggaagggatgagaaaaaaggggggagcgcagatccctgcccaattttcaacaaaaaccgtcattgctcaagtgggggngggggggggggggaagccccgcgccactcatcatcatcaaatcattaccaagagagacaggatgggattaaatgggataaggctcaaattgtcagccagcttcttccccatttgggcagcatatggttagcataaaaagtgctggtttggggttgtgtgtgatcttttagcaaccagcaatcgctcttgaataggctttatccaccgccggtgcttttgtgatccggatttgcttatccagggactgttggtccggataaaaatgggcctttttatcccgatttttttcgtctaccgttcaattaagccaaggactggttgtagcaaatttgtatttttgccaatttcattttctatttgcgatgttttgggccaaatgcctgaggcgctggccacaattaattaatttaattgcgctaaatatttccgtcacgcaaaggcaaaaccattctgttcggcaaacagcgcccctaaagcattgccactttttgttgttgaccttggccgggccattaagcattcattgctttcgtttgcgcgcattttacgtcatcagaccgagtaactttctccgtccgtgtcgccgtcagggacaaaaaatagtttttttttaattgctttttcatccaatatcgcccctccggcgcaaagggatgggcccaatttggtcggatggaacccgcctaattgatgagaaaccgatgtcccaaattgacaatttgtcaacagattcatttccaaattggtctcaacaaatttattagttcgttgaacaatttttgggtttattcgaatcagtaaaatttatatttgatttactgatgaaaatagaatttatttgagttcgatctccaatttataattttaatataattaactcaagattctttttatttgaaaaataaattcattccaaaaatgtaaaatttatgagaaaatcgtgaaagggcatccataaaattcttcatttgcttctatccgaccgatcccgcccctcattgtttcggtcactattataaaagtgcgtttattattatagatccatttccttcatcccattcttttctcccatccaaaatgatcaaaataataaacccaaatttggaacaaaaaaaaatccaataaatttgagtggcgcccggggggcgggaaatgtggaagatcacccgcgcagcttaagaggtcagcagaagcggaagaaacaaacgactactcatagcgacaacagagcaaatggttttcgcaaaaatttgcgtgccgatcagaggagggcaaaacattttaaaaaggggaaaaacgagttggaaatgtggcaaggggggaaaatggtggtgatcaaagtgctgatcaagcccagaaattgggagaagggcaagataacgatatgctgctgattaggaaagaatgaaatgcgataatgttatgaagttattcaaaaaatcatcgaactaaaaaattgtctttaactttgcttaaaaacaaccaaatttataatttttgatgtcattccatagcctaaagtgttttctattagcctacaaaatttttaaaaaacaatttaataagttattattaaaaagttatggcgaacgttgctcgaaaatctagtttttgagtacttctgctgattataacttttttgaaagaatacttcttccttacaaaagtcaacaaaatctttaaagagtttgcaggctaatagagaacactttgagctatgaat

SEQ ID NO: 22495 - DNA, 1472 bp, Heterodera glycines
gcaaaacttgaaaatatttgtcgatttattgcctattttccatccatgcttgtgatgaggaaatatatataaagatagactttgtataagtatgtattatcatggaagtcgtcagaataatatcaaaagacttcgtataaacaatattgcaataatttaagttcgttctatttttcagtcaacaacacgcccgagagagattttgatacatcaaagacaacctaaaatacaccgcggtgagagccctagcgaacgaaggctggactataaaattgcacaacaaatatacatactgttcgagttatgttttatacgagtcagatatgagtttttcctatggcaaggttgtgaaattcctcccaaaaactttcttacggaaaataagcagcaaattttaataaaaataaatacttttcaattcatgcaatgaatttcctgaatctataaattgatccactagaaaagtgttagtagaaaataaaaaataattggagcccatattttcgtcataaattgagtcccgaaagataaatagcatggcaaaacttgaaaatatttgtcgatttattgcctattttccatccatgtttgggatgaggaaatatataaaaagataaactttgtataagtatttattatcatggaagtcgtcagaataatatcaaaagacttcgtataaacaatattgcaataatttaagttcgttttatttttcagtcaacaacacggccgagagaaattttgatacatcaaagacaacctaaaatacaccgcggtgagagccctagcgaaaggctggactataaaattgcacaacaaatatacctactgttcgagttatgttttatacgagtcagatatgagtttttcctatggcaaggttgtgaaattcctcccaaaaactttcttacggaaaataagcagcaaattttaataaaaataaatacttttcaattcatgcaatgaatttcctgaatctataaattgatccactagaaaagtgttagtagaaaataaaaaataattggagcccatattttcgtcataaattgagtcccgaaagataaatagcatggcaaaacttgaaaatatttgtcgatttattgcctattttccatccatgtttgggatgaggaaatatataaaaagataaactttgtataagtatttattatcatggaagtcgtcagaataatatcaaaagacttcgtataaacaatattgcaataatttaagttcgttttatttttcagtcaacaacacggccgagagaaattttgatacatcaaaagacacacctaaaatacaccgcggtgagagccctagcggaaggctggactataaaattgcacaacaaatatacctactgttcgagttatgttttatacgagtcagatatgagtttttcctatggcaaggttgtgaaaattctcccaaaactttcttacggaaataagcagaaatttaataaa

SEQ ID NO: 22496 - DNA, 3326 bp, Heterodera glycines
atgtacagtactacgttcccgtcgttttacttcgcgctctctggtttaagaaaaatgtagtctataaattttggaattttatatatttattagacccaatcttaaatttcaaaattatatttaaaattaaagaattgattaattaccgtttcacaggcatacgacaaggcgatggcaaagcaatcgagatcagttgaagcaaatgaaaagttggagattttgaatcgaaatttacaaatttgggccagttaatgaaaatttctgcaacaaaaccaaaaggggcaagtgtatcacgaaacattaaagcaaacttattccaaaaaaataataccgtaaaaattatttgaaagtcaaggacattcgggatgatttggtaaatttttatatttcaaaattaccataataattatttcgagagttatggtctttgggctgacatggataaattttgttgcatttgttgcttattcttgttaaacttattaattgttgctgattttttaatactttataaatttgttgtttttgttactcattacagtaaattcaattttgagaattggttgtacatttttgtggaaattgtaaaaactcacaagtgattgataattaaataatacgcttttaacctaggcctgcagtttaaagaaatttcgagcgaaaacacttcaaaaaaacatggatctcaaaaaaatttgtggaaatgtggatattttgtaaattgcattaaatcttatttttcattttattacctatattcgcttagagcattttggcattttttggttcatgggatgccgataggcacaaagtatctttttttaattgaggtgatttataaatacattttgataaaaaacaacatctttgtaaggttttagatgaaatcgttttccaatggaatacttgaattgattgaatttttcgtacccagttcaattgaattttggaattcggcggtgccaaaaggacaatcgaaaaaagattttaaaactttggactgttttttaacagattttgactaaaaatgttaaattttattgaagatattaaaaaaaaaaaaactaaattcgggttttctaattttgattttttctataaagctagtaattagtttcttgtatttataaccaaatactgtttttttaaaaatcttatgcgtaaactgggatttttatattcttacttatttttttctacgggttagttatggcgagagcccaaaaaactttttgaacaatttatgatttaaagcgacttataaaaacatttaaactgcccgaatataaaactgcatgtgccatttcattagcaaacttcagtttgaatcatttatataataaatggaaggcaaatgataaaataattttgaggtgtgatcaatgatcatgttgaaaaatgagaaatgatgatcattttgtaaaaatgagcaatgaaaaattgtttcgccctgcatcgcaattacataaataggaaatttttcgccgctattcgctttgtgctgtccttcctggtgcccgttcgccgtgtccttcatttcgttaaattaaaaaaaaaatcattatgtgcagttgtcgaaaaccgaaaaagtcattttctcccgaggcatttaaattcaggaaattggtgaaaaacatttttgttggagcaaaaaaagcctttgttcctcagttggtgcccccctcacctcccccccaattttttcctctcgtatatttttctggatatggactacgatggttgctgctcgtttacctgggatgtcccatgatttttccacatccctcgtgatctcaacttaataaggcattagggataatcaagttgaacaagttcacgaattttatcacccaccgagtgccttgtcaaaatagctgaacgtaagcggcactctgtccaaaatggcctgtgcgccagcacggttcaccgttgcgagaatttctttaaaaggaaaaaaatacgcttttttcaacaagtgcattacaattccaaaaattttccgcaccgcctgacttgtcgttttgtttttgaaaaaaaattatgaaaaacattttttacggttttgggaaggggcaatggtaatttgttaattaagaattcaggtaatctttttccactcgcatacaaaaattagatgttttgccaaattttatatattttcagtataaattctaattatgggcccaacttacgcgtcgcagagaagccaaaggagtcttgggacagcttgttgagttgatcatcgttcaatgcaatctttccgcttgtaaagtgcctgtaaaagatgatgaatgccaatgagcataacaattaattttaataattattcccaggggtttttggcaaaagcgttaaaaaaattaattcaaattataatttttatagaataaacctggatttttggacttctttctcttacaattaggtctatcgttaataaaatatccatttttaaatatgaatttttaactttgtttagttttttttattttcccgcccagcagaaaacagggcacaactgtccgggtccttttcagtcgccaaatgaatgtttcaggtgccaagacaaaattataaataataaaatcgaaaaatatcaagaatcagcaataattttcaaattttgtatgaatccgtaagtaaatcctaaaaaaacattttgttctgaaagtgttaagccatttactcctcaacgaccccagaaatatgttttaatatttttttactcaatattccatcctccctttacaaattcctttctgaaggaaatccctactcgaaaaggcgacggcgtctcggttcaagtggtagtggaatctccattttcctgcacaatgactcgtcgatgttggcgaacacctccacagctcttttcctgtcgtttgacgtgccaatgaagaggaacccctttttggcttttgcgtcgtcaatggctgcgctaagtcggatgggcgacagcttctcaacgtctacaatcagcaaaacactgggacgggcaagagaggcgcgctctaacaaaaattaaatgaaaattatgtaatggcaaaaggaattttttagaattaaaaaaaatcaagattttaaaattaatcaaaagaaattctaggttttgttttttgatttcgtttattttcttggatgaattggagacaatttggtaattctgtagtttgcccctcctttttgaaaaagaattttcaaaaattcttttgccctaaaagcaagtttccacaggttttttgggtcgctgaacacgaatccggcatccattccggccaatttcggatcccggacccgaattcgaacaaagtcgaaaattcaaattt

SEQ ID NO: 22497 - DNA, 1808 bp, Heterodera glycines
gaaattcagacaaagagggataagaatcccgagactaatcccagaatcgagaccgagagtttcgagcaagggttccagggttttagtgccaaaaattgcacgcgattcgagaccgatgaattgatccctagtctcgaaaagtaagaccaaatgaccaaaatcctgagtcaagaccgagagtctcgagcaacggcgccattttttggtgatgagttatcatttgtccaccctccctggcgccaacaattatcaaaatgaatcggcatagacagtgcgggaaaggcggaggttaattttggatccggcttttggcattagccgcagccttcattaatctcgcctgccccatccacttaatgtgtgggtgggggggggggcggatttcatttctcccggcgccaaatcttttatgattattttggtccaccctccaaacaattagtcaaatgatccctcctccctcgttccaggtacaaatatatgacttaagcgcatttggctaatacatactgccatataaatactggggatggatggcaatatgtgtaatgatttacatccctccatgtgtcgtgccgttcttatatgtatttactgtcatttagcgttaaaaaaatgccaaaaattggggaggcgccggcgaccttttgttaggcacccaggcattaaccactaatttgccaaactaagcaatttgaatgagtacataatatgcgtacctatttattttacgattgggcttgccacattctgacactccgttacggtatataaattctaatttacggtaggttttgccacaattttggcactccgttacagtatataaaggttttgccacaattttagccctatgttacgatatataagtaggttttgccataattttggcactccattacggtatataaatttgaatttacggtagattttgacacatttttacattccattacggtatattaatttgaatcaattcacttttaattaatttttgttgactttgattttcacctatttttggcacattaaaaatggtgggaaaccatcatgtgaatgtgtaaattaaattcatatgtataatgagaaaatttttgatatttttagaagataaaaaagcccaaaaatagtttgagagagtaaaaattagggaaaaatgggtgggaaaatcggtaattttgacaatttttcattgaagtttttggtttgtgaaaacgacgtcagcttttaatggggttttatttttgaaattaaaaaaaatcctaatgacacaatgacaaattttaaattttttcatttttctccattttatgcggtttttcatttttttaaaattttctgtccgaaaaattcttaaatttctgcattttttttagccttagaaaggctgacaaatcatacatttttaatttttctcaaccacgcacgccgcttcccccaattgcttccatggctcagtggtcatttgtcatggccaagcgtgggtttgactcccaccgggcgccgttgtgtccgaaaatttcccaaattccttcattttttagctttaataaggtttgacaagaactttaacaccttccaattttcagttttcttataaaatctcacaatcttttttttaagccatgccacttcccccaaatgcttccatggctcagtggtcatttgtcatggccaagcgtgggtttgactcccaccgggcgccgttgcccaattcaacacactcattttttgcacttttacgccatttcatccccaaaataccacgtacataatatacaagtttcaaccaaaagcaaccagcttaa

SEQ ID NO: 22498 - DNA, 1444 bp, Heterodera glycines
gagcaaaagggaagagaaatgaaccgaagaaataaaatctttcttggaatattaattatacttttattaaaaagaaaacgatattggccaaattatcatttaaatttcgaattcttttctctgatttcttttgccctctcacttttcccttccctttcccctaattatttttttattttttataattttccattttatttctttttcctttctttttctcttttctctctttcctttccatttcaccaattccttgcgtttacaattaaaaaagaaaagaaaattacacaaattttctgaagaatgggcgaattggccttcatcagcgtattgccaccacttgcggctggcactaattagtgactaatgagtgatgtaatgaaaaaatttgtttgttttttgtatcgaaaaataaaagaaaacgcaaaggaagagagaaaaaaaagagacaaattgcttctcttttccgcgtataaagcggagggctcaccgacgaaaacccaaaaaattatgggaccaccgaggaaacggtgcggaagtttgaaaaagcaaaggaaagtgaaatatggcccggaaatcccttttatttgctcatttgggatctttcatagaaaagtccatttgtaaaggatgacacagaccaacgaccgaaattgatcagagatcgatgcaattagagaaagttagcggggggggggcaatcggtgcgtttagtgccccgcaaagattcggcccattgaatgtgtcacgccctttcgaccacagaaaagagaaaaggaaaagggaaggccaattggacggtttaccacttcggaggcaccgcaggcgaaacttacaaatgtcacttcacaacgccaatgatcagaaggagagggagaaaccattttaacagcagagaaaaagagaaagaaagaaaaagttagtcactgaggaaatcgtaaattaaaatggggggcaattgggggaatcacttcgcctcccctcccattttaaatgccatttaacaaaattattaaaacaattgcttaccatttacaataacccaaatgcattttgaattttaaacctttcatacaaattttgtgctaattggcgacgaatggtgtcatttctttcagtgaattttcctttcatttccctcatttgctttcttttacacttttttctccaattgccttaattgaattgttcacaatttgtccattgttttgtcagtttattgcttgcttaatgtttaattgggctgactatgaacggaaagaaaacgcattacatctctctcgaagtcaaaattaaatgactttagagattttctgcaattaacgcggatcgaaatttattttcccattggtgtctctgatgattttccatctttcccttccctctgttttcgtttagtgtaattgtctttaatttggcgcaaaatttgctctgggcaaccccc

SEQ ID NO: 22499 - DNA, 1240 bp, Heterodera glycines
  misc_feature (66)..(66): n is a, c, g, or t
aaaaaaaattttttaaataattttaaatttttttaaatcctataatctttaaacatttaaaacatncatttataaaacaattataaccaaatcatcaattgattgagaccggttaaacagcaaattgtgatgaagaaacaaaagttttgcaagattttctggtaataaactctttcgcaagtcatctgaaattagaccggccgttgagaaaagccttaacttatcggaccaatcctttgccagtggcgcctatagcctcagcgttttaactttacatttaaatgttatcccgttttaaattcgatactaaaaattattgaataatttttcaaatatgccatgttaaggacattctgtggtttctctcttccagttacggtaaccgtatcccagcactgtttggccaacaattgctgcccttttaccgtatgatgcccggctgggccatcgttctgtgtttttattttgcaacaacagtcgcttaccaagcctcgaacattgccacctttctcattctgatgaatcgtttcactgcaattgcatttccactcaaacagaaaagggttttttttaattattaaaatattaattaatattttaatttcatccattagatttgggaaagtcaatcatttttgatgatattggcactgattgtgttccttgtgccattgttaagctgtttgccaattatgaaaatgaacgtcactccaatgccctatgaaagggaaagcgacggatttttcatccaagaaaatgtttcggtatgaaggaaaagcatcggaaaacgcaataatcgagcagagaaatatttagataaaaattttgcatatttccattaaaaaaactattcaagctaaaatatgaaagtcaaaaataagactaatctttggcctagacttcggcttacacataacctgagcttatgttagttttagctagccttagtctttgcttagaccgtcctagctaagtcgactgaaggccaagtaaaggcctctggactttggctaaagcataagctaggcttatgccgttagctcagaccgttttaggtccgttgtttagatctatggccactgtacattaaactgacatgcgatttgtcaacattttccgctttttaggatattcgttcctttcctatgctataaagtgaaatcgcttacttctgtcattttcctgctcttgtcgcttttggccatttgtcaacctaattggctataaaaaagcaaaaaag

SEQ ID NO: 22500 - DNA, 1819 bp, Heterodera glycines
aaaatagccattgaaaaggacaaaagactgaccaacattcactcggttaatggagtaaacatgggccaaggcgtgacgtggactatttttgctgcccaattccaattcgatgaaacgcggagaacgaagtgtcccatctatggcaccctgaacaagtttggtagccgccgaagagccaatgctcaattccaaatcgtttgaagagtcagcggcaacaccagcgacgaaaaacgaaaggcacagaatagaaaaggaggttatcggcaacagtacaaaataattaaatggggcaaccataatgcctatgtataaggaagagtgatgtgcgaaatataccaaagatgtagtaaatcataccaaaccagtattgtatttagttgaggtttaaatttttcctaaaaatgcttacttttggcgtgccttttatcttttttggtttttttaaaaaaacattttacctcgcctagatttttttttattcgcctctggattttctctgcgagacatttcgccgcctgcagaaaaatacgtttttcgccacaacaattgaaaaccgtgaaaattaaacttagttacggtaaatgtttttgagtaatacacaactaagttatttaccagccgaaatttttgaaccggatcaaaatccaaattaaaaatgtttggattttctaacactcgactacaacggccaataattggggagaaactaatcaaaacacaaccaaaagagaaaatctattaaaaaacaggccagaattgcacataacattgtttcatttaaacattatatccacaattagacagcataatggataatcgaggaattcgtcatcgtctaatgttctaaaatcccactcgttggtcagttaatcctcctccggaattgagtcgatgcccatcaaattgtattcgtagccggtcaactctctgtcgcggataaggagagccgactgctcatgtcctttcagaactcgatgatgtttgcagccattcgtcccataccaatgcagtgggtaatagtcgctggtacaaaatgcggggatactaacggccgcgataatcatgggcaatctctcgtaccacatttgaagcaatggaattaatgcctttctcaattaaccaaatttaaaaatgtgtaaaaagttgaaactttgtatgtcataacgaaataaacgttcaatatataaaagaaacgaaatgaaataaaacgatttattcagcataaacagcactcatctataaagcaaaaatgcacaaaactttcgcacagtttcggaattaagtccttcaatggctttcagattttcatgcattggtttggtcttgtagaatggtaaacctaaaatttaagttacttgtaaatatgttctccaggcttcttttgtgtttcttcacctggttttatccaaaccatgtttttcacgccttttcggtttgccaaatttgctgtgttcaattgcacaattgcaaaatccattttcccatccactaactgaacacctttgaccacaattggttttttcagcactttgtcttctttgtccaagaaggcagaatctgtcgacaatttttgcgcctgtgccaatgcagcaccaaaacagtgacaaatcacattggccatattctgttctcttaaagaaattcctttagatatccaaaaaacaacttatatttttagtttgtcttaaagattcacatacgccgtccatgggtatttttggtcctgttcacggccccagaacaatgtgtgcacgttcaaatttggacatgaaagtcggggcagcagaggagaatcgttgtaaacattcgttttttccaa

SEQ ID NO: 22501 - DNA, 1032 bp, Heterodera glycines
  misc_feature (868)..(868): n is a, c, g, or t
cggttcgacagtccttaggcacggggcaatttgcctcccaacttgggcgatgttctgatttgcagcttcatcaatgcgcatgaagatggaattctcgtcgtagcccaactcatttgaggcgatgaaactgaacacgcccgccaacgaagggtcaattcgcataaataaaagcagcaccgtccatatttcgccatttttgtcgattaaaaaccgatatttttggctgtcttccgtcagatgatgattgttgtgataaattgacatctattgagattttcggcttttactgggctaacacaaaagatttattagtaagcgaactttgggttcaagcgaagagcgcaacagtaaatttaacacaactctttcaccatttttgacatgcagatcattcaaggtgttaataaaacgcggcggatattgcgtatctaaaagccgacatttttttttgttcaataagggataattaaggttattaggttaattactagttaaagcagacgaagaggcattaacaaactgtggagaaatgcctttctggccaaacagtgccgaagatgattcgggaaattgaaaatgaacgcgctttttcattgttttcatttgcccttccgatgattccgaaagaagttgagaaacaaaaagcggatcaaaatcaaaagacttcttatgatcaggattttgatcagcagtttgtttaaaacaaacagagatgggcgagagcaaaatgctattgatttctctctcaagcaaaaagacctcgatagcttcatcggaagagaactttttaacttccaaatattcacattcatgtgccacagcttcaatctcatcagatattttagctaccttttctttctcctctttncactttttcatcccttccggctttaactcctttttgccgttttcttccgactcttttttgaccattgttacctccttctcttgtttatcttcgtcttcctcctctttaggggttttctttcctttctgctttaactccttttgcccttttcttccgactctttt

SEQ ID NO: 22502 - DNA, 1009 bp, Heterodera glycines
cccccctcccctcccctcacccgcacttaagagccacaaaatccctttgtatttccgaagcgtttttgggtttgtttgtttgcacattaaaagcgcataaaacacaaggagctaacaatgagaagagagaactacggagatgattttgttgaaacttaatcatcattaagccattttcccaattcgaatgttacttaatctaattaattgggtgtttgttgcccatgtccccaccttcttctgcctctgcaatcacttcgtcttcaagaaggcgtgagatcgcatccatctttggctgtatacggactctttcgacgatgttctgacaaagatttataaattattttttgcttttttccaaaaacgaaatcccgggaatgtccgtgactaaaaacacaatttgcgatgtttggttttgaaaactcagaagtcggtctgtcgtcgtttcacctgatatttgggtggaaccacagttgagagaattgcgccggtgtcctcctccttttcgaagtccacaatttccacgtcaacgtccatgtagtcctcctcaataagcgcaactgacgactcactctccgcgtactcaatgctttccagaccgatgatcccatccgtgcttgacgtttcctggcccgcctcaatgtcaatgtccacattaaggtattgcgtacctgtgaaagttccatggaattagggtgacaaaattagaactgttaaatagacatttagtagggcatacccaaaggactccgattgtgtgagcagttcatgtccatcgaagccttcgtaaattccaacgagtccattgtgctgctccttttcttgcgcacaattttcttccgcttcagccttctccttggctgttcctcctctagaatgatctgcggtgtgcttgtttctggtccaagttcagaagacacacaggcgaaatcggcccattggaaagtcgcttcaataaattcgcattcgctcccatgcaaaatttcctcctccacatcaacctcattaa

SEQ ID NO: 22503 - DNA, 1047 bp, Heterodera glycines
cgattttttcaccgaatttcctgtcgatgatagtgccatggcgtcggatggacaagcgatggccaaatggctgttcactcccctcccggacgatgtgccaaaggtgttcaactgcgggttgaaagagtatgacgagagttggccgttgaaaattgaggcgttcaaagcggtaattaccactaactaattaattaattgacaatatgacgtttcgccaccaaagctaaaaccctcagtttttgtctttttacaacaaattaaaaaaatggtcttcaaccgtaaaaactcgaacgccagcttcgaggttttaattcagtgaaaatagttatcaaaattgggtttcctgaccctgaaaatccttaaaaacgactacctgaaaaaattggaattttggctcacaatcaatacttttaacaaaatttaagctttaaaattatattagaaatatacatacattttttgtttgctgggaattttaaaatttcatttttgtttatatatttaaagttagagacccagcagttggtacgccacaaaaaaattgttttaaagtcgtataaaaaatgtttcaaggtgtttcgagtgcgctgattatgaatccgacctccatttcgaccaattcagagttccggattcaaactcgaacatttggtcgaaaagacaaaaattatcagttttttaccaatatgattaacaatatagagcaattaattttcgcatggacaaaattttttggtactaatgcagtttgggtcccatatttttgtcaaattttttcaaattttttttttgtcagaattgcttttagattaatggaaacgctaaatcgacgtggcagaagttcaaacatgggtaatactgaagtttatcccccccatttttcgaaaaaaataaaagttttaaaaaaagccatgtaaaacacatttccttggggttttctgggtcgctgatcacgaatctggcattttgatgtttcaatggtttttgactggatttagcttgttttggtcaattttggaacaaaagtgagaattttgaaatttttta

SEQ ID NO: 22504 - DNA, 1167 bp, Heterodera glycines
atggaggcaccagggccagtgaagctggcggcggcactttacaaaagtcaagcggcggcaaaccgcccacaaaattatcgccaccgccgtcgccacgcgacagcggcgggcgacagtgggacgacgactacgacagtcgacgggggcggcggcggcggtctgtggcgaccctttcatgcctgctaatgaaggtcgtccgtcggtcgccaacaaattagtgtctgtcgtcgtcgccggcggccggtcacgcccctgggggcacaaacagcagcaacaaataaaaagcttttaaacatgttaatcttttgaatgataacaaaaatgttggatttggatgagaaagaaaaaaagttatagtcaaaaagctcttaacatgctatgaagaagattttaattggttttcctcatccgtcgttgtccaattgtgcccgatttaagaaaaagcagaacattaatgaattgggcgaacgatggaaccaaattgacattttcatagcaaacgacgggtcggggtcacttcgccgcggccatctcgccgcgagaaactggccgccgggccaacactgcggcttagttatggcgagagaagcccaaaaatagcattttctcctaacaatttttgatttagagcgacaaataaaaacataaaaacacatgttttggcacataaaaacatatcgcacatatttgttattactatttaaggtcatgggaaaaccaataaaatcagaaataaattaaatataaaataaaataaaattcatccaaaagtaattagttactgattagcagggatatgcaaaatgcgaaatacgaaaaatgttgaaaagcataaaattatagcaaatgcttttccatcggaactgacaattcccatttcaattgcaccattctgcccaattactgctctaattttaatttcgttcgccaatgtccatttgcgcgttttgaaatgttcctcaacgaagcagtcaaatcggcgactgatcagcgcaatttcgaggccaagctgagagggcggcagaaaatcgaacacttccaaccaacaatcgccgcaaatgaagctaaaaaagcaaaatgaattagccatggacattcaaatttagattattacatcgcttttttccatttctctctccgcttccttcggattgtcgaacattttta

SEQ ID NO: 22505 - DNA, 1504 bp, Heterodera glycines
tgacttttttgcgtttttgtgactcttttcatgacttttacactttttaaggcaaaatttgacaatttgactttttctgatgaaaattccgaaaaataagtcaatctgacggaactgaaatttcttataccattaggactgaaatggcgatactgaaaaataaataaaatctggcgatgtaacacttttgaatattttttccgttaaaattagtcgtttttaaattaatttcttcgaaaaatgtttaaaacggcttttggttttaattacatttggcaattttcaggacttttttggatttatttggtgattttggcacttttatgtgagcttttggttattttttcatgacttctttctggcatttttatgactttttcgtgactttttggcaatttttcatgactttttaagtcgacttttttgttaaattcccatccctagtgatcataaattgctgatcatcaatgtccaaacaagtgttatgaaggcatatctttctagacgaaggcaccacttatcaaaatcagaacatcggaggatgtcgacatcgacatcacaactttgccaaacacaacggcattggcgacgcgagttgcggcggcctcaactccctggcatgggtagttatgacaacgcatttcgccgcctcacgtggacaggaacgtgttttttgtattttactttacactacttaaagattatttttatttttatgcacctgaatgatgagctttactactattttcagttttatttgttttataaataattttttctaacaactaaaaatgtcacttcataacaaatattgattttttaaataatctttgctaataaattattctcggcatttgactgtccagtgatatgctgatttaaggcgtaccttttttagggatttttgaattatatatataataataggtaaaattattaaataaatttttttttgtttattttttatatcaaatgcgtatccctgtaatgattacagtcgaatttgggagtttgacttttacttttgagtattcatgtccgtgaatggaagtgttgtcgagtgcttgagcgtttaaattaaaaatgcatttttattgataagttgaatttatttattgttttacaccggcaattgcgcacaatcagtcctgtcttccacgttgaatgagacagaaaattttgtcaccgtttcaattcgcaccaatggctgatttggcacgataaattaattgaattcaatttaaatttctttattttttaatatttttatcatatttttaaagtgaattgatctagccagtaaaaaataaaatctggcgatgtaacacttttgaatatttttttccgttaaaattagtcgtttttaaattactttcttcgaataatgtttaaaacggcttttgggtttaattacatttggcaattttcaggacttttttggatttatttggtgctttttttgcacttttatgtgagtttttggttattttttcatgacttcttt

SEQ ID NO: 22506 - DNA, 1140 bp, Heterodera glycines
ccccataaatgtttgagtaccccaaacgggacacttgaaaaaatcgattttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggagggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgctttttaactttgggaaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttct

SEQ ID NO: 22507 - DNA, 2289 bp, Heterodera glycines
cctcattctccacacgaccatcccccccccgtaaataatcccattcgtcccgtcatttagcttcacaattgcccctgctgctgttctcgtcgtgcttctctcctttttgctttaacatcatttgtccttcctttctttacccccccccccttttcgattacttttgtccctttttcgcttcctttgccaatgatgaacagttccaatgttctgtcctcgttacgtcttcacaatcccttccaaaatgtttctcaagttcactcttccccaggtcagtctgccttttcgcttttcgtccatcgcttctcctcaaatcgaactctcttttctcagtggacttcaacaaaatgctgctgttcaacaacggttcttcgtctgtcccttttgcgagtgttccccgacagtcgccgagcccggaatgtccgaatgtcggacaaatgggccgaagggtcagcagagggggggggggtaattagaaacaaaaagaaaagcccaattaattgctgataataattaattaattagtcacttccctcgcttttgttgtacatcttatacatatttcacgaaatgtccttcgctcactcatttttttgaattatttaccaccaaatttctttcggcgccccccccccccccttcacaaatcagtgactcattaataaaacacaataacctttctttctttctttatccctttctttgttcgggggagggggcaaagtcaaatttgaaatcatttgaattgcatttttaggtgatgggactgaaatggccaaaacaaaacaaaaaattaattggccaatgccttttaaaaaatcagcaaaaattgagaagtgaaaaattgaaggttatttggctaaaagataatcgagaaaaaacaaaagaggacaaattcagctaaagaaaccgatgatggaaaagaaacggagggcgcggatcaacgcgtgttttgatcaattgaaggaagtgctgctgcactcggacatgcagcagaagtgaggggggagcaaatggggacgaattggggagaaaatggacaatcggagaaaaagacatttaaaaatgggaaaagtttggcatggaattgacggggaaaaagtccatcagagaagggataagcaaatgataatctgtgataggaccggttgagaatactttttgatttgactgtttgagcattttcagcagcaaattggaaaaagcggacattttggagaaaacggtgaccttcgttcggctgctccagcaacagaacgttcatctgcagcagcagaacgcgcgactccaccaacagctgcagcagctgctccactgctccgagcctacggcgattgccttacgcgacggagttcaaaaaggggtccgtccgtaattggccaattaattaattaatcccttttccgttggccaacagttagcgaatttgatcatatgctcccattttgtttcagatttctctctctgtaatggccaccatcgacttgttttccggcttcccgtttttcactcccgaactttgccatagactgaaggaggaggtgccgaaaaaagtggcaacagttgcagtggacattttcagcccaacgccaactccgacattggcactgaacagtgccattcaacaacaacaaaacagtgcgtttatgccgtcctcaaaaagtgtttaagcattgactgatcgttctgaccactgactaataagtccaaatttaaaatgagtaattcagcaagcgctttggcgccatcgcctgtccgcttcgtgttcacttctgcgccatcctccgtcccctcctcctcagtgccatttccgatggttcgtcctccgctgactttgccgaattgcttatggccttttatgaattgccaagcatttggatggacagccgaagcagaaggacagaagcaaaaaagtgaagagaaaaagcattggggagaagaggaggaaaagggtaaaagagggagcgaaagaaatgcaaaacgaataaaatttaggacaaaaagtgaggggggagagaaaaactgatcagagtgccgggaggactgatcggcgggaagaagcatctgagacggagcccggcacaccagacaacccgggggaggagattgaggtggacgtggagagtgttgagaagacaagtgacgaaactcagagagagggagccaaggaggagcaagacagtggggtcagttggaaatgagaggggactgatcaaaattggggagaaaagggaacgaggagactgatcaaaaatggggaggggagaggagggaggggactgatcaaaa

SEQ ID NO: 22508 - DNA, 1029 bp, Heterodera glycines
tagaaatgccaatttattgcacttttgataataaaaacagaaaatggaaatggcctcgaaaaggaccacataaagtaattgggagaatatacacaataaacccaaaaaacaaagaattatattaccttcgttatttattactgaataaacacgcaaaaagttttaatgatttaaaagttgttaatggctttaaatataacacgtatgcagaagcatgtttagccttaggcttaacacgagatgatttagaatgggacaaatgcttaaatgaagcaagtcaattcaaatttcctaaaggccttcgttcacttttcgcaaatattcttataaattgtgagccgaaaaacccaaaattactttgggaaaagtataaagacgaattaagttatgatcttaaaaaattgtatacgcaaaatgatgcttatcaaatggctttattattaattgaacagaatctttctaaccatgaaaaaagtttaaaagattttgaaggcatgccaaaaataaatgaaactataaaaaacatttcagagtatcaaattattaacccaaaagatgaattaaaccttgccttaaacaaattttcattaatgaataaggaacaaaaagaaatatttgaaaatataaaaacaatttttgaacaccccacggaaaatcaaaccaaatgtttttacattgatggtccaggagggacaggaaaatcttttgtccaaaccgcaatttttcatttggcaagaggttttaataaaaaagttacaaatatggcatttagtggaattgcagctacagtgttaaaaaatggtagaactgttcataatcgtttcaaattaccgttagatttaaatggtaattcttcatcattaattgaaaataattctaaagaagcaaacgaaattagagaaacagatgtttttattctcgatgaagcaccaatggcaccaaaatatgtaatttgaataatcgataaaaaattaaaggaaatacataaaaacgattttcttttttgcggaaaataatgattttaagtgg

SEQ ID NO: 22509 - DNA, 327 bp, Heterodera glycines
tttatttttaattttattagctttttttttaaatttggccaaatgttttattgttagccgtcggaataccggtttccgattgcctatttttttgaaggcatcacacatatccctgctgccgtgaggcattcgaatttccgatcaaaaaattcgaaaacttgctgaaattgggttcgagaattcaaaaaattgacataaatcagaggcttctggcttctgagttttggttttgtattttaattttattagcagcggtattttttttaattttggcgaactgtttttcgccacttttcaaattttcggccaaatggccagcaacggccc

SEQ ID NO: 22510 - DNA, 1681 bp, Heterodera glycines
tggactaaaaacccataataattttttaaaaattcaaacttcttcgccaaccaattgtcaatttgaatcgcttcacagtctatgtagcgaagctcccaaagcgcgaagcgcttttcccaggcacagatccgacggttcacgcacccgctagttaaccattttatacataattggtgaaagacatgtcatcttatgctaacggaggtagagcaagattttatctacgaaacttgaatttattaagaaattatggtataattatttagatgcctaataaaccaaaatatttgaaaaacatgtaaataagtaaacaaataaaaatgttaaaaatactaactaaagtaatataatgtttaggagaaaagaattttgaacaatttatgcaaatatatatttaaaatttaatatagaattatttttaatttttaatttgtatatcgaaaacatacattaccaaattgccctttgaatgtgagtcaacaacttatacccgcttatgggcacttcaattttgatttgataattgctactataaaatgcacaatttccttaagagggaagttgctgtaagacttttttgttcagcataaaaaatattgttgtgcaaaaaattgttcgtttaaattcaatcaggcaaaagagcaataattttgcacgatttagcatttgtccataaacttttgacaatgactgtatgcccaattaactattatctatattatataaatagaattaaaactaaaataatatcagcaaagatttaaatgtatatgaattgccgaaaaataaacatttcaatcaaaaaattgtttttacatttaacaaaataaaatttaatttgtcattatataatgcaggcaagaatcaaaatataatattataaaatgtgaataattaaaatttaaaaaataaccaatattactaaagtaaaaaagatactatttagtaataaatattttatattatatacaaaaatacgaaatgaatgatattataaaaaaatcttgcttttttcaaatactattgttaactaacgaataataatatataataatttaaaaaatgatctttaaattttttataaaacaatttaggaaatatattaaacaaaattaactaaatgaaacaaaaattataaaagatcatcgcattataattgcgtcaataaattaattgattttgtcatttttttatgcatatttattcttctattaagacaaaaaacttaattaataaataagagtgctaactcaatcggattcctccaaagaaccaagagattgtaaaaaaaagtcataacgtttagattatttaaatataaagaattataaaataaataaataaaatttgacaagcgaaaatacaataaatcaacaatttaaatttgatagatttatgtgtgaatttagagattgtttattcaaattctttttaaaggaatattctaaaatattttttattgtacatatttttgggtttacttagaagaaaaataagaagaaagaattgctaaatggtttaattaatttaatatataacttaatattcccttaaataaaaaaatttccacgttaaattactcctaaaaaatatttattacgtttagttttttgtccaataaatttctacaaattacaatcctccgaaacaaataactgagtacataaaatgagttgtaacc

SEQ ID NO: 22511 - DNA, 1100 bp, Heterodera glycines
  misc_feature (34)..(34): n is a, c, g, or t
ttaattccatttttaaatgaattgatgaattttntttgcaatattgaccacaacatcagtgaacaatttatagcaaaaatttgtccttgaacgtctgaaagccacatttcatttaaaacataaatatgcgcatttttaaataatggacacaaaataattgagttgaaaactgatcacaaattgccattgggttcataaatacgattcatacaaacgcatttccaaaacacgattgagctccagagatttattattatttttataaaaaacagatattcagtaattaattccatgttgaaatgaatgggtgaattattttaatattcaccgcaacatcagtgaactgtttatagaaaaaatttgtccttgaaagtctgaaagccattattcatttaagccaaaactatggacatcttttaattaagagcacacaataattgaaatgaaaacaaagcacaaattgctgtgggttgcataaattatgattcagacaaattcattcccaacgagattgagcttaagtgatttatcaataatttttataaacggtatacattctgtaattaattccatttttaaatgaattgatgaatttttttgaaaattgaccacaacatcagtgaacaatttatagcaaaaatttgtccctgaacgtctgaaagccacatttcatttaaaacataaatatgcgcatttttaaataatggacacaaaataattgagttgaaaactgatcacaaattgccattgggttcataaatacgattcatacaaacgcatttccaaaacacgtttgagctctagagatttttcattatttttataaaaaacagatattcagtaattaattccatgttgaaatgaatgggtgaattattttaatattcaccgcaacatcagtgaactgtttatagaaaaaatttgtccttgaaagtctgaaaaccataattcatttaagccaaaactatggacatcttttaattaagagcacaaaataattgaaatgaaaacaaagcacaaattgctgtgggttgcataaattatgattcagacaaattcattcccaacgagattgagcttaagtgatttatcaataattt

SEQ ID NO: 22512 - DNA, 1317 bp, Heterodera glycines
acggcgcgggtacccctccctacgcctccaaaatcccgcgcctattgaaggggtgttttcctttgaagatgccgcccgcccacaaacccgcgcctattgactgggtgttttcctttgaagatgccgccttagtattattaccgcaaaatcccgcgcctattgaatcctgagcctatgggatgttctttggactctgccgccttgtggattttaatttacccaaatccgtgcgggtgttttttcaccgcagcgacgcgccgcgggaaggtaatcaatcatccacctgtcaccaaaagtgacagctaatgaatttcaatttttcttttgccaattaaattcaaaatcccttatcttttgaaactttaggggtaatttctaaaatcctgagattttttatgatgatttttctgatttttgaaaatttgcatttcctctccgccccgccgatttatcgcctagcaaaattaatcgataattaataaatacacaacagaaccataaattgtgggaccgtcccaataaattaaaaattttttatcgtctctttaaattcttttgagccattttcaagtagggcagcatataatgagaattgtttttagttcccgtaattacgactttaccggtccagaaaattaacgctgtcatgcttttactccgcttgaaatttaaaccgcaaaatatttccggttcataaaatgcacgacgattttttctaaattcgtttagttcaatttcatgtccgaatttaaaggtcgaaacaatattttcaaccgtgtgtccggtgtaagaagcccccggacaccccgagcccttaattatttctatgacatttatatagcattttcacagtctatcagacttttcgtccccagacatatcatttttccggatccccataatagtgcggtggctttgatcgggcgtgtacatttgataactgcggcattgaattttctagggttatacttaaattcgcattcggtgatcgtcagagagtttagtttaattccggtaccgagattagcgagagcaattatatttacgattatcggtttttgcatttttgatacaatgtaccaatcaaatggtcctttcactccctttatatacccctctataaatagcaaacaaaaataaaattaaattgaaaaatgaactgcccacataaaattaagtgttgtcattactgtccctgtcattacgagatttgtagcaggtgtaaaaagcacagtcttttgcatttcggtacatcattttttgataatttctggctatgccccaatgcgcgaaacatgttccctatgaaaatataaa

SEQ ID NO: 22513 - DNA, 2238 bp, Heterodera glycines
aatgccatcaaagtttactgctggaacaaatttgcaagaacaccaacaaatatcgtatccacaaatggcacaaccgtacggcatgggaatgccgtcgacaatggcatgccaaaattgggcgccaattgcttatcaccagccggaccattatcaccagcagcagtattatggtgaattttggcaccaccaacaaaaccctggaatttgtgccacaaacagcaatttgtcacaattaatttggccaacaacagcaatggcaccaacagtgccatcagcgtcaacaacaacattttctggccaaatgccaatggtgaagcagtgcaaacggcgtgccaccctcgcctcagttagcaccagtgccgtgccgtgaagggaacggccgaattttcggcacaaaatgccgtcagcaatgtgtgctattacaattatcccccaacaattagtgctaatgatgccttttgtgctgcacaatattattatccaccgccgccgcctaattatccaaatcagcaacagcagccaaacgcacaatcatcatcatcattagcatgtccaaattatcagcagaattaccattgcattgttcaaataataacaaaacatcatctaaatcatcattatgacatttgttggtcaaaattaagagaaaaataaattatatttaatacatatcagttggttttttataattaagtttaattaaaaagcaaaaagactatagaaaattttctatatatttttttcattggaattttatttttctattttttttctaaatttatatttgaattttttttaattttcgggggagggtggaagaaacggcgggacggggatgagctgctccaggaaatctcatgcagagccaattctccacaaatcaatgtgtgtctcgtggcatttttcatatacgaaaaattgaaaatgatcgtacaaatttccacagtattttccgcaaaatttggttgaaacaaaacaaaattaataatgcaaacataacacattcacaattttaaatacaacatggattttccaaattatttattatttttattgttcattcacccgtgccacaatggcaacgcaccgcggtgaaatggccgggtcaaacagacggaccaactcagcgccaccgatgccattctcgcgcaaaaagagcagccgatccaacagcaccagcgattcaagcggacattggagtgcaaattgcaatgcctgctggggacaaattgtattttttacgggtattttgggggcgacgaaatggggcagcccttgaaaattatatgtgtgtagtaattgagggttgtgtcggcagtcggaaaaattttaggcgatcagaattccctaaaaattttggcactcgatcggagctctgagcccgaaaatgttggaaattggcagtcggcatgtgacacatccctggatatatttctataattgccaaaaaacgaacagtaaatggctcgatgaagcgaactgctgggctgtacgtgtccatgatttggtccaatgtttgctcaaattcatccctctcctcctccacaatggcacttcgtcgcatcacttccgttctgaactcgtccaaattgttgttggccaacatgcatttgttcagctttcgtggcggtcgacgctgatgcatttggagaatgtctcctccaccattatgatcaactttttcacaattggtactgtttgaggaatggcgatggggtactgtaaacaaatacagtaaatagcgggcaccaaacattctttcaagcaaaattttgaaataaaattaaatttttttaaaggttcaatgttaatttatgaaaaagcaccatcattagctgatttggcttttgttgctgctgttttatgcatccgtaagcactccaccaatgcccggttcgaaaatgcttgacgatgtgccgtgtgctgctgctccgtgaatgccatccaacggaccagcgtcgcttggcacgccagccgaaggcccgggattggaaagtggttgtggccaaaagtgtgcaaaaaaaggtcgcgcatttgactgctgagcacccatcgctcaatggcttaatagcgacaggtatatgctaatttgtgtacggtacaactgtttgtacggtatacagtaaaatgtggtcaaataaaaatgaaaagccattccggaaataatgtttaaccctgctcagcaaagaaagacttattttatgaggaaatatggtactctgtccatttgtaagttgc

SEQ ID NO: 22514 - DNA, 1346 bp, Heterodera glycines
  misc_feature (423)..(423): n is a, c, g, or t
  misc_feature (426)..(426): n is a, c, g, or t
  misc_feature (431)..(431): n is a, c, g, or t
  misc_feature (433)..(433): n is a, c, g, or t
  misc_feature (485)..(487): n is a, c, g, or t
  misc_feature (489)..(493): n is a, c, g, or t
  misc_feature (499)..(500): n is a, c, g, or t
  misc_feature (512)..(512): n is a, c, g, or t
  misc_feature (514)..(514): n is a, c, g, or t
  misc_feature (521)..(521): n is a, c, g, or t
  misc_feature (526)..(527): n is a, c, g, or t
  misc_feature (548)..(548): n is a, c, g, or t
  misc_feature (638)..(638): n is a, c, g, or t
caaataataaagtataaaatagtgcgatatatgtcaaagtattacaaaagaaaacaaaaagtcacgcaatgcaaaaccaaataaacccgaacgtttaggcatctcatcaacgaaaataagccgctgaagaggaacggaaccacacaaaaagaactcgggcggggggaggacaaaacgacggatagcgcatcatacataaaacgataacaatatttatggtttatcacctgtaaagaaaaaaaagagtattctccttacggtcgagaaagaaaggacggaaaatcctcatcaaattccttcacttcattcaataagcttttcacagcaaaagatgtaaatataaaaaagctcttttcattaatcattaaaccatatcttacacctctgagaacactacacatctatcccaatcactgcgaaatncanatacnantacccacccaacgaccaacccaaaacacacacaagcgctaaatggcgccacnnncnnnnncccccnncccccccccccncncccctcncttcnnctcccgtgcagccccctcctngcaaaaagaacccccaacaaaccaacaaaacccaacaccccaaccccagaacaaacaacccacccaccgaccgacccccccaaagcaaantagaaaacccccatgtagcacccacaaaccacgcaagacaatacaaaaaacatacaacaacagcaaaaacaaaaaagaacagacacccccccccccccccatttcgcctgcaaagggcccaagatgtcggaccatttcgcatcgagggggggccggtgtaaaagaggtgggggggtcgtagcgaagggaaaagaaggaaatttctgaaaaatgtacctattttttcttaacaaaattagcccaaaatctcaaaatttggtcattttttaggcaaaatctggtagcaaatggcactaaaaatacaaaatttttcccggcggcgcctaacggcaccgccggaacccccccccaaaaaaaaagtttttttaaaaaaagcgcgtcgcaaaaaagcgttttttaaagaagaaaaaaagtcgtcgcctggctaaaaatcgcaaaaatctgccaatttgcgatgaaaatctgttacaaaatccacttaaatttaaaatttttcccccccgggggcgcctatcggcaccgccggctccgcgttcgcgtattttttttgagaaaaccgcgccgcaaaaaaaaaagagatttaaaaaaaaaaaaagtcgtcaaaatttttggaccccgtcgtaaggaaaatcgcatatgaccaccccccccccccctggcccgatcgtacgtcgtatgacccttggaagtgaccaccccttgtacacg

SEQ ID NO: 22515 - DNA, 2366 bp, Heterodera glycines
tgtggctcagtggttttgtaagatagaaaggacaatgggtggtggttcgagtccgttgtgcaacatgaatatttttatttatttttgtccaaaatattaaaaaatgacgaattttgggaattatttttgaagctttttgccaaccaaattggtaaatcttggtatcattcgaaagccctgcccttgatggggagaagctttttctaagcaaacattaagcaatttgatgggttagaaaaaagatatgatgctttgaaattttgttttttgaataagttctcgaatcgacctattttaatattaacttgacctattaaccgatgcggaatttttttctctatcggtgtgcaaaatttggagtggatctaacatatagaaaaaaaattaaacgtagcgaagtaaattcggtttttctctattgacagagataaaaaaatagtacgccaaaatgagagatgtttttttctctgcactctctctttattgacacatgtctcgttttttgactcggtgtgtataactgattgtgagagtatcagttcataatttttggcctttggtaaaacactttttccagcaatttcacataaattcgagatttagcactgggaaagtcaacgaatcagaaataataattgaataactgtttggttatgctctgctgctagtctcttccagtggcatcgcttttcggcattttctcagtttcacttttcaattggtttcgttcgcatttatctgtttcctctgttcctttgccaatgcttcaaaagcactgctcttcccctccaattggtctctttcatcctttttttttgcaaaaggaccgaccgaaaaactgttgcaagttttcaatggtccgactaaagaacagcgacggaaggaggagcaaagaatggacaaactgaaggggaattaatgaaaaacagtgaatggacggagaatttcattttttctgttaaattgattcctttgtaaatcgatttgatacaacggccaaaacgaaatgttgcgggaggcgattgatcaaggacggacggcgcctttgctggccaaaggccattccgcaaattgcctttctccgccgcaatcggtcggatttaaaccgctctcttccgcctttcttctgatcacttctttttgtctttgctaaaaaccaaaaatgtttttaaatttccttttcctttcgctttttgttcttttctcgatcgacttttgtggtgagttcaatccgttggtcattctctgaaatgcgtcgttttgttaagcctccgtttgccccgccggttggacgcatttggcaggcggccaaaagtgtgtgaaggcatttccgtcactgacagattggagctacggcgcatgggtgagctgacaatgggtggggcggggtatactgtgccatcaaatgttacggtaccaccctttcccttccctttcagttgtgcgcttaccaaggagcacagcacatttcggtcccaatttgacttcccttgacgtgtgattcaattttttgtttaggttaaggattattatgaaaattattacattgccgagttggccaaaactttgcccggtcgccaagtttggttgggtgcgtctcgcgccggcactccgtattattcgtggtccgaccggactccctttgggtctttcgtccgttggcgcggaagtcggtcgaatggcattgccaattccaatccgtcttttcagatgtccctccgcctcgcaatggcctcggatgtgtcaaattggacggcgtttcgggcgaatggtttcaaaggtaagcggaagcgaacggagcaacaaaaacattgaccaatgctttaagctgttgtcggaagagtgcggcaacaatctgtcagaaaaaggctgacggcacggggacaattcggctgcgatgagagagaaaagcggcggagagggggggggggaatgatgatcaaaacgatgaatgatgatgatgattacgaagttaatgatgacaaataaatgatggatgatgaggcggtgaggcggaggaagaggcaaaggaataaactacgaaaagagactgatgaattcccccaccccccaattttttccatgggggaagagcttcgccggattgaattggctaattggattcaatttgtggcgctttgggtttttattcccttagggaaaattatgagagaatttaatttggccgcggggggaaaatgcaaaatgaatttgccgctttggcgaattcatttcatttgtgttcatttcctccaaatatgggtcgaatgacatgtgatcagcataaaaaggcattggcacgggcggaaagacgccgactgagaagggtttgccggtaatttcaacatattatgggattattttaa

SEQ ID NO: 22516 - DNA, 2353 bp, Heterodera glycines
  misc_feature (47)..(47): n is a, c, g, or t
  misc_feature (2171)..(2171): n is a, c, g, or t
  misc_feature (2179)..(2179): n is a, c, g, or t
  misc_feature (2211)..(2211): n is a, c, g, or t
ttttttttttacattttttaagtttatttatttaagcaaataaattntcggggttaaatgtattttttaaatcagatttatggtagaattaacaaaaaactaaattggtttaaagccgtattgagtgcaaaaatggtcgattttttcgatttaaaaaattataacttggcttaagaacatttgaatgcagttttttgcatcttgtagagaattgagtatagaatctcatattttgttcccattttgccaaaaaaaaattttagaaatttagaaatgacatatttttaactgaatttttccaaaaaatgttgaaatatgtaggtcaactgagatttcgaagcggtgaaatagaattgtagaataaaaatttagggaacaattattttatcttaagactattcgtaaacattttctttttaaaatgtagaaaattttgaataaattaagtattattgatttccttgaaagcccataatttatgaattaactgaaaatctctctttttaaaaccaatttagctaatttcttggtcaaatacgttaataaatcgcaaatatttaaaagtgcacaagcctcgcctatcatcaaaaattaaaggaaacctgttaaaacaaagaaaaaaagttaaatagaacaaaataaccgacactttgttggaaaatgtaaattgatatgcaaaatattaaaaaaaaggtttgaaaaaattaattaattgcttagaaacacctaaaaatatctaattaataataataatgtatttttaaattaatttaatctttttttgaaaatttaaaaaaacatcggtcacttgaaataataaattctaaaattttgtccaggaaaatccaggttttccgtgttttgcctggacctggatttttttttcacattggacctggacctggatttcctggacaaaaatccaggaaaatccaggtcaggaaaaatccaggttgccgaaaaatgacctggacctggatccaggaaaaatccaggcctggatccaggtccaggccgatctctagtgaaaatagttcagggcaatgccgaaggactttcccacggcgcccttctcaaattcagttttggatattttataaatattaaagcttaatttatcacaatcatgattaattatgatacaaatgaatcgaacattttattcttcaataaaataaagaaatcaaaatagtaaggaatttatatcaaaaaatattttttattcagaaagtagtaataatagagaccgaatttatggatttttcataattgataaattttagaatagatgttttatatttcggcattgatatttttcttttattattttaatgaattaatactaaaactttatataaatataaaatttatttttgggtcgtttcttcactcattgtcatttcaaacatttatattcactattaataaaattgcgttgaaaattataagaacaccctattttttgagtttaacttcaaagactgtgaaaaagcaattttttgcgaacaaatcgactgaaatataggcaaactttcttaattttacctaaaagcaacaaaaaactaaattaaataagtcaatcaaggccaaattttgtctttaaactaagagggatttatttacctaatgaaaaatcgaatgacgattgggcgtttaaatactgtgaaataacaatttcttgtgtaagagtcttattaaacgatttcttacagagcccagagaattgtttaatttaaataacaataaacgaaaatagtttaattaaaatataaatataaaaaagacgcgaacacattccaaatttaaaagattttaacgtatcgagaactaaaaaagaaattaaagttataatggaaaacctcaaatcacaagtaaacaaaatagagttttagaaataaaattttctattaaaaattaaaaataaataaaaaaattttacggaagataatatttgaaacaaaagcatggattagaatgacattcaatcgaccggcaaaatggtcataataattgatgaagttttgtgggatttcattcattcgttaatttaaattgcaacgaaacgaaagaaataacgaatttgaatgagaacattaaaaataaaaattataaaattaattgaactcatacaaaatattaaagaaaattattttcaacatgttaagaactanaaaaatanatttaaatataatggaagtcattaaaaactanaaaaataataagaaattcatcaaagcacgaaagaaatagaataagaatcaaataatattggaaaaatgtacgaaaaagacataaaacaaagcttgcaattcaatgaaaaataactatgcactaatgaaagtttttaaaactg

SEQ ID NO: 22517 - DNA, 1671 bp, Heterodera glycines
attcgggatttgtgtttaacggactttcgccaattggacgacgatggacgtgagaaaagggcggggaatgacacaggacagtcgcattaatcaccgcagggcaggcattcgtaccagcgaatgttcggggaccaacaagacggggagttcctgaacggagcgcgcatcgactgggttctgtctcaagagcaggtggaccgcgtgatggcattcactttgccgttgcatgtcagtgtttgtcattcgaattgaaaagggcaaaaaataaacatcgaattcaatgggccgttcatagtttttactgccctttcctcttctgatcggctccatttccttctgtcctttagacgtgcattaattatccgctggatgagcgtttcctcgaatattcgcatgattacgttcgtttccttttaacttttcccaaattgagactgttcaggtccattattttataagcggggacatgcaagaacggttcagctccagcaacgacccaatcttcttcatgcatcacggttctgagtgtcttaacacattgcgaaataataactaattaattaatgataattaattaattaccatttccttacactgagtaattgtcaaatcgattaattcccttcatattccaggcttcattgattggatatgggaggagtggagacaaacaaagcaggttggtcggtcagactggccactaaacgattcaaatgtgccaaattcggcctccatttgtttgttgtgccatccccaaaatcacactcatttgtcagaatcgtctccaacgtgaacgcgattatccccgtgacgatgccgactgcatgcccgaatggcacttctcatatgcgtacatgcctttgttacaacctttgcggaacatggacgctctgtccaacaactacacggaccacatgtacgaatacgcaccaaggccgagctgtgccaaaagtggaaaatcatccgaatgcggcaacaccgagttggtggaagagagggggaaatagagaaggagagtggagacaacgagagagagagagagagaggaggagagagaacgtgaaagagtgaaaaggggcgtagagacaaaaaagaaacaagagagctagagagagagaggagaaaggaaacggagtgtccgaaagggaaaaacagaggcgaaaatgccgtaattaaacaaattgcctgcctttcagttttgtttggtgcgacaagcgaactcacccgggccacgccgtttgcagctccaaagtgaagccggggggaaattgcaaagggttcgaatggagtgaggagatttgctacaaggggaagtgtgtcgggggacgctgctcaaagcaaaggacgggggacggcaaaaggacggggaaaagcggaggaaaagcggacgaatgggcgacggacagttttatgaaatgaacggacggacgagcgactgaccgatggaacaaaactttaagcatttaacccacgaatccttccattcgctagctttcccttctctttcttttactcagctttttacctttttagtctgtcctcacaaaattatgaattttagcttttcaaaataaacgaaaatggatagaaaatgggcaaacaatggaaattaagtgaatgtccgttttaattaggcacaaataatcgaaaataatccacagagaaagcgaa

SEQ ID NO: 22518 - DNA, 980 bp, Heterodera glycines
  misc_feature (11)..(11): n is a, c, g, or t
ccaaaatatanaggaaaaattttttaaaacattttttctccatcttcctttttgatactaaagcatcagagtgctaaaattaagttctaaataaaatctgggcgcatcggttcgggggaaaatatccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattacagtacagactatagggaagctattcccgaaggattcggtctccccataaatctgggcgcatcggttcggggggactgccccgaaaacaaaaaaatcgattttttcaagtgag

SEQ ID NO: 22519 - DNA, 865 bp, Heterodera glycines
atccctccgccccgccccccgttgaagcccaatgacccaccgattggtgaacggcgactggacggagagactggcggccactgtgagagcaatgtccagctggttgagcacacacgcgtagatcaacatctgccaacgaatgggcggtggtggcgaattatacatttttcgctcttttcgccctttggctctttccctccctttaattaccctttctccctcactttgctaatggccacatccaccggcaatttggccaaaattatgcccagcggcgtcagcgtccgttcgctgtgtgtgtccacgacgccctgcgctttcagtgcctccagcgtttcgttcagtgttcgcatgtcgggccgctccaaaaagggaaagtcgcgcacgtcgacttaaaggagaaaatgaatttggacgaaattgccacggggggagggggcaaaaacgtacaaaattcgatgccatttttaaatttgaatttttaaaacaaattccaactttccaacatttagcgacgggtgcccttctccccccccccccccccgaaacgggccagttgcgtctgagccaagtttagagcatcataacttttttctttgttgaccaaatccaacaatgttggtatcattcgaaagctcttaacaagctctatcggctatccaaaaatcacaaagacgtaccgacatataaaaaagttataaattaaaatatgcaaaaattctgactttttggtagtgttcatgtggcaacttttttataagtagttcaatcgcttaggaatatcttatcaaaagcttctaaacatggagagcgtttacaaagatgccaaaaatatactgtttgacaaacaaagaaaacagttatg

SEQ ID NO: 22520 - DNA, 1720 bp, Heterodera glycines
atcgtttgggtgaattcggcgaattctttgcacgcctcggcgacaatcgaaatttcggagattccgttgagaaacaccagcacatcgccactgacaacaaaagaaagaatgaatgaacgaatggatgagttttgttgtagagggagagcattgagacgagaaaccaccaaatttacgagtttttaaatgccaaaaagcaaaacattcgaattcaatggcaaaaggccgtcccatgcacaatttgaattttaaaaattgtgatggtttcgcgcccaccgttccgtggaagggtatttcttgtcgatgagctgcaaaatgttcacgaagggtccggggtcaattcgaaccgcccttttggaggtgtccacttcacggatcagagggggcatatacctaaaagagaaaggggagagaaaatatgaaaaaacaatggaagtgtccaaaaggaaaattatttaaaaatgagagcgacgctagactaaaaatgagtcaaaaaaagttcgaccccccccccgccacctgagttcgatgggatacaatcggccgggcaccgaaatgaccggcgcctccgggaaatagccttggaacaggtcgatgttgatggtggctgacatcaaaactaactgggaaaacaattattaaaaagagggaattggtactgaaaaatgccaaaaaatgcctttaggtcgccacggcgttggcacgcactgcgcaaaagcgcaaccaaaaggtcgccggaaatgttccgttcgtgaaccttaaatagaggagaaaatagtaaaacgaaagagggacgaacaaaaggagggaaataatggaaaaatttggaccaaaaaatgaaaaacgccgtcctcctcccctcacaccctttcggtgtccgttaatttgccattggccaacctcgtctaaaatgaccacgtcgtaccgctgtaagcccgggtcgtcgaccatttgccggagcagcacaccctcggtgaggaaaagcatccgcgtggcactcgtcttggtcttgtcaaagcgcgtttggtaggcgatgtgcgagtcgaactgcttcaaaagttcgcaggcgacgcgttgggcgagcgctgaaaaaaaagaaaagggaaatggagaaaatgccaaaaaagtgggaaatgccaaaaggggaggaaaagccaaaaactataaaattgacaatgagaaaaaagtaagactatattcctaacaaaaagtgtcgtgatttttcggatttgtcgagactttctaagtcattttttttgataaaaccagaatttgtttttgtcaaagtctcaatttaaaatctgagaaaatgctttttttctcgccccccccccccattttcgacctgtgcatgcaatccgtcgcggctgagtgcatgcgattttggcataacccgcgttcaacaaatattggggcagctaaacacgaaaataaagcaaaaacagaaaaacgtaaggtaaagggggcggaatcctttcttttttaaaaatttggcacttttaccccaaatttgtgtccatgcctttcacctgtgtgcttttgccgcagcccgtgtcccccgcaatgattatgatttggttctggaaattcatatttatttatttttgatttccccccgaatttccgcccacttcttccaatttttcgaggatttccgtccgactttggtaaatgggcagttcgagttgggactgcttcagtttcttcagcttttgaagtt

SEQ ID NO: 22521 - DNA, 2356 bp, Heterodera glycines
  misc_feature (2287)..(2287): n is a, c, g, or t
caaagcgtgccacaaaaacttccacaacgcgggctgttacaatcaccacattcagtccaactattgcgcgcgttcaaagaagtgcaaagactgcggtgttatttgggacgtcaataacaattctcaaaaagggcggaaggtaccaaactcaaaaaaaaaaattttaaaaccataaacactttaagggacacgtgtgcggagaaaaattctgtcagctctgcaacaacttccacagcaccgagcgtggctgtttcattgcaccacttgagcctaaggaagagatggagtcctatcggttcgtggcctttgatctggagacaatgcagcatctccctgttgaccctcgtgtacctgagaggcgcaaccacgagccaaacttcattgcagcgaaagtgatttgtccaatgtgcattgaaaatgggagctggaagcaaggaactgccgggtgttgggtgtgcggcccacaccgaaccgttgccttctgccaacgaccatttaacggcacttctgttgacaaacaagtggtcaccgacaatccaatgcaagcgtttgtgggatggctgatcaatgacctaccgaagaaagccaacacgtacgcatactcccattttggcggacgctttgatatggtcatcacattccgtgaactatttcgtcgcggatttaacccggaaatgattagacgagtgagaggctctctttacttttatttttacttagtgaatgtttagggcaacaaaatgtacgagatgaagctaaaggcacagaagaacaaaaatccgaacatcattttccgcgactccttcaatctgatgccctgtgcgctcggacaactggtgccagcatacggcttggacgtcgaggagaagccctttttcccgcacatggccaatcggccggacaactatgggcgcgaaatttttccaacacccgaagactacctggcccaaggaatgatgccggagaaacgacgtcagttcgaccagtggtatgaacaacatcgacgagagccgtttttattggatgaggcgttggccagctactgcaccaacgacgtggagatcttgatggcagcgttggtggcatttcgacgtgaattcctggaaatcactaagcggcaagaatatgtggatggtgtcgacaaccgcgaaaatcacgatggaattgacgttctgaagcagtgcatgaccatcgccagcgcctgcatgaagcacttccggatcaatcatctcccggctaaccatctggccatcgtaccggaaagaggctacgacaacgcccaaaaccaatcattgctggccctccgcttcttcaaatggtatgcggagaaacacggagtccaactgcagacggcccacaccgctggaggtgagaagcgcgtcgccaactactcactggacggttggatcgaatccgagaagagaggcattgaagtgaacggtaattttagaaaataaaacatgtgctagaaaaatttgtgtaggctgcgtttggcacgggtgccgcaaatgtttcccggaggacaacatgctactgcctaatggaaagtcggccggtgaagtgcgggagcgggacgcaaagcgccttgaatttttgcggaaccaagtgggccgtgtggacgtctactgggagtgtgaaatcgagcgcatgctgacgacagaccctgagatgcggcaggccttcgcaggctatgttgatgatggaccattggaaatccgcgccgcgttcatgggcgggcgcactggtcctctgaagctctaccacaaggcgcgagaaggggagaagatttcgtacttcgacttcacttccctctaccccttcattaagtgagttttagcattaaaaatgacacttaaaaatttatgtatttagttttacgacacgctatcctgttggccacccaaaagtgcacgttttgaacgaggacgtggaatggaagtgcgcagcggacaacccctacgatttgtcgctgctcaaagtgtgggtcgtgccacctcgtcgatgcgatgtgccggtgttgccggtcaaggtggatgagcggctgtgcttcccgctgtgcttcaaatgcgccaaagactacccgaccggcggagttgacaacgaatacaactgtcgtcacaccgatgaacaacgcggctgggtcagcacctgcacttcgcttgaattgaatgccgcattggatgaaggctaccgagtcaacaactgttccgtgtgctgcaatatgagcagagcgacgaccaactattccgctcctacatatcccgagtcatggcgctcaaaatccagncagcggcttcgacgccacatcaaaggaacagcgagatggaagaagatttgtcagcgatgctatgaaaag

SEQ ID NO: 22522 - DNA, 2709 bp, Heterodera glycines
ttttaaaaaatattaaattttgcaaaaatttaagtcgaagcgatacttgaaaattagatttgatgttttctataaatttcggtgtataccgttggaacaaaaaacatagcgaaatttttaaataaagttctgaaattatatgatactttttatacccaacagacctctaaaatcgataataaaacaatcgtaccctcaaaaaataagagacttattttcagagaaattacggttacataagcttgtaaaaaaattcccggaaaaaagtgatctcatcttaaattacaaaattatttcaagggaaatgaagaaacaattaaaacaattcagaaatgaaaaagattcaaaaattatttcccgggggcaaaattcagttaacaaatttatccgaaataagttatcaaaattttttgagattcctactctaattgataatgctggaaatatgttttccagcaatgtacaaaaatgtaaaatattagcagaaatatttcaaaagtcttttttaagaaaatcaattgttaatggtccacaaactcagtcaacacagaataagaccaagctttttgacattgaattgaacgctggcataatttggaacatattaagaagacttccccggagtaattccacttcacctgataatatcccttatattttattaaaaaattgtgcagaaccaattacaaaaatattagcagatatatttaggctaattttggattccggtcaaattccggaaatatggcgaacatcattggtggtaccaattttcaaaaaaggcgaaaaaactgatccattaaattacaggccggtgtcattaaccagcactgtctgtagagtttttgaacgaattttgagtagcaaaattttagaatttctgaacagtacaagattctttgataaagaacaatttgggtttttaaaaaatagatcgactacaacccaaatattaaaaacaatggacgatatatataattctctacaaaaggatcaacaaattgacataatctatattgattttgtcaaggcgtttgattctgttccaattgatttattacttcaaaaaatcaaaaagattggaattgaaggaaaaattcaaaattttttaactaactttttaaaaaatcggcgttttaaagttaaaattggcgaagaattgtcagaaagtttcagaatattttcaggagtgccccagggaagtgtcttagggccattactctttttaatttttataaatgatctgccgtcctttattacaaatgaagcggcatcagttggcataaaaatgtatgccgatgatgttaaattatattatgcccatgaaaatgatgaccattcgaatcagttggataaagaaattgaggctttggaaaaatggtcaaaaataaatgggttagaaatttcaactgaaaaatgttttgttttatatttagggaaaaataatatgaaaaaagaatattttattaactcaaaaaagatttcagaatcggataatgttcgtgacttgggaattataattgaatcgaaacttaatttttcagaacacataagcaaaattatacgaaacgcatatcttagaagctttcagattttgagagtgttgaaaagcagggaaataaagactctaacagcagcttataaaacttttgtacgacctcaattagaatacgctaccgaagtttggaaccctaatttaaaaaaagatatagacaaaattgaacgggtacaaaaatttttcacaagaaaagcatttcgaaaatgtggatttgtgtacaaaaaatatatggaaagacttaaaatcacgagtttacacaaattggaagaaagaagaaaaatcaatgatttaacaacagcttttaaaataattaaagggttcaccagcctcgatactgggaaaagtttcgttttctcagaaaggtccaggaggcctttacttttacgagtaaagcgccacacggccaaaactcaaaataattttttccataggatagtaagaaactggaataaccttccagttttagcggtgcaaattaataaggcaaaggaattcaggggtttactaaaagcaatgagttctgagtaggaaatttctgtgccacaattacattaaaataatcacctgtgaatttaacatttgatttatttttatttcacatttattacatcattttgtatttttaatttgacactttttatttgtttatttctttttggcgccatataagagcactaatgtgcctttggtttgctcgataaattaaattaaattaaattaaattaaacaaactttttattttttaatataagataccgtattatctcccttttatccccccgtctccattaatccccctgtctccatttacccccccccccctttctgaggaggttgaacaataatccccccgtctccatttatccccccggggggacaaatggaatttttattttttcgaaaaaaattttcttttaaaatttataaaaattaattacttcaattcggaactcatttaaaacataagcaatttgtaaatttcagtgcattcagaatcaaaaaataagatttttaacaatttttttcggcgcatttttccgaaaaattttttgggatgggtgagggaagagagtccggcggtgccgataggcgccgccggggaaatttttgtaatttttaatgcgatttcttaacgattttgttcaaaaaaa

SEQ ID NO: 22523 - DNA, 1583 bp, Heterodera glycines
  misc_feature (1511)..(1512): n is a, c, g, or t
  misc_feature (1522)..(1522): n is a, c, g, or t
tttaattttcattaaaataaaaaaacccgccgacgggcatcttttggtccatttgaaattatttgttcccttcaaaattgtgccccgtaggtgtgctgtgtgcccagcgggaattgtacggcgcccaaatattgggccatcgttcagcagcaccagtgacagacgtcgcttttgaacaaacgacatttgcaatgcttttgattcatttgctttgattccgacgattttttttaaattttcaaataatcgccaaactttttttttaattcctctcttttcatatttattcattttatcgtcaattattttgattttatgccttttctcaatatcaaatacttttgcttctcctgtttccgatttaagcaaaatggaaaatttcaccgtagatcataatcatttagcttttcataaaacttttaaattatttccatttcttgtgctcattttacaaaaaaataaataaaattttttcagtgagttccccccatacaccacaaatcagttcaatctccttaatatggtttgttttcaaaccagtaagccaaatagtattcattatgtttatttttttgccagtgaagaaatgagtaatgttgaattgaaaatggtgacgcatcaaattgggagggcattaaattgttaaatgatcgttgatcgctgctctaattattttttttttgggggggggggggctcaagcgatcaccaaaattgtttctctctctgtttctacactgagcattgggctgttgctgttcgttggttgggatcatgtttagtttaggtgactttgatctttgcgcagacggcaggcgtcaaatttctgaagaaaattaaaatggtaattggcaattagtaccaattactaaaataataataatcactcacttaacgcccgcggcggacgcgcatttgcacaacgcttgcacgttggcggtgttcagtccgctgttgagggcacactgcttcacctcctggaccaacacattgtccgacggcaagtccaagccgcacctgagacaaaattaatgtgccgaaagagcggtatttttgggttgatggcaattcaaaaatgggcgcggcactttttgaaggaaaaacagaaaacacagtgccactgacaaagcaaatgaaaatgccaatgtaagcaatgttgtttttaggggtatttgttttattaatgccattcgagggtctgtctcggttcgagaaaagtctcgtcttttttttgtcagtctcaacaatcaaaacaaaaattgttgttgttcccacttgagcgacttctcagcagttgcccgccttgctgttcatgcattttcgcgtacagccgaacattttcttgccgaccccgccccccccccccacgtgtcgttttaatcaccaaaaaatttttttgagcaattttttctttaatacatatttggaaaactaagcaattcatcataaattttgaacaaatggaaaaaatttttaagtgcattttccgttatttttcatataaaagatttnnccttttcttnaaaaaatcccattttaactaagtaggaaatattgagcgcgaaggcagggtgacactgcaca

SEQ ID NO: 22524 - DNA, 991 bp, Heterodera glycines
cccttcctccgtttttgcagatcaccaaccaaatgatttgcactttgctccgactgtaccgcaacgtgctcgagttcggcccactgtacgtgaaccatgccattccccggatgctttccgtctggttagacttggcgcccaaatgtgccatcgccgaggcgatcgcctcgggcaccggcacaactgttggcggtactgctcgcacttcggctagcaaaaggggaggcaaagctgcagcagcagcggcggctgccgccgctgttgcaacacaaccacacgacccgaacagagaaatgcgtgacgcgttcaaacggctggacagggcgtatttcttctcctcctactcgcaaatgatttcgcgcatcactcactcggacgccgccacatatgccctgttgaaggtccagcggggaaaataaaaatagcagtcgtttccatgtactgtctacccaatccactattagagggtcagcagaagtgtcgttcggctggccatgtaaaacgatgggttttttgtggcgcttttttcaaaaaaataatttttttgggaacataaaggggtctgccgatgctgatagcaccgcgccggggaaaactttttgaattttttaatgcaatttgctgcaaaaaaaatttttttttttgaaaatgttcaaattaaagcttttgtgttttctaaacacctaaaatgaatcagaatttgatttttcaggaaatgttgtccgaattgatcgtccactttccccaccggtgtttgtggctttctcagtccatcgtccgctccacgcgggtcgccgtccgttcaaagcgttgcctggagatttttgaacttgccaagaaaaaagcgcggagcaacaatgacaacaacgctgctgttgttgacctgaatttgctgatccaacaatacgactatttgaccaccttgctgatcgggtgggtgcacggggaaagttatttgaaaatttgacattaaatagggagatcttattat

SEQ ID NO: 22525 - DNA, 1551 bp, Heterodera glycines
acataatttgataagttaagctgttatgcgcaagaagggtccactgatgactcccaccgaattgcaacggtgagtcatctattgctgcacaatttggcactttttgacaaaatgccatgcgattagccattttagtcagtaataattttttatgcccacattacagtcttctcggagatcaaacatccagaggtgatcggttgaaggcttttcgtgaagtctgtgctcggcatcccctcgcaatggcacaatggattcggtacggtcgcactttcacaaaaatcaaatccaaaaaaaaattgttgtgtcaggaccacctttttggacgcctgttcctggtacaatgctcggcttgcattcactcgcacggccgccacgatgagcatggtcggctttttgttgggcctgggcgaccggcatggggagaacatgttgttggatgtgaggacgggaggtatacggaaataaatccatcattattttccactttttggtttttaaaaaataaacctaacaacgtactttgggtgtaccccaaaatctcgtcaccaaaattcaccgagacaaaatcacgcccacgaaattgtttttataagaaaattggcggcgagattttgggtgcccccaaaaattctttgtccggtttttcgatttatttattcacaaaccgaaaattatctgaaatcaatcatgcaattagaaacccttccaagatttgatccacgtggacttcaacattctctttgacaagggcgaatatctgaaggtgcccgaggtacagtcattccgttacaatttgtttccaaatatttttttttttaaattttgcgataaaattctaatacaaaatcacactccttctggtttgtcaatttcagattgtgccgttccgtctcacccgcaacatggtggacggatttggcgccaccggtgtggagggtacattccgaaagtcgtgtgaaaaggcgttgaaggtgggaacatggatggatggattcatccgtcaatcattgtctaattgatgcactcgcttcacactctcgacaggtaatgcgggccgagagtcgcatgctccgcaccgttctgcacgcttttgcgcatgacccgctgctggaatggaccacaaccgaggccagaaaccagcagtacagacaggtgcgtttggttgcgcgggcggtttaccgtagtccaaccaatattttttttatattatcctattttcttaacaaatttaaccgaatttctaaatttccctgcggtgcttaacgacaccgccgatccaatctttgatcacttttttgaaaattgttaccccgaaaaaaatattttgtgttgtcccgccccttactacaaatttacaatagttttttataattttacgcatttttttttagtacggtgggaccacactccaatcacagcagcaggacaacgccaaccacacaatcggaatgattaaagtgcttttttccatatgcctttcgctgttaaattacattttgaaattgttcagatgcgccttgccgggacaattgtcaccgcccgcttcac

SEQ ID NO: 22526 - DNA, 1988 bp, Heterodera glycines
tttttgaatttataaaaacgagtttttgatatcacttttttaaatttttagaggtacattttcaaaaaaattaaatttttcacaaaaattttttaatttagggagaaatgctaaaaaaatccaaaatatgtaccaaatatgtataaaaacatttcacggaaattctgttctaaaggtgtgagtccacccatggagtaatggaaatggccgaagcgcccgtgtggttatgagctctgtgttggtgagggcgggcctcaacactttggtgctctagccgcaagcacgtaaaacatatgacgacttccttcaacgcgcaagcggcgcctatcggcaccgcctgaccctaaaatctataattatcttgaaaaatttgatcaaaatcgctaaatttggtcatttttgggacaaaatttgttaaaaaattgcaatagaactttgggcctcggaattccgatttcctaaaattttttgacactcggaattccgatttcctaacattttttaatcctcggagttgcgatttccgaatttttttggggcctcggaatgccatccctgctccccacccccaccccccccctcgctgggaccgttcccgagggtagactttggcaacaattttttaagcaaaatttttctatattttaacaggcaacaacgacatgccgatgaaatgagatccgagttgcaaatggagcaaaatgagcctgaggcagacaatggacgtgcggcagacacattgtctgcgttcggtgacgacgaacaacacctggagattttgaacattgttgggacagttgaggccttttctgtggaagtaagaatattaaacttaacttatcagagctttcgactgatatcacttttttgaaaaatttatataatttggtgcaattacatggggccataattgtgctgttaagtaaatttattttatttttttaaatatttgaatcactttttccttttttaacattattcatttcattattttggattcaactaaaatgatggaattatattccgtgaatttaaaacgtctcaggacataatttaatcaaaataagttactagagtattttcctggcattggttaacccacacataatttatttttcagcatcttaatgcgatccacgcacacatcatggaaggacatccgtctgctggcgaaattcgcactgttgacgtcaacattattgatagggatggaaacgtcatttaccggccaccaccacattcgcacgttttacaactgatgtctgatttctgcgccaacttgaacgaagcgatgaaaagcgtgaaaaagagacgcatggaagcattggcagttgctggtgggcccaccaccaattggtaatataaatgaataaatgtttgggtcggagaatataaaattggtgacaaatgatgagggaaaggcacattttttactttttcattgggactcagttgtcccaggacttcgttggcaacggttcgaattcataccttgatttttagaaaactcatcaaaagctttcgaatgataccaaatttttctgagtttggccgttttaaataagtcaggagtccattttccccacaatcctcttgacgaatcgattggtacattatctgtgccattttttctgggatgttgactaaaattcacccaaatttgcttttaagaatatgaaatttttaggcccgtatccatcctttcgaggatggaaacggcaggatgtgtcgccttctcgtaaattttttgttggttcgaaatggcttccacgccatcgcgctggatgatgataaattccgagatgattattatgagatgtttgataatggagatttttcaaaatatgcttcccagattgcttatttggtcactctcccttctgaacaagcccattcataggcaatggagtgaaggtcaaggagaattaggagtaattcgtaaaatgtttaagataaagccgaaaaaagaaatcctcaccaaaagtcag

SEQ ID NO: 22527 - DNA, 1179 bp, Heterodera glycines
gttttcggggcagtcccccccgaaccgatgcgcccagatttatggggagaccgaatccttcacgaatagattccctatagcctgtactttaatactgcgagggatttttgctccccatatttgtttgagtaccccaaacggacactcgaaaaaatcgatttatttttgttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctcccccataattgtttgagtaccccaaacggacactttgaaaaaatcgatttttttgttttcggggcagtccccccgaacccgatgcgcccagatttatggggagaccgaaatcttccggaataacttccctatagcctgtactttaattctgcgttggattttttgctcccccatatttgtttgagtacccccaaacggacaactggaaaaaatcgaatttttttgtttttggggcaggcccccc

SEQ ID NO: 22528 - DNA, 1267 bp, Heterodera glycines
gaaaattttcaaagttaaatcccaacattctttttcttatgctgttctaagatacattcattctaaaattgtatcttacaatatgttatgctatttctattaatttttaatttgtattttctttttcactaattttggttttttttcccaatacattttcaatttctccttttttgtttcttccattatatttttattgaaaatggaaaattgtttcttccattttgtaattattgttcaatagctaactccaattttctaccaatttcggcataatttttgttccattcattttctgaatattgtatttttgcttattttcatttttcatcaataaaattctgcgcaattcctaatttttcttcaacagtttttgttttgtaacttttatgtatttgttgattaagacttagttctttaacccatttttgaatatatgaatttttcactatttttttttttcaattcttgcccattcttttgttgaatattttcttgcttttttgcctaataatttttgatcaatcaaatcgtccgtccgtcccaatccattttttctgcttcttacattcgcttccaaccccgacaaccccgaaccccgacccttaaccccgatcggggtcggggttaaatatacacccctaagaatggaatttttgtgggggaaaaggcaaaaaagttataagaaatttgaatttttttaaccattttgccaaattttattaaataaagtaaatttttttttgtttattgtgtattgtgtggtatagtggttattgttttaacaataacaattcttttcttatgagttcgataccggttgacttttctttttaatttatttttttgtgattaatatacttttttaaataagattaatatttttcaaaatattttttacaaaatataaaatattaaattaaatttcacagaaattcataaatttttgctgaaaaactattagaaaataaagattaattttgacaaaaaaaaaacaagaaaaaaacccaaaaatttatctgaaattcataaattttttggtgaaaatctgttacaaaatagaccttacatttcaaaattcgcccggcgctgcctatcggcatcgccggtgcccctcaaaaaccttttttttaaatcagctcaaaatcgaaaaaatttatcattttttggagaaaagatgttaacagacccatccaaattttcaattttttcccgggcggcgccgataggcgccgccggacccctttcacctaaaggtctttagaaa

SEQ ID NO: 22529 - DNA, 846 bp, Heterodera glycines
  misc_feature (806)..(807): n is a, c, g, or t
ctttcccttttctcttggtctccttctctctatttctttctctccctccctctctctctccattctctctcacatctgatctctctctctcacccctctcacttttgccttctctctcgctcctccaaatattttgccgccggcaaaaacaaacaaaataattaaaacataaaaatctaaatgaaaagcaccgccgccgcttcaattaataaaaatggatgattaatgcgaaagtcgcgcgcgggggaaaagaaaagggaaacacaaaatgacaaaatgcgaaagatgctgctgcataatgatgatgatgatgctaaaggttcactcacaatcagcagcagttatttattatcaccattcacttttattgctcggcgaataaataatagaataattatttctgcgcgcacaatttttattacgcctcgggggcacaacgccaaaacagcgcaaaattcaatttgcaaaaatgaacagccgacgaagcgaagggacggcgcctattcgaatcgaccggcggcgcttcatttgcatggaaattgcctttgattgtaccgccgcggggaaagtgcggcggcgcggggattcacttggtacggtaggaaagtatgaataaataaatgcataaatgaatgaaaaggtgcaattgcccaaagcaattagtcgcccattaaaggctttggcgttgtgccccaaaaaaacttttgatggagccaattcgaattcaccaaaaaattatttgcgctcaaagccccaaggggtcgccgacggaataatgggaataaataatgtttggatgacccggnntttcggggtcggacagcgaaaagaaaagcagcaaatttt

SEQ ID NO: 22530 - DNA, 1871 bp, Heterodera glycines
  misc_feature (43)..(43): n is a, c, g, or t
gaattttgggggatgatgaaagagatccgccgggggagcagcngggagataaaatcagcagagggaggggcgcgaatttgaagaggacggcaaagcaacagaaaagggggggggaagaagaagtacatggggaggggggggatggccttggggaattatgacgagcattgccctaggggacggcgattcgaatcggaaacagaagaaacaaactcagagccagccgggcaataaaagcgcaattcaaatgcgcacagattgacaaatgcaaagactgatgagtgatgacggacggagggaatggaccaatttgggggtttcgattatcggtccctcaatgaatgcttaaccaactccttttctgtcccttccgtctttcaatttaggcaaatcattaccgcgcggggggaggttcctttccgcttcttcctctttccctttctctctctctccctctcccgctcctctctctctgccctctttttctctctaccaccatcctctaacattccctctttctctctctctcactttccctctttctctctctcactttccctctttctctctctcccatactctctctctcccatactctctatctctctcccgctcctctctctctctctcttaccaaatgctctttcgtgtcttcttttctttctttctttctttcggcctcttttcctcgtccttccatcttttcccctcgttcggtggcggcagtcgcatttaatgaaataaaaatggcttattgaagaaattatgcgctggtggatgaaaaatggacgtgtcggaagggggggggtgattctgtgggggaggggccgtcccgcctacggtagcatttccattcactcatttctctcatccgcctgtgccattggcgaggagggcacaaatttgccgaagtgcccatttcctcgctttctttccgcttcggtgccaacaccgccgcttataataaggggccgaaaggaaagcgaagggaacgataggaaagaaaggcacttttggggcggaggcaaattgaaattaatcgccccggggcaaatccattcgacgcaaaatgtgccgcggtgaaatggcaaaaagggcactccataaattccatcgttggatgaaattaaatggggaaagtgccggacgatgaatgaatgaataaatgaatgaagttgatgggcgaagcgaagccgaaacgaaggggggggggggtacggtattggcaaaacgcaaaatgaaattacatattcggcagggcacggcaaaacccccgcagcggaagcgaaattttatgggctggaaaagttggcaatgagtgcttatgagggaaagaaaagaaaagggcatatttgggggaagggaaagagaggaaattggcacggggagagagagacggaaagaaagaaattggcaaagacagaaaaaggaaatttaaaaaggaaaaggaaatttatttttggaatttaaaattgcgaaaacagcagcatttttgttgatcgattcgataataaaatgggcaaaaaataagcgggggaagggtaaagggttaagaattcaaatggaaaatatgagcgaatgggggagggagtgatgtacttactctctgatcaagcaaacagatgaagcgaaaggggggacaaaaggggcaaaagggggcaactgacggcgatgacaaaacattgcgacttgcgcacattaaaagcggccttttcgaaaccgatgatttttcgcaaaagtattatgttttttttgcggtcgctgcttcttctcaaaagctttcgcaaaagggaggcgtaaatttatgaattgaaatgggaaaaggggtaaaggagacgaagtaaaagcggggggggggggaatgaatggaa

SEQ ID NO: 22531 - DNA, 1368 bp, Heterodera glycines
tttaacttacaacattgccaaatgttgctgaagaaccgtttgtccatgtgctttggtagcgatttccgacgaggacacggcgaagaccgatcctgaaaagtaaaaaatattgtaatttaaggattaacccgctttaaaaaaataataatttaaatttattaattcaccaaaatgcggtgaaaagtgttgttgccaaattataggtctgaatccactgcacaccgacgcactagactcatcaaatgttgacgactcttccgtgactgatgataaatcatccgatgttgacgactcttccgtgactgatgataaaccttcagatgttgacaattcttccgtgactgatgataaatcatcaaatgttgacgactgttcagtgactgatgataaatcatcaaatgttgacgactgttccgtgactgatgataaatcatcaaatgttgacgactcttccgtgactgatgataaatcatcaaatgttgacgactgttccgtgactgatgataaatcatcaaatgttgacgactgttccgtgactgatgataaatcatcaaatgttgacgactcttccgtgactgatgataaatcatcaaatgttgacgactcttccgtgactgatgataaatcttcagatgttgacgactcttccgtgactgatgataaatcatcaaatgttgacgactgttcagtgactgatgataaatcatcaaatgttgacgactgttccgtgactgatgataaaccttcagatgttgacgactcttccgtgactgatgataaaccttcagatgttgacaattcttccgtgactgatgataaatcatcaaatgttgacgactgttccgtgactgatgataaatcttcaaatgttgacgattcttccgtgactgatgataaatcatcaaatgttgacgactgttccgtgactgatgataaaccttcagatgttgacgactcttccgtgactgatgataaaccttcagatgttgacaattcttccgtgactgatgataaatcatcaaatgttgacgactgttcagtgactgatgataaatcatcaaatgttgacgactgttccgtgactgatgataaatcatcaaatgttgacgactcttccgtgactgatgataaatcatcaaatgttgacgactgttccgtgactgatgataaatcatcaaatgttgacgattcttccgtgactgatgataaatcttcaaatgttgacgaatcttctgtgactgatgataaatcctcaaatgttgacgactgttcagtgactgatgataaaccattcaatgttgaccgactgctccgagagtgatgataaaacttcaaatgttgacgactcttcccgcgactgatgataaa

SEQ ID NO: 22532 - DNA, 1659 bp, Heterodera glycines
ttcttaggccgtaccggaccagaatggcttgcggcgacggtgatcaacccgaagaatggagaatggaaaagccgaacaataaaagtgaaggacttcaacagcctttacccatcccggtaagaaatggcacaagaaatgactttaaaaatttaaaatttttaagcaacatgttcaccaagtacccggttggccacccaaccgtggtgcaattcgacaagaaagtggattggcgctgcccggcacatattgtaggcgaggacggcgtccggcttcaggggatcatcaaatgttatgcggtgccaccacggcattgcttgtttgacatccccgtgctgccgcatcggaacagcaagcgcactctcttcccgctgtgccgaacatgcgcgaagatatacccgaacggcttgattgaccccaactacaattgtccacacttttcggacgcagaaaggggtaaaatgggcaaataaagtaatttttacagagaagaattcacaggtttttccacatctgtcacgcacattgagttggaggcggcactccgatcaggctacaaagtgacgcacgtctaccgtgcatacatttggccgctggtgtgcgattggagcgatagcgtgttccattcgtacatgaacaaatttctgaagatcaaattcgagtgtacgcatttttttaaagtaatacaaaatttaaaaacaaaaatgcttcagcaagtggatacccagcaccgtgcagagaagtcggcattgacgaagaggagcgtgagcgtcggcagcaggactacatcaataagccgtgggagggcaacaaagtgtgcctcgatgcgaacaacattacgccaaatcccgggctgcgttacctgtcgaagctgtgcctcaactcgttgtggggccgttttgcactcagaaaccggctcacaaagacggagatcgtggaatgccatgccgagttggccaagctgctgaacaacaccaaaatagaaatcagcagcatcgaccagctgacggagaaattctggatggtctgctacaaggcctgcgatgaggatgtagtggagcacggcaccagcaatgtaaacttggaaacttttgtttttaaatgcaaatatctcaggttgccattgccctctggacaacggcggcagcgcgggttcacctgctcgaatcgctgcatttggtgtataagcaagaaaatggggtgcagcgatatgacacgcaccttctctatatggtaaaatcaaaacaaataataataataataataattgctaaatttaaggacacggacagcatcttctacgacttcaagtcagaactcagcgaccctcttcctggcggccagcagcttggggaactcaccgacgagtaccccaaccacaccattatggaatttgtgtgcggtaagaatttgcgcaaaataactttaaaatgatttgaaattttcagctggacccaaggcctatgggctgcgcaacaacgccacgggggaggacgagtacaaggtcaagctgcgcggcatcaccctggactcggacgcctgcgagaggatgacgttcgagaagatgaaagacatggtgctaaataagttggggcaggaggacaacaacgtccgtttcaactatccgacgaagaacttccggataacgaagaagggcgagat

SEQ ID NO: 22533 - DNA, 1236 bp, Heterodera glycines
atgataagcatccaaccattgaaaatctctcttctattgtcgaaattcttaccaaagatttttcgaaaatttttggtaaggaaatgaaccaaataccttggtaaggaaacggtggtaaggaaacggtggtaaggaaacggttggtaaggaaacggttggtaaggaaacggtggtaaggaaacggtggtaaggaaacggtggtaaggaaacaacaccaacccctaacactgggcttgacccatagtgccccggcgatacaattatactttacttctaatctttctcttatttagaaaacaaaaatctttttgtaaatgggaaaaaaacggttgttgcctttgccttcaacaaatattgagcaagaaaattcgtcattttcctcttgtaaaaatgttgaatacgaaatcattgatgaacgctttcaaaatgaccatcgcatcaaacagcagaatggaagcaacaacaacagctatgagctcagaagtggcaccaaaaaggcgcgccttgaaaagcctgacgaagtattggaattgaattaatttttggaatttttaatttttaggcccaacaaaaatcaaacaaaaaaggggggaggaaggccaatcggtttgtaaattcctttttttattcaattaggttttcagggtctaatccaaatataaaaaagcctcccgccccctctcatagttttgcattgggcccattaaagtaaaaagtgcccaatatccctttcaaagagcaatagtgcctctttttcatgggtttttacaaatttgtttagagcatgttgtgcgacagcccatttgttagtcggagccgaagaagcgaaagaatcttggaaagcaatgtccaattaattacaccaaaggttttgtcaatttttaaatttgaaaatccaaaaaatcaaaatgttaaaaatgtgaaagtcagtttaaaaagcatttctaaagttgaataagtcgaaacaaaaaattgaaatttcatcgttttgacatcgattttcgcgttttagctaaaaaacgaaagtctgtcaattttttaaaataaattttatgagtcaatatgcgccattcttacattaagaatattgaccgggtttattggcataatgcccagttttagagtctaaacggaaacacaaatggaccagcaattgggaagcgcaaagaaaacaacaacaacggaaagcaaacagcagcaagaacaacaacagcagcagcagaaagaacaacgcca

SEQ ID NO: 22534 - DNA, 2282 bp, Heterodera glycines
  misc_feature (43)..(43): n is a, c, g, or t
  misc_feature (73)..(73): n is a, c, g, or t
  misc_feature (130)..(130): n is a, c, g, or t
tcctctcgcgaactatcagtctcgcccagcactaatgtgggcnaaatttttggaatttaactttcgagagtcnagcagaaaaacaataattttttagggtttataagttttttttaaatttttttttatnttcgcgcgctgctgaaagagtaacagaaagaaaataaaacaaactttgataacaaaaaaaaatttcgcaaacaattttttggcttttattttatgctcatcatttccaaattttgcacaattttttgcattatttttgcgaaattcggccgattcatctcacttttgttcagcacccaattgttgtacaaaattcgccattccttcagcaatttttccatttctttctgggtttgccccatcttggcaaggtcaattctgagcagattccattcgattgtgtgcatacagtcaaaagtcgcataatcccaatccttgtttcggaacattttgttgatttcattttttaaaatgggcacaatttggttcatttctgttttgtagaaaatggaaaattttggtaaaatgaattccataaatacggtgtgaaacattaggcacaacattaacacataataaggcattttaagcgaagtgaaaaattcgaaattcattttaaaggaattttaactcgaaaaaaggcttttactgaaaatgcgcttttcttataattaatccgtaaaatttttccagccattatttcgctttctcatttcaacagttttaattttggggtgccgcccttttaatgatataacacatttacatattaacctttgtacggatcaaactcaattttgacagctttggcgtattgcaccaaattttcgccaaaataattattaattaaattcgctccgctgtaaatttttataatcaaaaaattatttaataatttaaatttaaaaataatttacgagtgttctgtatcactgcacaattcctgctttatcaattcaaatttgctaattgtcacttcaattggctcgacgccattaaacagaatattttgattttttctgtttttcataattcgttccaacaaatcatttgaaaaattcaccaaaacgcaaaactcactttttcggattggcactttcactttgtcgtcacttatttctgttgacatcgaaaaatttaaaattcgtagaaaaatttggggcgcagaaggctcaacccaaaagtgtgcattgtttgcttcaccaacaattttaagcatttgaataatttcgtaaatggtgggagaataatcggacaacaaacacaaaaagtcgaaattttctttatttaaaaatgatttaaaaattaaaattagcttcccactttttatttgttctctttgcaacattcccaagcttcttgcaaatagcaaattgtccttccaattcggaagttcaatttcaataattttttggttaattttgatttgcgtttgaagtaaactaaaaatttaattgaattaaatattacaaatataaatttattattatttaaattaattaaacatttaaatttgtataaatattaaataatgttttatctacaaaatcaccagtaatccgttatgtcatctgccgaaattgaaatgcatttattgacagaaatgaaaaggttaacatatttttctgccaaacgctcactttccatttgtgccgataaacgaattgccaaagagaaaagcaatttgaacaattgcgaattcactttcgtcggcattgtctttcggcgtggagaaaataccagaggaagttgtgatacgatattttctaccgtaatcacaaagtaaacgttttcgccaatttgacaaattgatgaatttaacctttgattaattgggcaaattttttaaacatttaactaattatacagataaataaaataatgtatttgaataaataaattaataattaggcacatttgaaccacagtgtacagtcgaaccagcaaatgttccactaatgagacgggcagtgccattaattgagctgttccgtcatattttactgatttcgatgcattgtgcaaaatttcggataaaatttggccaaatttcggcacatttttcacaaataagtccaagtcccatttatagtggcacatcggtgaagaacttgagcagctgtacactttaatgatttgactcaacaattcaaccatctccttttgaatgggcactttattgatgaggcctttcttttgctcaaaattgtcttttaattctttcaatttttaatagttttcaaaatcgtctattttttgaagaatttcaatta

SEQ ID NO: 22535 - DNA, 2344 bp, Heterodera glycines
tttgtttttaaagtttttcctgtcaagaataatgaaaagtgcgagaagcattagcggttcttgagctcctacaaaataaatatttgttgggatttttccattagcagaataatgcacatattaatttgattataaaacccattttaaagtactaatggaattccaccaaaaaattaatttactttatatattacaaatattcaacaaattctattgaaataaatcattattttttagtatttttaaaaataaattatacatttttgaattttaatttcatattttcgagagttaaaattttcattttttcctttttagtaaaattttctatatattttgtaatgtcttggcctgatcttgtcaacaacaatttgatcggtaaaattaataattttacatataatccgtgaaaaaaatttttatgaattttttttaaaggcactggtcatgtttctaaggctgcaatttgtggcttggacggttccatttggggaaaatcggacaattttaatgtcaggaatttattttaatttaattttaattattaaattaaaaagatatgatgaattattaattaaatatttttttagaaaattttcccaaaaaatcgcagaatacttttgaaagtttctatttcttgaaattttcttattaaaaaatttcttaacatttttttgaaaatttgttaagtttgaaagtttaaaaaattttcggggtagggatgaagcaaacgcatttttttattgaattaaattttacttctttgagcttcaaatgtttaaaaattaaaaaaaaaaattttaatttaagttggatgccacggaagtaacggcagcgatgaacggactgaagcaggtcatcgttttcaaaaaaactaaaactaattttatattaaaattttagccggatgctgtgctcgcctctggacttcgtttcgaaggagaaaagttagaaaaagcgcaaaatttggcgtcggacaatgggcgccaacttagactttttttataagataattaaatcgataacaaattttcaaagaaaaattttgttttaattaggcgcgcttcagttcgaatgagaaaagttcgacaaaaaggctccaaacatttggcgccggacaaatgggcgcaaagcgccagcttagcctttgtgctttttttcaaaaataaaaccaaattcggtaacaaaattttcaaagaaaataatagttggcgccggttgagtcccagccaggcctacgttaaaaataagcatttgtaagaaaaattttcctagattttttgttctgcaagcggacacggatcggatcatcggtgtgtttaaataagaaattcattcatttttataaatttatttcatttaaggcaaaaagatggccaccgggttcttcatttacaaaacgggcaaaggtgaaaaatgatgaaaacaagaaaaaaaaattctattaatttaatttattaattttttcataactttgctcaagaggaaccaaatttttgtgattttcaaaaaaattatgtccagatgatttaaaaaataggtttttcaaacaatattgtcataaattttttgaaaattaataaaaaaaaatttattttttggcaggaaaatagagaacatttaggagcttgcgaatgatatcaagaattaaaattttattgctttcaacaaaattataggcaaaatttttttattttaatcgttttttgagtgtcataattagggttatgatttgtatggttttgcatattttttctgcgcatatgctatgaagaaaggggctcaaaaatagcatttctgcgttaaattttttgatttggtgaaggtttttagtgcatataaaagcatattttggggttttttgagaataaatgcatatttcgtcatttttgggcttttagagcataattcggtcatttttaacaaatattcgtaagaaaaatgcaataaaaacgaaaaacacacccctaaggatcgactttttggaatttaaaaaaaaatacacccttaaaaattgaaaaaattttaaatttttgtaaaaacttttggaaaaaaaaaaatttatgtatataaaaatgtaattttgttttagcatataataaaaatttatatatttggaaattcaatatttttgcaattgtctaaaaaatggtccttagcccttgttttggtgttttaaaagtcaactcttaatttatacataatttttggcattttttgagggctaaaagccatttttggcagttttttaaggcatattttagtgcatatttgggcatttttcgggtttttagggcatatttggtggatttttagtgcatattttatgcgcattttggcattt

SEQ ID NO: 22536 - DNA, 945 bp, Heterodera glycines
tgatgatgacgagcattccgtgccggacttggagccgctgtcacgcgcgccaccggccaaaacggaggacgaaatatacgaaaagcacaacaaaaatagtgcaaaaagtgactttcgatttttttgaaaaattgctaaaaatagctttcattttagcattcgggggcatatatgatagataacattctcacaattttgtcgagaaaaatggaataaaatgccaaaaaagtcagtgttagggaaagaaaaggaaaagccaattggcgttaaaatcaatgaatcatgtgcacgccaggccttgctttttttcaaaattaaggctgtcatcaaaattccaattttagcttccgaaattttctataaaatttcgctcaaccccctcttttaaatttgaaattccgcccgcacagttacagtatgcaacaggaacgggcagtgcgcggcgtactgtgtacggaatcggcgctgccggccctcttttctccccaaaagtctttggaaaaagcgcgccgcgaaaaaatgttttgaaaagcaaaaaaagaagtgatcagaactattttattgctgattatccccccccccgcccccggcgctctcctctattcctctccatcccccttttcaacccctccccctcaatccctctcccattttcactttcttttgtcccaccctcattgtctcgctctccttcgcattcgccaacccttctcccctacccattttccctatccccccaatcatttgtctagtgatataatgatgagaactagcgggtgcgtgaaccgtcggatctgtgcctgggataaagcgcttcgcgcttgttgagcttcgctacctagataagttatgggttgtgaagatattctgaatttttaaaagattatctgggatttttgggccgcttcgcgacctcaaacgggcgcttcgcgcccgtttttaaat

SEQ ID NO: 22537 - DNA, 1194 bp, Heterodera glycines
ttttcatcgttcatctttgtttggttctttcttcctctattcccgcattttttatttgtggcacacaaactctggcaaaaacaaaggagttgatggccccaaaaattcagtatttaatcacttaaatctttcttcccaatcactgcaatatgcttatttctagatttatgtacctcttctattattaccattaaaattctgaatctacaatttttctgggctccaataaccaaccaccgggcgcctcctgaaactgtttttcatcgttcatctttgtttggttcttcttcctctattcccgcattttttatttgtggcacacaaactctggcaaaaacaaaggagttgatggccccaaaaattcagtatttaatcacttaaatctttcttcccaatcactgcaatatgcttatttctagatttatgtacctcttctattattaccattaaaattctgaatctacaatttttctgggctccaataatcacctagcgcttcctgaaagtgtttttcatcgttcatctttgtttggttcttcttcctctattcccgcattttttatttgtggcacacaaactctggcaaaaacaaaggagttgatggccccaaaaattcagtatttaatcacttaaatctttcttcccaatcactgcaatatgcttatttctagatttatgtacctcttctattattaccattaaaattctgaatctacaatttttctgggctccaataatcacctagcgcttcctgaaagtgtttttcatcgttcatctttgtttggttcttcttcctctattcccgcattttttatttgtggcacacaaactctggcaaaaacaaaggagttgatggccccaaaaattcagtatttaatcacttaaatctttcttcccaatcactgcaatatgcttatttctagatttatgtacctcttctattattaccattaaaattctgaatctacaatttttctgggctccaataatcacttagcgcttcctgaaagtgtttttcatcgttcatctttgtttggttcttcttcctctattcccgcattttttatttgtggcacacaaactatggcaaaacaaaggagttgatggcccaaaaattcagtatttaatcacataaatctttcttcccatcactgcaatatgcttatttctagatttatgtacctcttctattat

SEQ ID NO: 22538 - DNA, 1665 bp, Heterodera glycines
  misc_feature (1602)..(1602): n is a, c, g, or t
  misc_feature (1624)..(1624): n is a, c, g, or t
  misc_feature (1649)..(1649): n is a, c, g, or t
gcattccaggccttgactgatctgtttacaaaagattcattagattttttagattgtaatttaacatttaaacggaaaaatgacttatttcgagtatttaggttatggtccaaatgtgtaaaaccatgtaaaattttataagtagttaggaggtcaaaaatttttcttcgtttttcaagagtagctaatttaaaaaaccgaagccgttggtcatagggaatatttggaagacaacattttctgaaagcgattcgagtgaaatatttttgacatttttcaattttgataatatgcgattttagttgcggattccaagattcaggggtatattcaagaagtgaacgtatataactatcataaatatttttccaaattgcaattttctttgatttaataacacggaaaagtaaacgcatacggtagtaggcgttacgggtaattttgcttatgtattcagagaaagtaaatttattgtcaataagaattcctaaatcacgaatagtttcaacttcacaaattgcattatcattatttttatattgttctctggggttattttttccgaagtaaatgataaaagttatattaatagaaattttaatataccatttcttataccaatcagagagaatatttaaagcgtggtgcataacaattctatcattttttgttttatgtacagaatataatttgacatcgtctgcatataattttatagaaatttgtttaggaattaattcaggtaaatcattaatatatatcaaaaacaaaagtggcccaagaacagaaccctggggaacgccagagctcattttatattcagaagagagagtactatcaacccgaaccctaaaggtacggcttgaaagaaagtcagatatccaatttaggattttacccctaataccaattttatgaaccttatataaaagtaaattatgggggattacgtcaaatgctttcctaaaatctatatagacacaatcgatattcttattattataaataccatcataccaattttcaagggttgaaattagttgtgttgtggttgatctaccccttataaatccaaattggtgttccaagaataaattgttctttaacagaaaatcagaaatagtccaacaaataaatttttccataattttacataatgaacaagttaaggcaattggcctataattcatagggttacttttgtccccttgtttatgcagggggataataatcgattgtttccatatagtgggaagttttcctgtatcaagggagagtctgaaaatttcagtaacaaaaggagtaaacgaaagaaaacaattttttaagagtctaaaggtaataccgtccggtgatgtgttatttctgttaggtaaggttctaagtactttaccaacagaaacaatgttaaattctacgtcgtttattgttgaagaagaacaagaattatcaaaatcaagagaataattattaacaatataattttcagaaaaaaattttgcaaaaatttccgctttagaaattgaatcagaaataaaagaagtattgtattgtataactggcggatcttctaatggtttaaagtattttctaagatacganaataatctggtcttatcacggnatagtattttatttctttacgggantgatatttcttatttg

SEQ ID NO: 22539 - DNA, 909 bp, Heterodera glycines
aatatattttaaaatgttaggattggcaaaattataattatttactctcaaaaatactccagaaaaatttctcgcgtgctttctttctgatgactggttttgattgggtagaatggtgatttatatacgcttaatatattttaaaatgttaggattgacaaattataattatttactctcaaaaatactccataaaaatttctcgcgtgctttctttctgatgactggttttgattgggtagaatggtgatttaaatgcgcttaatatatttaaaatgttaggattgacaaattataattatttactctcaaaaatactccataaaaatttctcgcgtgctttctttctgatgactggttttgattgggtagaatggtgatttaaatgcgcttaatatatttaaaatgttaggattgacaaattataattatttactctcaaaaatactccagaaaaatttctcgcgtgctttctttctgatgactggttttgattgggtagaatggtgatttatatacgcttaatatattttaaaatgttaggattgacaaattataattatttactctcaaaaatactccagaaaaatttctcgcgtgctttctttctgatgactggttttgattgggtagaatggtgatttatatacgcttaatatattttaaaatgttaggattgacaaattataattatttactctcaaaaatactccataaaaatttctcgcgtgctttctttctgatgactggttttgattgggtagaatggtgatttaaatgcgcttaatataattaaaatgttaggattgacaaattataattatttactctcaaaaatactccagaaaaatttctcgcgtgctttcttacagatgactggttttgattgggtagaatggtgatttaaat

SEQ ID NO: 22540 - DNA, 1074 bp, Heterodera glycines
ccttggcattttcaccctttattttccttggcatttttcccgtttattttccttggcattttccacggtttattatccttggcattttcccccctttattttccatggcattttccccgtttattttccttggcattttccccgtttattttccttggcattttcccggtttattttccttggcattttccccctttattttccttggcatttttcccgtttattttccttggcttttccccgtttattttccttggcattttccccctttattttccttggcattttccccgtttattttccttggcattttccccgtttattttccttggcattttccccctttattttccttggcattttccccctttattttccttggcattttccccgtttattttccttggcttttccccgtttattttccttggcattttccccctttattttccttggcattttccccgtttattttccttggcattttccccctttattttccttggcattttccccgtttattttccttggcattttccccgtttattttccttggcattttccccgtttattttccttggcattttccccctttattttccttggcattttccccgtttattttccttggcattttccccgtttattttccttggcattttccccctttattttccttggcattttccccgtttattttccttggcattttccccgtttattttccttggcattttccccgtttattttccttggcattttccccctttattttccttggcatttttcccgtttattttccttggcttttccccctttattttccttggcattttccccgtttattttccttggcattttccccctttattttccttggcattttccccgtttattttccttggcttttccccgtttattttccttggcattttccccctttattttccttggcattttccccatatattttccttggcattttccccgtttattttccttggcatcttcgccctttattttccttggcattttccccgattattttcctcgacattttccccggttattttc

SEQ ID NO: 22541 - DNA, 1529 bp, Heterodera glycines
aaaaaaaaggacgcttaggaactctggattaaagctttaggcctatttttttccagagttccctttgtctgaaacgcacgaaaaatttatttttatgaatatttttctctttaatttacacccattttaaaatttaaataaagcggattgaaaaattttattataaatttaatttgcacaatggattttgattattagagctaatatttttaggttttgacctatttttcctgtgctccttcccaatggcctgaaatgcacgaattttaaaatctaaaaataattattcaaaatatgcaatcttttaataataatacatactattgtaaatcactattatatttctaagaaacaaaagattggaaaccacgaaaaaactggatttcttatggacaaaagattgacttgagtaaatcaattgaataaatgttgcaattaaatttatttattttggtattttatattatgttggtagaaaaacatataaatctgtaaaatgaaaagtcaagtgtagccgagtataaaaatttttatttttaaatatgaatacggagaaaaaaattcaaaaaataattataaattcctaatataaatatatttcatttttttcaaataaaatcatgttgaaaactagacattcattttagattaaaaaaacgaaaaaattaacttgctaaaaaatgttatgaaaataaataaaaactaaaatattaccaactgttgatataaatagaattggcttcgtcatgaaaaaaagaaaatgtcaaaattaaaaggaagccataaaatgattatattattattttttatataatttttaataaaaaaatatataaattataaggatattaaaaattataataaaaaggctttttcaataattaaataaagtaattttaatgatattaaatatataaccataaaaatatcgcgtgatttttttgctaaaattatattttatgttttattttatttattaaattaaaaaaaatatttgttataaatattttttagtttgtaaatattttttagttaattattatatttaatgaaatttatttaagtaattcaaggagagtactatttatttgtaatgaatcgcatcactattttgtttttataagattttatttaattcattgtagttattaaaattttgttaaaaatcaaaaaaataatcgattaacttttttttaaaattttataataacgtatatctctaattatcccaccccccccccccccggcggaattattgttgaacctcctcagaaagatgggggggggggattattagatatggggaataaatgtagacggggggattaattttcgactaattattagtgaaaattttttgaaaatacggtatgtctaaaattataatcaaaatatttactccatttcacaaatttaaaatttatttatatattttttcttttaattatttttgctgttttattgtaatgtgttttgtatttagcttaaataattttagtttcaatttttattatctcaatgatgatata

SEQ ID NO: 22542 - DNA, 1046 bp, Heterodera glycines
agagaagtcagaagaagaagaaggacacccgaaaataggagaaaaaaaactgtgaaaataaatatgtattgtaaaatgcacataaaaaacatacactggtgatgcttcacaacggacgaaactcaactcgtacaaggccaatttgtactgctccaactcgtactgttttgatttcgacaaaaaatcgtcattacttttgtcaaaatcgacaaaattaaacatttttggtgccattgaatagcgcttaatgttctctattttcttgaaaaatttcaaaaaaattgattatatttgaaaaaaattatggaaaaaatatttttatgcgattttcgtccaaaattttttttaaatattttttgaaatttttcatgaaaataaagaacattaagggctattgaatgttactaaaaatattgtattaggttttttctttttttgtcgaaaaaacagtatcaattggccaagtacgagttgagtttgttaccgttcaaataacatgtagcctacaggaaaaaaaatgtaaaaaatgtgcaaaatgccaaatttaaaaatttccctgcggcattcttttttgggttgttctgttctgttttgtgtctaatggcttttcctctgatcacttatcacagctgataccatttccgcctttcatacttttccaataatctgtaataataataataaataaatttaaataaaataggaaaaataaattaatttttaaattatttttacttggccgatcgggactgaattgcctgcgcattgttccgcagctgttcagtggcatcaacagttgagttgaggcgatcgccacgttcacccaaattctgaaaaaataaataaatttaaaaataatgaattatttaaatttgtttttttgtaaatttgatttcaaaaatgggttttttaaatcattgaaaatttctatatttaatctctcatcaagcagctggggcgggggaggattaaatcaagcttctttgataaaggatttttcaatttcatttaggatttggagtacattatggcagggacatataatg

SEQ ID NO: 22543 - DNA, 2581 bp, Heterodera glycines
  misc_feature (1470)..(1470): n is a, c, g, or t
aataatgataatgcaaccttaaataaaaaagaattactacataaatctaacgtaaataaataaatattcgttcatcctatactggatggaattggacgattctcttcgtgaattggaaaaaaatagtaaaagtaaatgagaatttaaaagataataatttaacgaaatattattaataaagaaaacaaaattcatttttataacggaaaacagaacaaaaataatgtaaataaaacaattaacagcacataataataataataataataataataataattgatgaccaatcaaaaagatgaataaataaatttaaatggaaaattaatttatcctatcaaataattgtgataattaaataaatttttattcataatgacaaaaaaaagctaaaaattaaatattattaaaaacccactaattaaagaaagcctattttcattaaaactaaataaaatatttaaaaaaaattacaaaataaaaacagttcgtgcgaataaatataaaaaactaaaataattatagaaaatgataaatttactattaaaatctggttaatgattatttttaattgcaaatcataaagatataataataaattattttgttcataatgtattttatataatttgtattattgaaatcattttataaaatctattttattatcattttgtaattaaaaagggaatgtgaaataatataaaacaaaataattagcacataatgagtgagtgccaaatcaaaaagatgaacaaataaatttaaaagaaaaaattaatttaccctattaaataattgtttataaattaaataaattttattaacaatgatttgtttaatataagcgcttttccttgccattccagtagttaccccccaagattttggcccttaattttcagccccgccatttcagtcccaatggaaagggacgtttcagtaccaaatttaaacctttaaaaaacacctataataaatatatccaatcccagaagaggtaaataattgaaaaaacatctgaaggataaaacccaacgccaaatcctattagagaaggaaagggaggcagagggaggacgtcagctgtcatgccttatagggaagggaagggacgcatgccacctgagcgcccgcgtgtgtgccatttaaatgctcgcgtatgccatttgagccccagagttatttttacagcgcagccatcattccgtttggcgttttgttgatttgcgcaaattcaaaaactatgagtggcattcaacatacaaaactttgcgggtactgtatgattcccaatcattcaggtaaaaatttagatcagtgatcatgatatgatatatcttcctctttcgctatgcaagtccggcattttccattacaaatctcattatatattaaaacattgtatgtgtccttgcaaattttacgagtttttcccgttatgtccatggcaatcattacccaccccgntgcaaaattaaagtgaactaaaaatttaatctataaattcacagagggggggggacggggtacactaaattaaaacaggttgtaaaaaatgcaaaattcacagaaccgggggtacaacaaaaatttaatcaggtttaaaaaatcattcatcttccaattccaattcgaatgtcgtgttcctggagttcgaggatgtgtcatctaatgtaggatcaaaaaaaaaaattttttttttctaaaataccttcattgtaattcatttgcacgcgacgtttattcacccctttcgccacttcgtctgcggtccctccaacttcgcctcttcccgcgtcattttcgagaatctgaaaattcgattgttgatgatgctcacaatcaggcattgtgtaattaatgtaggtatttaaaatgattaggattgcaattttcacaaaactcaccggtcccagtggaattctgttccgcagctgcaccaacagcggattgtcaaaattcgttgtccgactgctgctgctgctggttgatggcggcaacgctggcattggtgggaaaggcatcgacggagtagccggtggaggagaagcccacggaggcactatctaaaaaaaaattggttgaggagtaccatcgccagtattacccatttttcaatataattttttttcacagcaaaatatttgaaaaaatagtttattttcaaacttacgtgtctgagtttcggcttgtcccgaatttgttgcatcatattggtccatttggcggtggatagcagcgccaacggatttaacggattttgcggccttgagagaaataaaggcggagggggcggatgccgacgagcattcaatgaactggccttaaagcaaataagttaagtgaattccattccaaaattttcgaaaaattatttttatggacgaattatagatttttcaaaaaaaattccaaaaaatcgctcaaatttttttgaagtttttttttcttagaattttcttataaaaaaaatttctaacattttattcatgaaaatttatttctaacaataaatttgaaaaattgaaaaaaaaaattctcggtgggcagaggagaaacgaggcccgtcccatacgga

SEQ ID NO: 22544 - DNA, 1672 bp, Heterodera glycines
gcattcgcatcatcggcagtggcacgtgcccaagggcgatcgaagtgaaagggacggcatttctcgcagtccaatccggtggttgcgtgtttacagtcacaggaatatctgaacggatgggatggataaaaggcactgatcagaagaagagaaagaaagaatgtcgaacaaaaagtgtaacacgaaaagaatgttttttttttatttaaaaaaaaaaattatttttcttgctaatgatgcaattcaatgggttcttttcaccctcccccccccttccgttatttatttttcccaaattcctcctttctgatcagtcccccgcccccgctcaccgtcccattcggtcgatcacacatctgctggcgtgtccattgcatttgcaccgtccgcccactgccaactcggccattgcataaaaatacctttcccggactctgtcaggctccggcagttccaacaccgatccgttgtcccttcggattcgctcggccattttgtcggattcagccaatccatataattcggcctacaaactttgatcaatttcagtgtccgccactttacattgagaattgcctgatccatgctcagtctgttgaacaccacgcgaatgtcagtggccgtaacccaatcctaaaaaaaagaaattccaacaaaatggaaaaatgccgtgcctgaaggacgggcgactgttcgaattccatcgcagatggacgcccttcgagggttgcgaaagcgatgcgatcggaaagaggcgacaaaatgtgcgaatcggtgcaacgggcgacctcaatttgtaagagctgtctgtctaattgggtgtttcagctgatacggtcaatttgatcactttccttttgtctgatcactttaagttttgatcactctcatttggtctgatcactttgattttgtctgatctgtctcatccctcccacctgctcattctctttgcttattggcacttccttcgtcctttgatacactttttcacattcggtcgaataaaattgcatcggtgtccaagttcgacccctatttgccgatttgaaaatggccaatgaatcggccaaacggccgcaaaaatgcagcgatacataagtgatcttaatgacatcattaattacacaacgaaacttaggaaaattaatcacttcaaattttttgcccaatgacaaagtcaacgaaacattgtggggaaatgcggtggtcggttcgctgacccaacaagtcaaattgttggcattgttcagatcagtgagcagtgccgccggatgggccaattgggccaccgatgggtcgcacaattcgcacttttcccggagaaggccttcagcggagtttgccaacacacagaaactgaaacgaaagtcggggaaggcatgaaagaggaggagaaggaggaggaggagggcagattagacgatgatcagactgatcggaccaaatggaaaaaaccaaacgaagtgccaaattatgggagtccaatggccaacgttatggattatgcaaatacggcgaatggagccaattttgatgagaaattggagaacaatttgagggcccgtaccaaaagaacgaggtaagggtaaagttaccctcacaaatcagctgcgggtaacttttaacccgcactaaaagaatcgagtaactggtaagtttaccctcagct

SEQ ID NO: 22545 - DNA, 1936 bp, Heterodera glycines
aaaaatttccaaaatattatcaatattaaaaaaacaacaaaaaaatgatcaaggattcatctgataatttcgggaaatacctttcatatactcaatgttacggggatgtcggttaacataattgtgatcttcgttgttgggaaggtcggcgtaatagttttgaacttttgcaagaattcgggcattggcttcacggtattttttctttttttgaggcggctcaattcctttgataattttgagtaatcggcatctgtagtcttaaatgggaagtagttacaagggggccagggtcccacttttggcgctaaatttgaattcaaaaatttgaattcaaatttgggcttgctttttttctctgcctatagggctatttcgtttattggctcgtgcctattgagcggttttgggaggtcagaaggtgtgggacgtgtttggcgccaagtttagaatttaaaattttctttttttctctgtcagaaagactgtttcgtttttcgtcatacacctattgaatggttttgggtgatgtcagtggaaatgaggcgctttggcgccaaatttaaattcaaaattcctgaaagtgttgaaaattgaataatttatgttttaaaccaggccagcgaccgagttgcggcgccggtcgtggcgctaaatttgaattcaaaaattcgaatcaaatttgggcttgctttttctctgcctatagggctatttcgtttattggctcgtgcctattgagcggttttgggaggtcagaaggtgtgggacgtgtttggcgccaagtttagaatttaaaattttctttttttctctgtcagaaagactgtttcgtttttcgtcgtacacctattgaatggttttgggtgatgtcagtggaaatgaggcgctttggcgccaaatttaaattcaaaattcctgaaagtgttgaaaattgaataatttatgttttaaaatattgtactattatttttgtaaataacaaaattttttattctcctagaaacaggaaattttttaattgttttcagcttttgtatcggaatgggaaattttttttctacgggaattgctgaacgtaattttacaaaatttttaatttttctaatatttttctacctaaagctgacgttgaacagccgtttggaccagaccagcggccgagtgcgccggtcgtgtgtgtgtgtcgtcgtgtgatgacttgggcatggaatgaacgagtaaccatgctgctgctgttcattctgctcgtactgatgtgccagttcgttttttggaacatcaccatttgagatttttttgaatttttaaatgattcgatgctttcaatttgatattaaaaaacttttttcattctttattaattttattaagtgtttttcctcatttaaatatcgtgaatattttcttagcagctaatttattgtttgtttttgtcagtggccgcacttcgaagaggccgattgttttgcaggtttgattgggtttagatgaaaatgaagagaaatcagggcactaatttggtttaaacatccaatgatcattaatgaacatctcagttatcaggtcatttctattttagggaattgttattagcacatgtttaaacacttctaatgactcagctttcatttgatattgtgaatgttaatcacgtaagaaaaaagttatggtccgataactgagtatgatcattgtatgactcataaagtgcaattcgttttgaactgattaggaactaaattcgtaatctaaaacaaaaattataatttacatagtcatgtgtgctaatattggttgtatgatttacaccgaaatcacccatggcttcccctattatttagattgtcgtccaaaaaattgtgagcacggtttgctttcgtcattatcgtcgaccatttgaccgttgaccatcgctgctgcaacttttgtttgg

SEQ ID NO: 22546 - DNA, 2174 bp, Heterodera glycines
  misc_feature (2106)..(2107): n is a, c, g, or t
aaaaaaaatgtaatttttaatgcgatttgtttacaggtttttgtccaaaaatgaccaaaatttgcgattttgggctaattttttaagaaaaaagtgactttatgcaataaaatttcaaaaaattctcaatcatgagaaaaaaattacattttattcaagaaagattcctaataccatattaataataataataataaataataattctcaactatgagcaaaaaaattgacataatgccataatataatcaaaatatcgttgaaaattacaaagatttctcaaatttctttgaatttttttaaaacttttctaaatgttcattttcaaggacgtccttggcatccaaggacattttttatttgcaagaaagagggcccaatttcaaggacgtccttgccattcaaggacggatgggagccctgaaatatgttatgtttatgcggttatgacaattttgtgcatcgatgcttaaaatcggtttcaaaattttcatttttaaataacattaaataacatttaaattaatggaaattgtctttgacacaaatagaaaataaccaataaggtttaaataattgttgatattaaaaattccttaagaattaaagtatcgggtttaatcattcattatcaacccatttgattttgaataaaaataattctcaatcaataattaagaaatttaaaaaaaaaatttaacccaaaaatctaaaatttttttcttaatttgaggaaattatttttttgaaatgcatgtgcatttttcttatttcgttgtacatagcccaaaattagccaactgaaaataagagggggccagggatgggtcgaaatttctcgttttttaaatttacagagttttttcaccgccaataaactttcaaaacttaaatccaatcaaatttattatgaaaattggccagaaatttctttttttaaagagtgtaattagcttggcttttgatattttttttgtttttttttgaattttaattttcaattcttttttcgacccaccccaaataggcgtcactatctaaaaaacaacaaaataacttctaatatgagttaattaatgaaattcacattgataatatggaagagaaagagcagccaacagatgcaaaattacacattgaacgaaaacggaccttaattgaactagtatacatatttatggattagtgaataaatatgattttactaataattttttatttaattatcgaaccgtaagtttactaaattataaaatgtcccaaaatcttggtctttggcttccaaattgcaaaataaaaaatcatgacggctcaaattaaattaaattaaactaaagtaagttatttaaatttttcttagaccataaaatatgaaacatttaattctttgataacttttcagaaaaaaactaatataaatttattttctttaaaaattaaataaagcaaagatttctctattattcagttaaatttgattaaatccggttaagtcattgctttattattctgcaaataacattaaaagaataattaaattttaactattattatcattgatatttttttaccatcgatacttttaaggggatttgacctaacaccgtacaaacataaaatatccttgttttgtcttggctcccagctaagaaaaaagttatgctgatttaaggctaaacatcgctttattattctgcaaatagcattaaaatactttgttcgagttcgggttccggggttcaaaattggccgaaatggatacctgcattcttgttcaatgacctcgaaaacgcaaggaacttggttttatgacaataaactttccacggacgcatcatttcccgggcgcccttttttcccattgatactttttaggggatttgacctaacatcatacaaacaaacatacatatccattgtcttgttttggctaacaatttcatactggtacttttaccagatccatttggtccaagctacggaaataggtggaaagctccatgggacaatgcactgttcccaatgcaagtggatgggcatgatcccggtaagcagcacgttatatgttacgcttttcccttgtttaccttgtgcacgcatcatatnntgggtaggcatacatgaaagcatatttattttctcacttttttgtgaatttttgtgcgtaatgaatt

SEQ ID NO: 22547 - DNA, 1364 bp, Heterodera glycines
tgagaaaagttatgtgttgatttagtcaaaaatgttgcaaatttgcactttttgtgaagtggccaaccacgctttcgacctacccggggtccacacgatcgggcactccgttgcaaaagtcgtcgcggcagcattgaatattttcgcatttgatgaatttattgtcaaagtaggcaaggtcacaaactgagctgttgggttcacaacccattccaatgactcggatattgtcatctgaaaattttcctttttatatgcgcaaatacctaaattggaaatgtaaattaaatctcgcttccataaataaaagatggtttaaaaaaaaatttttttttgctgctcgagaccaaagaatttcccaaagctcgagactgaaatttataattaacaccgagaccaaaaataatccttgtttttttgtcgagaccgagacttttgagcagcacacaaataaatccagtaaaatctttttaaaagataaacatttaaaaaaaaactttttattaaagttttatgataaacttctatataatttataaaattttgtttaattcttggtcaaaatttgttacaaatgctattttttctccaccggcacttaatttttgaaaaaaaaaaataattaaatggtacatttcctcaggcagttagcctttgagcagaagacagtgccaggcttgcactggtgttctactttgccaaacacatcattgccaaaccaacacttcagtgctaaattagggtaattactgcataagagatttcaaaatgccattttttccaaaaaagaatctttattaaagctactaagaataagcatttaaaataaaaaaaacttaagttatagcaaaaaaaacaaattattttttgtaccgtttattttgccataattttccaaagattgtttttgtactaaagacacttacaatttgaacttttttcctaaaaaacgatttaatttctttttaaaatatgtatttataacaacaaaaaacacaagacggattattcctcaatccaatcaactctctgctgctgctaattactcactgtttgcagacatcgccaaacatgccaaaacaacaaccaaaaaaagtgacgatgaagccgacattttgattttaaaatgattaaagttggaaataatataaaataggaaaaaattaaaaatgcaataaataaaaataacatttttattgtttttgctttcactatacacaaaaagagcagcgctttagcctaacattagaataaattattcacttatttttataaaatgaatcaatcggttggggaaatcattgaaatgatgggacgtaacagaaggaatttagtaaattaattatgattcattcacactcatt

SEQ ID NO: 22548 - DNA, 1817 bp, Heterodera glycines
taaggaaacggttggtaaggaaacggttggtaaggaaacggtggtaaggaaacaacaccaacccatcattcgtttcatttatttgttttcgtctctctctttttcgaccttttctccctgacaatacctttccttctcattttttctctgtgacattttacaattccaaatcaaaattctttcaatgcttttttaaatttgtataattttctttttcagttcgcctatttttttttgttgtttgattaccaatctcaaaaaaatgtctgacaatccaaaggaagcggagaaacaaatggaaaaagcgatgtaataattcaaatttggattgtccatgctaattaatcattttgcttctttttcagctttatctctgccgactgttggctcaaagtgttcgatttgcttccacgctctcaacttggctgtggcattgcgatggttagccgccgttttgactgtttcgtcgacgaacacttcaaaacgcgcaaatggaaattgggcgacatgattattgaaggcaaaattggactgaatggcgcaaaaggaatgaaaattgtgcaaattgccaatctcggtggaaaagaattgccaatcccacaagttccgttgccgaacaaagtcatcggattcggacgcatttcgatcaagtaaaaaatgaatttaaaattttttaaatgttttgtgaccgtcaacacttgctaattacatttcagcttcatcgaccaaaatgtgctcactttccttcgccgttttgaccgctttttcgcttcatgtacaacaatctttgacatttacgttgaaaatgttcgcatttcggagttcgttctgcgcaacatttggccgatgctcaaggacaccgttctttatgtgcaaacggaggccatcgtttttcgtcaaatgcgtcaattgggcctgtcaacgctcaacgattatccatcacttcgaattttgtcgttgaccgagattttccccaaatttccgcccgacgacagtgccaatgcgtcggatggccaagtggtgaccaaatggctgttctcgcctcgtcccgacaatttgccgaaggtgttcacatgcattgtggattcgccggagatggcatcagtgggccaatggttggcaacaatggaacaaatcaaaacggtgattactcaatttaattcgtctttttcctttttatggtcaaattgaaattacctctttttatcattcgattactctcggtctgtaaagcacgaaaatgaaaacgaatttttggcggaaagcattttgtactttgttatgggcccggaatttactttttttttactcttttcaggcattttccatcgcttcttctcctgtcaatttcggcttctctgttttccttccgccgtccgatccgcctttgaccgttcagccctttgatctgactaacgaattgactggggagaaattgacattgttagaagaagacgacgatgctcttgtggtcctccgttgtccaacagcaagcgatgtgctcaaatggagaaagacggctcatcatggaatgaatgatcgacagaaccaatcggtctcgatgatcacaggagacgttttcgactaaaggagaacaacaattaatatgataaataaatcaatgttaattggttttttcagtaaagaagtgttgtgaattgatcgtttaaatggattgaggtggagaacactgatcagaatcagcaaaagcagcaatgaattgatgaatagaaatatgtgatctttgagtaggggtgtgttttgaggtttaagtgcagttgtattcgatttcctcatgaaaagagatgagataggat

SEQ ID NO: 22549 - DNA, 1441 bp, Heterodera glycines
  misc_feature (9)..(9): n is a, c, g, or t
  misc_feature (11)..(12): n is a, c, g, or t
gcatgcctngnncaggtcactccttaaaaatttcaaaaaaaaaaaattatacgaggaaatgcgaaattcctgttttattaatgaacatttattaattcgttaaaaatcctcacaaattgtgtacgaaaaaattcagaaaagttcaaaatatgtgcaaaattcaacaaacattttctggaatttgccaatttccgcatttttatgtgtattttcagtacgaggtgaactgcttcgccgagctggtcaaatacccgttcggctggtccgagcacactttgcccgccattatcaccggcattcgcagcaaattgccgcaacagagcgacgcgcagagaaaatttgtgagagagcgtttctttagggagggggggggggcaaaaataatttcaaaaaattcattaaaattcaaaaaaaaattaatttattacaatttccccctgtcccctacaaacgtgtacaaggggtggtcacgaccacccccccccccccctcgttcgtcgtaagggggttcgggtggtggggggggggggggtcgtcggcgaaggggaaaagaaggaaatttctgaaaaatttggcttttttctcaaaaatttgctagaaattttcaatttttcttccggcggcgcctatcggcaccgccggctcccgcgttcgcgaaatttttttgagaaaaccgcgccgcaaaaaaaatagattttaaaaagcaaaaaaaaaaaaaaggtcgtcaaaaattttggaccccgtcgtaaggaaaatcgcatatgaccaccccccttggcccgatcgtacgtcgtatgacccttggaagtgaccaccccttgtacacgtatgattcagtggattttatgaaaaattaagcgaaattttttgaaattttggtgaagtaagggctttgaggggtaccaataaggaaatcaaaagttcaattttcaccttttttttgccagaggctgtgcaaccgcgcactccgacaatcgatcaccacaattgctgaagtgtgcggctttgcagcaaccaacacggagctgtgctttgagcaaccaatgcgtgatgccgttgcattgttggcacaatcggcaagtttatagtgaaaaagaaaagtaaaatctatgtttttggaatgttgtgacgtcaaacagcagagagcaccctcccctaaaaaacttttcttacaattagatgactcacaattagaaaaatttttacgaattttaaaactaaaaaaattacattttttaattagtctagggaaggcggggcggccgagtgcactacgtttgacccaccgccgtacgtccccccggcgggtgggggtcaaatgggcaccgctcaattgggccccaggcggggtttttggatataactcctttcataattgacctaattgaatgaattaaaattctttaaatagccctaaatgttctctatttgcctgccaaat

SEQ ID NO: 22550 - DNA, 1121 bp, Heterodera glycines
aaaagcccaaacacttttcggtggtgccattttcgttttttcgtcgtatttattttggcacatattttccacggaagtgcctttatgtgcactttgccattgctaagtcggcactttccctcgtcccttcgcgcaaatcgagaaaatttcgtaatttccaacgcgagagtccctgcgtttcccttgggggtattattccacgtggaaatccgtgcatggcttggaaatgccaccggagataaaagcccaggcaaatgaaactgacaaatgccgacagattcctctgatgttaaaacgccataaggaactgcgaaaattttttttttttaaactttttaaaaattatgaatagagcgttcaattatatgcacaggcattttcttcatgaactgtgaaaggcatatgaaacgtagcttgttaggaagattctaggacgttttccatatgcatatttcgcgatttatgtgcgttttggtgcttatttgggcattttccaacaacaaaaaaaatattttaaaacgcccccttattaaagcggcctttttgaccaaggtttggatgaattatcgataaaattaaattaaattcttccatatttaccaatattttgcgtaaattcctcatatgtgatgagagggaaacgaattttgaaaagtgccgggccaagcgcagaacgacgattctcagcggaacattcgatggctttttgacggcatttttcgtcggcccaacggagtgccttaaatgagtcaaatgatttgaacaataattcttattcgattttgaaatattaattatcacgctattccaaattgtgagctcgtcgctgattctcaattgatcactttcgagtatttcacacaacatattctgatcaatttgtgcaaattcctccgattgcaaaaaaaatttcgcgtttcggtcaatgaaatccaagcagcgaagagcaaaatccttaaaggcaattaaaaaaaattaaattaggattaaattcatttacaaaaaaaattcttcaaaatcagtgccaaaactttacatgttcactgagaaaacgagcatggtcaatggcaaggaaaacattggggcattgaccaattggaataatcccagcaagctttgat

SEQ ID NO: 22551 - DNA, 870 bp, Heterodera glycines
  misc_feature (6)..(7): n is a, c, g, or t
  misc_feature (19)..(19): n is a, c, g, or t
ctgcannggtctgcacaanggattacattctcttcaatctaaggggtaagggttgcgaaatattgccaaaataaaccccaaaagatatttatctagcaaatattattagcattaagttgatgccaaatgtattgcattagttagcgaacttctttaaactgaggaagggaaggccattcctcgcgcggtacttccactgcaagtgctggtaaaacggcactttcttcggctccgtccgtcgaagttttttgctgctgctgcttttcttgagcttctccagccgacgaattagcatttgattcagacattttgttaaactttttctttgaccgacccattttttctaaattcaaacagataaaatgcttatttaagtattgcatctttgttttcaaatattatacgtaaatagcaaaatttaatttaaattaacaacaaacagaggtaactacaacgaagcctctagagaccggagggaacgggattaccgcgggaaaaacgggaaccccgttttttttttgcccgagaattgatgaagtgggtttttaagtgaaatttatgatgcaactttgggaaaatgtttatgtttttagttttttatacataaattataattaggacattgaattatatgggatcgacgccaaccccccacattggccccggcacggttgggccccagcatgtttttagactataacttttttctttgtcaaccaaatccaacaatcttggtatcattcgagagcttttcagatgctctaatagcctgccaaattccaaaaaatttcgtcaattttgaacaaatttatgggcaataaagttggaaaatttggttttttgtattcttcaggccctaacttttttaac

SEQ ID NO: 22552 - DNA, 973 bp, Heterodera glycines
  misc_feature (946)..(946): n is a, c, g, or t
ttattttcatgttctgatttttaaaattattcatcaaaatatcgctttggcttaattttgttacttttaaaaataaatttaccgttatcatttattagtatatacttacctaacagtttaaagtaccattaattttttagccttgcgaaaatggaaaatgctgaaattaaatctcaacgaaaaaataaaaaaactcgaacatgaaggctgcctgtatgtcttccatttgttgaacgccgatggtgacgtaaaattttggcgctgtgaacatcagcacggcgaattcaaatgtcgagggcgcattcacacaacgaattcaacgccctaattataatacagtttggcttaagggcaatggtgtggaattgggtgatgtgacatttgcgccgcagacacttgcgccgcccagccaaagtgacacttgcgccgccgacacttgcgccgcagacacttgcgccgcccagccaaagtgacacttgcgccgcgacagttgcgccgcagacacttgcgccgcccagccaaagtgacacttgcgccgccgacacttgcgccgcgacacttgcgccgcagacacttgcgccgccccccccccctattttgacataagcgaaacaaacatatactaatttttaacaacgcaacaaaattaatattttcaacaatattctaatcccatccttcgaatcccttcatccccacacggtattgcaatgcatgaatatgtcggatcaaatcatcgtcatttttttcttctttcgcgtcataagcaattaccaattgcctaatagctgagtcattttcgatgtattttttaagacgtggtcgatcggcaatgccccttgtctgatcaatttcgaaaagccgaacacgattgttttgatattcctcttcatctttcattgcctttatgaatctgacataataattttaagtgggattttccganaaatttatctaattaagtttaatataa

SEQ ID NO: 22553 - DNA, 1490 bp, Heterodera glycines
cgacataaaacaataaatattattttaatatatatttaattaattaaacggagcaaaaagatggggagtaaacaggggtggcatcgaaaaatttccgaaatcaaaacttcagacatttttaacaattttggagaggaaataaacatatcgaacacaattcttttttttttactttcaccgcgcattttgcggagcattttttcaaaaaaacttttgggtaacattaggggagggttgtccggcgatgccgataggcgccgcggcaaaaatcttgttgtatatttttttaaacagattttgtccaaaaagtgtccaaatgttgcttttctgagtaaaattttgatgaaatataagagttttgtggtccgacgtgctgtaaggcgccgctgggagaaatttcgttcaaattttaacacgttgttgtcgaaaaattgaccaaattttgcgattttgaggaaagttttggggaatcgatgccgggaaattttgctctatttgttacaaatttcataaaaaattgcactaatgcaaaaataaataaataaaaaatatttatggaaatatttttagtttcttttggcgaaaagtgtaatatcttgaagaaaaccgtcggtaattcccagcgaaatgccatggtacccccggtgttcggttcggcctgttttcgagccgctgcttttcgattttggtttcagttcaatgtgaacaaccctagtttttattaaattatttcattttcacaataatttacctaaaaaaattattttttataagataattcgctttcggataaccgccattttggaattttttttcaaaaatatgaccaaaattttctgaattgctcacttttcattagttttaaattacctaaaaaggcatattcccccccccccccccgacgcataacttttgcaaatcgtattgtaaacaaaaaattggaggaacaaaaaaaatctccaaattagcccagcccatctgattaaacgggcctgggcttccagccagatttggcttactcaaacgcgtctgcgagtttgaccgtgatcgatgtcgtccctgcctcgccttcccctttctttcccttgatcgatctcgtcttggcggcatgcgtccttcaggtgattctggctgaatttctcgtgccgctactcttctgccattttcgatgtcttctccttgctgattttcgggcgaacaatctttacaatatttcccgatagcccaaatagccaaaatgcaaaaaaagccgccaacaattagcacgccaactgtgcttcccactgatcgcttcttccggcgtctttgtcgttggttttctgtatgaaaattgaatgaatgcaaaaactattcaccatctcaaagtttttaaaaacgaataaaacttcgttgaatttttgttttttatcgttttaaatataattaaaaattcagttgataataaaattaggaaaaatcactaaaacagtatctgtcatgacggggacaaa

SEQ ID NO: 22554 - DNA, 1012 bp, Heterodera glycines
aaactcattatcagctgaaagtatgcgcttgtttcgttgttgatgttcgcgtttttcatgagcaaaaaacaaattatttttgaataaaaacacaattttaatgttaacaaaaaagaattacaattttgctccccattttccctaaatttgtgccaaaatttggtcaactcttcgagcatgcttttctgatcaatttgttgtccatctgccggtggcataatttcatttgttgagatttgcaaacgatttgccgtaccaattgcaatttctttaatcaaacttattaaattttgaatttttgcattttggtccaaagaatctaaataaataaataaataaattatttttttaaatacaccttcattaattgaagcacttaattcgttgactgatttgtgcaattttcttattaaatcagccataggtttgtcgagttggtcaatccatttcaaaatttcaaatttatccattagagttggcttcaccgaagaatctgatttttttattattagatatacaaaaaatttaactttttaccattttttccttttttatcaaactttgtcaacgtgatctttccaatcccattgacaatttcttcgatatttgaattggattttgacaaattatttatctagaatgatgattattggtttgcattttttcaattttcttccagccatcgcgaaattttgatcccggacttttgtatccccaaaagttgggtagcaaccctaatttgaactatacatattgtaaaaaaagtggtcaattttagcccaaaaatcttctctgatcacctttgtctggtcacttttgtacagtatcgcttcaatcacactgtaatcgattgcctggctctgatccacaaacagtactttgcctaccatgttgtaatgatccaacagatctcgcacaaactgtttaatttccgtatcatcattctttccgatttctttaggtgggtttttcattatggttttacggtttgaaagccaatttgtttccctcc

SEQ ID NO: 22555 - DNA, 1666 bp, Heterodera glycines
ttacataaaatcttagaaccatatttctccacttaaatgaatagcaatctaatcaataaatttagtaaccaaagttgaataaagcagtacagaaaataaatatgttttaatgaacgaaaataaaatggaaaagcagaaaagattggaaactgtggatgagaatataaaagaatttttaaaaaaaattaaacttctgcaacaaagaatttttactacatcggtgccgtaaaaaattttattaagaaaataatatacaggatatttaattaagttattttatacataatttctaaaaattaacaaaattggtatctgtttgagctcacaaatttacatatatcatttatagaaaataaatattttttcttgctttaaattttatcataatatttaaatgaagaaaattaatatgaatctatttgaagaaaagcataaaattttaataaaaggacagtatacaaattattatttttgatttaaatttatgatttcttaattgaaactcgttaatttaaaagatgctacattttattgcttgaatatgctcagaaaatgtaaataaaattaaatgtatatgataaaaaatgcaagacaaatggcattcacaattcatggtactaaaaatgtacgtaatattaaataaaattaaaaacgacagttttagtttcaataataataaaatataaaacataaagtgaatcaattttaaactgaccaaaatttaaaaggatttttggaattttattattaaatctttgctatttaaatataataaaaaaacaaaagcaatgattttacaaataaaacatactaacaaaactagctgcaccgaacactaataactgacaattttttattagttttttgagtttaaagtaaatgtatttcataaaaaaataaaatttattaaattgacttatattttataaatgcaaatcacaatcaattcttaaatttgcggaattcaatagaaatattattgctttaatttttatttatataaaatatgtactaattataattatcatttattttctttaaataattgtaaaataggtttatttatgtatatttcatctattttgcccttttctcacgtgtatgcgagtcgaatcgtattatagggtaataaataattaatatttgttttttatttaaatttcacttaatttcctatttcctatttttagttttattttttatctattttaagaaggtatgttttaaaataaaattaaaataaaatagttaataaatccacaaattattctttcattttattataaattttaaaaagaatcctttttagtttattttcttatatatttaataatacaattattatgttgaaatttgtattatttataatcttctgctgatttctgacttttttacaattgtattgtatcagaaatattaaaaaattaatttttaaatagctaggatttaggtttttacatgtttttagccaattatatttcaggctattattattatgattatcatgaaaatgaaaatatcgattttttttagacaatttactaataattattcgaaattttcaattttactagcacaaatttttttgatttactcattattaaatattaatcttattgttttgaaatggaatttattatgcattaaattattggcaattagtaaa

SEQ ID NO: 22556 - DNA, 1598 bp, Heterodera glycines
  misc_feature (37)..(37): n is a, c, g, or t
  misc_feature (88)..(88): n is a, c, g, or t
  misc_feature (179)..(179): n is a, c, g, or t
  misc_feature (188)..(188): n is a, c, g, or t
aaaaatttcgtctttgaatttttttgcaattgttggnccagtgtttggtcaaaatgcaaaaaacccacaaattcatctttagcatatngtacttcatggagaatgcccactttaaaatcagataagcatcttttgaatcgtcgttttggctaagcacttggaaataggcaattccgccnacacatttnacaaatgtcaaattgaacactgtccttttctgcttgtctgagtaattagtcaataatatcgttgacggatttcgtagaattgtgtctgaaagtgtatttatatccaaaaaaacaaatccaaaaaaataataattttttttgctggtaaatttcactaaaatatattttttattttacattttgcattgaactgacccatttttacagtcttcttgtattccacataaagatcatccataaatttggcaaacgtttgtacattgttggccaaattaggctctgatttccaagtgtaagatgaagccgtacaaatggaaacaccgaataaaatcagaacaattagaaaattgaaatttggttgcatttttctaaattttaattaaaaaatgatattttgcttgcgttttttttctaaattcttttattaataatctacatatgttgggacaggatttttaagcaccaaaaaggtgaattaagcacttaattatctatatcaaaaattccaaaattaagcactaaacaaaaaaagaaaaaaattttacacaaaatatagccaaaaccctaaaaatatgcgctaaaaatcttcaaaaacatcaaaaaaaattgtttttgcttgaaaaatctgcaaaaaaatttaaaagctttaaagacttctcctgattacatttgaaacttttagctgcacctcttaaaaaatttctaagttattagcttgattttgaataggttctatgctacatacattttaagaattgcttaagaaatgtatttggctttatgcaaataattttttagaatgatggcttctgcttgtgccatggcccatattaatgccgtccatcagtcattgtttggcattgtgtgcacgtgcgttattatgccatagaaagaagcccttggcaaacgaatgatgaatgaatactacacattaatgcttaaaaataaaatcactctttttcttttcctgccttatatttcgcatattaaaattctctgtttcttttcctgccttatatttcgcatattaaaattttctgtttcttttcctgccttatatttcgcatattaaaattttctgtttcttttgccttatatttcgaaccttaaaatactctttttcttttcttgccttatatttcccatcctttgtgtgcaattctttttttgtcacatcatttctttattaattctttccatgccatgtgcaatacaaaattatatgcactttcataataatttattatatgcaattgacataatatttttttattattattgattaatttaattttaatttaaatttaattaatttattacaaaaaaaaatacaaagtcagtgattgtctataaaacgtaataattgcttttattattttaaaaaatatttttttaatttttcataatttt

SEQ ID NO: 22557 - DNA, 2018 bp, Heterodera glycines
caacaacaaaaacaacagcatcgggagaatatattttgtttggtattgtatatgtaggtgtgtatatatgcggaaaaatggtcgggtgtgggggatggggggggggggtaaggtaaataaaagcatcaaaattaaaaaaaaaagaagcaacaacattacccattagggcgaatgaatgaatgaatgaatagttagttaatttaaatttttgagcccctcattttcccatgattccataaaaatgaattcgatcattaaatcactttggcattggcattctgttggtggtactgtccaccgttctcttcctcattttgctgcacaaatttgtacgcccggtacacaattgagtaaagccaaattgagacaattacggccagaaagtaagtcgacaacaaataataaaagccaaatgcatgaaatcctacaaaatttttcgggtttaaatatttaaatcacaaaaaaaaaataattaccttaatatttcataattagtttataaaatatcataattaggtgcgattcatcagaattttttgataatttattttagaaacattcccatcaaaatgttttcttggaaaaacattaaagacttcattataacaattaatggtcaatttcaaacattaccggtttctgtgaaaaatgttattgtagcaattattccgacaatcgctgttatgacctaaaattcacgaaattaaatattttattttattttaaaaaatatattgccaaaacatacggtttaatgaccagaaattattgccagaaaaaacatacggtagcgatcagaaatggtcgatacattttgctggttctttgcccgcgcatttcgccaacaattatcggaaaacttccgcacataagcaaaatacccttaaaagaaagggataaatgaaatatttgaaaaaacaaatttaattaattaattttttctgacggattttggtgcaaaaattgcaaaaaacggttacacctaaaaaatagattgttgaaaagtgccaaaattggtgccaaaattaaattaacggcatttctgtgccgaacattttgctttttatataatttcgaggaaaaaattttaacgattttttgtttaagaaaattattttcttaaaatttttttgtcatttacaaaaatggtaaaaaataaataataattaccgaaatcatattaataaagtggactatggaaatgcgataaaaaaataaatttatggcagatagaaagccaaaaaagccggccaacaaataaatccacgcgacgacaagtgagccctgacagataaaataaatttaagcaaattttaatgaggcaataattaattaatcaattagacaatgagccatgacaaataatttaatcaaatttcatgaggcattaattaggcattaactaatttagtttatcagtgattaattaatcaattcgagattaatcaattattaaattacttaagcttaattattaattcattatttagtgaacactgttttaatgattaattaattaattaggcccacagttgtcacgtgaaagccgcacaaacacatccatttgcttgagcagctataacagcacaggttcatgcgtacaacaaaaattactgtaaatctgataattaactgtataatttgagttaatataggaaaaaaaattgaggcattttttcagctttaatttttattaattgacacgaaatcgtcaagataatttaaaaatgaaaaatttaaaaatttgcatttcggtcaaataattgatttgctaattgcacaatttatgtaattaaatgtttcgtcgttaattgctgtccaaattgttttgttcaacacattatttaagcgccaaatatggccttatcaccaccattaacacatatgacactaattaggccattaattggttgacgattaactgataaattttgaaaaaattacattaaattttatgagtttggcaaaatcaacaatttgctggaaaatgaagcaaatgaatatttaaggcaaaagct

SEQ ID NO: 22558 - DNA, 1517 bp, Heterodera glycines
gtagagtcatggtcaaaaagtagggatactttgcttcattattaaatatttgttttggtaaaaatattatattgaatttaatagcattttaatgacttttaaatggaccaattattaaaaatatgcaaaatcatagatagtaaatgagaaaagaagggaaaaattaaaataaaaagatgcattttcaaaataaaatcaattgcttttaattaaaaaataagaattttttaattttaaatttttaaatttataatttttaaaataatttaataatgaataattaaattaaaaaatgttggaggctagctattttgatgcttatgcttaggctttcattttatatttgttttgctagaagcactatattaaatagtaaacataaagtgccccaaatatattttgtagcattttaagggcttttaaaatgggccaattatttaaaaacaactgttttaacctcctttattgaggcagcaataattgttttaggcttaattctgaaataattaaaatgtgatttaaataactgcaatgcatttttgaccactcaaaaaatgttaaaaagatccttgttaataatttgtatgctgtcatttatgtatgttgttgtcatcatttaagaaatgaatggttaaataaattcatttatttcatttctatttgaaaaatataattttcttttttaaatacaataaaaatgtaaatttgtctttgtaatttctgtttttctatttgattactctaattgatcaaattttatccgacaaaaatttacattcttaatttttggcccttgaagtcgggtgaaaatttgattaaaatagtccaaatcggtttatttaaagctgaaaaaatggataaaaattccatgaattttagttttattttttcaaaattctaaaaattcaaaaattaggcccgaatctttttgtgcgccggaaattcaaataaaaatagaaaattcataactccgtttaagcgtttttctataggccatttttattttgaaaattttcattttaggttaaaaaataaatttgtcccattgaaaagaaattgaatttttaaatatttcaatcatccttcatttcttccccaaattgttccttccaatttcaaatattctttctagcaatttttagtatttcagcaatttttccgttcgctcatttttggatttaccatttttattgccaataaattttcatttttttcattttttttcttttcaagtaaaacatttacccattccaaatagtttcttccatttgttaattctatcataacttacagcaatttttatacaaattttttatatatttttgccattctttttttgagtattttcttcctttttgcttaattttctcttttattttataatatttttcaattatttctcttttttcttcttctttttcttaccacttttctccaaatatttcatcaaatgacttttgttgtagttttttattttctgttttaattggaataattagggtaattaaaagtaaaat

SEQ ID NO: 22559 - DNA, 1523 bp, Heterodera glycines
aaagaaacaaatatatttaaatgtcaaaaaccagagattccatcaaatacccatttttcgaagataaatgtgttccaaaaaccagtgcgaaattgtcgatttgacataaaaatgttatacactaaaattaggataactgcactaagccatttgtttaaacccgaaaacgaaatatttttagcccttttagaacttttccaaaaaaagaacttttttacagcatatttcgtacagaccccaaaaaggaaattttttattctaccttttacaattaaatattaggcattaacgttgcataatttgaaggtcatatattttttattgaaaatttaaaattcagaaggaataattaatttattaaaacattttctgtgggtgatgtgccccccaacgacgaaaaagaaaaaatattttgttccacttaatgttattcctagggtctcaaattcggtactttttgttaatataatttaggcctagaagactatggtgggccttcagttctcaagcggcacacaatgggggctgaagatgtcgttggggcgggctttttgggcggactgccttttttcacgctaaacagagaaccctttcgtaatattccccctcccccattaaatttttatttttattttaaggcattgacgaagtgtttttaaatgataacagctttgtctttccgacgtttcgatgatcggcgaaaaaactactgcgatcgttaataccggaccaatattcttgtttaatgttaaaacattatttatgccgttaaccaaataggcccgtaaaaacttttagaaggagcataaagaaaaattttagtaattgttttcaaaatttacaactcaagaagaaaaaatagtaatacgattaaaaaatagttaactgttgaattttttctttcggagagagtgttgaggaaaattccctccctttggtaactggtataaaccaaatattttttattgtttgttgttgttgaataaataatgttgaatttgaccagttttccctttttaaccaaatttggtaaaatgaaaaaaaaatgtggaaaataaatgtttgtgttttatttaacaacagttcaatccaaaataaattaggatttatatattttcgataaatttttgtaatccgttaattgccttccgctttattcgttcttcagtacccgatacgaaagaaatgtcaagcttctttatttttgtggttttgaggccatatttttgacgaactaaagaatttgaaacacaatcattttaatggttttcgtcccgatttgtatctaccttggacatatttcggacaggtttcgacgatcttagccaaatggtgcgcaattggtcgatttaacattgagttcgaagattgcttccactgtaaccatttctgggaatggtttactttggtcatggtttcgcattcctcgattggacccactcttcaaatccgggccaacctaagatttcccttttttttacatttttttagtaaattatgaaaaaaatattttgttgattttt

SEQ ID NO: 22560 - DNA, 1439 bp, Heterodera glycines
gtttttttcccggttttcccagccaaaaattcccggggtttcaacccgaaaaggtcccggtcccgggtttgcccaaaaattccggttccggggcactcttataggttagaataaaaattttagcagtaatttgtaatttttgtttagtttctccaccgatttggcctccctttacccgacgatggccgaacttcgcgtcatcaaaactgaattagagttggctgtgcttcgttatgcctcaaaaattgctaacgaagcgcacaaagaagtgaattatttgtagtaaaagggattattcgggttttctttctaatctctgccgaattaattttcggcttttttcggttcgtccccaaattctgactaaaaattatgctgggaaatgccgttaaactgcccccatttggcaggtgatgcgacacgttcggcctgagatgtacgagtaccaattggaaaggtgcgcatttggtgcaattaaattctcgctttttggttggatttgtaatttccaaaaatcctcccttaaaaaggtctcatctatcaaacctgtccctttgtaaaactaacaacaaaagtggccaaaaatggcacaaatttcgtgtctctttcggcaattatttttattttttgctcttttttttgggcctctgtttccgaagtttctccccaaaaatgccggaaaaggacccctccaaaattttgtcgaattctgtgccttttcagtctgttccgccacatttcctattacaccggcgggtgccgtcacttgggttacacgtgcatcgccgcgtcgggcgaaaatgcggccgttctccattatggccattgcgctgcgcccaacgacaaagtgataagggacggcgacatttgtctgttcgacatgggcccggaatacaattgctacagtgagaggggaggggggggggaattcgaacaatcagaaggggaggggggggatgttcgaaattcatttttaataggatcaaatggggcaatctgattacccttgggagagttttcaatcttttctcccccttttgctagtatccgacgtcacctgctcattcccggccaatggaaagttcaccgaaaaacagaaaatcgtttacaacgccgttttgcgtgccaatcggactgtgcttggcgcggcaaagcctggtccgtttgttttgtttactttttaaaagtcgaaaatattaaatgttttttcttttttggtgtccgatggactgaaatgcatttgttggccgagaaagtcattttggaggatttgcttcgtgccggcattctccggggcgacgttgacgaaatgttgggaaagcgaatgggcgctgtttttatgccgcatggccttggccattttatggtgggcgaatattataaatttctaaataaacataaaaggaattctaagggttgggtgggattgtccttttaaa

SEQ ID NO: 22561 - DNA, 2148 bp, Heterodera glycines
  misc_feature (2026)..(2026): n is a, c, g, or t
  misc_feature (2091)..(2091): n is a, c, g, or t
aaaaaaaattttgggggttttgtcagtaattcgctcctcaattaaaattaaaaataaataaaatcatttaaaattgtcaaaggaaattcttttccggaataataaatgcccccaaacttaaattgttagcttaagagattaaattgtggacaattgaccacctaaaatctctgagttggtcggtcggtctgtttgagtgttgtgaatgtccaaaattgtttgctcaacatcaaaacaattttctcgacaatgtgggtgaagttttatagtcaatctgggagagatattgaaaaaatatataaaaattaattttcaatttgaaaaattcgaagttattacaatttaatattaaaaaaaaattattttataaatttattaatcaactaatgcaaaggaggtcaataaaataattgaagtattgctttctcaaatcaaagtagaaccttgaaattttaaaaatatttaaattataaacagaaaaaataaataaatttatgaaattttttctcgagaatttgtttaaacattaaatttcttaaagatcttcaaatttgggtcaattatgcaacaaaaaatggagattgagagcaacgatttttctggcatttttaattaaaaaattgataaaatgatttttaattatctatattcaaccatcatatagatttttttttgtttctaaaatgtaataaagttgcttgcactaattggaaagatttattttcatatttaaattttattgaaaaacaatttagataaatctttcaaaattcaattcgaacaattttgcattatcatctccggaacaattcttaattatcgtcaattatgccaccttcacgtgaagtgtgaactcgcactgaaactttctttttagggtcgtcgtcatttttctcatcttttttcacttaaaatttttatttatttaaaatactttttagataaatttaatttttattttttaaattaatttgaaatttactgaatttatcgtcatttttctcatcttttttcactttaaatttttatttatttaaaatactttttaaataaatttaatttttagtttttaaattaattcataatttactgaatttaccatattcatcttgaacatatttgcggtggtggtgtggtgttttaactttaagcagcaaatgctttttgagtccatgttttccgtctctttctaaaattaaaattaattcaattaaattaaattaaattgcaaaatttaatgtttttaccacggtacaattccatcaatcggtgacctctcactttaagcaatacgtgcttctttctgccgttcacttctgaaataggttacacactcacaagttgtcaatcatatttattcaaatttatattttttttaataatttatatttttttaaaatttaaattttaaatgcaatttaaatgttttaactaaaatgaatttaccatgttggaccaagacaaatttgtgtcgtttgtgtccatttttttcttccgaagatgctgatgatgaggaagaggcggttgatttttcgttgtacactttttcacctaaaaaaattaattttttaattccgaaaatcataattaatatttctaattactttttgcggtcgtggcttcatctcgttcgacattattatggtgatgcttaacattcacaacaacattacgatgatcttcatcaacaccagatgatgaagccgttttttgaggatcattattgacttgaacatctgaaattaataattttacaaataaattttataattaaaaacagaaaatgcaaaatttttgaaatatgaattttaccaatttttgattccgcttgcaaaaaatgtgcagatgccaaaatcagcagcagcagttggcacggacgacttgcaagcatttttttatcttagtagaagtatatttaaatttaatttaaaaaataattatttaattctcttttatactgatgggaaatcacataggtaattgggattaattatttaaatcttattttatgaagaaacactactanattaacacattagagattgaatggtaatcgcaagaaacgattagagtaattaactaattaattanattttttaaccgaaggcataagtggtgatgaaaatgttaactaattgctttatatga

SEQ ID NO: 22562 - DNA, 1335 bp, Heterodera glycines
  misc_feature (823)..(823): n is a, c, g, or t
cattattattcacttacggggtaaatgttagcgtttttgatcaaaaagcgtctttcaggctttaatttgaggtattcgccacgaaaaggcacaatttttggtaattttgggcagccggagagacgcgcgactctatcggagaagagaccggcgcaagtgatcagaaatttggagtcgatgatctgacgatgaaattaaagggagctcgaaaaacgaggaattcacttgggcgccgttgggggcaccgatcagtcgcaagggatgggcggagtcatccgaagggccaatgccctcgagggaccaatcgcaaaagacagtcccacccattctctggaagtctcttaaagacaccaatcagtaaatggcgaagtgatcgaagcaaactcggcgaattttctggtgaccatcgtccaatcaacaattcccgtgtacggcgaccaaattgcctttcgacccttagatgccaaattgttccaaatttggccaaattggcattactaacgcgacagtgcggctcaatttgacggatgccgtcctcgccaatcatttcgatgcttttgcattggttttgtttggcacggtcgaacaatgcctttggcaattaatttgcttaaaattcttcttctcctccctttttcccacttccaaacggcgaatttccgcctcgtcaagggccacaatgagtttcccacattttttgtgggcgatttcattgtcctccaagtatttgtaggccaaatcgatccctcaaaaaagtaaaaaatcgcactgaaaaagtcggaacgaaccgctgacgcaaagtttggccttcaaactgcccggngcataataaattcctaagttttaagttcaaaagtttgacgctttgtgttactaccggcatgaagcactccgctgttatggccactctgatgggaagctgaaattggcattggtaaagcaaaaaatgggggaggggggacggacggaccgaggcgactctctttctccagaagaacgacgctcagattgggcttgacaattttgagctgacgggctgaaattgtctacggactttttggggaaaacagagaaaagcgaagccaaaggaaacgaattgcaaaccgacggcacagccgacaattccgccaccgacgatggcaacgtcaaacaatcggcggatggcactccgatgcatttaaattcttccaaaatttaaaaatattttattttgcagaatttacataatattttgaccagacagacattcgaacagaaacccattcaaaggtattaaaaatgaactcaaacaaatgactgaaaatcattcatttgccatcgcttcggtcactttct

SEQ ID NO: 22563 - DNA, 1007 bp, Heterodera glycines
ttttttcaattcttaaatagcgtgaaatgcgtaccatctggtaaaaaacaaattctgtataaaaatacaaaaaaaaaatttcaaaaaaaagtgaaaaaattttcaagagggctctttgcaactagcgcctattattccgtcaaaatttaatattttttaaactaaatttaggcattttttggcatcgttctgccccgccattttcatcctcccattttccccattggcataccttttcaaaatgcaaatggccaatttcccccaaatgatccgccaatttgttcagtcgattcgtcaaagtgctcattttttcgattttttgcaggtcgaatttcgcttcgacactttcgtaagtctgtaactttttcctttcttttttccttttctttttctaactttgtgattcgttctgagtaatccttcgaactctttgaagcgtttgttgtggacaaaagcttcttcaaaagagtgaatctcagcccggacgaattgcgaatgagagaagagatgggacgaaggcaaaggaattgtccgctcaatttcatcgattgacatcgaattgaattgaaaggatggaaaagggaaaacgatgacagctgaaagaaaacgatgaataatgaacgaaaaatattttcataaattccttttaaattttaaaatttagaaactaaaatttgaaaaattaaatttaaaaaaatgttaaaagtaatcaacaaaaagagaaaatttaatcatttgaaattacgactaatgacaataataaatctacgcgttcagttcggccgtcacgatttggccccagcatgcttttccactataacttttttctttgtcagccaaatcaaacattgttggtatcattcgaagctcttcacatgctctattagcctttacaaaaagcgaaaagattttcaagcctggaaaaaattttattaacaaaaacttcaaaatttcgagttttttcgcaaatttcatgtataacttttttgttaattgtctaatcgcaa

SEQ ID NO: 22564 - DNA, 1878 bp, Heterodera glycines
  misc_feature (1826)..(1827): n is a, c, g, or t
  misc_feature (1841)..(1841): n is a, c, g, or t
  misc_feature (1853)..(1853): n is a, c, g, or t
atatatttaaataaataatccaaaatcaatgtaaatttctttcctaacgatcttttattaaatttgataaacaaaagaattataagttaaactttcgtgatattccataaaaatctaatggaatttatttaaaacatttatttttttaatttaattatttccattaaggcttaaaatttctatatgttttatattttcaaaaagaaattatcttgcacagactcctttatttttttacattttgcagaaatgaatttgaattttatcaaagaaattatttttattgtattaacattatcatttttaaaaaatttaagccgctttatttactttttttttaaaagttttatttcatacaaaacatatttaattttcctttaaatgttttacagtaaagcttaaataaattatttgatgttggtaaactatgctaataaatcatttaattaatttttttataattccaagcaataaggactcaaaccgttccaggattctactgagctgtgacgttccttctgttgcgatttcaaattttcttattcctttaaaattaattatatttatttgtattcatctcccatttattaaagaataactgattattttattattcaaaaagtttcttttactacaaaatacatttattaatcttctttaaatgtgtaaattaacaagtgaattatgtgaaactttttaaaataatatctttaaattaataaaattttgttttatattttttacttgtttttaaatatattgatttttttatattgcattagaaattcattgtaatatcatttatttggtaaaaacttttctttttttaatttaaattacttttaatttatttagaatatttttataaatttaattccatagtgattttatttaaaactaatttttatttatttaaataaaatttataattcttttacttattatccattccatatataatcatattcatttatttatttctactaatatttactaatatttgttttttaatttagcttatttgttagaaataattgcccgaaatagtgacaaaaatataacttttttaattcaaaaaatcgaaaattaaaataatggcttagttttgcattttttactgccataatcaaataaacttttgcaaaattcggaaattttccatttttggcttatttttcgcacaaaggtccatttttttcatcgacatttttgttaatcattttatcgtgaaaacacccaaaataatttgtttttgaaaaattttggatccttcgagtgcaaaacttcaaaacaagctaaaaacatctttttggtggttttttcaaaattttgcaacggtattgacgcgttttgtaacattcgaatcacttgtacggcttctattttttccattagcgttttaaagagtgactattggatttcaaccgaaatatttaaattatttataaaaaatgtcaaaataggcaatatttttttttgtacttttactcgtcaatcgaaggaacatgtcaaaataatgaaggttaaaaaataccaggaatatgttggttataaaatttattccataaaatatcaatgtataattgctattatttaaattgtaattaattttgcgatgggttgcgaaaaatattgattttaactataattatgttttttaaataacgcccattttgatggttaaaatattattgtgtaattatttattaatttttaaatattcataaattgataaatacggagggtcaaaggtggagatgataaagaacaaaatacaagcaaaaaaaaggtaaaatttttgatgaaaatcattgaataattttttnnaagcaatatgcttnttaatagatcanaaaattttgagtcaccttttacttg

SEQ ID NO: 22565 - DNA, 1772 bp, Heterodera glycines
cgtccatatcctcgggcaaaaagtgccgttgctcatatgccgcggttgtcggttcgtcctcgtcgctgtgccgttttgtcgcattttgacgacgttggcggctctcctgctgcagagtggacagaaaattcagctcctcgttcagacgaccaccctctaaaaaattagaaaaaaatccaacgttttatgggcacttttggaccgaaattgcaaaatttgggttctccgatggcatttttcggcaatgccgtgtggaaaaaaagaaattttcataggatttttaataagaaaaccatgcaagattcaaaaattacccaaaaaattcattcgtttgaaccaaaaaaaggaggaaaatacgccttcggggaaggggtaggcccatttttatgtcaaaaaccataaattgggttcggtgtgtggatagagttagtcatcaatgaatttcaaaaaactcaatgattttaattgaaaaaattgttgattcttcaatggaaagaaacattttttccaattttccctttaaatttattatagtaaaaactgacggacagtgtccgacccggtcaaatattttttttcaaaatttttacaccaacctgaaacccacagcttgacaatgtccgtctcaatgtacacatagcgcagcccgcaacaaaaaaaggtgaacagcgaaagaacgaggacaatgatcagccaggcgtgccgttggacgaagcagccgatgccgaacagagagcgttggatgagaatgcgcgagtacaggggccaacggaagccgatggcacggccctagaaatttggaaaaaaatggattaagtcgatggaaatcggtggcacaattctgtaaattgaggaaaaatgcctatttaaaaaatatgagacgatggcacggccctggttatttggggaaaaaggttgatggaaatcgatggaacaattttgtaaatttgaaaaaaataaaatgctaatttaaaccgatggtacttattccatagaaatttgagaatttatggcagaatatagtgaaatctgcaggctatggccctgaaatccgtaatttgtaacaccaaaaattaattttgccacaggaaagtacccgcaaaatctggtggagtgccatgtccgcgttgaaccatgttggccgcttggagaactctctcttccacttgtcggaaaatgccgtttcatccggcgcttggccaaccgccaaacaacggtcaacacactgaaaaaaatgagtgagtttaattaatttggaggagtttgaaatttcaaagcgaatcaaaaaagggtttcaaatgcgtaaatcaaaaaaaaaaaaaaaattttttttgaaatttttcatggccaatttcatatgaaagttgaaatgggatatttggaaatgcccttcaatgttatagattaaaataaacggctctttcggaaatccgtattaaaatttgggattaactttcaaaaattggtgggggatgtagcgaaatttcagtcatccccccccctgaaaaaaaagtttaaatgtgtcaaaatggcatttttttgagaaatgccaccatttttagcacatacattcggttcgatgggctccaattcgtcctcctcgtccccactccatccatcgatttcctcctcatcgtcgtcgtcatcgtccaccgacatttcgttgttctgctgctcatcgtcaagcgatgcaaatccgcgccgggcggcccggggcgcctccagccaagtgatcatacaaaatgcaaaatgtgtattaaatcaaattgcaa

SEQ ID NO: 22566 - DNA, 1263 bp, Heterodera glycines
aaatcaaggaggcaagctgattattctcgagcttatgagttggctcagcattttgagttgttgttggccagtaaaagaccaactcaagtctcggttgccgagctattgcaaatttgaaatatttagcttaacatatataaataaattcaaatgataaataaataattaataagtttaaaaataattaaatgtataacaattattttagtttgaaaaaaagaatgaaaaataataatactaaacttgcttaagcaaacatcactcaatatatagttgggcaaaaatgataaataaaaatttttatgcataaagacaccggatccccacttttatagactaataaacacatttatgaacttcatttatttagaaaaacgaaacgaagagattcaatactaagcaaaaacaaataataaaaataatttaaacattttatgataaattaaaataaacaattacaaaaactatgttaatcaacattatttaaaagaaaaatatttgaaagataacaatattcctggttgtaaattcaaaattatacttttaaaaataaattatttttaaaactttgaacagataatgatttatactttaaatgttaaagtttagctcgttttattcaaaattagttttatacttttttatgaaattcaaataattttaaacactgaatattttataagaggacccagagaacttaaaaaaatctaaacttcaaaaattaagaaaattattataatgtgcattatagtataagtaataacaaaaaaataaaagaaaatgaatatgaatattatatctaaatttgattcagataaaagtgataaaatcttttgagtttctgtgttcataattaaattaaataagattaagttattaatccaattattaaaattttttcttccagagattaagacgaaacagtaactgatgacacaactgagcgtggtaaaaaatcttatagtcaaaatttttgagttcaaatttttgaaaattaatgattataaataactaactatatgttcttataacaaaaatataatttctgtaattttaatcctggaaatttttatttattttttttgttttagtgtggatataaaaaaaatccaaacaaaaatataataacaccataaacttttaatttaataaaaaatgaaaagatttaaataaataattagatgatcttataaaaattttcatatctcttttttaccgatttttaaggggagtacatttaaaaatttttctaaatattcacaa

SEQ ID NO: 22567 - DNA, 995 bp, Heterodera glycines
ctgcgtagcaaaaaaaaaaaatcaaaaacattgttatccgaataaaaggaaatacaagatttaaaacaacatgaagaatgacaaatgaatattagaaatactttactaaaaaacaaaaatgagatattaaataatttacaataaagaaaataatgagctagaagatatgtattcgatatttaatatttttattataaataaatattcatgctgcaaatagaactatagaaatgatagtgtaaaagtaaaaaatactctaacgatgcgaaaaaaattaattcaaaaatatattaaaaaatttttattttttaatactactttaaaaaataaaaaaatagatattttacaaaataaaaattgctgttagatggtaagggtatgcacaaatacaattccaaaacaataacattaaaaaataattaattcatgaaacatgattaataataagcgcatagatttacgagcacagtgatgatgcgccgatgtcaattaataatttctaattaatctatttaagaacaaactaaaatgaaaaataaacaaaatattaaactttaccaattaagaaatattaaacaattttaaattatttacaattaatgaaatcaaataatcaaaataaacaaataaagttatgagaataaaatcagagcccctttgcacaagattcagaaaacgttctattttgagacgtagatcgcaagttatatgattaatataaataatttaacttcaattaaaacaaaaaagatcgaaataaaaaagaataaaagccaaggagaagtaacacttgaaaaatcaatttaataaattattttaaaattcaaatgggattgtaatctaaaagttaaacaaacccataaaataaaataaaataatttcatataattgctaaaaaataaataaataacaaatcaatatgaaaacagtaaaaccgcactaatagtattcgtctattgagtgaagacgtcaagattaaaaggaaaaaattgacc

SEQ ID NO: 22568 - DNA, 835 bp, Heterodera glycines
  misc_feature (18)..(18): n is a, c, g, or t
  misc_feature (26)..(26): n is a, c, g, or t
  misc_feature (551)..(552): n is a, c, g, or t
caaaggatggaaagtganatagcatntaaagtgggtgaaaaatttgtatgtttttataatgaaagcgttaaaatcgttcattttttatataaaggtcaaattgtggtcatttgtaacaggttttttcaattattatgggtatattttactttattacttactgcatttttgtaaaaaaattacactaaaaaagcaaaataattgcaaaaatagtgagtgaaaaactgcaaaaatatttatttaaaatttaaatataaaaattttttcatttaattatgacattaaaataaaaattttggctcttataaaaatttttttcgtgccttttcatcaaaataactgaagaaacaatttttgtttaatcattttgcagaatgttaaaatcgaaaaatcattttttaaatacccttattttttcgatatttttattttgaaattttttaattttccttcactatgattaaaataaattaattaacaattggacaaaaattttttgttttttatcgtttttcgaaaacacaaatttgcgtcagttccccgcccccccnncccgcccttcaaaattttgaaaaaaaaaataaaataatagaagactcagaaatttgaaaattttttataaaaactgatgacaagctaatgtgataaaacaggttaattcttttcctttcagtatccctgcaaagtttggggcgcttctgataagtttcacaaaaaataataaaaaattaattttgcaaaaatcaataaataatgaaccctcctccttaataattttcctgcgcccatggtactcactcggccgcttcgcggcctcgaggggtccttcggccca

SEQ ID NO: 22569 - DNA, 1093 bp, Heterodera glycines
gtttcttttcttcgttgagattagtcacaaatcaaagcgaagtttcgctttcacaaacagaaaaatattaagaagaaaaacagtttttggcctggttttgtgaaattccgaaacaataaaagaaaaacgaaaaaagaaaaaagaaatccgattcttttccccgcggtcccttcgattcgctcacttttcttttcctttctttttaattttctgcttttcgctgcgttcgttagaaatggaatttcgtttaacgaattaattcaatttaaaataaacttaaaaatattttatgatggaacgccgaaacagcaccaaaaatggcggtctgtcccccacccctcaagagacgaccattaatttgcccgtttcctccaatcgaagggcttcgtccgcttcgattctttttgcccaggtccccaaatgccattggctgttttgtttcttcgtctgtttgaccttcacttccccccaggcgagtttcgacacgggcctcgacgtgagccgcgcctcgcaattgtcgtcccagcggaatgtgctgagtacgcacgtgatggacttgggcagcggcagaccgtgcagtggcatccaatgcaaagcgttcaaatgggacaaaagccattcggaatggattcaaatcggagacacgtaatttggcgcaccgtccgcccgaactgacgaacaaatatttgagggtgaccaatgcgcaggggcgcattccgctggtgcaccccggcacttcgctgtccaaaggcctttacaaattgcgttttgccacgaaggaatattacgcacgtcaccagctgaagtcactgtttccgcaagttgacgtagggaaaagaatgaatgattttgaaatggatttgccattgttttaaggtggtcattgaggtggacgacgccagcgaacattgccatgtgccggtgttactcaaccatttcggctactccgtttataagggacactgatggaatattccctctctcattaattctcattttggtgtatattaaaaacaaataaaataaagaattaacggtttgcctttcaatgttttgatgaaatcgaaaaagaaatcaggcaaagcaattggat

SEQ ID NO: 22570 - DNA, 1075 bp, Heterodera glycines
  misc_feature (44)..(44): n is a, c, g, or t
  misc_feature (165)..(165): n is a, c, g, or t
  misc_feature (1038)..(1038): n is a, c, g, or t
tatattaaaaacaaaataaaataagaaattaacggtttgcctcnaaatgttttgatgaaatcgaaaaagaaaatcaggcaaaagcaattggattttagtaccaaaagctgtgctgaaatggctttttctttgtatcgacccctttttcgtctgtctccccccccnccctccctccgccctcttcgattccccacttctctcccttttctctctctctctttccctttttctctcccttctctctctgtctttttctttctctctgtgttagcgcccgggggataattagtgcgatgggtgcgtctgagtgttggcgagggaggagcattccatgcacttcatccccatttctctgcttctttccgctgtgtccaggcacaaaattcgaatggtgcgacgaataaatattttggccctcgcccaacccaatccccggagggcatttcagacagaaattaatgcgcgcgcacattaattcccctgcctcccctgagggcattgggggagtgaatttcgtttacgtcaatggacaacgaaaatgaaagtggaagagaagggaatgtaccggatgaagtcgaactctgatggtaatccaatccgatagccgaaaagaatgttaattaaacgtacacgtacaattgacaacattaacccctcgggggaacattaactaaactaactggtctaatccctccatttgcctctctaattatgactaattgggctttatcgattaaaattttggtcttttgggacactgcttttaatggctgcagaaacctattcatattcatccttggcttcgttctttgctctttccaagccaacgattaatcacttaatttattaattggcaaataattaattaattaatgtgtccgttgtgttttaaaaagggttttttgattgacaaataattgtttttcttatcactctcttcgcaaaatatgataatatgtctcatttatttttgttagcagcttccctttctttattgatcacttattttaattggtttgtattacttagggaggccanattaaattttaaaatttaattttttttttttgatatt

SEQ ID NO: 22571 - DNA, 1200 bp, Heterodera glycines
aatacgttttccctcttctcttcccccggggtaaagcacagctgccagctgctcgtcgctttccgatcggctggcagcaaaattgggggaaaacgaaccgtttgtctttcttcttcaacgaccctttgaatgttggctcaattttcgccgccacttcttctcttttcaccaacttttttttcatcttttttgtgtcggttttcttttttgattttttgttgcttaaaacttaaatgagtaaatgtttggttttttcgccttaaaaccccccaaaaaaaaaactctgaaattcagaaacaaaattcgtattttttagttaaattatttaaaaacattttttgatggaagaaatgcgttcagctttttccgtcaatggaactcctaaacgatgattcgctcatttgcgtgttcaatgaactccactttttgcacaaaatccctcttgagtcggtttgtcgccgatggaatcgaattttgagagtaatgtaaaaatattaataaaattcattatttttaaataattattcattttttaaaagagtcactcgccgtacagcaaaatgcaaagtgttaacatcgccgaatatgtcaacggacagaggcaaaattacaacaaaaaagatcattatcaggttatgttcattatgaaatttaaattaaatttgctcaacaaataccgtctctcattaggcaaccatttcgggcataattagccgtgccggcccccatatccgcgagttcgactttggccagcggtggccacaaatcccgcaaagcatcataagtcaactaacaatgtgttgaaattaattacatttaaaaataaataaagtattttttatttttgccagaaaatgcaaaaatataaccaaaattgagatgggatgggtgcgattggaggcggacatttcgccattacttgaacaaattgccgcacaattagttgatttttcgctggaagaaacgagttggacgaaatcggagaatgcggcaaaagtgggaaaagcaaagggaggcaaatgaatttaaaaggattttgatgaaaggttccgccttttttgccaaaaatgcgactgttaaaacggctgaatttgcgcaaatttgacgaggcattggacgaattggcacagcttgacagtggcacgatggagtgagcttttgcttaccaagattcactttttgtcaccaagattcatcccc

SEQ ID NO: 22572 - DNA, 2898 bp, Heterodera glycines
  misc_feature (94)..(94): n is a, c, g, or t
  misc_feature (142)..(142): n is a, c, g, or t
  misc_feature (227)..(227): n is a, c, g, or t
  misc_feature (234)..(234): n is a, c, g, or t
aaattattttgaaatttatggcaaaaattttctcaaaagaaaaagtaggaaaaaaccagtgattatctgattaaaataaatcggtttttctcanataattcatttcttttctgctgaccaattggctgcccgtgttcattantagcaatcaattaagtgcaatttgacgaatggctatatatcaggactcgcattcgtactttgatgccaagtacgtacttgggatntgggctntcatgcttggaaaatgtaactgtactttttccaagaataatcttggatttccaagattagacttggaaattggcattttaacacatgattatcaaaaatacccgttgttatgaaaaaagtttacatttttgtcattcttctgtctaataataagcattaatttttttacaccatagagagtgcggaagaaaacattttggcatttatgccttttgctgtccgcacgtcaacggaattcacacagtttggatggcccgatttcgatggttttaccgacatgatgcaaattctgtggattttcctctgccggaccatccgctgtctaagcaaaaaaaaatctactccaaatcgcaaaactttgtaattttttttacccagtttgtctaggtttttggccataacttttctgaaatttaacaaaatttttcgattttggcatgctaatagagaatacataaggctatcgaatgctttaaattcattcacttcggacaactatgaaaagagttatgctccaaaaaccaggctggagcccagttggttgcagcccagtcaaccctcacccttaaaaattactagggttgtaaattatcgtggtgcgacttttggggatttgcaacttggggacccgacatttggggaactagacatttggggacctgacttttggaaatcccgacatttggggacccgacttttgggaatcgaacgacttttggggatccgacatttggggaactagacatttggggattttattaaaacaaaaaaaatatttaaaaatttatcccaaattagacaaatttacaactgctttagccagagttaattccattgcaagaaaaaacaaaataatatttttaaaattaactctaattactgactctaagaaacagaaaagatggcctcggcattttgttgctgtacgcaattagacagtaaagtcgcctttaactttttgaatgcccttgatgaatttctgttcccgttggcccttgggaaaggcgttttaaataaaaattggaaagggtgtacggtaaatactaaaatgtattgttatttctctattgggttgtggttagtatgggctcaaaattctgctacctcaccgctgtgagtccggaatagctctaactttttttttcgtacatctaaaaaatagatgtccagaatgtttgttttggactaaacctttaacaacagctgttttacctactttttcgaaaatcaagtaatttttgtaaatgctcattgtttttaggaaaagaactcggtataaaaaaaatataaattctcccacgttccaaatactaaaaaaatatacaactaagtttagaatttaaaaaagcaaaattttttagctattatctgtaaaagaccgttaagaccaccgttatataaaaaattaggttctacaaaaaaataaaaagcagctgttgtaaaaaaagaacacaaaaataatcttcgcaaacacaaaatattttttacattagtctttaaaataggtcctataaatttaggaacaataggaataggaaaatattaaactttaatctttaaggatgatgaaaattcaaagttatttattatattttgttttattttctttttcgttaggtgagataacttttcctatgcaattttcattagtatcagctttggtggaattgataacagatagtttaaaaacaaaaaataataaagatgtttctttaacaaaaattaatgacagagttatttaaaaatattgttttgtcttttcttgcatttgaattaactctggctaaagcagtcgtaaatttgtctaatttgagataaatttttaaatattttttttgttttaataaaatccccaaatgtcgggttccctaagtgtcgggtccccaaatgtcgggatccccaaaagtcgggtccccaaatgtcgggtccccaaatgtcgggtccccaagtttcaaatccacaaaagtcgggtccccaaatgtcgggttccctaagtgtcgggtccccaaatgtcgggatccccaaaagtcgggtccccaaatgtcgggtccccaaatgtcgggtccccaagtttcaaatccacaaatgtcgggtccccaaatgtcgggtccccaagttgcaaatccccaaaattcgggtccccattaaataatttttggacaaaaaatactaatttaaagaaaattttcaaagaaaaatataaagtaaagaggaatttattaattttgaagaaaaaagtaaatcgaaaattttccacttctggcttttttaagatatttacaaatttttagaaagttgaataagttgattttcgtatatttaatttattgctttaagttttgatttttgtgaataaaaaacaaagaaagtatttaattataatgtttttctttttaaaatattaaataaaaattttattaaacaaatcttgttccagttaaaattgatgagatttttaaggaaacgggaaaaaggcggaaatcccattctcgttcccgtaccgattttgctgtttctccgcttcctgttcccggaaatttttttaccggggctctaattttgacaaaattatttttgcatttaaaaaaaacattctttatcaacgctgacgcgattgacataggccatcagattttgaattggtgaggcgaacgataccaacga

SEQ ID NO: 22573 - DNA, 2226 bp, Heterodera glycines
aaattttcgaaaattttaaaatttcaaaaaatcgagctttcaaagctctacaataagttcgctggccaccccccgctcagatcaaagcctggcgcggcattcacctggtactgaagtgtactttttgagctcgcttcagttagccaagcgtgcaggccagggggtggctctaataaaaaaataaaaaataccagcatatagaggacccttcggcggagtgccctcacagcgggaagtttttgattcgggatttagaaaaagagttatgggccttcaaacgcaagcaaaaatggaaaataagccgctggtactcagttggccaccggaccggaaaacccgtatttttcccggatgccccgtcccgagatgcctatgtgtgcaaaatttcagccccctaactattcccgttcccgagattttggttttaaggatgaaaccccttatcattctaacatatatataacttttagaaatatttatttcttgggataaattatcaaagggttttggaaggaattaaaaaaaatttgacaaatccgtaagtctttcgtgtaaataaagaatatgtatacaaaaaatatcaggaatttttttctaaacaaaaataatgattcactactcatttttttatttttctataatttggaaactaaaagtgagtgaattttaatcaaatttacgactattttttttgctctcagaattcaggtaccagagtttactatggtttttattatattttagattatcctaatgcttttgagcataagaaaaaaaccaaaacaaagaatttaaaaacggaaatgttaaaatcttagaacttaacccaggccccattcctccaaaagaataattaggtctatagggtagaaaattttttatacaaaaaaatagacccgaagaaaaatgcgtcaaattccttacttgcctttcgaatgaatgtgtattaattctggtaaaagctgaaatataatcacagataagaaaaagaaagagaagaaaaagcaaaacggataccaaatgaatttttgtactatatcgtttttatttttaatgaataattttggcatttattcttaaatttttcaaaaataattaaagatcgaatagatgtctatagataaaattactaaatttaagcaaaacttgattaaataattccttcatattattctaaaaaataataaaaagacggtatttaaaatgtataattaaaattatgataaataaacataattcattaacaaaataaatggtagaagtacgaatttgttattctttttatcaatgatagtcattcttatggtgatttaataaaaataaataaataaataacaacaaaattaaattaaattaagacttaaaatgggtaaaaactttactgattgatgaacttttttttgggcattcaaattaacggcgcaccacatagtctaattatttaggaaaatccgggcctttgctggctcagctgtcaaacaaatggttgatgattatatttgtgcatgcaaaaattcggacacctgcctatttcgcaataagtatgtgacatacggtcagtcagtgaaatgcaccgcgcggaaaggaccgatcaatatcggtccgcttaatttacatattggaggaggaggtcagtttatgtcacttgtcagtcggtcggctggcacgtgatacttcattaatcgctataaaaaactcaaatgagcaacattccatcacttgaatcgagaaaaaataaaaaattcattgaatttaacaaataaataaattatatttactaatctggggtttatagacaaaaaataataaatagtaaataaaaagataacaaatatcacagaaaaaattgctgactgcccgcaaaaaaaagaaaagaagagatacaaaattttttttcaaaaatagtattaatgcattaaaattgaaatgaaaataataatgtcaatatattgaaaaaagatttgttagattacgggatatatgataagatgagtattaaacaaccgccaaaaaaaataaaataaaaatagaaaccgaaaatttaattagaaaaatgattaaaaataatgcttaaaaatgatcgggtgggaaagtaaatatatcctattgatttattttgtaaagttattaatgacccaatcattatgccacccgggacccaaagatttacaacaatgatatagggagagacgcaatctttaggatttgtttaatttcatcaaaaca

SEQ ID NO: 22574 - DNA, 2633 bp, Heterodera glycines
aatgttccaaaaaagtttttttgaaaaaacagcgccacaaaaaaagcgacttaaaaacaaaaaataaaaaaaacaagttttggtcattttttgaataaaatctgttaacaaatccgaagacaattttcaaaattttttcggcggcgcctaccggcaccgcccgaccccaactgtccccgaacttttaaaaaacgcaccgcaaaaaaaggtggaaaaaatggacaaataataaagtttgtttctaaaataaatatatttcatgaaaatattttttaattttcatgaaaaaattttaaagatttttgtttggatttttcatgacttggactcggtttaaaaactaggactctgacccggctttctgtacctggcaataccctgacccggtatttgcccaaatacccaggcccgtacccctaattaatatacgattttgaagttttttaaattaaaaaataaggctacagaaaaaaattgaagaactctcgcctctcgtcctctcgcctctcgccaactctcgtgtttttggggactctcgcctctcgccaaactctcgctctcgtctttttggggactctcgcctctcgccaaactctcgctctcgtcttttctgagacaagtcacacccctgattcttaccagtgcttgtttttcccggttcccgtttgccctaccgggaccgggatccggaaataaattttcaaaatccggggcttggacgacttcggatgaccgggaattcccgtcccggtcccgctctactctagagttattacgattaataagcaaaacaaacaaaaaaaaattaaaagaaaaattaattaattattttatttaattttttaaaatgtttaggagagttcctaaggtggactctccatgggtgaaatgcatttgtgaggtcggcgcagtgaaccagagtttggccgtcataccgccaagttgttgattgatttgttaattattgaataattaatgatgaatgtattaattgtttttcattaattaatcccccttttttaaatacagtgtcatttatgcccaccacaccaatgagcggaaacatgaccgaaaacgcaactgttgcgaccggtaaggctctgttctttttttttgcgagatgagtgagagtccggcgggggaaaggtggggtcagtctgaccattttcatgaaatccctgctggttagcatgggataaagcaaggatggcatggaattccgaggatttgatttctcgaaaatttttgggcatcgaaattccgaaatttagagaaaaaaaagacggtaattttgtacgaaaccgtatttagggagaaaagtttgaaaattcttttttttttttacattgtatttttattttactttttatttcatttaatgttttctaataaagcctatttaagcacattttgggtccggtggtgccggcccttgccccggggaaattttgatttttgataaatttcttaaaaaacgctacttttcaaaaattttacttgattttcataaaaaattaattttcatttatagtttaagggggggagggggctataacgccctttctctatgctcttgctataaattaaatttttcagatgcaagtggacatcaccatctgacggctttggcttttatcttgccatttgtcattggtagtaacattgctaaatttaaaataatttattcataataaacctccggggatcccccagcggaaaactttggattaaagggattttttaattttaaatttcattgagtaaactctaaaaatttcccaacatttgactcaaaaacaaaaaaaaaaatcatgttttcatttttattcttttaaattattatattttaagttaaaatgtgagactctaatcaataaattatttttaaaatatgcaatttatattaatttaaggaattttgccaaatttggccatgccattcgctaccaacctctagacgacctaattcaagagaaacaattgatggccagaagcagatcatagaaaatcccaaaaaaaatttatccatttaaaaaacaatagaaaatcccaaaaaaaaatttatccatttaaaaaacaatagaaaatcccaaaaaaaatttatccatttaaaaaaatttctaatatttttatttatatgtatgtaattttaactagagtagagattttgaaaaatcctgcacctggattaaatccaggttcagcaaaaacccaggcttgtcaatgcatcgactcaggccttggatctggattttttgaaaaccaaatatttgaaaaaattaattaattgtttggctaaaatatgtataatccaggaaatccagcttttcatgccgaacatggaattagatttatgaaaaatctgacctggacctggatccacgaaaaatcccggcctcgatccaggtcatgatcaaactctagttttactaattactatatccaatttttttacaatttacctatatgtatgtcttttctatatttcgggacatttctattctactcctttttcgactatgtttatttctttaatcaagcatttctttttgtggtgaataaatcatcttgggaaagatttggaaaagccaaaagtttaaatttcacaaacaaattttggcgtaatgttttca

SEQ ID NO: 22575 - DNA, 1114 bp, Heterodera glycines
  misc_feature (967)..(967): n is a, c, g, or t
  misc_feature (1041)..(1041): n is a, c, g, or t
  misc_feature (1076)..(1077): n is a, c, g, or t
attgcttataggaaacaacattcaaattttatacgttttcgttcccttttaggtcataattttgccgtatttaattgttccattatgctcataatcttaaacaggaccaatttattagcgcactttggccaaacaatcgaacattgcgagtttcatttcattttcgttaagtgattgtcatttgtttttcattaattgaccaatgcgagcttaattaagattaaattattggcaaaataaatccaaaaaatcagagcactgatcattaatgattgcgaagagcacaaaaaaaattcaataattagattcttaaaactttttaagatttctaaattatctgagaaatataatttctttaaatgcattgtgagatgaagaagtcatttaactctcaaaacgatgatttttgattacaaactagagtagtactggactgtgacctggtactgaaaaacacgtacaactaactgattaccgaattcccggttttgactggttctgaccgggaccgggaaaagtcccggtttttaagaatttaccttcaaattttcgaaaacacactaaatcttaaccaagaaattttaaatttaactgtttctcactaaagtgtttgcacttattttaatttatttcaataaaaaaactattctttaaattttatacatattttgtaattttatttaaaaaaatgtgaaatcgagtaataaattgtgtaagaaatgacaacaatggttaaaaattagagaccggtaaaaaaaatttccgggagcgggaatcccgtaaaactcccgctcccgttaaaatcccgtccatttttaacgggagtcccgggcgggagcgggagcacttcgaaaatttaattaaatacccacaaaaaaattttaatgcacaaatttgaaggacaatccttttataaaatacagaaaaattataatatgcagaaacgaaataaaaacatagattttangctcgaaaatcagaaaattttttcaaaattgcttcaaatcattttttttaaatcatgtattcgaacaaaaaggnttaaaccttatatttccgaatcctttattaatttnntacattttttgcgccgaattttttgaaaaaacttttt

SEQ ID NO: 22576 - DNA, 1188 bp, Heterodera glycines
aaaaatcattatactttcgacaaagtcgaccaaaatggtatcattcaataacacttattattctttatccacatgcaaaattcaatcaaatttattgtattctttttaaataaattattaaaaaattctttaaaaaaattttgtccgtaactttttttcaaacttagacgattttttgtcgaaaacagtatgagtagagcggttagaattggccttgccataccaactcactgtctgaaatttctctgatttcgatgcaaagcgtcaattggtcctcatttttgttgtaaaagcctttgagcgggtccattagtagcttaataaccataattagttaatttggatttatttaaattggaacacaccgcaaatggtaagggacatataaatcgccggctgcatgttcattgttaaaaacgtgttcagagaatccagaaaaattgcggtacttatttttaaacaaaaaaagcaaggttgccgaacatttgcaactccaattttcttcttaataccctaatggagttgtttaatgactgaccctattttttgaagttttgctaatgactaaatattggtttttttccagaacatgacggcaggagtagtataggtgtaaaaaatccgcgcgggtacgctggcagaaagatgcgcattcaccataagagagaagagagaaacagagaaaaagagtaaaaaaatatgcgcgggaaacaaggaaaactgcccatatttttcatgaaaatcccccaatttccatggcatcgcttaatcgctcacttcccacctcctccaacgcaaattcggacactttttcaatttccatttcaattgtatcttcgttttgcgtcggccaactggtgatttttgaaaattttcattgagaactccgatcatgaatagtaagcggatttacagtcagggctcccagatgtgaggctttagtctcattttgtggttttttgataggtcaatgaggttttttttcaaatgaggctttgaggttttttgtggttttttgagaaattttgaggttttttgtggttttttgttaaattcttcataaaaactagaaaataatcaattcttttccgaaaatcacaaaattaagaatttttttcaatgaaatctgctaaaaatatagtcaaaattcttaaatttattggtcgaacaaaatctgttaacaaatcg

SEQ ID NO: 22577 - DNA, 1701 bp, Heterodera glycines
gggtccggcggtgccgataggctccgctgtgaaaattttttggaaattgtaagaaatatcataagaaaagttgcaaaattttcagaaaattttccattttttcaacaaaatactgaaaaaggcatgaaaaaaggcaccaaaaggcaaaaaaggcaccaaaaagttcaagctagaagcttcaaaccaagttaaaaacccgtttttcgtgcttattaggccgtagaaagctagcaaaaaaaggcatatgcctcaaaatccgggctctacttattaaataccgaatttacgatttgaagggatctaaaaatccttaaaaattgcgaaataggcgaaaatggtaaaatagggagcgaaaatttgaaaatcagtgcttttttcaataaattaaattaaaatcgatgtaaataacttattgagcaaattaatttcaaaagaattaaatttaattattttttgaagcaaaaaaatatttggttttcttatagaaaattgttttttttttcggttttttgttagttggtattctattcatttttcatatctttagtgaacctattcaatgttaagattttaatggttaaataaaattgaatgtctaactttgtgactaataattttttgcaatttcaattatttatttttgccgttggtttatagttttagtaaaacttattgataatagtggaattttaatgaaaataatatttttaacagcgcagcgcaaaaaaaaaagtccatttttgctgggcggcgcaaatatcgcggcgcaaatcagggatgttgcaaagagaaaaataaaaagcgaaaaaagcgaaaccaaaataaaaagcgaaaacgaaaaggcgaaagcgaaatgaccaaaaaaagcgaaaaggcgaaattttttttccaaaattagatgaatttgaaagtctaaaaaattcacctttttttaatgcttaactgttatgatgattgatgagtgctcttttgttttttcataaattctttatgcaattcctggttattagacaaatgggagggctggggtcggttttttaaattttttttcttatgccatgtagtaaaaagcgttctatgtagtatttttgcttaaaaatatttattaattttcataataataattttatttgcttttattttttatttcttttttatcgtaaatatttttgtatagaattaatttaaaacgcatattgtattttgtgtattattattttttccgttataaattaaaaaattattctattaaaatattttgcgacaaaaaaggcaatttcgagaaattacaattcaaaaaatagattatattaaatagaaatagtggtttttattaaaaaaaatgataaaaaaaatttcttattactttaatttttaaaacaattaaataaataaattaaaaatgaagccgtcaaccggcatagaactcatgacaatgacagaaagtaagtggaggttgatgcactaacctctacaccacactaaacatcgataaacagcagactaaattatactttatttaataaaatttggtaaaatggttaaaaaatcaaaattttgtgtaaattttttgctttttctcacacgaaaatgccattgttttattttaaaaacccaatcgttagggctgtactttttttttcgctttttagctcaactaaagagatgttgacataataattctttgtgggattatattag

SEQ ID NO: 22578 - DNA, 1712 bp, Heterodera glycines
ggagaggcaaaaagtggaaaaagatccccacactgacgcgggattggcgggagaaggaggaaaagtttgagcgggaccgaattgagtacgaaaaacggattgaaatgctggagagggccaagcaggagataaagcgtaattttaaaattaaaaaaagttattattttaaaattgaattctcatattaagagggtttgaaagtggcacagaacgcagcggcacaagccaaactagccgaacagcagcgacaaacggccaacagcacacaaaaaacaactccgacaacacaaacaactccaacggtaacagcagcgaaagttgggaaggaaaaagtgagggaacaacgggacagcagcaaacagcggacaacgcaacagactgacaaggaaatggtacggtgaatgggaaaaatgttgtaataattaattaaattaattaatgcacgatttgttacggaaaagcattaaagcacggaaaagggacacaaattttgatttattagcaacaaaagaaagtatttgaattgttggagaattattttaaatagtcttatattaccaaatatgatttgttgcctttacaggattccgttgactccgcttctgtcaattccgcaccacgtacaaatccgtcacagcagcagggtaacaaaacaacatttaaaggtctaaaacttcaaaaaaaattgcttacaattaagcacctccgaaaaaagcggtggcacctcccccaccaccgcctcctcctcctcctccgccgccaccattgtttgtacagcctaaaaaagttgtgcaaaatggccctaaagcagcgggaggaatgccaccaccgccgcctccgcttggcttattcgtctcaaccgctgaagcggtgccgaagaagaaaattgcgaaaattggcagcaaaatgccaatgatcaattggacggcgctgaacccgaaccaagtgaagggcaccgtgtttaacaacatgaatgacgagtgggtgatcaaaccgtacatataacatgtattttttccttttttcagaaaattggctgaagagcttgacctgagcaaattggtcaataattttcaatttttatttttaccattttctatgcaaaatatgaattcaggaagcaatgtttagtctggacgagaagaagccgtcgtctgaatcgcaacagcaaaatgtggacgcaaacgcagcggtcaaaccccgtggacagccgtcaccaaatgcgaccgtaaattgcggaaaaaacactgttctctcaactaaacggcttcaaaacatcggttgggactttttctcacactgggagggcggaatttgcaatcattaagccatagaaatttaaaaatgatttttttgcccacttaatattattttatttttttacagccataattcgtcggaagatcgggaaaagtgcaatggatgtgagtatcaattgaaaaggggcgggttcatgttcgggttccatacctttttgtgtcctttaaaagcaacaaaatttggatcattgcaattattttagaaattcctcgtgttcatttaacttaaaaaattttaaaattaaacaatcattccaatagttgtgtaaaatttcgcttttttcagattatgactgccgtccataggttcgatttctcagtgctcacttccgaccaagttgatgttctgcttcacaattgtaaggaattctttattccttatttaattaaaaa

SEQ ID NO: 22579 - DNA, 1768 bp, Heterodera glycines
cagcatttcaatgtcgacttccttccctttggtctcaccctaaaattccttttatggggttaacaaaacaaatgaattttgggataggcaaactcggacctgttcttgccattccacagcagcaccatttttctcgggaaaaattgtcgttacgagggcggtttgaacgcgtccgttgcttcgctcaattttgacgctcattccggcacaaattctcttgatgtcttaaagacaataatttttaacagtttatatatagattctgctacaacaaatacccttgacgggtgctataggctgcagtggtggtggtggtggcggcgacttgctgatataacccacggaagggccacaatcaatttgtcggccaacaaccgtttgcatgcttgatgaagcggcgatagagtgccgatttttgttcgagacaactccatttgacgcagttttcgggtcggcgcatgatttctccggtttgtgaacacgggaaggaaagagagatgggttgttcctgacaatcacttcaatgtccaactgtttgcccttggtttcgccctgaaattataattttttgttgggtattaattgttggcattaaatacttcttccatccattcaacactgacacctcgttcattgattgctgtgacgagtgccgcatgaacgcggccatccgatctcaaaatttggacttccgtcccaattcggagcttatccatttttgaaaaagatcgataataagctaaataggcaatcataaaaaactattcctactttaatgaaaacaattttctggttttcccactagaaaaataattcgcttgacagtaaaaaagcgcactaatagaaaatagatatcaaatttatttggttcaggtgaattgaagcgagttatgaccagggctgtaaattttatgcaaatgcatatttttttcctggattctacgtagtccaaatagaacgaaaaacaccttctttttggtatttgcttataaaagttgggacttttatttgcatatttcgggatttttgtgcatatttgcatatttagggtttttctgcatatttcatgcatattttgattttttgtacatattttcagattttttgcatattttgccattttttggaaaatttgttaacaaaaattcaataaaacggaaacccctaagaatcggccctaaaaaattcagaaaaatacacccataagaatcgaacgaaaatttttaaaaacacaccactaagaattggaaattttttcaaaaattcttcccccaaatttttttttcatgacaaaatttttgattgattgaaatgttggtgggttgagtcccagtgattggaattctggtgggttgagtcccagtgattggaatgctggtggattgagtcctggcgattgaaatgatgttgggttgcgttccagtgattgaaatgttggtgggttgagtcccagtgattgaaatgctgttgggttgacccagtgattgaaatgctgttgggttgagtcccagtgattgaaatgttggtgggttgagtgccagtgattgaaatgcaggagaattgagtgccagtgattggaatgctggtgggttgagtcccagtcattgaaatggttggtgggttgagtcccagtgattgaaatactggtgggttgagtcccagtgattgaaatggtgatgggttgtccagtgattgaatgcaggagattgagtgcagtgattgaatgctgttgggtgagcacagagtttgaatgctgatgggtgagtcc

SEQ ID NO: 22580 - DNA, 1500 bp, Heterodera glycines
  misc_feature (1434)..(1434): n is a, c, g, or t
  misc_feature (1469)..(1469): n is a, c, g, or t
tctgttgtattcgcaattttcaatttagcattttgtcgcaaaaccctttcctcaatcccgcgttcaatccgctcgccgcattttcctctcctcctgacatcgctcgtgttcagcaatggtttcagcagaacagttcctactcgagtccgactgcctcctctgtttgtcgattcattttatttaatattatttttgtttttaattagactccttctctgatcagcaatctctccggcttgagtattttttctaccgacaattcatttacactcaattctcaacaattaaacaacaaatttgtcaggacggatgagacgttggaccccctaaaagatccaaaaaaatttcttgcatattttctcgaagctatcaaaaattgcgaccaggtgagtgtaattaagagttttggacacattactttacccttctttaccccctccattctttgcatcgttttaattttaaccgataattttacggatgcacttcatccccccccccgtcgtttctccccctccccctcccaaaaaaatttaaattttttcgcggagggacgacgcggggggaaacgacctgctgcgtaatgaatgtttacaggacaaaagagttttttgcgtgccatttaaaagaggttttttgaattttcataagggccaaagggactttttttgcaaacgttttttgtaggataatttatagtcgtgaccttttttctgaaagttttcgggattgttgttcgtgaatctgaaattcattaaccaattaacttatagacaaaatggtcttcccccctaataaaactcaagcatattttaatttttctttttttgtttaattgattttttaaggcaaataaagtttgctgatcagtgatcacgaattcaacatttagattttttaaattaaaaaactatcgaatttgttttgaattttggatttgtcaaaaacttgtgatcatccgggttttattagtgctaattaattaatcataggaaaaaaatatttttttagtcctgtaagtaaactcagaaaagtaccttttaacgcaatcaaaaaaaatattttttattggatgaaaattataatttcattccattttaggaggttttctttcattcattgaaaccactcaaagtttttgccttagcaattgctaaacgaaagataccaacagaatttaaccaaaaggattttcgggagctgatcaagttggtcattttgagattattcaattttcttttttcctttttaggattttaattgaacgtctcgctttgctcaaagaccaaagggtaagtgaacggaccaatcggtcgtttaaactttaattggttccccaaataacagttccatttaagtctctcaattatattctggaagtgctggacattcttgtcaaccaaccacagtttgaattggtctcttttctcgacnttttgtttgttccgcaattattttgttttttttangctatcgccgatcgcaaatcgcccattttgc

SEQ ID NO: 22581 - DNA, 1015 bp, Heterodera glycines
  misc_feature (11)..(11): n is a, c, g, or t
  misc_feature (1009)..(1009): n is a, c, g, or t
tttttagcttntgatgggcaaaatcgcctcaattgcgcactgtcggaggaggatttcgtgaagcctttgaactgtctgaaatgaaaaagcgatgccaacgcaatttcaacacagaatttgtcgttggccataaattttgccattagaggcacttttccttcgcgcgagtcgaagccaattgtttattggacgaacattttaaatgcactgacattccttcgaaatgcaatcgttctgaacgaacaggcgagggtaggacagaaaacaattgcttttaattaaccaattaagtgcaatttgtcattaaaaaattttaaaaggattatttggcatcgatggacgagggccgtgccgcacattattttgccgacctttcgcgccaatgtatgctcgaagtggacgtgggggaggcggtgacggagaaggtcaaccgcctgaagagagcgatgttggacgattctctgatgattttggctgctttatgcaaagaaatgaatgtaaacggaaatttaagcgaaggacagaaaaatgtggcaaaaatcgtaagaaaaaattataaaatgatttcactttaattttatttgtttagtcatttccctttttcagatcgcaagcaatgagaccgttttgttcatttaccattcaattcttcggatggatacaatttccatgttcaaattgcaaaagacagttttattagtgagtaatttcatttgccatatcaaatggttttttgcccttggatgttgaagaaataatttttaaaaatttagaaaaagactaatttttggaaacgttttcattttcttagactttaaaccgaatcacaaagtctggcgctttgcccgctgtccttgacaatggtccgcttctctccgaagcattgctcaattttctattttcttcttttgactcgtccaatgtcgccaaattggtgagtttcgaagttcatttctgatattcaattattgagtcatccaagaatttgatgaaaatgtgtgctgaagtntcttct

SEQ ID NO: 22582 - DNA, 2200 bp, Heterodera glycines
  misc_feature (2181)..(2182): n is a, c, g, or t
atatatttttaatctcttttcatgacatattctgctgtgaattccggctgattgcggcttttgtttctatattataatgcattatttatctctctaatgataataaataaaaactaatagatctcacaataaaatgattactgttttttgtttttttattaatttaaaaggttgtatcttacaaaattatctttttatgtttgtttttttttgaaattaaaaagttttactattgtataaatatctttataaattgtttagaattaatttaaatatattttaattttccatttattatttaattatttatttcattatttctttgaatttattttcttttaattttaataaaagcaaaatttaataataaaatattattcagaccattattatttaaaattttttaaaatttaaatctcttgtttctttatctaccatgatctcctatttgacgaacgactatctatatttgcattatttgtatttgtaagaattttttatgaatttatttttccctcttacaaattaattttcttttttttcaattctgtttctttaagttttgatttgactattaattttttaaacacgctggttctcattttacattttaatcagtttggatggcttaaaaattaaatttattagctaaaaaatgatcaaataaaaccccaagggaagtaagttttatattattttaaccttttaaaagaaacaatttaatcaaatttatatgaaatgaaaagaatatttttaatttataaaaacaaaaataatatatgtatgtaaaaattattgcataatttatgacataagattattttttaaaacttttaattcaaaaggaatatgtaaaagaattaccacatatggcataaataatatttgtgcagattccgccgctcgccctaaaagcgcaattaattattttgtacatttcatgaggctcaaaatcataattgaatttttgtcttgtatcttgagcaaaaattattttaaatgttagtgtcatggacagaaattttgttgaatccatatgtaatcttgatcgtataaatttcgcttttccttaaaagatttggattgggaattttgccctagtcggacttttttaaatatggggatcatcttcccacctaatccctgcgtttttcccatttttaaatatcttcgtggtcagtacgtagcgtaagccggtccttggtcatcaacaatttgccgaacgcccaactcaacggcccgcccatggatcagcttgtccgacggatggccgtataaaagaaagacgaaggaacgatgctcaccttcttccactacccttttccaaagtccaatttctttccccaaaatttgcttttgctatccaattttcaaagatcgtattcaagtgatcatttttcatttcacatttcatttttttggtgtgtaataaaggttttgcgttgtaaaaccttgcgttcaaagcaattgtgtgccatcccggccactcgaactccctgacattctcagggacggtcttaagccaatccggcaaattataataaaataaataaaaccaaaacaaaaactttttccaatcacttcattttcacataaaactttcatttcctaaaacgaatcaaaagttttggattcagccgcctcggttgacgtctgttctttaaaccgggtcagacgaagtcgaaacaaccgcagtcagcggccacaggacgggagcggagcggaaacggcggtaggaaatgaagtggacaaattttaaaattgtaccatttttgccattttttaggcggcctaaagaatcagctgaagccggaggactaccgggaggagatgcgcaagtggcgccaactgaacaacggtagtagcggtggtgccgttgtcgccgcttccggtgccgtcgccattggcggtggtagtgccacggccatccggcgacagggcttgtccgcaatgccatcctcgtcatcactttcttccgcttcatcctcatcatccgctcgaagaaattaaacgaacaaaaaaaccctcctcctcctctgtcctctttattttgaatgtattatttacctacctaaataaattgtcattctttttaaaatgtccaaattttgcgattttgagcaatttttttatcgggcggcgaaattttgttagatttttcattcgtttttatcaaaaaannttggtttttttggaatat

SEQ ID NO: 22583 - DNA, 2410 bp, Heterodera glycines
  misc_feature (817)..(817): n is a, c, g, or t
aatgcaaatttttaaaataatttttaccaaaaaatgaccctccccagaaagtaaaaatttcaattaaaaaaatattattttctttatttacgatttatgtttggaaattttttaaaaaagtcggacagaagagaaaaggcgggtgggagggggtgaaagttaattcaaaaaaatttatattaaaatagcaataaaaaatagggaaaatgaaaaataaaacactgccctataaaaaatttttatttaaaaaaatgatgaatgaaacccatgcaaaaaaaacaacacctgcacaaatgagaggcgaaaatcgccatgaaaaagtgtggtggcgcagtgcccactaaacagccaatttgaaggcggaatgaccaactcggcaccggcacacatcgccacgaacagttcgaccattgacgggtcaaaatttgtttgtgtgccgagcagaacggtggacgaagtgccaatggaaaaacgggcactgcaaaatatgcattttaaaactcgcattcaagccaatttataataataatttggtgtaattatttctcaaacctttaaaattaaaaaaatttttttttgaataaaataatttattttttattttcattataaaatttcgcaaaagttgaaaagtttcgcgattttttgggaaatgtaaataaattcaaaaaatctataaaaaattttccctaactaaaatattaaattttctcataaatgtttttggggcgaaaaactaacaaaattcaaaaaatatttccattatttttgaaaacgaattttttttttcatttttgtcattaaattacagttttantaaaaagatagaaattttcgaagttttttgaaacttccttcacatagtaattacataaaatcctcaacatttggcaaaatggcagagaacggaaccaagacgaccttcggaatgcctgaaaatccgaaaaaaacgaaattttggcactttcacacaaaaatcggttggcacaaaaaacaaaaattttgcaccggtagagcccgacgtttgaatggcataagcaattggtccaaaatcggtgattgttttcgaattggttgtgtcatcatcaacgacggcactgtctttggcataatttgtggcaaaatgcccaatttttaggcgcccaaaagtgccataattgtcgtcatcaacaaatttcgtgccaacaaattgaacagcctcgttctgtgaaagtgacacggcgtcgaacagtgccaatctgatgcgaaatcgggcaaatcgacgctcgagaacatttgcagggcccggttcaaaaatggcaaaggcattgcccgactttaaaacgctaaaataaataattaaaaaacccaatttttatttcatttgaaataatttttttaaaaagtttatttttatttcattaagtaattttcaaaatttttattgaaaatataattgaaaaaattaaaagtgacttaattattaagtattaaaagtttacaaaaataaataaacataaaattcaaaatttctaaaagatttaaatgaatttcaaaataaatttaaaatattgcagcagatgaaaatattttaaaaattaaaatgattattaaaattagaaaaaaataaggaccttatgtggtttagaccacataaaaatttttttgttaaagcattataaacatgcttccaggggttttcggggtcgctaagcacgaatctgaactcagattaataaaatttcgaacccctaaccccgaattctaacctttttcgatttttttttttcaaaaaataatttgttttccgccgtcgccttcactgaaattccaatgaatatacatcgattggagaagggtgctgatcattaatattgtgatgaaataagaatatacagagcataagtctgagagacgtgcttttcttggaatgattgtatatttaagaaaagtccactaggtgttgagtaatttcccatgactatgcgaataaatgtcactctagcaccaaaaccaaatgagcatgttaatgatcatgatcttgatatttttccctatgtgatttacggatttaagaaaatcgaaaattaattattgaagaatttcccaagaccacccgcatacttggtacactggtgcctaaacggcattaaatgaccatatgtatgacgaccatgctattcgttcaatgactgaatggtttagaaagataaagaatatattcctgcggaatttccgctgaccacgcgcatctatgttatagcggtgctgaaatggcattataatgacaaagtgtcggacagtcatgctttgcttgccatgatcgtataattaagaaaaattaatagttgttgataatttcccagactatgcgaaaaatggcctctagcgcgaaacaaatgagcagttatcatcaagatcttgatatttt

SEQ ID NO: 22584 - DNA, 2333 bp, Heterodera glycines
  misc_feature (51)..(51): n is a, c, g, or t
  misc_feature (73)..(73): n is a, c, g, or t
cctctttttccacttcaccaatggaaaatttgacgttcttttgcaggagangaaaaagaggagctgcgatggnaccaaagttttagatgaacttcctatagtatgtgaaaaagcccaaaatagaatgcaattcctttcgcgtttgaggcattggaaggtttgtaattggctgcactttgtcgacgtccatttttattccttcgcgagttagaatatgcccgagaaatggcaattctttagcacaaaaatggcttttggacagcttcagtttgagtcccgcctcctgaattcgttcaaaaacaagcgccaaatgttttaaatgatgctcgtatgagtcggaagcgataaggacgtcgtcgatatatacaaaaacaaagttgtttatgtatccgtcaaaaaggtgcgtcataaatctttggaaagttgctacggcgttgcacaaaccgaatggcattaccgtaaactcatgtaggccaaattcggtagaaaatgctgttttttcgatggaattttcgtccatacgaatttgccaataacccgtcatgaaatcgagggtcgtaaaaaatttccggcctccaagcattaaaagggtgttgtcgatgtttggcaggggaaaactgtcttttctggtgaccgcgtttatggccctgaagtcaacacaaaatctcaacgttccgtcgcgttttggcacgagaacgattgggcttgaccacggcgaatgggagggacggatcacatctcgttgcaaatagtcttgtaacattgccgcgactttctccctgtaggcatatggcacaaaacgcatcttacagcgaattggttccgcctcgcctgtgtcgatttggtgtttgatcagattggtttgtgtcaattctgcatcactaatcgcaaaaatactttcatattgcatcagcaattttaaaatatcatctgtctccttcttttccaatgcctttttgtctacccattcgtgccaaattttttcaatctccgcagttttttctgctctccgcacttcaagttttccaatcaatgcttttggcgctgctaaaaagtcttccgcatcgcaaacttcttcaattaattcggccgtgccaaatttttttcctccttccagcgttactgatgcatttgaaaaatttatgattggcaccacgattttgttgttgcgtccaatcgcgattgttggttccaaacgaatctgatcgttttcttgatcggatgtcaataaaacttctctcccttcatattggtcaggcaagccacattcgatgactttcgtggcccgtggttccaacaccgttttgtagatcacggtgagcgaatcgattttattttggttcactttttcaaaatcaattacagtgtcgctgatggcatcgtacagcttaaagcccagattcattaagcgcattcgtgccaaaaagaaggtcaaatccaatcgacgatttggcgatatgcatcgcgactttgacctcgctcgaattctcatgccgttttatcggcagacaaataactcctaaacattccaaaggattgccattcgcatcggaaatgcgattttccgctttcaaaacactcaaattccgaacgtccaattttttgtcccttatcaaattgtagaggaactttgcctcaattacagaaatttgtgcgcctccgtcgagcattgccttcgtcttcgttccaaaaacttcaaccaaaactgccattacttttccgacttttgaaaaattcgaatttttgtcttccgtcgcacatttccttatttcgtcaaaaaaatcttccaggtccctgcttcaattcaccaacaatgaaattgttttgatgaacttgttcctcttgcagaactaagcaattttgcttcaaataattcttttgctggtaaagccgatttggtgggttttcgttgggctcaggcatttgctgccgattataacccatttgttgtttgccttgttgattcattgtcgtagaagagttagttcgctcaattgcgcgaaaaatttttccttggggacaatctctggccaaatgtcctgggctgttacagttgaagcaactccaacttcggtttgattgggttccaaatttttgcatttgctggccccgttcctcaaaattgcttcttgagggcccattattcgtctgggaaaaatgttgcggtgtgttcgttctccaagtcctttctctgttgtccggcctcgaaaatcgttgtgttgccttttgcgtagattcagcacgcgcggcaagtgacacgaagtggtccagagtcatgcctggcgttctcacaagctcgaggttaacgcgagctcaggattgcccatcgctct

SEQ ID NO: 22585 - DNA, 1286 bp, Heterodera glycines
  misc_feature (1245)..(1245): n is a, c, g, or t
agggcaatctctactgattttctcttttcattatccattagttatttgataaatttcccagaaatccttagagaccaaataattatttaatcaatcagatattaaaggaaattacgcattttgccgtcgatcattagacaaaagccaaattttcgtcggattcgttcactttggccatccaaaaattcgtacaattcattttggtaaataaatctgattttctgccatgcatttgcctttttctcggtgtaaatgttcaaaagtgcactgttttcgccaaaatttgtttcgtccgccgatggaaaaagtctttcccaccgccaattaatgccccatttgtacgtcaatctccagacaagcctttgcatgtgctggtaaagcagaaactcaacacaactgataaagccgttagtcaagggcaagctgaattagccggacaatattaactatgagcgcgtaattaggcacgaaataaccgaacgaaaaattattagacaattttgaaacagtggttttaaagcggatttttacaagacaatttagcaactccgacattttatttcccgaatagtttttgaaatattttaatggctttttaaatttctttcatcccaaaataaatcttcaactttgtgtcaaatgcaaaatattctgacccgttttcctccgtttttggcattttgttacacaaatctgtcgcaatggtcacaatttttctgccattttttaatatggtttttctttgaatttcttctttttttgaagttaaaattaatttttccaaattgttgacaaaatattcgacaatctctgccgccgatattttttcattcaaatttctgaaagatgcaaattcattgctattcaatggaattttgtaaaaaatttctgctgcaaattttgcgtcttcagttgtaaacggcttacaattaattgctaaatttttttaatttttcaaaaagaaatatttttatttaaaataattatttaaataaataaaccttcagtaattttgccagagtaaaagtagagaattaaaaaagttgaaaatggatgcattaaaaatttataagcaaaattaacggccattaaaaatgacaaaaacatttaattaaatggaatatatttaaaaacatggaattaaacaaatccataaattgattaatttttatattcacacagccaaaatgtgaaggcgacgacgacagaaaaaatatttataaaaataataactcaatgtatctngttctgatcaacgttgtgtataatttaaaatgatttgttaa

SEQ ID NO: 22586 - DNA, 1296 bp, Heterodera glycines
gaccatccgttgccgaacaaaattcgttttcgtatcatttctattgggtaatttgaactttatgtattttaagttttatttattttaataattttcttcaggtacattgaccattccgtcattacatttctccgttcgaacaagcacatttgggacagaatgggcaccaaattggagttcaatgtgaatacaaacgaaaccgaggatggacagcgaatttgggatgttttggcccgtcaaatttggccaatttttgctaccaacattcgccatttgtgcttttacgatagcggcaatcatttggacaaattgcgtcgccgtacttcgccgacacttctcaccgattcaaatcaattgatttcaatcgagtcttgtggccttttacccgatgcaattggcgatgatggaccgaatgcaactgctggccaagcgctgtccaaatggctgcacactccgacgaaagacggccaaccgaaggaattttgttcgtatttagctttaatggaaataaacaattggttcgacaatcacaaacaggtggtcgacaaaaaaatttttacgattttgaattgcatttggttaaaatttttacgaaaatgcactttttagtgaaaattttcggctaaaaaccgcaaaatttgatcgttttttgcacaaaatctgttagcaaattgcattcccaattttgtttagacatttctccatgccaccacttctgtcagttacaatgtgcgaattattttttataagacaacaacgccaattgagccatttgaattggtgaacgaacgaaccaaggaaaagctgacatttatgaagaaagatggcggtggtaaattgcttaatgcttggctgttgaaacggtgcccaattattgttggggagacggcggcggcggttcaaaaagacgaaaatttggaccatttgaacggagttcacttccgtctttatgatgattattgcattgggtgagcagcaaagaaggcgccttacttttgaataaaatacggacatgacgacagtatcccctgtacagtacatactttcccagaattttggcaggaccagcaagagcatacatgaaaggggggggggggggtaaaccgaaatttttgcgaaggggtccgtccatgtaaagaatttttaatgaatttttattaaatagtccacattcatttaaaattttgcttaatttaggccgatggatccaccagatcaaagcgacgaaaaattgttctcgactcccgggcccagtgatcagcagaagaatgagtgatcagttttgaaatgaccgat

SEQ ID NO: 22587 - DNA, 1495 bp, Heterodera glycines
  misc_feature (1452)..(1452): n is a, c, g, or t
atcagtgttaattatttcttagaaaaaaaaatcgcaactatcatggctggaagtaattacgaaatactgctgatcgattacgaaattacgccgattcaagacccccgcgtcatgattaatgtttttttgggctgttgttaatctacttttcgagttattagcacctattttctaggtttttatttttagcacctaaaaacctaaaaaattttttaaaaacttattttcacctattttggggttttgcccaaaaatttgttttctcaaaaataatttaaaatgcctttttagcgcttattattgtgtggtcagttgagtcccggctggatttggcattccaatcccggcacttttttatcttgaaaaagggcaagcacgcccctaattctatttttcctacccatttctagcctttttacatcgattccgaccgtttttgagcaattttgagtttgggacctcaaagcaatattttccatttatttatttattgacagaatttgtgattttaaaatatttgactcaaaattgatttggtttaattttgttacctttttgaatagattttacacccctaaaattgaaacattttggcacctcttttcccatttttaacacctattttggggattttttagaacctaaaacctacctattttggcagctttcgcacctaatcgtatccctagtcatgattgattgagtcaaagattgaaattaaaattttaatttaacatagattagtttacatcttttttgaacttgtttgatttaaaaaaatgaggattgttttaccaaaaaagaaaaagcacaagcaatttttataattacatttaaaagttgaattaattagcgatcactttttcctttcgcgtatcgtttaactgcgcattcatcactataagatttttactattaaattaaacaagaagcttgtttgacaacaggcaacggtggttcagtggtagaatgctcgcctgccacgcgggcggcccggtttcgattcccggccgttgcaacttctttttgcattatcatcttaaagaattttttttttattgtaatattttggtttttatttattaaatggataacctcatctctcattttctaatgattttcttcgttttccgtaaaggataattactccaggaaaacttcaaattaatagaatctcaaataataatatttaccaaattaaaatcgatttttaagaataatttaattttttcatgcttaaaaaagcaatattcggttgaacaaattttacggcttttgagaaccaaatttgattgactgatcaaaattataagcgaacaaaaagcttttcgtttgcaactttattcacaataaacacaaaaaaaagatgtataaaaagtaaattatttcccaaaaatggcaattaatgaatggcaacaaaagggggaaatgtgcacaattcacaccgatgtnttgccgatcagtccgttctcgcgccacacaccggcgcccattg

SEQ ID NO: 22588 - DNA, 1366 bp, Heterodera glycines
ctttctcttcctctttctgttcctcttcactttctgttcctcttccactttctgttcctcttccactttctgttcctcttccactttctgttcctcttccactttcttttccacttccactttctgttcctcttccactttctcttcctctttctgttcctcttccactttctcttcctcttccactttctcttgcactttctgttcctcttccactttctgttcctcttccactttctgttcctcttccactttctgttcctcttccactttctattcctcttccacttctgttcctcttccactttctcttcctctttctgttcctcttccactttctgttccacttccactttctgttcctcttccactttctcttcctctttctgttcctcttccactttctcttcctcttccactttctcttgcactttctgttcctcttccactttctgttcctcttccactttctgttcctcttccactttctgttcctcttccactttctattcctcttccacttctgttcctcttccactttctcttcctctttctgttcctcttccactttctgttcctcttccactttctgttcctcttccactttctgttcctcttccactttctattcctcttccacttctgttcctcttccactttctcttcctcttccactttctgttcctcttccactttctgttcctcttccactttctcttccactttctgagggtgtgctatactaataagtactgatattcctatgcttgaaattttttctgggacaaaatttcaatgtgaaattattcacattaaactttgtttagcaaaagtgattcacatttttgctttgtataagccgcctcaatgttctacaccaaattttaaaaaattattagattatattatggaatttaattataataatattcttatctgtggtgatctgaatttaccgggaattgattggattaattatcgaatagagaacaataatcattcgaaattatttattgattttatagcacaaaaacaattggttcaacatgtaaaacaaataacacgtggtaacaacattttagatttagtgctttcaaatcctaagcaattagtttatgacacgaatgttacagaaagtttttcaacatcagatcaccacatgattgaatttaaaattaatgggagcttttcgatcaccaaaaaagacaaaatttatattagagagtttaaaccaaaaaattttctaaaacttagaaatatgcttcaccaaaaacgcattgatctacatataccgaatttaattaaagttaacgacaaataccattttctcgatggcgaactttacaattctttgatcaattatttc

SEQ ID NO: 22589 - DNA, 1746 bp, Heterodera glycines
  misc_feature (53)..(53): n is a, c, g, or t
tcccgtgacaccctacttttttttttaaattgccaaacccttacaattttggncaatttaaaaaaatacaaaatgccaaatactttttttttaaaaatgccattgttttttgcctggcatgtcgcgggtgggtcgcgtcatcttccgtcttcatgatcatgtcaaatttggccatccatgaggccaacaccgtgtccttgcttaatccatcaatttcaggcaatgatcgaattctaaaaattaaaattaaattaattaaaattaaattttaaattaaaattaaattaattaaaattaaattttaaattaaaattaaatttaatttaataaaaatttttttaccttctctcaacgttgcagcgaaagacctgagaaaaaaataattatatttttatcaaagcttcgacggaagattcctttgtcagaaagaaattaaagcaaaattttgccaaatttaacattcatttttaatttgaaaaatttgaaaccatttttttagcattttcgggactaattaggaaaatacaatttggttgaaatttcataattatttattttctccaatttttttacctcacgaaaatcgttgctggaaaagccgccggcttgtatcttaaaaaaatataggagaatttaaaaaaatgtttttattttttaacaaattcattatttaccactttggccaccctttctgacttcagaaagccctcaaaatagctctcaattgcctttgtgaatgcttcgtccgcctgttgcacaaaaaaatggcaaatataaataataaaatgctctatttttattttatcattttaaaatttcccaattttccagcaaactttcacattgaaatgccatccccacccaccggaatttgtatgtcgcccttgagaaatgcgttgaagcgttcctttgtccttgaaagttcatgtttgctgaccttaaaatatcaaacattaatatttaccgatctattcagcaaggaagctgcttgagggtctcaattctcgattttcgtgtcggaaattcttagtttttttttgcattgtcccatttgtatggctaaattttaagtctcgagatatcagggtcaattctcggtctcgataggtcaaaattattggtccctgttttcgagtcgaagatttggtgagtttttgggcattagttttaattcttaggatcttttccagtcccgagtctggggggtcaattctcggtctcgagtgtatgagtcaatcttggtcgatctatgttttcgagtctcggtaaattttgaatgaatttcgaacgcccctactgatcagccccgccccttaagtttgttgattgaccttcaattgccttctggccatgtctgtgggctgtttggcgttgaaatggtaggcaatgcatttggccacaaacacataaagttgcagcgatcgcttgtgttcttcctcctcatcttcagccctggaaattagtttgatgagaatgatgatgaattgattgattggcggcaaatttgtgattaggggggggggggggcttgattaatttgatcaacggagctcaactgatcagacatggctccaactttgatcaattgttaaaatttgatcaaattgattagtctccctccttttatctttgatcatggcacatttcaatcgttctttcctgtcttcacccatttgatcagtccaacaaaatgccaagccgttgaccatcagcactgcaaatggcacttgccttaaccgatcacgc

SEQ ID NO: 22590 - DNA, 1567 bp, Heterodera glycines
aaaaattctgctcggtcgatttgttggggcaagaattggatcctttggactggtgaaaaataaacgagggtctgtttcccattctcgccgcgcttgccaaacgttatctttcggccccggcaacaacgattggaagcgagcaacttttcagtgttgcgcgtgatgtgtttgactatcgtcgatcaaatttgaaggctgaacacgccgaaatgctcatttttttgaacaaatcaattccgaaaattcaattttattaatttttttttgtccattaataaatgaatatataataatttacgttaaaacaatttttttttaatgtttaaaatataatattttcacttgaaaaataaaattaaaaattgaaaaaaaatcaatgttttttcgaaaaaaattttttcccgttcccgtcgggattcccgttaaaattggcgggatttttacgggaacgggaaaaaaggcgggaatcccgttcgggaatcccgccccgttctttttcgttttcccgttcccgttcccgttcctggaaaaatttgtttaccggtctctacaaaaaaaagtacgccaaaatgagagatgtttttttctctgcactctctatttatttacacatgtctcgttttttgagtcggtgtgtttaatgatttgaacatattaaatttgtttttcaattttgctaagctaatttaaatccgacgaaaactgtcttaataatttgatataataaaatgtcagacaaccgaaaagaagcggaggaaaagatggcaaaagcaatgtaaattaaaaatgcaaattttcaatttcaattttaaattttgttttccattttctttagtttcatctccggcgaaggttggctttcggtgttcgatttgcttgagccttctcaacttggcctcggaattgcgctgatcagccaccgtttcgacctttacgtggacgaacacttcaaaacgcgtaaatggacattggaacgtattcaaattcgaagcaaatttggagaaaatggcacgaaggaaatgcaaattgccaattggtatggaaaaccatcgccaattccgcaaattcaattgccacgcaaagtcgtcggattttgcgtccacttttcacctcctgctgtccaattaatttggccatcaatacggacaatgaccgcgttttggagttctttctgcacaacatttggccaatcctcggaaaaaatatttacggtttgaattcgaccgtcagatgtttccgccgtttgcgacaatttgtcccgtcaattctcaacggttgtccaccgcttcgctttgtcaatttgaagtttggcgatctgttccccgaatttccatgcgatgacagtgccatggcatcggatggacaagcggtggcaaaatggctgttcactccccatccaaacaatgtgccaaaaatgttcagaaatgcatatttcagtgagaaacatgagaattggccgttataaattgaagccttctaatcggtgttttcttttatcttttcatattaatcaatttttccatgttttaggcatttgccaatgcttcttctcccgccaatttcattg

SEQ ID NO: 22591 - DNA, 798 bp, Heterodera glycines
agctccttccaaaaattgtcaggacgaggcgtgaacagccattttgccaccgcttggccatccgacgcagtggcactgtcgtcgggcggaaaagcggggaaagtggcgcctttggaaataacagcgtgaaggactgggcaggttgagaattgacggggccaaatggcgcatttgatgaaaaatgatggagttcaaaatggtctcatggaaagtgttcttgaacattggccaaagtagtgaacagtgagtgacggctgtccgagcgccgactttggcattatttgcaggggcggagtatttgccaatttgtcaaaaacgtgtcaaaaaggttaaaatgtggcaaacactttgcgttgagattgagtgggaggggtggggggattaacgatttgccctcctccccttcttttcccccggccggaagggggcgggggagacaagtccaagagggtggtggtggtgctgcagtgaagagaacgaacgaatttgccatggatgaatagtagcattcattttctaaagaattaagagcctcgagaaaatattaaaaaaaaaaattacggttgcattttatagcagtttgggtttgactcccgcgaaaagttcgaaaaagcaaagaagcagcagcataaaaggcactcccagcagcagtggatgcttatttaagaggaaaagccattaatccaacccatcccatcagatcccatccatcggcagatcgattttagtcaacaaaaaatatctacacgacaaaataccgccaaaatccgaaaagggcctttaaaagccgaccattaa

SEQ ID NO: 22592 - DNA, 2718 bp, Heterodera glycines
  misc_feature (15)..(15): n is a, c, g, or t
ccccccccccccccncccctcaatagcaacgggcaagtttccctttctgtggccacatttccaaacccacaaaaagtcacaaatgtccgcgcaaatacgcagcctcgctagaatttaatctaaaaaacttttgtaaaaaagcatttaacaacgtcgcaaaaaaaaatatttaaaaaaaaatctccttacccggacgaattgtgaattaagtgatatgcagatcaaaaggtaactaactaggagcttaaaaattcatactaatgtagctttcgatgcagaccaaaaaatcccatctataataattagtagagtaatcatttatttatctaaagattttacggcgctgttagatttcgccagtgattgatttcgccagtgattgatttcgccagtgagtgatttcgccagttggatttcgccagtgagtgatttcgccagtgaactatttctctttttctcgccgtctgtatttgatttcgccagtaattgaactcgccggtgattgttttccccagataaggcaaaattcaacccatggacaaattttaactatagaaataaacaaataaagggggaaaggtcagcaattggtcatctcgagacgagaacaaacaaatttgcttcgccaatctatttgatactgcgcctaatcagtttctccaatttgttggtcagcggtgtgtgtgttccaaatgtcatcttatcgcaattcacaagaaaaaatttagggttttggctctcgttccttggtcacttttttgaattccgtcttgcgaaccaaaacaacaatttcttcttattttctatggcattgcttcgttttgatcaaacaaaatcgacacggggaaaaattttgctaacaaatggaggatacgaatatgtttttgaggttggaaatttctaataaaattttttaaaaatgtgcaaaaatcaaggccgtttcaaagttggatgagaccagtgaattttggcgttgtccaagaaagccaccatactgtccatgaagagcatgtgtacgcactggttggcaagttgatgcttttggcaaccaatataaagaggggcgtgtaactggggaacataatcacgctccattatttggagcaaaaatggttctcaaatttctttgtttaaatctaaatggcggatacaggtgagagagtcagcagaacgcttcgcgaagagcccaaagtgattcccaacatcgagccgaaacatcatcagggaagtgcgcgccgaattgccatttgaagttagggcagcttctgctccgtcaccatcaaatatgcgttggaattacaactatgccaaacgcaaacatcaagaggaggtggatgaattttgggttcttttgggttttgaataatgtcaaattcgtaaatcagcgctaaaaataagcctagaaaaaaatttttcaaaaaaaaatttcagggagtgtggcaaaacccaaaagaaccgaattttgtaccaaaattttcactttttttttgaaaaaagacttaaaaattgatcgacgggtggttactcaatccaaaaatccaaaaattttcagataatttttcctacttttttaaaaattttttgagatcggtgacgctggattggatttgcaaccagcagcggaaatcataatcccgcagcgcactcagcatttggtcctttctgatcaattgcacaatggagaacgaatgctcattttctgttcccctgctggaattgagaggctaagaacttacaatgctgaagtggcgattgatgggacttttgaagtaattaagcaataaaaaaagaaaaatgaaaaaatatgtgctaaaatttaagactagccccaggggattttcgcaactttacacattgtctgtgataattgagcactgttcggttccgtgcgtttatgctttgctacccaacaaaacacttttgacctacacacgtttctttcgggcaattcgcgatgcgatgcctgctggctggcatccacttcgcatgatgagtgattttgagcgtgctgcaatttcggctgcaaacaacatttttccaaacacaactgcaaccggttgtttgttccattttggcaatgctttgttcagacagattcaacaattgccacatcttttcacacgcttccgtgaaaatgaagacactcgagtggctctgcgatctgtccaagcattcgcaatgttcccctgtgaactctggaatgtagttgatcgagctgctgaagggttgggaagaaccaataactcagttgaggtgaatgattggcaattgcagagatgccatttgtatttatttctaagtttttgtttatttggaggagctaaatcatagaaatttaaaaaattcacatttcaaaacattcatattttgtgcatggggggggggggaaggcccaccacgaggccgcgaagaggccgagtgagtaccttcggtgcaggaaaattattaaattttaaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaattttcgaaaatctgagtctttcattatttatttatttttttacaaaattaattcataagtattttacagaaactgctctgaaa

SEQ ID NO: 22593 - DNA, 1918 bp, Heterodera glycines
tccctgttttgcccaaaattcccggtcccgctcaactctaattgaaatctttgcccagttttgccatcagccatcacaatccgtcctttttgtttttccaagttttgccatcaaatgccaattcatttccaagttttccatcacaatggcaacaattcatttccaattttgccatcaaatgccaattcatttccaattttgccatcaaatgccaattcatttccaattttgccatcaaatgccaattcatttccaattttgccatcaaatgccaattcatttccaattttgccatcaaatgccaattcatttccaattttgccatcaaatgccaattcatttccaagttttccatcacaatggcaacaattcaaaaaaattgatttcaactttatcattgccaatgccatcaattttcccagtttttccaacacaatgccaacatttgtcatttaaaattctttcatcacaatgccaaatttgtcatttcaaatctttttccagttttgcgagcacaatgccaacaatttgccatttcaaattctttcaccacaatgccaacacaatgccaaatttgtcatttcaaatctttttccagtttgcgaacacaatgctaacattttgccatttcaaattctttccccactttgccaacacaatgccaaatttgtcatttcaaatctttttccagtttttcgaacacaatgccaacattttgtcatttcaaattctttccccacttttccaacacaatgccaaatttgtcatttcaaatctttttccagttttgcgaacacaatgccaacattttgccatttcaaattctttcaccactttgccatcacaatgccaaaattttgtcatttcaaattttatttgttgcaaatttaataaaggtttcctaaattaacattgattggttattgaattatagaattgtacgggaccgggacctggacacgggcaactgagtaccgaagtccctgttttgccaaaaattcccggtcccgaccaaccctattgaattataataataattataatataaattctgtgttcaataaataataaagaaaacggtccagcttttatttttgcgtcataagaagccgtcctaaatttagatatttactctttttaataagttataccaatcaaatatggtagtgcgtgtactgtaaagcattatcaccatcttaagaaatacagtatcgtagaatataacgaaattaatctgcaaagttctctaaggaaaaaaacttttataatcttgcatttttcaaaaaataaataatataataatagttattatgactgagtgacccaataaccacctgctgctgccgttgttcctcgtatcccgcaaatcaattaataatgggcgggcaattaattgtccaacaacctaattatgctcatcatcatcactaattcatttatttatttcattaaaaattatttattcataatttaaattatcactttatatgaaaaatcaattaaacaaattttaacataattaatattgtaatttttcattaatattttaaggattccatttaagaagcaattagtcaaaaatggcaccaaaaaaattcttgccaatggagttaatcgtggaaattgtcactttcctccaatttcgtcggcgatgggccaatgttcgcgtgtcgagagcatttgatcactttctgcttgaacaaattggcttatttttgatgaaaacgaaatcatcggtctgtgacataaaggcaatatcactcttgaatttataaacttttttttgaatttatattttgccattaacccgttggatttgactaacaaaattttagagaattctcggaaataactgtaaaaaataaataaataaggtgcaatttacaaaatgtattaaaaaaaaaatttgttttttaaa

SEQ ID NO: 22594 - DNA, 2268 bp, Heterodera glycines
gttgggcgctcacggtagggcgccagcatgcttttccactataactttttttttgccatccaaatccaacaaccgtatattattcgaaactcttaacattctctattaaatttacaaaaggcgaaaagtctcaagcctggaaaaatttattaagaaaatatgttaagctttctaaaatatcaagattgatgtatttgtatggcaaagaaaaaagttatagtggaaagcatgctgggccccaaacgagcgggcccaattgaggtaaaccgtattttttcaatgaaaaatattggagatttttttaaacaatttttaccatttcgaacatcaaacgcaattgtcgaaaatgttcatttgccaaaaattcgatgaaatatttgacactaagtgaagtgctttcttgaccaagcaatacacgagcagtggcctttcttattttgcctagcggtccctcgccggggttgtgcagttcagcggcttgctgaataaaatgtcgaaaaatgggtcacaaaaaatcgaaaatttgttactacactaattaaaccaaacattcgggctaatttagccttaaggagagaaaagatcgaatatagaaagttttcccattgaaaaaaagccgaatatgtaatgtggaaaaaatgtgcaaagttttacctcaaggctgaaagtgtcattatttctaaatttgcctttttgtcgaatgttgacggatttttcaaaatttatcaattttaattaaaaatatattttaagaaattttctatttttctctaggatcgccgatgggcatgccgaatactacccctttttgatattttttgggttttgggtagcaaattgaaatctaaaatttaaaaaactcgctgcttgtgcaagttctttgacagaaggaagaaacatgagggtccgtttgctgttatttgtcttaagcccggaattttgaaaaattcaggctcaggatcgaaggtgaaaaatatcccggcagaagagccttgtcctgtttgtccacactcacttcttccgcccgctcacagtttggcacaaaatccgttcgttcgttgcgatttccctccaacaaatccaacgccagcctttccacatcgccgtgcagctcatcttttaaacggtcacgcaaactcttcgcctttgattttttctggttacggtgaccgtactgctcattgtaacaacgcataattgccaacatttctgcattactttgctccaccaaaatctgcaaaaaaggaaactatgatgaccaatggagaaagactgaaatttaataaaacgtaaaaattttggatgatcaagaagaacaagagtgaatcaatttgttactgatcccgccttaaagataaatattgacctttataattgctgcaggattagcgccgacaccctaaaattacaaaatattaaaagattatacgaaaaaataaaaaataaatttcacatggactccagcgtaaatttgatctgccttttgtttcacattttcatattccctttgatagtaatactttgggcataacttattcttaagacaatattgataataattttggagtattgatttaatataaatttaattacaaataatgaaattattagtattatccaattatatttcaaaatccgagaatctggaatttcatggaattatttctggcaaaattttgtagatatacagtatttgtatttggcagttaatttaattgaaaaatcagtgtcattgtttaatattaattttttcattattttggcgttttaaagtcaattctgaggatttaaagtcatttttggggagtgtttagccatattgggccattttcagctttttccacgttttggattttttagtccacatttatgtccctccctgttaggcgtttttattaatccatgcaaacacggaccctatttataattaaaaagtacacataaactaattaaaaagttattattattcaaaaaagaaagcattaataaataaaatcaaatttattttcatcgtattatcataagaatttccatgatagagtgaggtgtgccgcaagggcgtagccagacccttggcttcagggggggggggttgaagtgaaaaaattcggtttttaggggtgtatttttcttttaatttttaagggcttgtttttcttttttgattttttggtatatttggcgttttttagcaatatataaatcctttccctgcttataattttcaaaaaatttgctgaaaatttttatttttttggatttcggggg

SEQ ID NO: 22595 - DNA, 981 bp, Heterodera glycines
cgccgaacatcacgcattttgagcagttgcaattcattcagtttgaagtggaaaagttaggcaaacaacaaggcaattttgtgaaggtgttggtgctttcgctgaccgaagcatcgaaaaggtcaaagagcagttttattaatgacctaaataccgtatttcctaaaacacagcccccctaaattaaatcccccctaaaataaagccccccttaccattttaggggggttgcaaaataaagactcaggatctattttaggaaatacgataatataaaatttatattaagtgtaaagtttgcatcaaaattaatttaccagtccaattaaatgattttttaaaacaacataaaaatgttgaattaaaaatatttttgaattaatacacttaaaatattttaaataatttttaagtattttctttatttatttttagaatttcgcttgacgaaagcggcgacttttcattgtatttggacggcacaaaacgtgtggcattggtgcacattgctgacggcaatgtgccgcatgagtacccaacggagcacgaatggacggcacggacaacgatcgagcgatcaaatgccattttgtcgccaaacattcgcttccacctgagcagcaccaagaaaattcagcaggtccagccaaattaatttttcaaaaaatactctaatttcatcccattcaaacaaaaaatttaaaattgtcaaattaacaaatcatttaataaatgtttaaatatatctttaaatataatttaggtgttggccaagcctggcatggtggaacgcttctttcccaacgatccgaaacgtgtgtcactgatccgcagcacattcaccggactgtggggccttgaggttgaagacgaggcgacccgagaagtgattgaggtagtgaaatgtgccaaaaacaaataaatcttcatttaattcttttttcgacaaaaaatggcatgacgatgcttaaaagcaatcta

SEQ ID NO: 22596 - DNA, 1272 bp, Heterodera glycines
  misc_feature (12)..(13): n is a, c, g, or t
tctagagtcacnntgatttggaagagttgtggggaatgaatatgcggcattgttttgttcagaatcccaaggcattgatgccttggaaaccgaccaagagtgtgcttcctccgcaaactcgcaattccgtcctttcgtgggaggatcaacggaattatgtggcaataattcacaatttgctaaagtcaactccaacattccgatttgaacacgacatgaaaaaaataaaggttggaacctaagcttatatgtatttaaatgactttttgtaggcttgggatgagcttttaagagaagagcgccaactctacttggacactgctcttcggtcaaccaaagcctccaaaaattacccatattcgctcttcgtttatccgggtttctcttcacttaacactgttgtggtttgttttatctttgttaaattaccgtgaattttttttttcattttttagaatcaccaactcagaaagtcactttcccagctggccgatcgcgcatttcaaggcgttttattggaaattccctggacaaatgagcaacctcacaatctgcagcaatcagttgcattgcgcttcaatgtgtctgttttgcagccgggcaatgggaagccaattgtaataccagacatacgacaacgatgcgaaataaaactggacaacaaaactattcaaaaaagcatttcggttaaattagacaaaaaggtaagtaagcactgatcttattcttagataataaactgaaaaaatacaaattcggcaaatgaaatcttgccaaaattttatttattttgctcatttatcgtactatttgtcgcctgtagtcaaaatgcaacgactaattaaagttcaatttgaggtgcgtttaacaaatgatgaggttatgaaaagtctatcgtttcaaaatgacgtcgaatttttgatggatggcagcactttccgtcatcttttgtctgctccctatggccagcgacctcaaccttcatatgcatgtcgcgtaagcattcaattggaattcactggaggtaattttttgacgtccggaaacaggtcatttcgactatttactccaattttaggaaaaattcgcaaggtttgctcaatttttccaccaattatcgcttctcgaatgcatcggccctttgtcgttcgtgaatattttaaatgggcggtcaaattggcattggccgaaggcagaaaatcatcagatgatgagagaacagtgcccgagacaggagggccaaaaggcacagtccgtcgattcgttgttgga

SEQ ID NO: 22597 - DNA, 1958 bp, Heterodera glycines
  misc_feature (1906)..(1906): n is a, c, g, or t
  misc_feature (1946)..(1946): n is a, c, g, or t
tgttttaggaaaatagcgaacccaagtaaatggaaacttttgattttgtatattaatttatttgtcaatcgctcgatgagaaaagtcgaatcgcgaaacttttagctgtcggcaataactttaaacaaagttacagacccgggactaaattgtccatttacctgtggggctgaaccttcaatgcaaaaaagcactaatgtccgacaattatgcataattagataattactagggatgggaatttaggcacaaaaaaaacgttaattaggcatataaaaaagcagaaaatcgcaaaataagcgctagataggcacagaaataggcaaaaaaataatgctttttaggagcaaaacacaaaaacttccggtcccgacttatcacttctgctggttccacatgttttttgtattagaatgcgatcactaatcagtagggattcttttttatgtaaaaacagtgtggaacaaaagtatatgtatttatgtaggtaaacacgaaagtttttcgccaaattcaattttaacattttacacaattagaaaaaacactttcttttttgtgtttgcgaacaaaagttgtaacttttatttatatattttacatatttacggggtttctatatattatatatgtaaatatttttatacaactctttcacattttttgcacatattttgcaatttttagctattttgaagatttttgagaattatagtaatttcttgtgaaaaataaaattttttaaatgtactcctaaaaaatcaatcaaaaattaacttttaaaatagtaaaatgtgattctgcgccatttaggtaacaattttgtgctattttgttcctatttcaccctttacgaggaattttttttctaaaaaataaccatttttaaaattttatttacattttgtacatatttcatacatactttagctatacttttgcgtttttcataaaaaagaatcccttgtaatacgaaaaaacgaaatcagaggaagaagcatttgcttttttgctaatggtcaatctaaaaaatgaaaaaataaatgcaaaacaactaaaataacccacagtaagcgcattattctcttcaagttcactgagcatctgagcggaccaaacacggtaatcaaattcctttgtcttaacaaaaagaatcattatttgcatttaaaactatgacttttgatagagaattttttgctgattcatttaaagtcttgcacaacaaattctaatatctgtcttctgcttttaattttgataaaacaacttaataatcggtaaataaagcggaattggctaattaaggatcgatgcgggcctttaatacggtagttatcctttttaaattttgctaattggtaagctctaattttttgtttcttaacatgttttttaatttttcaaatttgttaagtttgcgaaagtgttttgactcgaatatatttttaggaaatagtccgtatatgtcgaaaatatttttttaagttttagtttactgtcggattgtccagtacggtgtttagtatgagtttagaatttttttttataaatctttaaaacctaaatattttctcacgttttttgaaacgttgaccgatttttctgatcatttggggagggggtcatgcggagcaggacaaaactcagccgccgaaattcagccgaccgaaactcagttagttacagtcaggggtgcgatcgaaaatttttcaaaatcaggacatcgggcccaaaaaatcagattttggggtcgaaaattaggacttgcacaaatcttatgtattcttgataaaatagtgccattctgccataaatttttcaaaattatgagtttattttaaaaatcagaacaagttttggtcgctacctccaaaccaggacagatcgcacccctggtacacangttcgtgtggttcccttgtgataaatacactaattttttntcatcccccccc

SEQ ID NO: 22598 - DNA, 2430 bp, Heterodera glycines
  misc_feature (2096)..(2096): n is a, c, g, or t
tctccagaaaggggggtgggggtaaataaagacagggggataaaaggagacggggcgatacttagagataatacggtatgtaaagagttctttttcccgatgcacagtttgcgccgcgatgctaatcaatcggcttaacaagatgcaatggtttcgcgcacgtccatggctttctcggttaattcaggcggcactgtgcggattgtttctcgcttttacgacaccgttgggttgtgtacttagtactgtgaaggtagtaagaatttcggaaacaaaaattagcaaaaattggcacaatttaattggtctttttgttgcgtggcgcagttggagctcgaattgcaggaacaaattcgtcagaaatttgtggccaaaaatgtgccagtgcctgaattggtctattacaacaagggcttgtgagaacagagatgaaagagagagatgaaagagaaagaatggatgaatgctattatgccaacaattattgtgatataaatgctgtaaatatgtgataatcaacaatattattattattatagggtatactgttgtttgtatataatattgattgttccatatcatatgaagatgaataatatataccggtaatttttttaatgttgaattaaccgctgacccacaaaatgtccaagccacgaaatgtccaagccacgaattgtccaagccacgaaatgtccaagccacgaaatgtccaaaagagtaaaaacccacgaagtgtccaaaactcgaaaaagctattaaaaagccggaaaatgggtctaaattaaggttttcggggtcgctgaatacgaatacgacatttatataacccatttcctaaccccagacacaatataaacataaaatagcaaaaaaaattcgaagctcctaaaaagagtgctgatcaaaattcgaacaagttttagggctcctatgtgatccgaattctctctatagacccaccctcagcttcacacattgaaaaaaataattttattaaacattcaataaaattcattacggaacacggacattgaatcatcacatttttcgaatccttcaattttaatgcatatccctcaatttgaaaaaaagtgccggcggaattggaaaatgtggtgcccgaacgatttcgtcctcccatgctggaacagaatttttttttattaaatttaaacggatgaattgattaaataattctgcctgaaggcgctgccgaagtcgatagcgggctcaacgagtattgaacaagctgctcccgtggactcacagtggttggccatgtaagagttgatggtgccggtgccgaactctaggggtagccgcatagcttgttccgagttgatagtcgaaattattgtcccgagtgtagctaaaaattttagtttttggaaataaatgcctaaatctaacaaacaatggttgccggtgggtgaaaattgagtggattatctcaaaatgcgtcaacaccatccaacttctggcgctgtgtcaagccgatatatgttcgagagaagtaaaggaagaacattggcattccaggagaagacggccaagataattgagaaaaactcgatttgtgcatcttcagcaatttcctgagtggtgtgtgaatctaaatcctgaatagtttggaaataaattttttgcggcgcttcaaacatacctttcaaccatagacaatctcacccaaaattggtttttccgcgctcaaaggtcattgttgaaagttcagcctcgttcaaagtctgttgttcaacattgtcggaagttatcacggcatgcagttcgtcaatctccactccaaaatttacggcctcctcagttgggtttgaaatgctgacaaacaaagcttcttccgacttttttgtagactttctagtttattacgaatcatttgttcaattaatgaatagcaaaatctgaagacaaaaaaagcacatatttttaatcaaatttggagatttttcttattcgggtgggtctagggttaggcaaggggctatataaatgtcgtattggtattcagcgaccccgaaaaccctaaaatagacccattttccggctttttatgagctttttagactttggacaanttcgtgggtttttactcttttggacaattcgtggcttggacaattcgtggcttggacaaaacgtggcttggacaattcgtggcttggacaattcgtggcttgaacaattcgtggcttggacactttgtgggggcgccgtaatttttgcatataaacaaaaaaaattatgaataaacaattttcaaatttttggcataatgtaaccgaaaattggcagaaattttacatttttcaaaatttcccctgggcggcgcctgtcgacaccgccggactattttcaactatttctacttgcttgtgaacaaaaaatttattatgaaatattcaacaaaaa

SEQ ID NO: 22599 - DNA, 2388 bp, Heterodera glycines
  misc_feature (1417)..(1417): n is a, c, g, or t
  misc_feature (1430)..(1430): n is a, c, g, or t
tttctttcctttattcccttgtcaattgggttcgttaatcccccccccccccctctcaattcttctcggcttttccccctcgtccattctcccttttcctttcttgtttcaccctcactcattctctcccccttcctccatttactctcccccccccccttcgccctctcccattctctctccccccccccattctctatcctcccctctcggcttttcctccccctacagtttgtctgtccctctctcattaccccattttgttttgtccctttttctctgtcagcataataactctctttctttcatactttctttgtctttcctttttgcctctcccatttgcttctgactctttttctttctttcctttacccattattaattcaaaacctaaaccatcgcatttcacgcgcctttttgaagtaaaattaagaaaacatcatcggaaccactgctttaagtaatataaaaaggaaaacaaatatgccaaagacgagaacattcttttgactgtttcgcctgtgaacggtttactttcattggcatttcatttattcaattcggtcacttccactggcatttccttccatctctttcttccgttctcgtacttttgcttttcgggatcaatccatgcgcggatggttcacgagcgtcttagcggtcttagcggcacttacaccgccagtcgcttttccgctggcggtgcgttggcgacagcagcaaatgacccaatgatgtccgacttcatggattattacttagtgcacaaaaggtgccaatgccaaaaaggcggaaattcattagaaaacagaaagagaaacggaaattgtcaattcttaagtcaaaatttgaggaaaagtggcaaaatccaaagaaagagacaaaatgagacaaaggcttaaaagaagagagtcggaagtatgaaaaataaaaataatcattaggtattaatttcaattggtctgcagtcattttgcccttttccaattcagtgaatcgtacaaattcatccgaatggccgacgatttgcacgacgtcgccagttacctcaatgaaatgcgaatttgctttcttttgctcaccggcacagttcgtagcacaaactctgcccgtttactctcaattcttttaggtttacctcattttggccatttattttgtgagttggtgcgtacggagaaatcgtcgccaagtgaacggcggcggaggtgcgaatcgcccgaggggtgccaaccaccgctgggatttgcaggtggagaaaggcacagcggcgaatgccgacaatcaatcagcagttgaataacgaatggttacagggcgatgagtaccaaaacgcagtcaatgctcagaccaatattggccaaacttcggatgatttggtttcggtgcgaagtgacggcgcattgcctgnggccaaaggcggngcgcccgccagcattggcacgacggcaccgcagttcggcatgagcacacgagcgggggcagccagacaaacgccctcttttatgaggcatagcggaacgggcggtggcatggccatgcaaaatcacaggtgggagcggagggcgacgggaagcggccgatgcgcagaaattcgaaaagccatctgaaaaaggcatttagctttgtttttgacttttccgttttgccaaaatacggcggggagagatggggagggagggattgtttagcattgagcagacatttgaagaaggttgtagtggagggatcaatgcaagcgccgccaccctgcagctcggccccacgtcgaccacgaggctaatcgcggactcggccggcaatgtgaccacaaaacagcagccgacgaacggcccaccccaccaccaacacatggccaatttggcaccggcacaacaccaacaccaccacatggcaacagcgcatcagcaccaaatacacacgaacaatggggggacggagcagcaacagacgcaccaaatggcacagggcaaaacgactgaaaaaggcagcgcaacgacaagcgcatgtctgctgaacaacatttcggaggaccaccggcacacgcacacaatgccaacgacgggtattcccaccttcggagtccgctccagggagcgagtgctgctggaaaggcacgagttgcagccgaacaacggcgccggcggtgccgaattgtgacggacgaaatggtggaggccatttcaagaagagctttatcttttgttaattgtctatctcattattgccaattagccccattcattttctttcttatttttggataccgtatttgccaatccttttttgttactatgtttctctcttcctctctctctcccctctctctttctctcctctctctcgctctctctcccttctctctccctcccattcccctta

SEQ ID NO: 22600 - DNA, 1918 bp, Heterodera glycines
ctttgcaaatgctcaaagaacgactccacaaacgaaccattgagcaccaaatccgaattgaagtgcgtaattaatttggagtgaccaatcagcaaatcaattaactactcattagtactaatcattcttctcccctcaaggaaatgtccgctcgttgtctgagggtatttcgggacagattggcatcgcttgaggcgcaattggaaagcgcaattcagaaaagggaggcggagagactgaatgggttggaacggaaggaatacagcgaactgcggaaagtctgttcaaaaggccaaatggatcccgcataaaatgtaccattgtttgaggagttggaacaattcgacaaaacattggccaagtcggcgaatggcactgatcagaaggcacattggccaaggaaatgggcgaaacgattccaacaattacacaataatttaaacattttcggcaacaatttggccaatgcgaaagtaagtgccaaaaagggaattgcaattaattaattaattaatgagaaatgccaaattgttgagattgccattggagcgagggaagaacggaaggaactcaaattggtgcatcatttgagtgcatttgggaaatggcttgatttggtgcgttttatttatttgaattttctggttaagcgaaggggcggagaaagggtaaatttggggttaagaaaccaattgtatgcatttttacactctcgtgattcttgttgttttggaatgcatttaattaaattaattactgtccccacttccatgtcattaattaatttcggctcggagggtcagtcaaaaaaataattaaaatgattagtcagccggggggggggcgttaagtgtggggcgaaattgagaagaaagcgctgcgggagggaatgtttgcctttctttgcccgtccaacttttgtttttgctgtgatcagatcgaacatgagatgctccaattgcactcccccgatcagtcagctgatccctttgaaagtgatcggagtgagagacgcgtcaaattgaccaaactgcgtgacaattgcgtacaacacttccgactggtgggccgaatctgtgaaaactcagcacattcattttccatactttttttaaaaatttaatttgattggaaacccaattttgggatttgtgaatttaattttgaggtgttttagcataacgaattaacaaaaaacttatcttttgaatttttattttttgcaaaaattaacgaaatgtttacccttttcatgagcacatttttaggaaccaaacatcaaaaagggccaactgacaaagagaattcaaatcgatttgagaaagaattttgctgaattgaatggccaattcaattttcaataataataatatacatttataaaacatagagatgctctcctaaaagatgaattaaattatttttattttttgaatttaaattttgcttcaacaaattccccccccccttttcccttttttaggtcgttaaattgcaaacgcaccaatttgccagtgaagaacaagccgaacaagcacacacattgtgtcagcagtacagaaaagtgatggagcagttcgagaagatgcgattgccaatttcacatttgattcccgtgaaaaaagcggaggaaacgcacgacggaaacggcgacaataaaagcggcggaggaattacggagagagcgcagtcgcaggtggtgccaaagagagggacggaagggcatacaatcattctcaatttggcactttttgccgttgccatagacaaacagttttcctggatgcagacaccttccaaacatatttttttgttttaaaatttggtttttttttaaattggcgttttgttttggcccctttctttccggtatgaaatatgaatgccattctttgcatttgccattgtcagctctcct

SEQ ID NO: 22601 - DNA, 2404 bp, Heterodera glycines
gggtcataaaaagtttaaaaaataggtataaatccagcaaataaaattctaagtaaggatttagagtaatttaaaaatgtgggtgggcgctcgcgctatataaataagtgcgcgtgtccccatcggcccatttcaatttattcctgtcaaacatttggccatcagtttttcatgtcggataaaaaagcattgtttaagcgtgttatcgcagaggtggacctcactataagcacgggcggcataactttgagcggcccccgcctgtctgttccccgtttcattccgtttgaggaaaacgggcgttgccgagcatgtaaaggaactgaggctgaggtggacacaatggtcaccaaggagggaatcaccttatggtgcacacgcatagaaaaagcgcagtttgtcccttttgacattgtctacgagctccccggtcattgttttttccgcgtgaaaaataaggcaagggtgttcagcgttccgtacagcgaactgccgtcctcagacaggtgcgcccagcctctacccccaccaccaccaccaccaccaccaatgacaacagcaaaacatcaacggacaccggacgacgaggaggagaagaatttgaggcgtaaggcaaaggtggcgcttgacttagtggaagctggtctagcggcagacgcaatgatgcaggatgggacgcgttggaagaaagccaaaaccgcgatcaatgtgctggccaatttgcttttggcggaatcattaacagatgtctcgccaacttttgatcaacaacaacaacaacaacagctatcgtcaaaagaggaggagaagagggaggaatgcacaaacaacagcagtgctgcagcaacaactgaatctgctcccgatggtgatgtaatggacgatttcgtcaatagcattcaagcggcgacaagcaatatgcaatagcaaagcgtaaaactgataaactcgctctgccctatatataaaagttgttgattgctgcacgatttgtcataatttttgaaaatgttaaattctcaatcgttcagtaataaagatatttgtttcaaattgccttgcggtataattatttccgggccatcctcgtcgggcaaaacggaattcctactaaaatttattgctgagtgcaatgaactgatcgcacccagtcccatctcaattctgtactgttttggtgagatgaattcggcggtgccgctactacaaaaggcgggagttgaggtgtattcgggcgtaccttcggaggagctgattaggcgccttcccaaaccgatgctgctcattctcgacgatctgatgctgtcaatagaggagcgctatctgtccgatttgttcaccaaaaaatcccatcaccatcagtttacggtagtgttcatcactcagaatctgtttgagcggaagatcaaggtggctcgcctttcggcgcagtatttggtgctaatgcgcgcgcccaactcgctgctgtccattcgaaatattggagttcagctttttccgcgtcaactcgattttttccttgacgcctaccgcaaggcgaccgcccgcccctatggctatttgctaatcgatatgcacgcatcatctgatccggcgcttcgcctccgcaccaacatatttaaagaggagcaggaggaggacgagggaacagttgtgttcattcccaaaaatggagcggtataaacggcaacaacaacgacaacaacaacaacaacaacaagctaaagttactcaactaataaaagataatgccaactggctttgcgcactgtcgaaggcaaaatgtgtgaaacgatgcgggagactgatcagaaaggcgaacactgatcagctgctgtcactggtggaagtgtgcttgaacattgttgcttcctgattcagactgacaactcggcagaagaaacgactaatgccctacgtggacacggtgcgccgcgtgagtgagcgagaagtgagagggacgctaagcgagcgcttgtcatccagaaaggagaggggtttggcggactatttgcagcccttttaacccccgtattaattgaattggccaaatcggttgtgacccgaaaagaaaggaatatgcggacagaccaacaaaagttgagctgaccagggaaataagtgtaatgatgaatagaggtggcgaaggcttagataaatcatgcaaagtttaaataatcacaaaatacaagtaatatacatagccgaatttaaaaaaaatataaattacaaatatttttgatacagcaaaaaattaaaattaaatccagattagcgagtgataaaaaacttacaattgttaaactgcccatttgatttttgaccaaataaactaaaaaaaattagtcttagaaattaaagagaagtttgatgtttctaaaaatattttcataaaataatcaaa

SEQ ID NO: 22602 - DNA, 1680 bp, Heterodera glycines
  misc_feature (959)..(959): n is a, c, g, or t
  misc_feature (992)..(993): n is a, c, g, or t
  misc_feature (1061)..(1061): n is a, c, g, or t
gcctaccagaatttccgaagccggagtttgagaagccgtcatttccgaagccgccgccaccgcccgaagtgggactggtgacggaaggacgacgctccgattgaccgaatccaccgccagcgttgttgaagaagccaccgcccccgtcgctgtcctgacgattctgtcgaccgaatccgccgccacctccgcccccgcggcctccaccgcgtcccccgcctccgccgtcgttccaacgattgcctctcccaccgcgacggttgccatccgactgattctgtgtgtcgccaaagccttgaaatgacaatgatgagtgggcgggagccccgacttttgtggccctgacatttgcgcctatgtccaaaatcgtattcaaagttgaattctgtcaagccctgatagcttaaacagaattaaaattaagaaaacactgtcttctagtttatcaggaccattaattctgaagtcgagacacgagcgggcgctaaggaagaattttaatttttttttttttctatggcgacgtcctttttctacttttaatccacttttttttgcggcgcattttcccaaatttttttttagaaacaggaggggtctggcagtgctggtaggccttacacctctgcctccctttcctcttgtacgactatttggccgtataattaaaaagtttcgttttatttcatcataaaaactaatttttcgttcattataaataacaaatttctaatgctcatccaaaataagtcatatcaccaagaaatggcccaaatatgaagaacattcatttaatttttatatcaagtgcataatgtaaattcccaactttctccttgtctgtctgttcatcccatcccaagccaatcctccccctttcattccaaaggtatcgtgccatttttatcccattcacctcttgtgcataatatgccattcatttctctctcattttcttngtgtttttgcctcattacccctcatcctacccnnaagtcatcccattttgccagtatctaagtctatttcatcttttcctatttcgcaaatttctgcaaaantgaatttcgttttcctatttcgtaattttttttacgaaatatacattttttagtgaaaattggtaataaaattttttgaagttctaaaatcgcaaaaaatcggggcgttcttgactggaattttccggggggggtatttttcccccgcggggccccccccccctcccttaaccaaaagttttttagaaaaaaaccaaaaatgggtttcaaaaacaaaaaaaaacttttcggggttttttttcaaagaaaaattaaattgggcttttttggggatttttggcccccaaattccccaccggggtcgttgaaaaccctttctttcacacccccccccccgccagggggggtggggggagaagacccccccccctgaacccccccccccgtggggaagaaaaacccccccccctttttttttaatttttaaaaaaaaaacccccccccccccccccccccccccaccccccccccccccccccccttgttaaataaattttctcccccccccaacaaatattttttagtgtttgtggtgtgtggtgcccccccccaattaaataaaaaaaaaaaaaataaaataaaaaaacaaaaaaaaaaaaaatttttttttttttttttt

SEQ ID NO: 22603 - DNA, 2233 bp, Heterodera glycines
aaaacggatatgcgtgggagggcatcatccgatttatttgcccaagtccctaagtctgtcagcacgcgtcatggctagcaaagggattcagccccaggtccgctccgatgacaaagaaatttacaactttttcaatgtacacctaaaaagagtggttggacgggtcacgattttttaccatcttcggtttgatgatacattttccgttatgagcagccatttcgtgttggaatgctaatctaatgaaaattcacactttgtattttggttcgataaataattgcaagaattcgtgtcggaaagttaaaaggaataattatagcacacggtaatcaatcattttaatttaagttgtaaatttttaaaattggcggcaactttaaaggaaattttttttataaaacgaaaaataatcaatcattcttttaattaatttttattttaagttgtaaaatattttgaaaaagtcggtatgataaaaagaaatattttttaagcattaaataaataatttttgatttggccatctgttgacccggttgccaaataatagccattttcggagaaagaaatggcccccactgccccctgatgaccctcgtagtgggccataattttctgatttttgatgtcccaaaatttgatgacgccattttttccataagtgccaaagatgagcccgtcggggtgaaactggccacagcaaatgtacggcaaatcatcattggatttaacctgttaaaattttaaaatatttttaataaaatatgttgttctccgactgttctccgactttgaccaaagggcgtccagcattgagatcgattagcgaccaatgcgagtcctcagaggagcagagcacaaagtcgccagtcgggtggaacgacacgtcgttcacagctttgccatgaattgcaattgtgtggattgatgtacactgatctacactccaaattcggatcttaatgaaaaaattgattgggtaattgaaaacaaaatattcaaaaaaaagatataaaaccctttaaacagacctgcgaatcaaatgagccctagacaaatgtttcaatgcttggatgtaaacaaacttttgaaattttagccgaatgcccgataaaagtccttctttgggtgtcctcctcattaaatttgtttaatgtcacatatttgtcaacaccaccgcttaaaattaattgttctaaaaatatgtggagaattttaaaatgtgatttatattctgtttaaaaatacctggaaatcaacagtacaaattgcgccattatgtattccttgaaatgtcattccctcactaaatttttcaatttgttcgaccgttgccaacccctcgggcaattggacacgctgctgtcgcgcagtgaagaattccatatgtttaaaattaaagaactgaaaataatctgcaatttgtcaaaaaatttttaaattcgatatcgaaacgaaaaataattaattattttatttgcttttaaaactcttcgtaaatgcaaagaattcataaatttttaatcctgcactcccctcccccttctcacattgaccaactccttgccgattccacataattttgttttgcgatgctcgcgaagttgcgcaactctttgagcatattccataggaatttttttaaattttgatatgttgattgatcatgttgacaccacactcgctgattccacagttgacgctcgcagctctttcgctttatcacgcaattaacggtatttcttccctcctcgtttggtcttctttttaggaggaccatttgcctttaaacaaaattgagtaattgaaatgttaataattaattaattaacttacatcctccccaactacaataaggtgatcatcatcaccatcatcaccaccaccaccatccgcagcagatgccagggcacttcctaataaaaacggctcctcaataatttcgtcaacctcgtccaattctgcatgtgcctctttattttttgatggaaaaatttttccaaggattccgcgtccttaatttcatgcaatggaaaagaatttataaaatgcaatactaaacaatcttctccaatccatgagatgcccggaccccatccacagtccatactccccgaacaattccacaaatttttataataagcaaagtcattggcacattcatcgcaatgcacaactgctggaccaatggaatattttttaaaaatattctggctgtaggggctcggaa

SEQ ID NO: 22604 - DNA, 971 bp, Heterodera glycines
ctttgacggtggcgatggacaacggacggagacggaagaggagaaacgaaagacattggaagcagcaaagcctaagaaaatggaaagggaggaaaagagaaaaagaaggaaaagagagggaaagggaaaggaggaaaagaagggaaggtaaaaataaaaaaaattattttgtggaaagaaagtgcgttcttcagccatttaaccctccgtttttcttcgtgcgttcgtcccacgtccattgatcgtctcccccccccatccgatcattttgctgtttttatctcttcattcattcctcgtccactttctcactgtcctctctctctctctgctcatttccattttccattatttttcactaatcgatttcattttcttccttttatggtaaatgaatggcatttcctgttaagtcagctgattttaacaaatgctttttcattccttttgttcctcaaaatatgtgaaactttgtcgataaaaagaaatgggcaaatgctatgcgtcgggtgagaatcgaacccacgccgcctccacccggccaatgtggagtttttaccattgagctaacgaagcacatccgccctttttgtgtttcttaccaatcccacccactttcggcattttggctgatcaccgctttttccttacattattatgcgctgcttcttcccccgtgtcgtccgaagtgttttcccctcgcccctttccttcgtccgttcctctctctccactttttatcccatcgatgaccaattgttcggtttggacgaggaacaacgacaggtgttcggacttttttctgatagtttctccattccttccgttagcttcgtcaattggtctttcgactcgctcaaaaggaattggccccttttgctgatgaattgaccgtcaaaatgaattcacaaaacttcgcgatttttggcgattgcttggtcaacaggccttttgtgggtcacagtgccagc

SEQ ID NO: 22605 - DNA, 1359 bp, Heterodera glycines
ccccccccccctcccgcagactgatgcaagccgcttgtgacgtcgccttcgaatatgcccattcgcgcattgccttcagcagtcccatcggcacatttcaggcaaagcccaagtgcctttggcaatcgcatggacacgcccattttcagctaatgcaaggcaaattagcggatatgtacgtgcgtttgtccgcttccagggcgtatttatacgcagtggcaaaaaatgcggcggactcagacgaaggattaaacgcaaaagtttgtcaacttctgacaactttgtgatcaaacacttattataaaggattctgctggaacgatcctttttttggccgaaaatgcaacacaaatggcattggacgccattcaggtcaaataaacaggggggggggggtgaccaaaggatgtaccgacgcagcaaccgatcaggtgctgggagggaacggctacatcaacgattaccccacgggacggctgcttagagatgcgaaattgtacgaaattggggcagggacgtcagaagtacgtcggttggtgatcggaagagcattgaacagagaatatatgaaaaagtgattgcatcaaagggaattggagcggaaatgggaaaattctgtccgatcggccgcctttcactctcacactgacaatgggcagtgtcgtcatttgtgtcactccgttatcttttccaaatgttctgtgtaaatctttgggtgatcaatcgccaactttctctgtctgtttgtccgtctctccatttttcttttctcatcgttcctttttctcttcattttctctcttctgaactccttccgaatctgatcagtggtgcggcatctgtccgaatataagctcgtttcccgaaccgaatcagaggggccgccctttccgctggtcgacggccgaatcgcatcaatgggacgacagttgaccgttttccaaaatgatcggcggaaggcttaaaatggggggggatgattgggatggcacgccgactgacccatcggagcagaaattgtcgcccttcggggcgtttttggaaatcattggctttggcgacggacggcgtccgcttcataaacgaccagggctggtagaacattcgctttccgccttaatccaagccaaagtgttcactttttctttgttttgtcacctctttcctccataattctcatttctgacgattcgtaactttgcgaattgactgaaagcagcgaaaggaaaagaagggacaaaagggagagaaaagggggagggggacggacgaagaagcgaaggggacgaagcgacggacaacggcgaaacattggcaaaaacggaacggaaagaagggaagcgcaaaggagacgaagga

SEQ ID NO: 22606 - DNA, 1604 bp, Heterodera glycines
taagggcttttgaatcagaccaagaatggtgtatttcggttaacaaagaaaaatgctatgatactcaaaacttggctgggacagagttggcgtgagggatttggcccgtcctcgcaccagggatggcacggaattcgattttcaatttccaaaattttttaggccctcggaatgccatccatccctgtcccgcaccatacacagaattttttttttaaagatgtgtacaaaatgccacttgtcaccgacatcacagtttggcaggggccgaacacggaagagaaaatgatgcgcgaaattatgacaaatgggccagtccaagttgcatacaacatttacgaagatttccatcgctgttgcgcaaacggcgaaatatatcaagtaaccataggggagattttggcgatatgtaaaaggagtaggactccgatttccgaaattttttggcttcaaaatgcctattttgctttcattttgggcgcctcggaatgccagccatcccttttatatataatataaatacatatttattgaaatttttaaaaatgcacgtttatactgtagcaattgctttaattagaaaaaaattttgattaatattttctgctaaactactatattatcggcccggtacagtatgacacaaaaatatattggcatatccaatttgtgaaaaattttatctgctattgatcagactgttttttagaagggatttttctaacaatatgtgggtggaatgtagtttttttattttaatttgtaatctttttaaaatgtatattaaatattcttaaaattttaattccgatgtaatttttgttgctgaaccaaaaatatattggaaaattttagaaaaaaaaataattcagataagtaatacatagaatttttttaaaaattcggtatgcctaggtaattttgtgtcacactgtaacacttctctctaccgtacttaaacctaattttatgtagcacggtgtcaacagtacaaaaactgaattcgcacattcggtgacggcaattggttggggtgaagcgaacggtaccaaatatgggctgcttgccaacacgtggggcacagagttaaaccgagcaactaattattagggcttcctttttacaggcaaatatgcctaaattttctgcgcattcatacgctcaaaataagcacgaaaaacgcgttttccttggtttgggatttctacggtaacttttataatgcctatttttgcctgttccggcatttttgtgtctaatgtgccaattttggaaaaaatccttaacaaaattgctataaaaatgaaaaacacactcctaagaaatgactaacaaaagtttcagaaaatactcccctaaaaattgaaaataaattttcccaaattaattagtttttggtttaataatttgtccttattcggaataaactttaaatctattaaataattttatttacaatttgagatatttaagtttttacgtgttttactacctaaagacgataataataatatttttttgcctatttcttgattttgtgcataaaaaggaagccctcctactaaattatttaatatttacttaaacaaaaaaatttcttctgc

SEQ ID NO: 22607 - DNA, 1000 bp, Heterodera glycines
caaaacttaataataatttcgtttatttgaaattgaataaatattcgataacttatgctttctttggtaaagatttatttatatgtggttaagtaacttgtgcacattttgtacttttatgcgttggtatatcccccaaatatgtaattgtttttttatgcatttttgtacattttatatgcttattctatctattgtggcttttggatctagaaggattgtttttgggcaaagtccgataaaaggctaaatttttccaaaacgccacaaaataacaatattttgatgagaatttattaaaaattctggctaacatttccaattttcccggcgacgcacgtcagcggaacctaattacttaattaatttcgcgaaatttagttaaaaaaatggactattactgaaataaagataattaaaaaagcaaaaatttgttagaaatgccttaaaaaattgtttttttttattaaatttataatcgatttaagtatacaaggcaaaattttttaaataattctcgagtcatggaaaatttgcactactgtttagttagcatttaatggttcatttaattttttggcaacatgagtttttttgggcctggatttttgtccaggaaatccaggtccgggatttttacaaaataccgttctctaataaataggtatgtgttttcaattacgggtgcggaaaattgaaaacaacacatttgttgttgttgttttttttcattatacaaaatgaacattttgcaaatttggaagaaacggtcgtgccaatagtcgtcgacagggaaaattttttgtaattttaatgcaattagttaaaaaaagattttgatgaaataaagaaaatttccaacagtggacaatccgtcaatgaaaatccatccgtcagcaaaatttatttatagaattcaaagcttgttttaattactaaaaaaagttaaaatgatcatagttaaaaattttcggaataatttatgtagaagaaaaattaa

SEQ ID NO: 22608 - DNA, 1480 bp, Heterodera glycines
  misc_feature (43)..(43): n is a, c, g, or t
  misc_feature (147)..(147): n is a, c, g, or t
  misc_feature (167)..(167): n is a, c, g, or t
  misc_feature (1473)..(1473): n is a, c, g, or t
atcatcaaaatgtcggtgaattcaagggcatgagattgattgnaaattaaccatatggtgaatagggtcacaaatccattaacttatagactataaaaccgaaaattgtgagccgtatattcattcgttcattcgtaatattaaatntaattttatttagatcaatnttattcaaataatttcgcaaatgtctaagcaatgtaaaaattttcaataatagatgtatgaataatttttttctctctagctcaagctgtgtttgagcgctcaccaactcctgactctgagctcaacgaattatcggcatggtacgaaatattggaggatgacgacgacaacgtaaaaaaattttttgttgtaaattgtatttcataaattattttattccagattttacattggttcaccccaaagaaggcgcgtgacgtgtgccaggaggttttggaatttgcacaagaacgaggaatgccttgcgagaagttgaccaaatggatgaaaattctcaacaaaatttgcgccccacgacttgaagaatcgaagtgacctgatctctttcaatgtgaagaaattcctctgtatttctctcaatgctaaataaaaattgtgaatttgagtagtgtaattgagaagggatgggtgggaagaatgtcattcggaactgtcacacgggactcagttctgagtgcccatcttcctccacttttttcaattctgtcttgtcaaaatgggcggggcttagccctttgacaagtgtatataaacagttggtattcatccattcatgtcatttcatttgaaaatttaaaattctgttaaatggctatcaatatgtccgacaaaagatcccttgtcaatcaaattctcgcccaatcggacatcactgtgacaacaagcggcataactgtgagcggtcctcgtctctccactccacggttcatacctttcgatgagtgtggtcgctgccgtgcatgtaaagcaaccgaagttgaggtggacctaatggtgaccaaagaggggatcaccttgtggtgcagtcggatcagcaaagcccaattcgtcccatttgatgtcgtttacgacctaccaggccactgcttcttccgtgtgaaaaacaaggccagagtgttcaatgtaccctatggagatttaccttctgacacgtgtacccccaccccgaccaccactccaacccaaggcacacaagccggagagcaacagcaggacttgaagcgaaaggcgaaggtagctcttgacttggtggaagctgggctaatggccgatgccatgcaggacggcacgcgttggaagaaggccaaaaccgcaatcaatgtgcttggaaatctccttttagcggaatctctggacaaaaaagtgacaaatagccctgtggaggaagaaaaggtgcaggaagagcccaaagaaaaagaggaaaacaaggaggaccttggagacattgacaaaacacttgatgangtcttca

SEQ ID NO: 22609 - DNA, 1246 bp, Heterodera glycines
  misc_feature (132)..(132): n is a, c, g, or t
  misc_feature (1151)..(1152): n is a, c, g, or t
  misc_feature (1193)..(1193): n is a, c, g, or t
  misc_feature (1211)..(1211): n is a, c, g, or t
gcgcagacgcgggatggtgcttcgcactgttgccgcggtggtggtggcgtacacgtaggcgccgccggccactttcttgtgacacttggaacaattccaaatcccgacacacactcgcttcatggcctcctntaagagagataaattattgtttttattttgaagattggtcatgaaatatttgagttcccgatgcaatgattaaacaaaatgatagttttctgggcttggacgtttgcaacccacagatttagtgtctttttgcacataataagtgcctcttatcccattgactttttcaagggtaattccaatcgtcaacacaaaaaaatataaaaatgatgttttgagcagttctgcaatgtaatttcaggttatcgaaaaacaactcacgctttgacaatgtattaaatgcaataagcaatttggatggtaattttgagaataagcaaattatttcacaaatttagggtccaaaattaatgtcagatgaatgatagtcattttcgaataactctgagcacatcgcaaaaccgctaaaaacagaatgacaatcccatggaatttaccatcttttgattagtgttttattgtatccgtcttcttgtcgctagcaaattgcaacataatgtgcggtatgcaaaccttgccgcagaatgcacatgtgtatttggcatgttgagacacctccatctttttgactgtcttccgcaacgaggcgccgtaccgagtgccgtacttcccgacaatgccgaccttttttgtgcgctttgcctaagcaattgaatatgaattaattgagttatcagtaatgctattccgttacaacttaccatttcttgttgtcggacgaaaccaaataaaaaagtgaattcaataaatttctgaaaaattaaaaatgtttttgtttaaaataaaatatggaatttgatgaaaagtggaatgaaatgaaaaactcaattagtcataccagctttaaatgtctctaacacatgaaaaatagcaattcacaaattataataatcttgattgtaaaggtacaaaaacactatggacatttagaatcaataaaaaatgattaatcttagcatttttgttagaaacggcggcctaggactttaagtataacgtgataaaaatttgaaactccnnacacttttttctgagatgtcaaattgcttagcattcacttnagaaaaagattctccttntcaaaaactttttttaaatatcaaatttgttcagt

SEQ ID NO: 22610 - DNA, 1711 bp, Heterodera glycines
gggactcaaatctccggcattccagacactgggactcaacccaccaactttcaatggcattccaatctctgggactcacccacccagcagcatttcaatctctgagaatcaacccaccagcatttcaatctctgggactcaacacaccagcatttcaatctctgttactcaaatctccggcattccagacactgggactcaacccaccagcatttcaatgtcattccaatctctgggactcaacccaccagcatttcaagctctgagactcaattctcaggctttccaatcgctgggactcaacccaccaacatttcaatctctgggactcaaatctccggcattccaaacactgggactcaacccaccaactttcaatggcattccaatctctgggactcaacccaccagcatttcaatctcggtgactcaaatctccggcattccagacactgggactcaacccaccagcatttcaatctctgagactcaattctcaggctttccaatcgctgggactcaacccaccagcatttcaatgtctgggactaaaatctccggcattccagacactgggactcaacccaccaactttcaatggcattccaatctctggggctcaacccaccagcatttcaatctctgagactcaacccaccagcatttcaatctctgggactcaacacaccagcatttcaatctctgggactcaaatctccggcattccagacactgggactcaacccaccagcattttaatttcattccaatctctgggactcaacccaccagcatttcaaactctgagactcaattctcaggctttccaatcgctggaactcaacccaccaacatttcaatctctgggactcaaatctccggcattccaaacactgggactcaacccaccaactttcaatggccttccaatctctgggactcaacccaccaactttcaatggccttccaatctctgggactcaacccaccagcatttcaatctctgggactcaacccaccagcatttcaatctctgagactcaattctcaggctttccaatcgctgggactcaacccaccagcatttcaatctctgggactcaaatctctggcattccaaacactgggacttaacccaccaactttcaatggcattccaatctctgggactcaacccaccagcatttcaatctctgggactcaacacaccagcatttcaatctctgggactcaaatctccggcattccagacactgggactcaacccaccaactttcaatggcattccaatctctgggactcaacccaccagcatttcaatctctgagactcaattctcaggctttccaatcgctgggactcaacccaccagcatttcaatctctgggactcaaatctctggcattccaaacactgggacttaacccaccaactttcaatggcattccaatctctgggactcaacccaccagcatttcaatctctgggactcaacccaccagcatttcaatctctgagactcaattctcaggctttccaatcgctgggactcaacccaccagcatttcaatctctgggactcaaatctcctgcattccagacactgggactcaacccaccaactttcaatggcattccaatctctgggactcaacccaccagcatttcaatctctgagactcaattctaaggctttccaatcgctgggact

SEQ ID NO: 22611 - DNA, 3522 bp, Heterodera glycines
  misc_feature (3454)..(3454): n is a, c, g, or t
  misc_feature (3494)..(3494): n is a, c, g, or t
tttgggaaagttttttcttgcaaaaaatccacgcaatcttttaatagtcgaaataacggttgatgctgacgatttttcattagaaaactgaaattattcacaattatttttagtttttacatatttcacttgcctttaaagtctctcgatgaaaaactcccaataaagggcacagttcgcgcaaaaaatcaaagtcggtaatttccaaatttggcaaattttctgcgacaatgtcgaggcgcgacttttttgatgggccaacaccgaatccacgtctttctccttcaatggttaaaagaacgtttttttgttcacgaaatgccatcatcatttcaaaagtcgaattccaacgggtcgggcaggccttaatttaaatgaagattttgaaaacattaatttataaaaccattatgagtttttttggcttcgaatttgtcttttcttggtacccgcggagcaaggacatgcccttacttgtacgaaaaaaggtaacccaagaccgaattttggaaataagtcctgccaactcaggcagtcccaatacgtctcccataacaagatgaagaaaatggcacacacattgaaagcttaaaaaataattataaaaaaactaaaatttggtaaaacctattcaagttcgaaatattggaggcccttatcatgttttttgcgttatcgcaaaccaaacaaattattttttctgggtttccatttgtccgaagtgaatttgcgatttcttctgctatgtaaattcccgtgtgatttgtcattggaatcacatcaagtacaaaatcggcgcgttcaaagtattcatttacatggtgtagagtaacactaaaatctgttgatataaaccatgaaaaaaaggagtataaaaccttaagagcgcgggtgattttgtaatttgagaccacccatcagaggtcaccgaaaaaaagtcctgatcaattcgctgaacaattttttgttgaatttcgtctgccattttgggaattacagttctccgaaaatattctctttgtcgaagcttaaaaataattatgcatatatgtagtgaaaatgtgttaaaaatattactttgagttttgggtaggccaattcgttcttatcatcagccgtgcgatttgttcatccaccttttttttgggtcttctttgccaaagaatttggtaatcccttggtttttctgaattttttttaatttgaggtaaaaacgaagtttatattaccgtagactggtcagatttttgcaaatatttttcatattctttgccatgtttcgttttaaaatgcccccacaacccttttgtgcacgattgcttacatgctaattggttttcacaaagctggcacttggcaaattccgaagaaattttagtaaaaacattccaaatatcagatgcttttgaagtcatttgaagtaataaattgggtgaaccctataaaatcacagaaaaattgaaaattatgtgcaagctgcaaattattattaaaaaagtattttttattaattttttaaagagtataaaaaattcgtttggcttgctgtattggtataatttaaatggttgaatagctttaaatttttacaacgttcggagtccccaatcccccgaattagtgtcggggggtcggggggcaaaaagtcgggggtcggggaccgccggggggcacatgtcgggggtcgggtcggggaataggtcccaaaaacgtctcggggcgggtcgggggtcggggggctcggggtcggggagcaaccctaatttaaattattaattcattaagttaatgtttgaataaatcttgatttttgcacaaattctataataaataacaaagttttttttactttttattataattggttgacttgataatataaattcatttttttgagaccgaaagttttttcaatttatttacatgccaataatttgggcatttagaatcaaattttacattttttccactagcattcaaagccagaaatttataccaataatctttatttaaaaaaatatatttaattatctttttttaatattacttatttaattaattgtttatttttatatttcatttttatcccccaaggttcttttgtattattaaaatttgttctaaaggaataaagaatctgtattatttcattaatttccttatatatataccactgtatttttatttgtaaatttatttctccaaatatcatggttaggagctgagattcagtcccaatgacaaataactgtttatttatttttcattattttatagagtttaataatttttatttaatctgtataagaattaattttgttaagcaagtattctgtctattaatacattttttcaatataaattataagatacaatttttttagcatttaaattccgtgaattttatctcactaaaagtcgcggccctacctatgacattaaaatcttcaaacataattttatttatttttatttgaaaaagatttattttttattgaatagctcatattattttaaagtttatttaatttatttaaagagaataaaaaatgtttgtttatattattgtttttatttcattcctaatttcatgtttggacacgcgagtttgatgtcattcttttgaggttgattaacttaggatttaattgtccatttttgaatattattataagaaaataaattttctttaagtttcggtttaatgctttaagcgacacgcactttcttaataaaagtattttttgatattttgttatttaaagcttttgttttgttatttttgtaaattatctttttcatttattaatttttattcccgattatatttttcaattattttaataaattaatttaataaaagttaaatttcaaacatagttttttatttgatattcactcgttctcgagaagggttaaaagataatattcatttttcattattagttcttcgcaattcgctatattggcgctttttcattaatccaaaaattttttaaaaagagaaaattaattaaatatgaacaaatatgaatgattgacacttcactacaagattaatttgtttacaattattaaatatattttacagttttgacttttcgtttgatgtcttataagtaattttataaaattattgaacaaagttttttcattttcatgtttgtattttaagattttataattgttatgctaatgaaattgttatactctcattgcatagaaatataatttaattttgatttaaatttttattctcttgaaatcacctttattaatttctttattgaaattatgaactatatttttctaaaacttttaacaaattttatttatttattgtctcagaaattagaaagaaacaacaattcaaatttataaaattttataatttatcatttttcttttttcggtaattagttatttttttattatagaaaaagtctattattanatattttattttaaatagggaatttcatatttttccatanatatttcgaataataattccagattttt

SEQ ID NO: 22612 - DNA, 2612 bp, Heterodera glycines
  misc_feature (1716)..(1716): n is a, c, g, or t
aaaatacacccctaaaaatgaaaaattttcttaaaaattcgtctccaaaattatttttttatttttgacaagaatttttttaaaaattgtgtatctcaaaagtgatttggcttaattttgttacctttttgatgcattttgtcattttacaccccctaaattaaagctttttagtgcccattttggagtttttttagaacctagtgcctacctattttggcagtttttagagcctaaaaatcgtatccatatatataaaatagatgatgtaaataaaatgtttcattaattagctcaaatttaaactcaccgatggatttgcatgtgaaatcacagcgttcccatgttttgtacgtgccgcagggacaacccaaatatttttcgctgttcaaaacggtgccacaactgctccaaaatgggctagaaatgggtgaaacattaataaccatatttggaactttttatttatttatttttacaaaaaattcgtttagtcccagcaaaaatgccataaaaatgtaaggctatagctccccttcctgactggctctgactgactccgtcatagccttgtttgaccagtgcttagctatttagcgcctagcacgattgtcgcacaatttcgtaaattaattgcctctaattaatgaatgaacacttacggagccgcttcgcggtaggctgatccgccgtataagcggtagtgacgacagaagcctggcccctcccaaattgagcaacgttttttgccagcagttgccctctaaaatttagttgttattttaaaattttaatttaatttaaaaaattaatttacctccatacattcacaaaattggttgtcgcaactcttttgtcctatttgcttgttgtagcatctgtaattgaaagattatatttaaaggtttataccaaaattgatgaaaatttatttttggttaatttaattgaaacttacccaaaaaatgattaaatttttcgctaattattttgggataattttataaaaattcatatttttatcaatcctttactcagtctgcacgtaacaacaattgttcatccggtcttaatttaatttttaaaaacaattaactaatgcattaaaatacatttaataatttacttttccatgatggacaatccgtgtccaccgccgcttcggtgagtgttctgaattaattttgaaattcaaattttgattttaagttgttgttgttgttgtcatgtgggtagccagccaccagggggaccagcaccatatttgccatcgtgctcgtccgacttatcgtatttgccagaaatgccaatatgaacaaatgccaagcaaaaaattgccaaaattgtcagtaccatttttcaattttcttaaattatggacaatttattttaattgctcaattcaaaatgttccctatcatctgatgagtgatagattttgaaattgaaaattatcattttatttaaattgagtataatttcaattaagaaatattttttatatataaaggttattttgagtttaaataaatgagtgaattcatttgaattgttcatttctttaaatgcatttcttttctgcaattagcttgtaaactcaataacgctaatcactcattagttaatcaaagcatcataacgctactaattaacgaccaattaatttcaatcaagttttgcggaggaagtcattttgcaattaggaaaaattggaanagtgtaaattgtgcgcagcagtgcaaatgtataacgaatggactaaaaaacaaaattgttcaccccaaaaaataggaaaaaataattgaaaaaaacaagttaggtgagcaaatattctcgacgtaactctcccctatctcaaaatgagtaattaatgaattaataaactaataaaataattaggaaaaattaattaattttaaaagagatttaaaaaacgaattaatgaaattatttgatataaggtcaaaaaacaataatgattagccatagcctaaatgatgagctaacaaataaattaagaatttttataaaaattatgtcgaattaaattaaaggtgcaatgactaagtacgaaaagtgcaagattgggcgaaaagtacgaaaaggtgcaaaataggcgaagtacgataaagtggaagtgatcaaattaaaagcaaaataataaattattttaaaaattaaaacaaaaattattttatattaattaaatttatcgtttttagtttttggaggtaagaattattagcgaaaaacgtgaaaaatgaaatgctattttttgatatttacataagataactattgaatatgtaccttcggctcaccacgtatataattaatatagaattgatctagcgaatatttaaataatatatgtattattattaaattcaattaacataaaattattttgattttaatttttaaaataattaattttgcttttaatttgagcacttgcactttcgtacttcgtctcatcacgtaaattaagtcatctcaattactaatgaataaatgctcaaagaataggaaacatgaaataatcagccgaagtgcctgattttgtagaaaacaagaaatttatgaaaatggggacaaattgaaagtattaa

SEQ ID NO: 22613 - DNA, 2167 bp, Heterodera glycines
caacaaaaggggcgcacaaaattcacattctcaccgcatcaattaggcattcggacaagcccgccgcttccccactcgctgtgtatgcataaattatcgtgttttgggccttagttttggccaaaaaccatttcaccaccacattcattccaaaatatgtcttccttaattgtatttcccttatcagctgatcaatctgacggaatttatctgctattgttgcatttatgcctcctcattagtgttacgcgcgcgcgccttgccttgtttattttgcgcgtcctttttgttgatttaaatttttgggtgtggcctaaaaacaggaaagtacccaaaataggactttccgtcaagaaccctgaacaaaatgttcatgtcggaaatccaggggcctcgcccaggttttatttcaaaattcaggtcccctctattttatttttgaattcaatccgtccgccaccgattgccttggccaaatggacgcgatggaatgcgatgaagtgagtgaagataagtaccaaaaaaatgccaaaaacttttcggttgaggtcgaagtgccgccaaaaaagaaagaaaggtccgtcttctcggctgagcaattggacagattggagcgcgaatttgtggccaacaaatatttgagtgcttttcaacgggaaaaattggccaaggaaaatggccttacggaaacgcaagtgaaagtgggaaaatattttactatataatatcggtcaaaaatattgcttcaaattttttttttaacaaaaaattgtttttttcaataataaaattttattcctttgttatgccaaaagaatatggcctaacaaaaaagcaaatatacacgaacagatttgctgaacctataaaaggcaatccgatagagaattttgtcctcttttttagaggcctattcaatttcccaaaaaaattttcccaaccccttaggaatattttcgaaaattttagcaattttcagtttgtataaactatagtgaacgccccgtgaaaaatgggttaaatgatataccaatcgattcgtctcaaggagctaagcatggaaaaatatgtctcgagttgcggaaatgccaaaaaaccggtttttgaatcggttcaaaactcgaaaaattgagtgaaaagggggacctctgaacctttaagacggtcaaattcggacaaatttggtatcattcgaaagctcttgatcagctaagtctaaaaaaacaaggtataaattcgaaccgatgccatctaggcactggacaactgagtcccagtgaaaatggacacttcagtaccaaaaaaaattttaaaaaatttcatcttatataatgcacgaaaatcgtttaaccttgaatatcgagtattgcgctaaaaaaccgccgcacactcgactacggcggccagtaggtggggcgagactacggaagaagtccgcgcgtgatccgcaggcggttgactgattggcaaagccaattggccagcttcgacgaattaacaccgaaccgatcttcacatgaccgcagatttatcctaattatatgattcgcacttaaacaagataatataaagacctcagctcaacatacttccaagctgatgtttgcacagtactacaaccaaatgcaccttataatgtgagactgcagaccaagaagcttacactcacgagggcttgacggccacctgacattcttctcggagtgctacgtattgaaaccagttgattgttagacaaataaaacagctaccaataccactaaccatttgccagtcgaaaatcggtgacatattcaatgtaacagggtcaattacgatcaagaaatcaacctacatctaattggtgatagtgggaaactaccaagaatcgccacactttactaaaacaggctcagaggcagattttcattcaacagcaagaaaaggacgaactgagacagcttcaacgcaacaaactcttgcccagcatagcaacattgcgatcaagacggaagagagaatccgttcccatcacctcaaaaacaatcctagattgatctttcatcagacagcgacacatccggcattgagatcatacaagatcccatttagggatagactaatctaatcaccaaatgagcatccaacggctccaattccctatggccagagcaacggctaacaccaa

SEQ ID NO: 22614 - DNA, 2025 bp, Heterodera glycines
tagatcgttgtttccgttattcatttctccttattttatgtgtttgaacaaagcctgcatttttggtcgaaagttgaaattcgaagaacctaaaattttcgcatttagactgtagtcgtttttgttttgttttgtaagttcactaaattgagacgtaaaaaaatgtttgagtcgaacaattaatgtatttcaaaagtttcacttttaagcgtggatacaatgtgcaaattgcaacaacgcataagggagggaaaaacaactgagtatcgtccagatatgaacatcgaacagcgggacaaagaattggaacagtggaagaaagcagttcggaaaacgacttaatgactcggcagagtgtgaattaattcctatcttttatacactagtagtttcttttatttttatatacacgctttaatagcaattttactttttaatttactataacatgcttgtgaataaaggacttaaactttgacgagggctacgatttatttaaatctcacgaagtgtgaaaaagcatttattttctttttcagtgtttgagcttggcactctgtttcgttcgtataactaaaaacttttcttgagaaggaatgcaaattcgattcgcggatttggaaatggattgtgactcggttgtgctgtcttcttcatcttcgtcgttgtccaaaacaatggagagtgaaactaatgaggacgaaattgaccaagaagagcagggaaacgaacacactcaagcggaagaggacgtaagcgattgtttgtgttattacgcctttattaagtgccttttagacttcccaccatcagcagaaatgttatgttgcgaaatgcttagactccattgcaaaactgcaaaggacgttccaattaagcaatggtctttccttcttcattcatattgacattttataattatttccctcttcagcctcggcggatgttttggaccgtgccgccgattatatgcaactttatttggaccgttatgcgaatgggaagttcggcgcagatgtgcgtttgttttctgttagcatttaatgttctcacttttgccagtgggttcggcgtatgcttttcatagcgcgaattcacggtgctccgttgtcaaggcttcgcttcattgacgtgaatgttcgtgttaaaattaacaatttaaccaatggaattttgcaaaatcaatagcaaaggaatgcagcgattccgccacatttagaaacacaaccgtaaaatggcggctttgtaccagtcgcttggcccgggctttcagacgcgttggctcagcggagccatcgacatggaacaattgtgggtgttcagttgtttacattcaccaatggtcagatctgtcttatttaatgaatcgcttactcccaattttcacattcttattgtcagatgtattggctaatagcgactgttaaagttcaaagcgagttactccactgttcccttgcaattttagttttgctcgcatggattttttggagtcgaagtacggagagcgtctttgggaactccattttgtttatggctatgaaaatatcaaccgttctgaggggtcgtttttccgttggcaaatcatctcgactgtccgttcgctttataaaggaattctgcgaaggaactgggccgaagtggcacaaaatatctgttcgtgttttagttgagaatttcatgcgtactcgcctttagcgaacatcgaattgaccatggccacccaatccaatgccaagtcgtatctctcctatctgcggaatagcctggcgccacacatctccgccatatttctgactgctctccaatgttcactcgaaaccaaatgttcgattgagcaaattagcgatgaatttattgaggtggggaaatccaagcgacggacgaacaaacggggggggggcaacgcatgagaaatatggatttattgtaattgaaaaaattatattttcgttgacaatcagttggtccagtggtaaatccaatctgtttgttctaaattgctgtcagttggcattctttccc

SEQ ID NO: 22615 - DNA, 1686 bp, Heterodera glycines
agcgcgcgcaatggtcagacagcagcacataagagaacagctggaggaagctgatcagctgcacgaccaaattgtagaagcggaacagcaaaacgacgaaaacgaggatcctgccctgcaacagcagcaacagcagcgtcaaatcatgttgcaggagcaatacgagaggaaagtacgtctgcagctgcgcgaaagccggcgattcagcagcggtgcggcgtcgtcacttgtggtgcccccagccaatttgtactgggagcgcgaatgtctgatctgtacggacgcgcccgccaactttttcaaccgttcatgcggccacgtgtgcctttgttcagactgcgctgtgaattgtgttcttcacaaaatacccacgtgcattctatgccgcgcggtagtgagtggcatttatgcattcgttcgttgaattatgatgtgagtgagaaatggcacttttcatattaatcaattcgctaccttcactcactcatatcaaaatggccaatgattcacaatatttgtaacccaataattcatcacttattttctctctggttttacgtgacttaccatcctttgaattaatttgcattccgttttttttcaactgcattttcaattaatcggcaaataaaatgcattgaaaattattgttcttcatcgttctgtcaatttgggagcgtagggagtgggtaggaatgaatgaatgaattgatgtacaaaaaaagtgactagagaaaataaatgataaagtttgtgactagaatttaaaaatcacattatttataaaattttaaaaaaagtttttttttttggctcagcgtcccaaataagtcagccgcttcatagcgtccgacatcgtccaaagacgtatgagccgctttcgagtcaaaatttgagcaaaataaataatgtgaaaaaaagtgactagagaaaataaatgataaaatttgtgactagaatttaaaaaaccacattatttataaaaatttaaagtttttttttttgactcagcgtcccaaataagtcagccgcttcatagcgtccgacatcgtccaaagacgtatgagccgctttcgagtcaaatttttgataaaaaataatgtgaaaaaaagtgactagagaaaataaatgataaaatttgtgactagaatttaaaaatcacattatttataaaatttaaaaaagttttttttttgactcagcgtcccaaataagtcagccgcttcatagcgtccgacatcgtccaaagacgtatgagccgctttcgagtcaattttttgataaaaaataaataatgtgacaaaaaaagtgattagagaagtaataaagaaaaattatagtattggattaatgtggagaagaggaccactcgtaatgtacagcactgagaaatgagctgacccaattgcaaaagtcgataagatagacagaaatgactgtctttggcgtatagcaaagtggggtggggttatggagggatggagatgaggaaaaggaatgtgaaaaggattgacctatgaattgatttttgtggaatgggaagaataaggacgtcagacacattacaaaaaaaatattcatatgatttttcaattttttcaattttaaatatttttagaatttgtcggaaatttattattattattattattattattatatttattaatgggaaagagaaagcaa

SEQ ID NO: 22616 - DNA, 2917 bp, Heterodera glycines
  misc_feature (20)..(20): n is a, c, g, or t
  misc_feature (62)..(63): n is a, c, g, or t
gcggcgggttattagatttnttcaattgcttttatactaaaatatgtgcattaatttacatnntagatagtatttttcagacaaaattaatactgcaaaaaaaaacttaaccggacatttggacagtggacatcatgacagtggaacagtaggaaagtgaactcatttggacagaagcgcgcaattggacagtggtcattacgaccgacagtgaatgtattttttttactattgtaaatggctttagcaattttcaaaaacattctttatctttctttatcttagctttcgaaagaatcacctacgtaatgcttgatttgatgaaagaaaatttattttacctaatgatttaaaaaaatgttttttgttgctgctaaagccatttataataataaaatattcacttactgtcgcaatgtccgctgtccaattgtctgcttcagtccaaatgagttcactgtcaaaatgtccattgtgcaaatgtccgggagcccaaaagaaattgaaaaaactgagtgcagcgacatttatttaatggatttaataatattttttatacatttttaatagatttataatctttggatttacatagaattttccgatggatttcatttttattatgacattgctgaaagttgctcaaattaaataatgaacttttctattatgttttatattattctttttttgtagaaacataaaggtttttaaattatgtttttttgctattaaatcattatgtaatattaattttcttttttaaaattattttactaatttgattataatattgactaaagattattttattgtatttcattttaatttgaaaatattattgtaaaggttttgcataaattaaaaaaataaaagtaaattaattttattaaatttataataaagattggattttgtttatttattttcaaagaaaaatctgtacacaaattatcaaatgatttttttaatttgtcgtttgattttgtttatatttttgttcaacaacagaatattttgtgcttttccattaatctcatgactatcagacgtttatccgccatcaagttcaaatcaattattttttaaaactattacaatatttgcttttcaattgttttaaatgcgtaattaataataaaatttaaaaaattatatttgtttaataattatttattttcctattttaaacttattattttttgtaagttaaattattatctttttaactcttttatcttttaatctctgtttcttcaagcatttgtaaaacaaaacaatcaattaatcgtaaattaaactcagtaaattgctcacataaaatataattaagctggtatttggcattatgttagataaatattaatatatttcaaccacacgcgaggaaaaaaataatttttattatatactcttaattattgatattttatataaaaataatatgtaaatcattaattgtaattaatatttattgagtatgaatttaaaatgatatgataatagaaaactaattcatgcaattaattatagaaatttatttaattttatgttacttttaaaattaaaaaatttaatatttgtaattgaactttaaacaaaaaatatttaaattattcccacaataaaaattaaattttaattttcactttcatagcatgtcataataaataatttataaataagcttatatttgcaaaggaattcttcggttcagtggcgagtaattaagaaatttataaaatattaacaaatccgtaaagaatattacaaaaattgtttaaaaattcttatttttttattaaaattggaaaaaattgatttttcgctaaaaataaaaaaccatttataaaactaacaaactaaaagctgagactaataaaatgaataacaaacaataaaataatgtaattaattgtaaattttcattatttaaattaaaagcaaatagcatagtaatcctttatattggcaaaaaaaatactaaaacaaatttaacaaaatggtttattatgtctgttaattttaaacaaaaaatcttgcaaataatgaccacttttatggacatccaacgcccacccaaattagaaaaatattaggatgacaagaaaaatataatagtaatgttaaatagtaattgttggtctttcatattaactaattaaaatctttataaatcttggattattttttaaaatggaataaagaaaatttcgttgtttatgttctgtttttttacctattgtgttttgtcatttttttaacatttttattctaaattttttaattttccgatttttttccaattattctaaatttggttagttttgagcaaaactaaaaatttttcggaagtctgaatcggaattctgaccccaaatcacggcacacctctagccgttgcgggtaaattatgtatcaaatgatcaaaccctttaagaaaagacacaaaacaaaatcaaattatattaaatttagctgagaaaaagataaataaaaaagcacattaaaaaataaaataatataaataaggcaaataaaaattaaaccaaaattttattataaaaataatagttggtacggtagtccaagcatattcagatttttttagttcttctttgagtggagttatcacagtttttcgacccttttttcataacagttacgcatttaacaattcgcatcccaaaaatattaattgggtaccgtagtccacttgccgttcgtccatatacccttcggtttgtctacaggtgatatgggagagtgtattcctgatcttatttccttttttctgctgtatatttttcaagcaattttccgtcattgcacagcaactgctaagcgtacagcaacggcggcactcgcatccggtgcagctcttcaagcgctctccaagcatattgttatttttttt

SEQ ID NO: 22617 - DNA, 1630 bp, Heterodera glycines
tttattgtataaaatatttaaaaaaagaatgagcacatctttttgtttgtttgagtggaaaatccggtatatgaaggttttttttttgtgtgtaagaaaaaatttgttgttttgctgtttgtcattatttttttgtctaaattttgtttttgttaattgatttgagtttgatgtgaaagcttttgtgttgcttatgtaaacgataatggagaattgtttggttaaaaaaatgcattagaatttgtttgaatgaaaaaggtttgttacttaaaaaagttttttgtacttttccttgcttcttataatatgaaaagaatctgatttggtttttgatatttgttttgaataaaaagcatgttatgatagtaataaaaaatgaaagaaaaagcatttgatggatagaaaaaccaatataaatgctacatctcatgttttgcctgtgttcgagtggaatatttatatgcaattgggatattgacgtgccacttgcgggatcaaatttaggtggaaagttttaaacaggtcagttttaatttgaatttatggggtgggggcaataattatacaccatagtgttttgatttattatgggttatatttcaatttctggattccttttaaatagttctgtattccgttgctgaggttgagttccggtgattgaaatgtcggaggactgagtcccggtaattgtgttgctgaaggattgatgagattgagtccagtgatttgaattcgggagaattgagtcccagtgacttgaatgtggtggattgagtcccgttgattgaaatgttggtggattgagtcccagtgattgaaatgctggtgggttgagtcacgttgattggaatgttggtggattgagtcccagtgattgaaatgctggagggttaagtgttggcgattgaaatgttggtgggttgagtcccagtgattggaatgttggtggattgagtcacgttgattggaatgttggtggattgagtcccagtgattgaaatactggagggttaagtgttggcgattgaaatgttggtgggttgagtcccagtgattggaatgttggtggattgagtcccgttgattggaatgttggtggattgagtcccagtgatagaaatgctggagggttaagtgttggtgattgaaatgttggtgggttgagtcccagtgattgaaatgctggtgagttgagtcccggtgattgaaatgcaggagatttgaatcccagtgattaaaatgctggtgggttgagtcccccagtgattgaaatgctggtgggttgagtgccagtgattgaaatgcaggagaattttgagtcccagtgatggaaatgctggtgggttgagtcccagtgatttaaatgctggtgggttgagtcccagtgattgaaatgctgttgggttgagtcccagtgattggaatgctggtgggttgagtcccagtgattgaaatgctggtgagttgagtcccggtgattgaaatgccgcagatttgaatcccagtgattgaaatgctggtgggttgagtcccccagtgattgaaatgttggtgggttgagtgccagtgattgaaatgcaggaaaattttgagtcccagtgatggaaatgctgttgggttgagtccc

SEQ ID NO: 22618 - DNA, 1064 bp, Heterodera glycines
aaaggatacagtatctgatttatttcacaacgccaacactgcgttgaaaataaaaacacaagttgcatgtgatggcaaaagttgtgaaattcaaacgcattttacggccatgaattgccgggaagtgaggcgatcaaaattcataatgatagagaatgtgtggctttacctgttttgaagctaagtcggggatctgacggctaatatgagaataaagtgcagttcgctctttaaacgaactgattttatggccactttctataaaggcgatggcggtcgctgtatgaccgtaaacccagttttttgtatagaaaagggttgtccaaattgcaaatggatacagtatctgatttatttcacaacgccaacacgccgttgaaaataaaaacacaagttgcatgtgatggcaaaagttgtgaaattcaaacgcattttacggccatgaattgccgggaagtgaggcgatcaaaattcataatgatagagaatgtgtggctttaactgttttgaagctaagtcgggcatctgacggctaatatgagaataaagtgcagttctctctttaaacgaactgattttatggccactttctataaaggcgatggcggtcgctgtatgaccgtaaacccagttttttgtatagaaaagggttgtccaaattgcaaatggatacagtatctgatttatttcacaacgccaacacgccgttgaaaataaaaacacaagttgcatgtgatggcaaaagttgtgaaattcaaacgcattttacggccatgaattgccgggaagtgaggcgatcaaaattcataatgatagagaatgtgtggctttacctgttttgaagctaagtcggggatctgacggctaatatgagaataaagtgcagttctctctttaaacgaactgattttatggccactttctataaaggcgatggcggtcgctgtatgaccgtaaacccagttttttgtatagaaaaagggtgttctaattgcaaatggatacattatctgatttatttcaacaagccacacgccgttgaaaataaaaacacaagttgcatg

SEQ ID NO: 22619 - DNA, 878 bp, Heterodera glycines
acattccagcaggagatatttgtatagaaaaagtgaaagcgataacaaaaaaaatcatacaaatcttattttttattacttacttcaattataaattttgtatatgcaaattgtatattaatattaacatgtgtacaataaatcatgtagaaaattaattaaaaattactgtcgaaaccaatcactgtcgaaaacacctggtacgtttgggacgctatgtgcgtgaacttcatgttaattgggttcagttttattacgtttgacaattagtagagcagatcaaagtcgcctggcgtgctgaaattctggtcactcccgatcactttttgaaggagtgatctgatcaggtggtgcaattgacttttttgattagagtaaaaagatatagtacaagttatagtcttcagttttttgtcgaaaaattggctgttcttgtaattttacaacacattttaacattttcagcgatttctggctcacaaatggaaccattgccaaaaaatgcaattaaaataaataaaaattatttctaaaaaattatttaaattttcttaaaattaaaatcatcagaaaaaaaggatgtaaataaaatgaagaatttgatcaaagcgacccgcaaacccgcgggagctctttttatatgtaattgtgaaataaaataaaagcacaaaagaacattatataattgatgtgccttcgagtcattctcaaccacagcatccgtagcatcctccaccaccgcaactgtaacagtatccgtcaccgtaaccaccatatccgtatccaccgcctccggtagtgattataatcgccccgctaccgtaccccccgctgccgcactggccgcaagcatcacagcctttaaaatttgttgataa

SEQ ID NO: 22620 - DNA, 2143 bp, Heterodera glycines
ttgaaatggagcaggacaaaacgtcgccgggaaaaacgtcgacaggacataaattcgcaccataaattttttttaatttaaaaaaaatcaagaaaaatcaaaaaatttaattacctaacctaattcgaaaatttttttaagaaatttcacagaaaacaaaattttattttcaactttttcctttttttctggaaattcagcagatttatttttcagtaacaactagaattttcaaaaaaatactttaaaacaattttttaaatttaaatttttgaaaatttcggcgccgaattttaaggtatttcgatttgaaaatatgccattttttcttaccaaattgcttcttccattcataaatttttgtacgggtggttccaaaattttccgcaatttcatattcaatttaatttctttttttttcatcatatttgaaaccgtgaattttttcttttctcatttgatcaaattttctgatcagtccaatcattgtgtccttatcaatgtccttaaccatggtgttgctgcgcttcttctgtgtttgtcctaattgcttcttgaattgataaatgttgtcgcgagatgtgcccaatttttttgcaatttcatattcaaatttaggaaatggcaatttcttataaacttttttgtgccgtaattcctttttcatcgcactaaatttgttcaaaatttccatttctttccttttttctgcctcctaaatattaaaaatagagagcggatttatatggacaaaaaaaaatccaaaatatggattatatttatggacgaaaaaatcgtaaaatatggacgaaagatgctgaaatgtggagatgacaaaaaattctgaataagttttttgcaaaaaattcatttttacgcgaatttgtaatgaatttttttttgcaatttttcaattttatattttccaaaattccaaaaaatttccatctttaggggtgtgtttttcgaatttttttttgtgaaaatgccgaaatatggatgtacaatatggaaataaaaaaggcatcccctagaagcatcaaaccaaggctaaaaataccatgcacatgattttaggcagaaataaaattgtgaaaacaaaatattgaaatccatataaatccggtccctaattaggataaatattaagaaaacactctaaattaaaaatatatatatttttttcatgaaattgtacagtattctatcttacattaccgtatcactggaaccctgatcacccacagcattgctatgaataatagtatgtaaatcattctgatcagtttgctcatcaatctgatttacaaatgatccttcttcgctgaattggacgaattcagtttttggcactttgatggattttggcattaaaaaattcgtttgatcatccaattgttcagttttaattttttgttgaacttttggctttatgtcttcaatttctatttcaaaacaattctcagatttaataattgttttctttgctttttgctgttcataattttttgatgtcgatagcagtgaatttttccataaatcatcaaataaatcttcttcaattccatcaattagtacgatgattaaatataagaagaaagtaataataataaccaaattcattttcaccattttttgcgtcaaaaatttacaaaaaaaaaaaaaatataatttttgaaatttctgctcgtttcaaattactaatagagttagcaactattttgacagttttccataaattccttagcaaaattgcaataaaacaaaaaatacacccctaagaaatgaaaaattttctcaaaatcagtatccaaaatttatttttcgcaactattttgccattttgagagtttttagcacctatttcagtatttgtagcacctaaaaatcctactagctctaaattattacatgaatgaataacaaaaaaaaaaaatgaaataaaattaattcatcaataattgattttataattgcattttgccatattttatagaatttttatcattttgtaaaaaaaaaatattctccatgtataatttgtaattgttctgggaatgtaatttttaattttatagatcgtgatcggaaaatgcgtcagtggaaaagcgtcagtgatacaaatggtgtaaaataaagtact

SEQ ID NO: 22621 - DNA, 2183 bp, Heterodera glycines
gtcccggttcccggtcccgggttttgaaaagctcaggtcccagtcccggtcccggtaggtcaaccgggaaaaacaagcactggtaagaatgggggtctgagtgaaaaattagtgatgaaaattggagttaaagggaaaataaaaaataataattaatatattctttaaaagtaacgttgcccaatgtgcaacaaattgcacccaaatttttaaaatttcccccggcggcgcctatcggcaccgccggaccccttctttcccaaaagttttttgaaaaagcgctccgaaaaaaagtgatgtgaaaatcaaatctgaatttctattaatattcgatgatttagtccaaaaatgattaattgtttgaaataattgaagaaaatttgtttgaaaattttcattaatttaatttattataaaaaaccaaataattttgtattattttcacttgatataaattaaaatttgattttttttttaaatttttaaaatttttttgaatttttaaaatttcccggttggtcccggttcccggtttttcttgcggtcccggtcccgaaaaaaaatcgaggtcccggtcccggcttctcaggtcccggtcccggttttggcaaaaattcccggtccagtggcactctaattataatacaaaaatactgatgctgtgtttctttttgactcagattcgtaagctaaatttttaatatgaatttgtataatcaaaagagtctaaccgatgtttctaaatctggtgtatacacttgccaacggaaaattctttcctgtatacgttcgcaaactattatatttaattgaaacaatttgctggttgatgctaagtctaaattgttcatccatttctcagtttcgtgagctcctgctgctggtgaaactgatatctcgatgtgttttctaatatttaaacattctatagtggatgcgccttaatttttagttatttttttagattttctcaatttttctaattatttgaaatttaattttttttactgtaattgtaaaaccatgtttgacatagttcttcacgttcgtcctccgtaagtggattaaacacaaagtttaaggtagcccgcgccatggtttcaacatgtttaacttgtgataattttttatttttaaattattttttacttataatattttttattcattttgtttgaatttttttagaaaattaaaccttcttggctttcattactgctttggctttttggagatatttcttcttcagaactttttaattttttctttattatttcagcaaaaatttgtcccttagtttttaatttttctgcagattcttctgtgcgtaattttctttttctctaaaataaaaaatatatggctacttcaagaaaaagttgacctctctgattttttgatcttttctttagagataaatcgtatccgttctttcatttgtttttttgaattttcgatattgattatcatgaccaattataaataggaatttattgtcgaattttgaaaaacattgtgacacttcagcgttttaacattggattaatttattaaaggaattaaggcaataatattttttataataaatgtatgttaaagaaatttagctatttataccatttaaattgtaataaaactgccagcctcatatttcctgctgacacctattggtacaaccaaataaaaattaagtaaataattgtaaattaatttaataaagatttttagtctgtcactgctagactaataatatttccggctgacacttacttgcacaacaaataaaaattaatagatattattgtatatttaatttaacggatatacatacataatcatatgagttggtggttttaagaaacgccctagcaccattatagataatattttacctctttcacatttcttttttttctaaagattcattctgatatcaaaatgtttccaaaactaacatatagtattttagaattatctttgttaatttttaattttttaaataaagattaaaattttaattgcttccaccttctttgaaatatttaaaaacttcagtataaaaattttagttattttttatataaatttaaaaaaataatcagtgcttttcttttcctctaattacaatttccttgattaatttatgactactagcaaaaattaattgcattccaatttgtgat

SEQ ID NO: 22622 - DNA, 1736 bp, Heterodera glycines
tttgcttgattgctgtaggctttagtggtgtatacaggtttacatgccgaaacacaaataataattaatttaaataaattaacccaaagagacaccgtactgatgaggcccggtctctttcggttaaatttgcacgtttcgcgaagtgcccatttttgcactgtcgcgaaacgccccatttttacaccatttttgcactgtcgcgaagtgcccaatttttcatttttcgcgaagtgcccaatttttgcactgtcgcaaagtgccctttttgcacttgtcgcgaaatgacgtagcacccgatccccgacccctattaccaaagttttttgtcaaaaaaaattgaatcaaattaatgcgacaaataaaataattatgattataaaattttgccaaaaataatagaaaaaataaagtaatcgtgaaactgtatttctcatttttggttgctgtttatttatcaatatttgcttaaaaactttaataaatacactaaatctactaaagaatggaaacttaaaaattccgattttttaaattatcgtcaataatataaatccttcatggtttttgtgataattaatggattttgaaccatggatatttcggaagagaacaaaatatgtctaaattagcagggtttttcgacactttctattctcttccattttaaatctatatctgttttgtgaagaaaaaattggggtcggaattccgatttctaaaacgttggaattccgagttccgaaatttttgaaaaaaatttttgtgaattttttagaaattacactgaaattttcaaaaattttccctgtggcgtttattggcactgtcccgactctaaaaacaaccttaattttttaaaaaacgatacaagagagagtgttatgagacttggatgaaaaacgaatttattaaaaataaaaaatactttttagttagtgttcaaaaaatttattttttgactctactcttaaaaaaaaagtaaactatcaaaatttattttaaattatcggaaaaacccccgagcggttggcgccgcgaagcggcgcctagcgctcgtactaatttggtctgtctgtctgtatgtcacattttgaatagattattttttgtaacgaaagctttaaattaaaaaaaatgaaataacagaaaataattggattgttgttttgttgcacaaataaaactaaatgcagacaataagattatgaaattgtttatgcttatagatttttttcttgacaatattttttttctttaattatacgttcgttattttttttaaatagttaacttttttttaccaaacaaagaccaaaatttaggttattattattattattaatgtatttttcgttaatataataataaatattgttttactatttttaaattatattaatgaaatgtattttcataacttcgttttttcaaatatttctttttaatgtattttttccttttttttctagatactttacttaataaataccaaatggtacgtactaagcaaactttcccttccgatacgccgtgttctacttcctctttccgagaaaatgacgggttgcaagctcccgataaaagcggtcaaacgggttgtacgctcctgataaaagctgttgaaccggttcaaagctccggggaaaaaagcggtgcaaaacaaaatattctaatgattgcgttgtaaaccttgatgaaattgaagatttcctgatattattaatgctcaatat

SEQ ID NO: 22623 - DNA, 1718 bp, Heterodera glycines
gttttatttatttttttatcttaagtttcacatggaatattaataaatatgtcgatacaatgtttcattaatcttttaataacagaatgtaaattttaaaaatttaacgctaagtaaacttttgtgaattgatttttcgtattttctcgacaatttttaagtgaattgcaatgaataaattttaattaattaatcgttgcattttggttaacaatttcaaggaattaatttaaaatatatataaattgtttattatccttttttttaattttaggctaatatatttaatttttatttaatttcacaattttttttatttttgtttttaattcaaaatacttttctttattgaacatccgtttctaccttttaagatatgtaataaagtgcttgctatttttaattattagtccaagctgaaatagaagattaagttacttattaatctgagtataatttttatttttatttctcgctaatttataataataataattgtcgttcccattaaatgtaatatttttttcacttttaacttttttcttattaattattaaatacattttttcttatcattgtttacatatttaataatctatcggcgcactattagttgtaaattgagaaagtttgcaaataagaaaactcgaaaccattcttgctttttagaaaatattccaattattttaaattgtaaatcctttatttttaaattttaaagtaattttattaaataacattttaataaaattaaatttgttgctaaaacaaagatgtcttttgctctttcgttcaaagaacggagtgtttctgcttttttctttgtaataaagctcatatttattttacaaaaatcctaaaatgttgaaaaaaccaacaaatttacaatttaaaaaattatttataaaattaaaaagtaggatccaatgtcgcatttttaccatcgaaaaactgattaattattgattcaaacaataatttttttatatttaactcttttattataaaatttattttaatttttcgtacattaagtaatgttttctattttctaatgtaactgatttatttatgtatattatttatttatttgcttcttattcttttaatttgatttttaaatttaataatttatggtgtcttttcaaaacatcggtcaacaatttttgtgttttatactaattaagccaaatatggggattatttaatgcattagcaaacaataatattatcataacaatattaaataataagagattaattgaattaatattaattattaatgattataaaattgcaaataggtagtattatcgttaatttaaattcatgatagcttataataatttgtacaatttgctcttcatataaaaattattgactattttagaatttttcatttttaatattattgcgtagtgacaattaaatttaaaaattaatttttatttacatatgtttaattttatttatttttcataggctgtatagaaatttaaattttctttttttttattcacaacaaaatttttgtaaaaatctttggcaataacatttttgaaacttgccgaaattttctgaaattttgtactgttagagcatacttagggctatcaaataatataaaaaaataaaaatttggttgcttttaagctaagttataaataatttttcatcaaatcataatgatggttttttaaataccgacctagcaccgt

SEQ ID NO: 22624 - DNA, 2302 bp, Heterodera glycines
aaaaatcgttttttcccaaaaactgaggcgtttgaatttttaaaccgaaagtttttccctttttccgattaactttgttttcaatgcgaaccgctttttactgattgcctttatccgatggcttttgtttcggcgaacggactgggaaattggtcgacgaatcgagcgaatgctcgacgaattgtacctcgtcgtttaccgatgtttcgaaattggtcggctatgttagggccgatttgatgatgccttaaaaaaaggctaccgtttctcaatcgggcgagagatgtggcccgattggccggagacggggagttgaaaaaagattaggttcttaaattctatgatatataatttattttccccgataggtctaattcgattttaaaatctaaattaatgtcgaatttattattattatgtatcaatttgtagtgatggcttttggcgctgggcattattctggagcggccgttgtttccattatttggcttggaattttgactgctctaatggtcgccggtgaagaaaagtttatatatttctttataatgaaggggtaaaatttttgaaatctaaaattatttttttcaagccctattgttaattttccttcaagtttttaattaaccgattattttgaaaattttctaaacaggaattaaattgtccattgggccaaaactgttttcaaagttgccataaagtttcagggaaaatttaggaagcgcagggccaaacattttcaaaatattcaaaaatatttctcttcctattactcaaaaagaatgaaaaaatagtgtattttatgctcaatacatgacaaaattgatgaaatagtgccgacaatcagttttgactattgttttttttgacccaaaagcttttttacagtttctgtttctatttgaaaatgtcagattggagtcctcattatttgaacctaaggataattaaatatttttaagcgttcataagaatgaagaaccatcgctaccgcgaggaccgtcgatcgaatcccaatgccgacgttttaattgatcgggaaatcaatggccaaatgcttttttgaaaattacaatttaaacgcataaaaacgaatattttcaaaaaatggtaatttaaaaaattaaaaaattcaatgaattaagcaccaaattttatttatccctaaacaaatatttgcgtattaattcgtatttcatatctattgataaaacgcaagcaaaattaaaaaataattgcattaaactaaaataatatcaccaattaaagaccatcacatttgtagtgcatcgctacattaaagtagctgcataatccgccgagattggcacgtagttgtgctcccaagctgcacttgtggatggcacgtttgggtcaggatcaggcgaagaccaaacattttcttgtggagccaagatcgctgaaaaataaatgattaaaatcaaaatttaaaaaaaaactaaatttaattgacctatagccgcggtgtattcctcaaccatttttgcccgctccgatctatactgcttccataatgctccaatctttagacgtaatgcttttttaaggaaagcactttgttttttgcgtttttgctcctattaattcaatgttaattatttatggaaaatggcaaaaaaaacctccaattttggcgcgaaaaaccctttttccattacggaagaattattttgtttggtaataaaatctgaaatactatttatttagaaggtttggaaatcgggaaggtaacctaaggggttaaagggtgcatcatcaaatatattaggatggggagttgaagcctttcgacgattcccgacgtttccgttaagggcatcataaagccgactgtaaagccgtgccgtttttacaggcaatacagctccaatccggtcaaaggatgaacaacgttgccgtaaaaacggcacacttttaaaagaaggagacaggcttttggccaaccgatgatatggaggcatttgttggttgcgctattggaataggcacgctttatataagcactcccccctacctctcccccttattccagtctttttttggcaccgacaacaattattcaggcccaaaattataataaagcaggttttttgcattttcagctgtttttgagggattagcaacctataagcaacttattatctattacctcggccacttttgttgcatttcagccgttttacggatgaataattttgcatttcacccatttttagggattaacaattttgttcactcattttttggatttaatatttttgcgttttcccccattttt

SEQ ID NO: 22625 - DNA, 2062 bp, Heterodera glycines
  misc_feature (2011)..(2011): n is a, c, g, or t
  misc_feature (2049)..(2049): n is a, c, g, or t
ggcatcggcaagagcatttacgaagatgtaaacgttgaagttcttgttacgcctctgcacattcgtccgcgtcgtctctttgctccaccggggaagttgatgatggacgcgctcagcatcagtacggccgcgtgttctgcagtggcactcgtcgcagcgacggtcgtcctttccgcgcagatacgccgcgcacggcgccgcaagccgacgcgcctgtttggtgaacgcgagtgcgcacgtcgtcgcagcaatacatgcacagtgtcgccgttgagcgcgtccgaggggtgttgtggttggtattccgcaacggaacatgtacagcacgcgtcctccgcgttgttttcgtttcccccgctgtacgacgcgttgtccaagccgcctgtttttgccgctttcatcagaaagcggaagagcgacttgcggcgcggctgcgaatgtttgcctttgccggcaccaaccaccaaacattgctgaaacgacagtttggaaacgaacaaaacgccaacaaaaattagggccattttaatgtgaaaaagccaaaacgtcattttaaacagaatgccaataaaagtgaattaaaattttaaaaaaaacgaaaaaggtaattaattaatttaaaaataattacaaataaataggcacagagagaaacggcacaaaacaaaacgaaacaaaatcaaaacgaaatcacctgagaagtgctggcaccagaatctgaaagggaaaaagctttgaattttacatttattatcattttctctttttaattatttttcggattttatttcatttttcctattttaatttttctttttttcgttattttccttttttcaccgtgcgatttggcatctccgcccaattcctccgccaattgtcccccggcgcgcaaataacgcggccaacaatcgtatttgagcaagtggaaaatttggtactgaaccacgtcgtaaacgtcgctggtaaaccgattgtttttgtacgcctcgcgaatctgagaaaattaaaatgaaaagggaaaacgaacgaacgaatggtaattaattaattagttaattaactaattaattggtataattaaaagcattcattctcacttgattggatgttgagttgtcaatattcaccggttcaatacaattggccgcaaaatggcggtcataaatttgcctcccaaagtccgttcgtcggccaaattcattctcgggaatttttttgtactcctccaccgccaaataaaagttgatgttctctgcacaaaattgttgttggaggaattgcttaaaattcaaatattccgtttttccttttttggcattttgccctcctccccaatttactcacatggaacggcgctcgcgccgcttccgacttgagcacctgctccaagtccacgctgctgtccggctgctgctgcttcggcgagcccggcgcgggaggcattgacgcctccggcgactggcgctgcgcgtggccaatgggcagcgcctgcggcgatgcgtccgtctgtcgcttcggttgtttttgctgctgtccgtgcctaatttgacgaccgattcgccgcttcggactctctcgcgctgcttccgcctgcgtttgttcctttgttttttccgatataacggcgctgggcgacgggcggcggttttctttgttttcactgttccgagaaagggcaaacgaagcgacggaggacgccgccacggccggcactttgctacagtcgtcggggttgtgttgcgggtactgctcggagatgtgcttgtcgctcgccgccacttcttctgcctcctccgtcgtcgtcttcaaatgcgttggcaaataatgctgttgcgctcctgttaataattaatgttccgttttcaaatggccatcgaatcgcctcggggcccttttatgcgttcgcgcagcgatggacccacgccatccgggccaaaagcacaacaaacatacacaagacaacacattctaatccgacccggtgatggcatggccaacccaatgccgngggacggcacggcacttcaaagccatgccatcatccgntgctcatcgcatc

SEQ ID NO: 22626 - DNA, 1383 bp, Heterodera glycines
ttcatttcttaggggaatattttctgaaattttggtcctttttagggatatattttttaaagttttttggatcgattcttaggggtgtatttttcattgctttttgctatgaaatttatggaaaaagaccaaaacaggtgctaaaatttaaaactgccaaaatacgtgctaatctcccccccccccctcgttttagtttttaggtgctaatagtctctctaaatcaaaattgttcggagaaaattttccgggctctaatcattaagctgcgatatgaatgaataaagcaggaatagattttgtctaacgtattttttctcagatttgagtttgttaaatcggcacaaaaattgagcgcattcttggcttggttagcttatcttagcttttttatcttttgtatcataacgccaaaatgaggaaaatgcaccaaagtaagcttagtcgttcaacaaaatttatcaaattagcaacaacaaaaaagattaattagttgttattggtttaatcaattgctaattgattgtttattgtgccgtccaaaagattttattttttagaatattttaaaattattaatttgttttattcgtcatcatttgcttcattttcgtcgtcaacaatttcgtccacaacaatggtttcgcgttggcctatttcttcacctcgttggtgacgctcctgtgttacctttgtcacgtgcacatactgtaacagaaacgacaaattacagtatcagaaatggacgagagacgacagacaaattgaaaatattattaaaaattaattttaatattatagaaatatatgatttttggattagtgtcagaccctttttttaattgataaataattgaaaaattataaataaattccagcataactttttttaaaataattattacgatttaaattaatttctttttttggcgccgacctttcctggcgcagtgcctttcattcgtacaactaaatctgctgtgctgcgtgcctcgccagcactgttctccagaacacaagtgtattggcccccatttgacaatttgactgcatcgatgagcaaaatgtgggcgaaaaaatccttaaaattcagtttttaatctatctactctaatgatgttcgagagctgcttttctcgagtcgagtcgagtaggtatggccctcgacccagcccttggccacgaaaattaattctttctcgggatatttccggaccactatgtccacccgaccccgattttctcactcagaagagtcggagccctacacacgctcgagcatcattatccttattacatattggtcccgtttaatttgttaatgaatcaatgataactcgtaccgaaaatttgaaaaaattaaattaagcctaggcctagcca

SEQ ID NO: 22627 - DNA, 1225 bp, Heterodera glycines
cttttttggttatacgagtcgtcgtcgtgccattttttggttatacgagtcgtcgtcgtgacattttttggttatacgagtcgtcgtcgtgacattttttgttatacgagtcgtcgtcgtgacattttttggttatacgagccgtcgtcgtggcatagtgaagcgattttgtgtataaaatgtgaatttttttgaaaaaaggattttgactttttggttcgaatccgggttcggagttcgaattgggcgaaaatagatgccggaatcggtttctccgaccctgaaaacccttaaaacaagtttatttcaaaaaaaaaaattttttgaaaatctgcacatagataatacataagtacccaaattttgatgttttctaaaaatccaatttcttactaaaatcgcttttttatgacttggtagatgggttttcatgctttttcatcattactacgcaatatctaactgtttcacaacagaaattaatgaaatcgtttgtggcactaaaccaaactcttaccaattattttgatcgaaaacaactttaaaataattgaaatataagcaaaataagttttttgattaatttttacgtattttgctatctaaaaagtagagtccggtaaaaaaaatttccgggagcgggagcgggatcgggagttcaaaattttccgggacgggagtcccgaacgggattcccgtaaaaatcccgctcccgttaaaatcccgtccatttttaacgggagtcccgggcgggagcgggagtaattcgaaaatttaattaaaaactcaaaaatatttttaatgcacaaatttaaagggcaatcaatttattaaattaaaaatatatagaaaaatttataaaggagaaatttgaaataaaaaatcttatttttgagtcaaaaatcagaaatttttttcaaattgcttaaattattttttataattaattcgaacaaaacatttattaactttatatttttgactccctttattaattttacaaaattttttgccgtgtatttcttgaaaaaactttttggtgaccaaggaggaggagggaggccggaggtgccgtaggcgccgccgggaaatttttttgaacttttggctatatatttaacagattttcaatgaaaaatcattattttttgccaaaaaaaaattcttaccagtacatttttactccccgttttgggtaaaaatttccgggagcgggatcgggagt

SEQ ID NO: 22628 - DNA, 1162 bp, Heterodera glycines
gacgggtgcgcatgattccactgttccaagcaccccaccaaaagcaaaacgatataaccaaaatataaggaaaaatttttaaaaaattttttctccattttcctttttgatactaaagcatcagagtgctaaaattaacctgtaaataaaatttggtgcgctttagagcactttctgaaaaaatatttatgaaattaaaaaatcgatttattcaagtgtccgtttggggtactcaaacaattatggggagcaaaaatccaacgcagaattaaaatacaggctatagggaagctattcccgaaggatttggtctccccataaatctgggcgcatcggttcggggggactgccccgaaaacaaaaaaatcgattttttcaagtgtccgtttggggtactcaaacaattatggggagcaaaaatccaaggtaaaaataaagtagtggtatatcgaagctattcccgaaggattcggactccctatatatctgggcgcatcggttaagggtactgccccgaaaacccaaaaaaaaaatttttttggataaaaattatttaaatgaactgactagataatatttaaaataggttatttctcttcctttcagtatacctgcaaagtttgctgcgcttctgatcagtttctgaaaaaaagttaagcctaacatcggttcagggagactgccccgaaaacccaaaaaaaaattattttgaaaaaaaattattaaaaggaaatgactagttactatttgaaataggttatttctcgtcctttcagtgtccctgcaaagtttggtgcgcttctgatcagtttctgaaaaaaaagttaagcctaaaccttttggcctgtttaaaaaggaattaaaaatttttaaaaattttattcatctccctttttgatagaaaaagcatcagagtgcctaaactaacatgtaaataaaattttgtgcgtttcagagcagatcgtccataaataatttgtaattgatcaggggctcaccaaattttgcagagatacgtatcggaacactacaaaaattttgctaaaaaaataaaatagtgaagctttaaaaattaataaaaaattttaaatcagaattactggagttagcatcatagcagtgcttttccttttctttttgatgctctcgcaaaattctggtt

SEQ ID NO: 22629 - DNA, 3029 bp, Heterodera glycines
tccaaccaagcacagcgaatggacgcccagaaaagcggtgaacagaagcgcaaaagactttgaaacgcgccaaaaaacggaggggtaagcggtggagaaggccacctgtagggaaaaattgagaaatttttggcaatactaatgaattcattagcactaattaatagagaccgggattttgaatggccgagaccgggacatgggaaataggtcgagagaggatttcggaaccgtgatgtggaaaattgagcgggatagggtcccggaaccgggacttccgtttttcgtgttggtcgaaaaaaaccgggatcgagatcggtattcgcggcaaaatcccggcggagcaccggacccgtccgatctctactaattactatgtcttttttacgagaattattggtgccgaaattttgtaaaaaaaaatgccaaaattaaaattgtctttgtgtctctttggcctattacaactttcttttgtttccaaattaaccatgtaaaatttggtattttctgatcatttttaatagattttttaaaaatggaaaaattaattaaaaaatggaatttaaaaaatttttctcaacgtcaaaatcatcgaaaattatggaagagttagtccttttctcgaaataaaatttttatttggaaatacataccaaagcgatcagaaaattgacaaattccaacggaatgccgaacaaccgagtgtgcattaaaactgaaattttatttcaaaaattatttaaatttacatttaaattatattaattttgccatattctcgcgctgacttggcaaaatgtttggcgcaacgggcgaggcggaaagctcctcggtactgatccggaaggactgaagccgcgtttcgcccatgggcaaattggtggccaactgacgagcacgctgaagcagccagtcgagctccgtgttcaagaaatcgccttaaaattgaaatcataaataattaaattcaaatttttaaaataaataaataaaatttagactcaaaaaaaaagtaatttttttacatttatataactcaaaaataaatttaatttaatttgataaataaagtaatatttaaaaaataaagcattaacttaaatttaataattgttgaaatttttaaaaaatttaaatcactaattaaaaaaataatttgttatttctgtaatttcaattaaaaaatccataaagattaaaaattaaccctaaatcaattaaaagattaaaaattaattaattttaattttaaacatataaaatttaatgatatataataaagttattttaccttaaattagtcattagatatgataaaatttaataattacataataaaattattttaccttaaattaatcattagataaataaatttatttatttaattataaatctattttaaatccataaaaatttagaaataattaaatttattttttaaaaaagatattaaacattcaatcacccgagttgatgaagccccatcggtagagttgcgcaagcattgtttgctggacgaacagttggagcagtgcaagcagcacatgcaaacactggggtgccggcggcgcatgaagccatgccgaacgcaaacaatggcacaggcgatatgcttaaacaaaattattcaaactttggcatttcaaagaaaatcaaatttggcattttgggaaaaaagaatggctgaaatattccgtaatttcgcatttttataacggacatagcgaacttaaaatcctcaattacaattcgatttctctgtcttagttttcgagtcggctttttctcggctctcgagtgtctctgtattaaactcatttccttggcattggcatttttgctttaccattcgaattccggtgccgtacagcggtgttgcccatgccgcctttgatcagctcaatggtccgttttggacgtgcacccaaccgatcattgtcaccggccaaattgccctgtgtggtgatttttcaaattaaataaagtttttgaaaaattcaaaacaccgttttcataaggccaaacaccaaaaatagtgccaaaattggaatgcaagtgccgagcaatgatatgtaagcggtgagccaaacgcgaggaaatgcgccggcaggcctcaaatgtgcaagaaatatattttaatccacaaatttgtgggttctaagctaataatttttgaagtaagcaataaattaatggcattttcatcttttagaaaattaaattaaatttattattttttttatttccatttaaattccttagatatattatttatatatttgtcttaatatttctttattttaggtaaagtttgatttaaatttaaaattaacccagtccaaaaataatttctctgatcactactcactgctcaccattgcatgtcggtgtacagtcgataccgtacaaaggccaggtacagtaaccaggagttgagcaaagtgcaaccgatggtgtaccacagcttaataaatcaatttttaaatgaaaaaattaaatattattaaacacaatatgtgtccaattaccgaaagtaatgtgtttggttgaacacggaatacgcaggttggcattctcgaaaattggcacttacagaagcaaacaatcaaaatttattaatattagtgtaaaaacaaaatcatcactttaatttaaatctgaaacaaatatggcacatttaattgtaaattttaggaattttgatttatatttttttttgttggcatttaatgagaaatttttttggggggaggtctttttaattagatagtgaatcttggcatttgcacaattagaaagaaaaaaaacattttgatcaacccaaacaaacacagtaaaagtgatcaaagacaattcccagtcgcctagacttaggcacattctgtcgttggccttgaaaaccctaagaaaattcgcagggatcagcccctggctgagtcagtcccaatggtttcgctgatcacagatacacaattaaaaaaattaaggatttctatttttagtgccggaaaaaatggcaatat

SEQ ID NO: 22630 - DNA, 1532 bp, Heterodera glycines
aaaaagggaaagaaaagagagagaaaaggaaagggaaagggaaaaaacgaggaaagtgagcggcaagtttaaggaagggtcgcgcattcgcgttcgattcgactaaccctgagggcgatttgtcgaacgcaaaagtggggacttgaaaattgactatttccctaagaaatttcgccaaaattttccaatttttctgcgttcgacatcccttcctcgtgcgttcgaacgcaagaggggctgaataattcctaaaatcttgcctatattttttaatttcattaaaaattcctaaattctcttaaaagttgacccaaaatcgcaaaaatgttgtcattttttggtgaaaatctgttaacaaatcacatcaaaatttcaaaaattttccccggcggcgcctatcggcaccgcctgacccagccccccgttccccaaagttttttgaaaaaagtgcaacgcaaaaaactggcatgaaaaatgcaatagatggtcgcgcaaaaaattggccggccgttgacaaaagggctccgcaaaaaaaggtgatgaaaagcaaaaaaataaaaagtaaagccttcaacggggcaaaaatggccgaccgcaaaaaaatttgacgctgacccccccccccccccccctagggggggtcatcgccgaacgcacgacccttttcctgaccccccccttgcacacgtatgtacgaatttgaataggggttcaaaaagaaaaagattgttttgacggacccgctcactgacaatggccgaaatgtttgtcgctttttcctgcagttttgacgacgcctttttggctataccaaaaactcggtctgaaaaaaaagaaagaaaaaatttaaaacaaatttcaaggacttccaaattgtgtgtacttgcaatttgcgatggtcgcattgtgtcgtcgcccgtgtcgtggtcacttttttcgccatttcggtcagcatcggtcgatgcagaaggcatttcttcgttgtcaacgcctaattttgtttgaattgtggaccactgagacttgaaactgctcagaaaattattcatttgagctaaagaaaataggccatttattaattttgtttcgtaagtaaatttgtaagtaaataaacaagaaaccaacaaactctgccaactcataaattataaatggataaacaaaatgctttttgtttttcgtggattggatgaaaaagcaggaaaggagaaacaaaatgatgaaggaatgaggataggatcatcatctatttatgttagttaccgtattttctctttttatcgccccgggggattatttttcaaactcctcagaaagggggggggataattggagacggcgggattaatggagacggcgggattaatggagacggggtgataaaaagagaaaatacggtacctacatatgttacatactactatgcaatgcattgtgactgagtttgcatacaaatatttcggtacttatatggttcgtacgccacaaatttaaaatttttttttaaccatcacagattccttagaaagtca

SEQ ID NO: 22631 - DNA, 914 bp, Heterodera glycines
  misc_feature (20)..(21): n is a, c, g, or t
  misc_feature (41)..(41): n is a, c, g, or t
  misc_feature (96)..(96): n is a, c, g, or t
gacgcgatgaaatcagtgcnntaatggaccaagtcaattgnataatcaataaaaataaataaattaatcattcaaattattcttttactcacattntaccgaaatttttgtcaatttaattgaaattattttctgcgacaaaatccgggcacatagcatcatttgataaaaataaatcacatggataaaattttacaaaatttgaattttttaacatgtataaaattgaattgtgctttttcggagtttttttagcaatatttataggattaaaccaatatttttttgttttacagaattaaattttttaaatatatttaaaagttgaataattggattattaatattaagtgttgctatcaatattctgttaaatagaagtatttatgcttatgcaaactgagataaactctgtcaaaaaatatgaaatacagtgagaccgattgagcaattttcttcccgtttcaccaaaacagcccctgttttggttttggtttgatgtcttcgcgaatagaagtgacttcatgtttgatggactccacattcctgttcatctccgtcattttctcgttgagctccgttttgatggacttaactttctccgtcattttctcgttgagctccgccttcagaagatcaattctcaaacccatctctgtcttcatgccgtctatttttaccaacacaacatcaatttttgaggtcactaacagatgaaccatcgcccaaatataagcagcaatagacaacaacgccccaatagatgcgagaattttccaataccaatctgacgacgcgctggtaacttcgccggcgcaaacagtacagacaacgagttgcaaaacgatcagcaaaatctaaaacaattaagtgcttatttacagagcaggtcgtttcccgcgctttgtcccccc

SEQ ID NO: 22632 - DNA, 963 bp, Heterodera glycines
  misc_feature (111)..(111): n is a, c, g, or t
actcatatttgccagtcttttgattctgtaaaaattttaaaatcaaaaattcggagcgaaatttcttttctctcccacccctttctaaatggcttaagccaacaaattacncaattcatcgcgtcatacaacgcctgtttgtccgtctcacaatcagtggcaaattcaaaatagccaaaaaccgtgcgattttcgtcaagaaatgaattggggtcggtgaaaacacgctgaactccactggtaatggcttaaggtcgaaacaaaaattgcatcttcagttgattttaaacaataattactattaatttgctcaaataattcccctcggcctttctcaagccaatcttcgtatttttccgatttagtggtaaagttgaagtaaatgcgattggcagaaagacactgacaattcaaaaacaaaaacggccgctgttcggcacctaaaattggaatgaaatgagttcaaattatttaattacaacaattagtgatgtcacttttttggtttttgtctttacgtcattgttttgccacttcgtggcatctagaacaaatgaaatacgccgttcgaattgattgcattaaagacaattatgtttccgatggattttcaaatttcggtggagtttttcattggcttagtcataatttaattgagaaaataaaacaaatccacttcaattatgaggtattgacaactttttgtgtttagaagccatttacagcaaataggtggcgattattcaaatcacaaaacgtattaaaatgatttaccttcctcgtgttccttcttgcaaatttcgtggttctcaatttgtgggccgccgttctctttgcgaatgattggcccattttttccgtcattttccggccccattccattttctacattggaatcgacaacggcagaatgtttttgatccaagaatttcacgattggtacaaggactctgagaattcagt

SEQ ID NO: 22633 - DNA, 2449 bp, Heterodera glycines
  misc_feature (1028)..(1028): n is a, c, g, or t
  misc_feature (1122)..(1122): n is a, c, g, or t
  misc_feature (1127)..(1127): n is a, c, g, or t
ttttttcttaattttaatttaagatttgggttattagaatttaaaaaagtctttagaattcattatcctaaggtaaaaaaatatcttttttaaataaaaagtctgaatatttttaaggaaaggacggttaatttataaggtccgctgattttaaaggttaacatcatctattcttttaagccattgacgaagcttacaacggtacatagactgataaggaaatttaaaaatttagtcagttgaacggttaaatttcatggggccataaaaataatattttttaatgacagttaaattagaaattaattattaaataaatttaaatggagccttaaaatagtatttcttaatgacgcgttcattaatataaattaattttattaaatttttatgacatggcatataatttcatgaaacgaaattcggacgacagtgacaatttgggattgacatatgtatggaaaagtgcaaaaattattttaaaaatgaaatttttaattaggatattggctcgacaatgcattaccctagcaaaggctttagcaaagatcgtaaaaggtttttataataaaaaaataaataaaaattttgggaaaaataattttccaatatttagttatacaatcctaacaaaagacccaaactttcaacaaacaatgggcaaccgtgctggactttcattcaaagatgctcgaataataaataaacgttattgtaaaagtaggaaaattttgataaatttaaatttaaaataattaaaacgattccaaaaattttaaatttttttaaaatataattacaaaaaataattaatattttttacaaaaaagattcatgcagtgaaaaattggaatgctcaaatgacggttacacagatccaaacaattgcaacaaatgtcggtgtccagatgtaattcaaattttattaatttgaaaagaatgtttatcgaacaaatttagggatattcgggcgccttctgtcaagaaacaccgttaagcggtaataattagttataatgatgaattanaattaatgcagtaataattaattataaagattattaaagttaattaatttaattaatcagacagtccattttgtgtcattaaaataaattaatntaatntaattagacaattcgttttgtgtcattaaaataaattaatttaatttaattagacaattcgttttgtgtcattaaaataaattaatttaatttaatcagacagtctgttttgtgttattaaaataaattaatttaatttaattagacagttagttttgtgttattaaaataaattaatttaatttaattagacagtttgttttgtgttattaaaataaattaatttaatttaattagacagtccattttttaatttaattagacagtccgttttgttcaaatgtcggatttttgatggctgggaaatgggccggaacaatcacaactggtcaacttcaaccgaacactgaatgctattggagaattattgtaaaaaattattattttttttataaaattaattaaatttttaattaatttgcatttatttagccacataaacacgagcaacgaatcaaaattacaatcacaaaattggagttcccgtgctccgatgcttgttcaagttatttggaagtgaaagcaaaaaagaaaaaaatttcgacaggttagagaatgaaattacaaacgaaaaatttagaccattattttctgagagatttttctttatgttgggttagctaaaaataatgttataaaaataataatgaaatttctgttatttttgtcatgaaattactccccaataattaaaaataataattgtaaactgttattacaaagtaataattgaaaaaatctatttcattttatttttctaattttatatgtatttatttttaaaaaatgttccaaatttttataattaaattaaaatcaaattttaacaaaagcaattaattaaataattttttatgcgcttttgatctatttaaatttttaggggctcgactttgctgcggcacaccaacaacaatatttagtgatgttgacacagacgttattttgatattgaaagtttcaaataacttaaatggcacttttcatggcgctaattttgaatataaaagcggtaatttttattataagaaagaaaatactgtaaaatataatacaaatttacagtaaaagcatcgattacggtaccacaaacaattcaggtaatgtacaagtttaattttgaaaatttattatttttttgaagccaatccgattattctttacttttttaaagaatacaaataaattcctcgacaaatttttaaaaatttcaagaattaataccctcgtcaaaaagtatcatagaaagtcaaaaatttaaatataattaaaatttattaaaataaattaatttttgaagactcttccgccccagaatggtt

SEQ ID NO: 22634 - DNA, 1552 bp, Heterodera glycines
  misc_feature (164)..(164): n is a, c, g, or t
  misc_feature (1459)..(1459): n is a, c, g, or t
attaaactgccaatttataagtttagcaaaataataatacatttaagaagaaaatggaattaacacgtatattattctgttcaattttatttttgatcatcctaactgatcagatcggatcagaaaagaaaaaaatggaacaaaaaacatttgatgaaatattntggagaaaaatgggaagaaaaaagaaacgaagaacagaaaaaaagagaaataattggaaaatattataaaataaaagagaaaattaagcaaaaaggaagaaaatacccaagaaaagaatggaataaaattgaaggaaaaattgcaaaaaaattgggcacaaatcgccaatatatttatgaatggatcaaagaattgggattaaatcaaaaaacaaacaaatgctacaaatcaaaaactgatgaagaaaaacttgacactgtacagaaattcattgaaatgtcaaatgaatttaagcaaaaaagaaaatattcaagcaaagaatgggacaaaaattatgaagaaatttgtaagaaaattggagttagccttaaaacaattacaaaatggaagaatcaatttggcattagccgaaaatttataacggaaaaagaaaaaacggagaaaatgaaaatttattggcaaataaaaagagaaatgccgaaaatgagtgacaaggaaattggaaaaacattgaaaattaatagaaggaccataagcaattggaagaaacaatttggagaagaaataatggaagattgaaaacggatgaatgattctaagaatgttagtgatatgattttaagagtggctataagcggagatcaaaaattgaaattaggtaattagcatttgaaatttttcaaaaaagagaaaaaaattcaatgaatttttattctaaaaaattatttataaaaaatttggcaataaaattcatttattttcaataaattgttttcttttgcagaaacatttaatcgctaagaattaaaaaaataattctcttgacacttttcccgcacaattaagccctccccctccctttgatgtccccgcccaggggaaaaagcttctttttttggtatgtttttgttggtgaattattttgtcatgggtgtgcaaatgaattggtggcgatgggttagcgtttcgtgaatctagcaattagcactaattgtgcgtgccgtccttttgtcggcgatttacggggtgacaaaatgtgccgccatcaaatcattgattgctttttattccgatcaattgagcatttaacaaaggacgattatcacattaatgaggtttaatttgacgggtttatcttttaaaaaatggtaatcaaagttattttgtgattgggtatgacattttgaactgactggatgctttgctatcaacaaatatgtgcttttatgattgtgatcaacaatattgatcagttggactgattaataaaatgataaatgcattttgattttanattattttgtaaactcatttttgaaatatttgtgaacttacaaaaaagattggagtgatatggcatcggaatctcactaatttattgcgcgat

SEQ ID NO: 22635 - DNA, 1057 bp, Heterodera glycines
cagccggtaagtaaaaggagaaacttgtccaaacgatgtccgctcagcagcagagaaaaacccacacatcaccttcccaaaaatgaaagagcattagtagctaaacagcggcgttaatcagtgagtcccgcaaaggcaaaaaaaccgctcggctcgtccaattaatcaaatccaatcacacacacaaattaattgctgattgctaatcgggcggctaatggatgcgccaaagaacaaaacaaacggcgcttttgcccacccgccgagcagaagcaaaagccaacccaatccatcaaaatcagccggaaaaacccgtttttttagagatggaaaattcttttttcggtgggttcccccaattgccaaattgggcaaatgtcacattctctgcactatggaagaaaaaaaaaatgcaaaatgaatgtcccaaaaattgttttggcgaactgtttttatgtgcgcctttggcgttctgctcagtgtgaaaacggaaaaccggactcataaagcggtgaaagtgttgttgtgaagggggaaaaaacggaggatggaactaataatggtggcaccacggaattagttagcaaatttaagaaaatgaaataaaaataattaatttttattgaaatttatttatttatttatttatttacattaaaggttttttaatttaaaatggaaaataaggataatattgaatattttatgtatgggtggaaaatgcgcatttatagaaaaaatgaatgttttgttagatttgcataataattaggcgaaacaaactgaaaaggataaaaatttggttgtgaatttttatgggccggaaaatatacaaaattattaattttaaatgaatttaaattgttttcggtttttaatttttattatttcgacaataagtataatttcaaaaaacttgccgatttttcctgaaaaaaatataattcgagaaggtgtgggggaattccatataaatcaaaataaggggtcagaaatccatacacaatcacttcaggccctagggaagccggtatcctaaaattttataaatctaaat

SEQ ID NO: 22636 - DNA, 1226 bp, Heterodera glycines
tttgaaaaaaggtttaatttaatgttaatttacatttttataatgggttaaaattgtgcagaaaatgacaaagaattatgctattcatctgagaaaattagtcatttttctgattattttaaattatattgtgctttggttttttccgaaatttggaccgaagtaggggtaaatatcttatgctagtagcaattttcttaaaattttttgtaaaatttcaactattatgataaggttttacaaaaagcggttaaaacatttggaaacttcgagtaaatataatctctctcccatagtaataacaattaataataataaaaaattattcgttttttctgaccaatttaaaattatattgtgctttattttattcaaatttgatgatcggtgcaggggaaatatctcaagctaatcttaatatttttttaaaaatttaaaatgtttttttgaatccataaatttttttaaagagctaatctgatcaattccctcttgtgtgcttggattacgtgtgtttgttgagagtcttcgtctcagttgcggcgccgaacgaccgttcatcggactgctgacatgggttggtgctggtgttgtcatcatttgtggggcactgcttcgactccttgagaaagtgcagccatttagagcaaccattttttgaatgattccaattaattaattgtctgaattttataaattagatttttttctttataaaaacttttattaaattttcatttattctaaaaatttaaggtttcggaaatttgtttaaactaactatctaatgaatttattgctttttttaattctgattaatcattaatcgggcaaatttttggtggaataaaaatgaaaattaaaattaaattatctgttacattacatcaacttttttatacggtaaattttttcgttttttttttctcgagaaagtgaatttgatttatatattttggttaaaggagtgaggaaaattcagtttttgatgacagagcacattaattaaagcaataaaaaaaatttcatgacggaccaaaagggcacgcgtgacccattgttttagttagataaataaatttgtaaaaatatttattcatttttgaaataaactgttataaatatttatttaaaaattaattttatttatttattttaaacttttggtattaaataataaaaaatgataattttgttggcattttggcgtaaatcagttaatcttt

SEQ ID NO: 22637 - DNA, 1524 bp, Heterodera glycines
attaattttttgccgcataaacaaatctgcgggagttgtgtttaattttcggattaaattgagtagggaagtgatgctaatttgtaagatgaagggaacgacgaaatttgtcatcagaatgacatatggtccgttagcgcgcgaccgcttaacgcgacgaatttcttcttttttttttggcgtgtttcgcgtaatttttaaatcacattttgatttctaacaaattatctttttcacccatttcgcatcatctgttcgttccaaattgttaaaattaggaaaaagctgaaaaatgaatatttttgggttaaattttaaaaatttctgtagaaaatttcaatttttttatcttaattaaataaaaaatattatttcattcaaataaattgatttcgaattttttaattgatcaaattttgagaatgattcaaaaaaattttcaatttttcagtaaaaatctcatgtttcgcatttcgtatttattttagtttcgttttttcgtatttcgcttttttcgaatcgcaacaacggatggtagtaaaatttatatataaaccttaaaaatagccttagtaattatgatgaagattagatgcttaatgattaatgaatatttttaaactaaatcaaccaattgcactttaagaaaaccaaaatatttgggtcgaattcaaattaacattgcgccaaacaaatacaaacaatcaaataaggggccaaaaagtcactaataccacagcttaatgattaatgaatattttattaaaattaaatgaaattcattatttttattatttggagggggcgaaatttgaatttaaaaattaaataaacttttttgcccaaacaatttgaattctacatgatatgaattaattagttcataaatgcaataaaataattgcacataatctcgcaaaaattccttctttctgtcattcggtgcaatttccaacaaaaaaatttttcattgaaataagtgaattgagcacattttcggtcccttcaccgtcagccaaaaatgtaaggggaaattccttttgtcccccgaggggtttccccggccactaataaataataatttagcaaaaaaaggcaattaagaaaataaattcaaaacaatttaatgataatttttttatcacttgggctgaaccaacccgtgattttgtgaaagaagaagttttgagcatttaatttaattcttgaaaagaaaaatttaatgaattcatcaatttattaatgggattaattttataatttttgtctgatcgttattctgcatttttgatcatcttttctatattaaaagaatttcatagcaaaaatgtaaataaaacattaaatcctacccaaattttataaaatgccaaaaaaaaatgtgaaaattcgtttcctgaaattaataaatcttaaattttaactgtaatacatgggcatatatatatatgtttacgcgatatttttatttaatattatttaattgagtgtatttttgcattttagaaatttggtgtttttgta

SEQ ID NO: 22638 - DNA, 1404 bp, Heterodera glycines
atgtgcgatgacgaattaggaaataaaggttactaatatttaatgggctgatggatggcatcagtgccaaaaaaggggcataaacattggggaaaggtcgagcggaagaagaggaggcattcgtagcctttgcccgatgaccctcaaaggcttatcaaaaatgccaaagttgacgagaatgaggaagaactttaccaaatatatgaattggcactaattaatcgccgaatgaaaagtgttgccaaatcggactcactttctttcgctctctttctctttgttttgtgtggccatgcgcccgtagtcgtcacaccacagaagcagctcagactcttgttttgttttgtgtgcctttcttgtgccattcatagtgataagcgcactaatagacattacaccatttgagagttattgtccggcacaataacaacccaattaatgcccataaatgacattggcactttttttgttgttgaactttgccgggttcacccagggggcggcgggaggcttttgatgaaaaagttcattttttaattgtactaacaaaggcactttgtcacgccaaccgaaaatggttctgtcatttagcattaccggtcgaaattaataagttttaattagtacaaattagtggtaaaataatgacagaattgtgtaaaaagaaaaaaacgaagcggaaagttcaaaccgttaataatgagtacaacaaatacaaaatgaatgctctctttccatgaattattaggactacaaaattttaaaatgtggcaaaatacatttgaaaaaaattcatgcgaaacggaaaaattattcacatgaatagagaataagctgatcaaaataaagcgggcaaactggggcaaatggcaattccttaaaaatgccacggcatttgacacaaaaataatatttttgtgccaccgccacagtgaaaaaaggaattgcgaccggccaattagataaattgccagagaattacttatacaaattattgtttgttattgtttttgcttttttgttttaattgcataaaatgatgaggaaataaaagataagtttttgcaattacataaattaaacagagcattagtgaatgaattaatgagtttcaatttcaatgaatgaattaatgtgagaatgaaatgaagcgaatgattggcaccgacccaagcgaaaagtgagggcggagatttgtgaattatttaagtcggcccgaaagagtgggcggatgacagattgaaaaggaagaggaatgaaatgagggagaggggacgaacggacgcaatttaatatggacaataacagaagtggttgccgcatagagcgcaaaacagttgggtggggaatgccgggaaaagcttaaaaatgatcagtaaaacatgatcagagggggaaaagcgg

SEQ ID NO: 22639 - DNA, 1524 bp, Heterodera glycines
cattcgaatgataccaagttttaagaaattggccgactaaaaaaaagttatggccacatcaatttaaaattgtacgagttgccatgacacccaatttttaactcaccaatgctcgcaacacccgccagtaaagcacctataagatcacggttcttttcggttttgtgaccccccctgaaattttcaaataaaaagtcatttctagggtaatttggggcgctgatcacgaatatgacatttatttttcaaaattccgaatcccgaacccgaattcgaacaaaaattctaaattcataaattacaaggaaaacatatttctaggggttttagaggtcgctgaaaacgattatgacatgcattttggccaaattcgaaactcgaaccctgacttgaacaaaaaaccgaatttaaatggtaaaatatcacaaatttggtatcattcgaaagctcttgatgagctaagttaaaaaaaggatccacgcgtttcggcgctcccgtttcggcgctcccgtttcggcgctcgtgtttcggcgctcacgtttcggcgctcccgtttcggcgccagctcgtttttccacttaagcttttttctttgttatccaaatccaacaatcttggtatcattcgaatgctcttaacatgctctattagccgtatcaaaaacgaaaagtttttcaagcctgtaaaaattttattaagaaaaaacttcaaaaatttcgacttttcgcaattttcatgcataactgttttgataattgtctaatcgcaaagcaatagcttaaaaaaagcttctaaatagattaagctttcgaacgacaccaacaatgttggatttggtttacaaagaaaaaagttatagccaaaaacatgctggcgccgaaacgggagcgccgaaacgcgagcgccgaaacgcagtggacccctatgggtcaactccactgtgcagagaaaagccttgtactatctcgtcgtttctctttttctttgtaatttctctctctttggcgtactatctcttcattttaattatgtaaaaaacaacatttacttcatcctgtttaactttttttctgtttgttaaatccacatcaaattttgcatagcgatagagaaaaaaattaggaacaaaatgtaagggtttttaagagcaaaaaaagggttaactaaaaagtatggagtgattaaaatttttgcatttctttttctctccttttggagtactattttcatgtctctaacacatgaaaaaacatcaaattcgtaaatgctaacaattttggttataaggatacaaaatcactttgtacatttagaatcaatagagaaattaatagttttagcatttttggtgaaaacagcagtttaggacttgagttataacgtgataagaatttgaaagtatcacaacttttttctgagatgtcaaattgcttagcattcgtttagaaaaagattcgccttttcaaaatccttttttagataccaaatttgttcagtttagttgggaatgaagtgagtttatga

SEQ ID NO: 22640 - DNA, 1602 bp, Heterodera glycines
  misc_feature (1530)..(1530): n is a, c, g, or t
aaaaaacaaagttatttttacaattttgaaatttaaatatgcaattgtttaattattaaatgaattttttacaaatgtcgctggcccaattaacattttcgtttatttttttattaaaattaaattcattcaaaaatttaatttaattattttcttaaatttttaaacaatttacagctcgacgagtcatcgggcccggacgatgtgtttgctgaagctcatccgatgcaaccggtcgctgctgacggtaagagcaaaagctcaatgcgaaaaaaaaacaatcgatcactggccaatcgatcagtggaaagtccattggcaaaaattaaaatttttaaaaaacaacaaggattttccaattttacatattgaatttaaaaaggttttataatttttaaaaataattaatttatcattatacaaaatatattattttaagtttttttatcaaattagataattataattttttcatataatttaaataaaatttgttttcaaaatgaatttttattgacggattgtccactgatcaattgatcagtgacggattgccactgataattttgatatttttgggtttttattgaatataaagaaatttttgggcagcgctgggcacatcgggagggaaattttgataaaataaaacgaaatttgttaaaaattttattgttatttctctaatctttcattcttttaaggtaccccaacattacccggaggcattccccgcaattcccaagcccaaattgacgttgtccggaaatcgacgtcggcacgtggcaaaaaaaattcggtgagtaaatcagggttttaaacaggggtctcaactgaaaattttcaagatcagcattttgattttggcttaaaaatcagcatttcaaaattttattacaaatggttaaaaatcaacaaaaatgtttttttgcggcgcgcttctaaaaaaaatatttttttttgtggaatttggagggggaggtgccgatagagactatacatatatggcaatttttgaggattttcaaaaaatcagcgaattttgaaaaatttttgcttggattttggtagaaattttacataaaaatgaccatttttgaggttttttaaaatctttacaggtgaacgcggagggcgaggcggacaaagcgattgtggccaaaaacaaggccggtcctggacagccaagtgacccgtcagacatgatcatgctgccttcaacatcggatgcaccaaggaggtctcgtcggatcgtggccaatgtaagttttgggtgggaaaaaaatgaaatttgattttcaaaaatggtttattttttaattaatttttatattttttaatttaccgattgctttttgattagttttttttaattaaaaaaattaaaaaacgcccattaaaaattttcaatttattaattaattgcatccaaaggcatttttttttatttcaaaatttattaaataacatttaattcatacataaaaaaggtgtggggggtgccaaaattttttggaaagggaggtcggncgtcgacgatcttttttttgctttcaaaaacagttttttccgggcggtttttcctaaaaattttctttttta

SEQ ID NO: 22641 - DNA, 1680 bp, Heterodera glycines
cgactaagaattttaaataaaaattcaagttgatttttttccattttcattatttttgctttgcgctgacaaaattttataggcgctcaaaagtgtgttcaattgccattgtccaatgccgtggatgaaataattggcataactgaaaaatgtctattctcatcaatgaaatattttcggtggtaaatttttaaaatatttttcaaaacgccttttccattgttaagaattctttcgggataaaagtacttaaaaccaaataccaaaatcacagattatttgctaacaaataagcctaatttgaaattttaaaataaaatgaatgatatgagctttggttaaaaaattttaaaaccttaatggaatggcaataaggtaagccaagattgttttctttaaattttaaaataatatctccaactttaattaattcttaaaatcataatccttgggtcattgggtaagcgaatatttatatgcagcccaacaatttggtaaataatatttggggacccgacttttaagacaaaacgacatttggcgactgaatttgggggggttcttatttttctgaaatttggccacgaatttaggatttttcacctcataaatttttatagtttttttttctcattttaaaagtgctattcgtttttcgaatgaaatttattttacttttctaaaacgttttttaatagaatcttattatttaaaatatgaactcctagtaaaacattttagtatacttgtgatgatcataaatacttgatgcatttggctcttggtgaaggttttttaacagtttttggtaaagattatcggttttttgaaatgaaaaatccccaaaatttcgctccacaatttaaattttatcactgacaccacactgagaagaatccgcagggcaaatgagaaaaacagctgcataaattgcttcatcaaaataccattttctttgttttgtgcacaaaattcctcgacttttttcgcaattcgatggccaagcgattggtcataaaaaagaaaacccacaaaattcgcattgattccaccgcgaaacacatttaaattgtggtaagtttcgtcggccgtgcttttgttattcactcggaaatgggcaaattcagcggcgcatttgacaaaagtgaaaataaacacggcccttttttgctgatcagagagacgggcggacggcagaacatttgggaagatggtgtctaaatttagggccgagttcgaattaggaagcctgaaaatgggtatgaacatttaataaaattgttatgaactgaaaaaagaaaatagggaaacggaaacccgaaaaatagggcacattaaaacaaaacaaaaggaaggtgaaagaaagtacaatagtgtatcttggaaagaaaacacttgtttttggcactgaatataactgccagagatgttacggaattccgactttaattagcctttatccggacttacccattttgttattcattgtgtaagtcatgaaaaggttgtcaatgaatttggcaaatgtgtgaacattggtgaccgaatttgttgggtcccattgatacggcgaaaacgaaacgaaaatttgaacaaaatttagaaaaaataaaattagcaaattgattttcattgccatatcgcgaaaaaaaattaagaaggttatattattataatatt

SEQ ID NO: 22642 - DNA, 1640 bp, Heterodera glycines
gtgatggacaaaaatttcccaaaaaatgtctcttgacattttctttttgattggttgactcattcctacaatttgtttaattgaaaaacaatttggcgaacttatcaattaactagcatatgtatatgtttttatttacctgctcctgatggattgatttccttcccccaattaaacgttaattaccgctcgacaaattagccaaaaatgctcccccccccctccggcgacgcccccgccgttcgcgtgcccctcccaattttttgagcacatggcctctaaaaatgggctcattatgaaacatttaaagattctgttccctcatatcatatccaattcccgcctcccaaaacccgccaaaattgcttccccaactcagtccgagtccgtgttcttctaccggtcgtccagctcctcactgctgtcgctggactcggccacttccaccaccaccagcagcagcaattcgtccggcattggcaccagcgacgcggaaacgccgccgttggcatttgagggagagcagcggcaacaacaaaagcccaacagcagcagcagaagtggcacgagcaaaagccaaaatttgtgcggaggcacggcactcaaaatggcggcagacggaaaaaaacagcaaaaagttgggcacaaaacagcaccaactgcagctgctcactgctgcccgatggaggaggaggagcaacagcaatccatggacaaggagcagcaacaattcgaggtgctgccaatgtgcgacggcatttttgggtttcccaaaaaacgaaatgcttttcgctaataagaaagccaacattttggtcaaaattcgttaaattttcccaggcgtcctccaccgcgcactgttcgccgccgtcttcgtccagcggcggtcaatccggcgccgccgccgcctccgtgctgctcgtcgacctgtccaatccgatgctgcagcaattctatgtgcagcaacggttgttcttccgacaaatttatgcccagcagttcgccgctctgtccgcccgacttggcatggtaaggcgctgacacttttagtgccaataacactctcgagctgactttcacttccaactctcgactcaatttcactttttttcccggttttattccttttcagtttcaaatctcaatcccgtttattaaaaggtgccttcgtctgtggaagagactgtgttcgacccgtccgttcctcaccagcacctcggctttccgcccgcttcgcctccaattgcgcagttggcacatttggatgcctttttcggctcgtcctccgctgaagaggtgaaaaagaacagagagagaaagaggggggcgggggtcggtcggcctgggggtataattaattaagatatgaattaaaatgaaggttttaaattgtcccgcctttaactccccccccccttcgtcagtgttttggctcgtccgcttctcctcctcccccgactgatcacaacggttcgccgccgtcggatgagtccgtcgtttattcgtcctccaattcaaccgccgatgcaatggcaccaccgccggcaacagtcgacgaatacagtaagtgttgtgcataaacatatatactgtattttttggcttacttactgtacactgagagagagtctaatcgcgat

SEQ ID NO: 22643 - DNA, 601 bp, Heterodera glycines
ggtgataagcggcggtaacaaaccgatcaccgccgccaaccgtggtcgtcgtccgtcgatcgtcctcctcctcacccattcagtcagccccagcagcatcagtttcgtttccccgtccgtcacaccgattattccccccaaaaattcatttcccccccccaccctccgcccattctctccaccaccactttcgaccgattgaaattgactggtgctggctctcgccgctggctgtttgtgccctccctgattgactggcattggccaccctttccacccccgggggcctttgtctccaatccccccaaatttactgattttataatcactttgtgtgccacccttttttctcccccccccccctccctctttcacaccacaacaaaacaacagttgttgtccaatcgctttgctcgtctgatcagtccgcacaccgtgccgggtggtgggactgatcattctcactcatcaccagcatcagatcacttaaaaaacaacccccttttcttcctttgtacattgcccaaaagcattcattgcctcgtctcacctcggagcaatggccaaccaatcgaatgaatgaatgaatggccagtcgatt

SEQ ID NO: 22644 - DNA, 1850 bp, Heterodera glycines
  misc_feature (1821)..(1821): n is a, c, g, or t
ccgatcttgtttattaaattgcaggaaataataatatcctctaaggtttcaaatttatttaaaataaatgctttctaaagttaataattcatttgtttcatttgaaagtttaagctatacaactattttgttttttaattcacctattaacattcctatttcctttaataataaaaattatactaaattaattttttaattttatttgtatttttattatattaatacattaaaaaattatttcgatttgataatgtgatcatcgtcccgcatgatttgaactctcatgcattcgcctggtttttctggtcttattcgatagctccttttcgttgctgcaaatagttctctattgatgatgaatggatgcattttaactagagaccggcgcaggacaggatcctgcgcaggattttgcatgatcccagtccgcaatcctgcatattttggaaaatacaggatttacaggatttgcaggattaatcctgccggatcctgtcctgtaaaaaattttgaattccaatcctgcaacaggacccgcaaatttgatttttatgcaggattcagcaggatcctgcattgattttttgaaaatttttaaaaatagaatgccaaatattcagaaactttcttttttcaaaaaattttttcttaataaaaatttttcgtttaaaaacttatccttattcgaaaaaagtttatacaattgaattttttatgtgttttgctacctaaaaagcgttaataaaattttttttcactattttcgtgcctattttaggatttttctgcctttttaagtgcctatttcgcgattttttgtgcctaaaaattccatccctatacataatggattatggcttttttgcaaagaaatttaaataaaaattattttactttaatttaagctattattatgagccacccaatttggcaaatcggtctttttaaacgcattaaagaagattcagtcgattgcttggagtgtaagcaaaaaaacgttattaatttttcatcttcatcattttttggtttaaaaatatatttgaatacttttttatactttgaaagattttttattaatacagaattttttgaaatttcctaaaatccgcaatcctgcgcaggatcctgcagattttaaatgcaggatttgcaggattaatcctgccggatcctgtcctgtaaaaaattttgaattccaatcctgcaacaggatccgcaaatttgaaatttccggtctctacctaacactcgaattttttttacttaaatttttgtagagtttttctatttttttttgtttaaatttttctttttttatataattttttttcatatattctattatacattgttttcctgatcaaatccagctgcataaatgtacacattggccggcgcattgcgctccgccacaattcgacaagcataacgcgaaattctctgatgctcagcaattgtgaaatcaattttttcattcctcgccctgccaatctaacaaagaaaatgttttatttatttttgtgtaaagagaaaaaattgtgaaatttgggggagaaattttaaaaattttactaagatttattaacagatgactagggagtccaatcaattatatgcacatgcatatttttttcctggactctgggaggcctgaaacgcacgaaaaacatgtttttagcttgttttgaagcttctaggatgactttccatatgcatatttgcatattttggcatttcgtgcatattatatgtgcatattttggcatttttccaaaaaacctctaatagaacgtcccccaacagacaaattggctnttttgaccctcaaaacccggaaattttcc

SEQ ID NO: 22645 - DNA, 1578 bp, Heterodera glycines
tttggagttcattatggcaggaacatataatggatgggggtgggagtacatgggcatgggcattaactgctgagcagtcagtgctctctggtcgagagtcgaaaaattttcccgagactcaagaatgccgaacaggtacatagactaagactcaagtccaagaattaacccacgagagtcgaggacgagacccccaaaaaagctgaaaaatttcccaaatcgaaaaccgcgacagagaaaatctcaagcagaacaaggcattggcatgcctgccatccccccaaagatgcaaaaatttaaaaaaaatgcaacaaaatatatgccaacaaatttccgctccttcccccctcggtgccgttgtatcattcatcaggcgcctaaatgcccaaatttggttgtaatacaacgttctacacacaaaaactaatgcaacaacacctgcttggctaatggcaaaaattttgcggaatttttttgcattgaaaattgcttgcaacaaaagttgacttggagtgcttgttgtgccgcctgtgccgcgctaatagtgcgactcgtgcccagttctgtgccggtcagctgctgttgcggttgttggtgttgatgttgttgttgtgacgtgaccatcggtcgcgcaactgttcgcatcattgagcccggagcgccggcgggcggcttctcgcgaactgagggaaaaaaacaatttttttttgtatttttatgctaattatggcaattaaattaataaaaagcgaatgtaattgctttttaattgtttaaaatattttcaatgcaattaaaaacttagatattctcgaaaaaataaattgccgaaatgcgagaccgaaaaacttcgcccgagagtattctgtcgcatcgaaaatcgagaatcaaatgactattgagattcaattttggtagggcgcgggtttttaattatttaattaatcgcgtaaaatgtgcaagacccatattttttaatagaagatttttatttttttatttttattttcgttacttcaaaaagagttggaaatccttcaaccatctttaaacaatcttttaaaaatgtttatatttaacgatataaaaaaattttttgattactttttcatcactttttttgccatttgttcatcattatttgtttaaatatttttgcgattttttttattttattgtatcaattactttttttatatgataattgttctctaaatattattttaaatgacaaataatacttattttaataacatttaaatttgttacaaaacaattacgtaatgtgtccatttcggccattgggtcgggcccgcccgttctgctgatgccggacacggcactggcgccagccgccaaaatgccacgaagaaatgagtggtgtctaaaacattttaataattatttattaattgccctaattaatgtattgcccactttggcgcctcaggcatatcgcacggcacaaacaattcgcccatgcaatcgttgaccttaaaattggtgctaggtcgtttcttaaaaaccgccactatgggcgtttcttaaatccgcccaagggtatgaaaacaaaaaatg

SEQ ID NO: 22646 - DNA, 1108 bp, Heterodera glycines
caggcccagctcattgcactacgtgaactcgtgtcagctgtatcagtacgaatgcgccatcagtgccgtgttggaaatatgcgaacattataaccgctccaaactgttcgaggcgtacggattcggcgccaaaattccgccggcattcgccgtcagtcacatgttcccattggtgggccatttgttgacaaatttaaaaaacggtaatgtcaaagcggttgaacaacaatgagagggttgtgcacggagttgcgggcgttctggaggcgtatcggtacgccgttctgaacacccatttgttcgggcccaccaatttcgcaccgacaatccgcgaattcattcacaaaacgagcaaattcccgcgtgacggcagccgatatcaggcgagcaatgaccattgttatttacatattggtgagttcgtcgtcaggtgctgctcattctcaccgatggcgtcatcacggacatgcaaaacaccgtcagagcgatcgtcgacgcgtcccatcagcccatgtccatcattagtgagaaggccctttgattgaccttcttccataattacgccctccccaacttgcagtaattggcattggctcggacgaattcgccaaaatggacgcattggacgccgacgaccgaactttgtccgtcgatggacacaccgccgtcagagacattgtccaagtgggagaggagacgacaatcagcaaattgattgattgtgacatgttgtcctttttcagtttgtccctttccgcgaattctttttgggaaccgattggacccaaaatgcgccttctgctctttgtcaagagtacctcaagtccgccctggccaaggaagtgctgtccgaactgcctgatcaggtggtgccctgccgaccgaccgatcacttacttttttttgcttatttgttaggtgtgctccttcatgaaatctcacaacattccgcccccactgcgatcgcctcacattccacaacaacagaatggtcccttcgtcccgtcatttccgaataaaaacggaaatgccaatgctccgcccctcaatgaatgatttcgttaaatctgatgccattcccgtgttctatttaataataatatttatc

SEQ ID NO: 22647 - DNA, 2180 bp, Heterodera glycines
  misc_feature (223)..(223): n is a, c, g, or t
gatttcatcaataaatgttgcgaattcctggacatttctttccgaaatgtgctcggtccatttatcagcagtagaaacacaattgaatataaaggcaaaaaataaaaacagttgcaaagtgtttacagctttacaagccatcatttcttttaaaaatcaataaaattagtgaagccatggagagcaacggaaattcccatttcctaattgttgacttataatntaagcttccgaatttttttattggtatcagattagaccgacttctgacacttttaggtttggaaccacaacctctgaaatttttccacactttttggaccggaatttcagttttctcaattttttggatccagcaattccgagtttcggtccgaaattggttcgggtgtgtcacgatgagaattaaattgctatgaaacgaaaacttaaattttttgagtgttcgcccctaaaataagtttttatccctattttggcgtttcgcccttattttcgcccctatttcgcgatttttgggaaatctattaacaaaaatgcaataaaaacggaaaatgcacccctaagaatcaacccaaaaaatttcggaaaaatacagccctcagaatcgacccttaaatcctaaaaatttctaaatgtacttcatttctaactgtaatcagtaacaaaattgtttgacttaattttaactaatttacatagagaaaacagtaattttaataaattcaccctctacatttgaaattttttcgcccctattttcgtccctatttcgcaaattttttgcccctatttatgcccctattttggactttttcgtacctaaaaatcccatccctagttatggccaagaatgactgaaaacctggtttctgatgtacttttggacataagtttgttcaaaatttacgaaattttttgcaattttgtaggctgatagagcacatttagggctatcgaatgaaatcaacaatgtttgattttgtttataaagaaaaaaatagatcaaaaacatgactctggcccaattcggcaccgccggcacttttcccctatccctgaaattttttctaacaaagccgactgccaatattgtgggcaaagtaacaaaaaaaaactagtttcatggaattaccccatcaaacatttattttttgaaaaaatgaatttttttcaggacccggttagaaatcgatatccggactcggttgaagaatttgggcccggaaccggttttgcacaaatatccggacccatgaaccgtactcaaaatggtagtaccggtgcgtcatttttccaaatccaacagcgtaaccgatttaccggaataatgaaaataagttgaaagagatttatccactaaaaagaagtttaaaatgaaagataggaattctaaactaaccgaaaaacaaagaaagcaaagtaaaaaaggacagaaaataaatgaaaaatctcagcaacaatttgaaaggattgttcctccaatcctttctttcttccgcgccgcaacactttgttcagttttgaaccgtcttttcacttttcattggccctttttttggttggccttttttcctttcaatttttgatcgactttttttgcatcagttttctgtttgccttttccctttgtcggcttttcggttggcttttcggttttttccgtctctttaaatccaattgcttttgcgtaccgtttaattggctcttttaacaattccaaatcgatttgttcaatgctaaataaaagtacgtaaaattttaaatattttaactacggctccttttggaattttgatgaccgaatgacgacggagtaagcataaaattattatatttttttaaatagatttgttcaaacctagcccgatcaaatgattggctatatttaaattaagctttgcatgaatttacctgtatcccaaaccatatacatcatccaatactgtgtcgtcaactacttcagaaatccacttgtgcaactctcctccacaccctcttttgtgctttgcaaagaattcaccgaatttctgtgtcggctccgacaataaagaatttagttgaaagcccaagttgtacagtatacagctaattggtggaatagcggaaggctttgatgactttacattcttcatttggttgagaaaatatcttctcacaaatctgtacacttctggcaa

SEQ ID NO: 22648 - DNA, 1544 bp, Heterodera glycines
  misc_feature (23)..(23): n is a, c, g, or t
attcaggaaaaacaagttttttnaattgaattttcataaaaattccggaaaatattttttttttcgttatttacggtccaaaaaatttatttattgaattttcatcagaaaaatacctgaatgaatctggctaaaagtttaaaagcaagtaaaatttctcgaacaaaacattttgaataaatcagctccccattttgccataaatgctaaaaattcaattccaaaaaatttatttattgaattttcatcaaaaaaaaaatcccataatgaatcagacaaaaagtaaaaaacagaaaaaagttgaataaatcataagtaattaattaatgtctccccattttgtcaaaaatttaattgaaatgccaaaaaaaaattagccaaaaaaaaaaaattggttttactgcggttagtttaagtgagtgaacacgaaatcgatcaccctgcttaggcttctgctgttgctgtgcttttttctattatttttgcccgagaatgaatgtggaatgatttgccggtggtcgacgagagtgggaggggggaatgcctcgaggggagaaaaatgtaagcggaagcggagggaggcatatgcgggtagcgccgggagggtgttgaatgtcgccggagggcaaatggtggccgtggtggcggataatggaggggggggggcacggacgtttcagtgccgaccgtttcagcgctgcgaatttgaaaattgattttgttttcttagccagtcaacttaaaaagaaagttctgcatcattgtcagtttatgaaatgagctctaagttgaaagtgccaaacatggcacacggcgttgaaaaagaccgaaaatgccattttagtctaatttgagtatatatatatttttttgccacggcaagatttctcaaattttttagactaattaaggatgccaaggcgcagcatttaatgatatcaaattttgtaaaaatttggggatgtcaaggaaaaaataaaataatttttactatcggccggcgctgaaccggctcggcgccgaaacgacccggtcctagcctaacagtgaatgtggcaggcagcagcgagatggtggggagccggtgaaccgacgacaacgacgaggcacaaaccccggcggcgcttcgctttgtgcttcatccgtccgtttgccgccccctcccccctcccgcccattcgatcgatcgatcggcttggcggtggcaaccgacgcctccgcattttcttctagcaccccaccgcttttcaatgcttttcacaccagcagcagccactcccccgccccccgcttccataggccgtgctcaccccccgtctgatcagtcagtgtcatcacagagggaggcagttgtaacacattttggttggacggactgctgggccaagggtggggcggcttggccattcatacataaaatgaaatgaacaggggctgaacagcagcagaagtatggggtagaggaggacaaagacgactttttgaaatgtcagggaatgctggcgaacttaaatagacacggatttatggggtggtgagaaaat

SEQ ID NO: 22649 - DNA, 1112 bp, Heterodera glycines
  misc_feature (35)..(36): n is a, c, g, or t
  misc_feature (71)..(71): n is a, c, g, or t
aaaaaagagatagtcgtttttacatacgatatgannaaagaaggcgtaaatggctctgaagcgtccatagnccgcagaccacaaagtaaaatgggaccataggccgcagaccacaaagtaaaatgggacaacattcataaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctcttccggaaaaaattttcaaaaaagtgttccgaaaaaaagagatagtcgtttttacatacgaatattgaaaagaaggcgtaaatggctctgaagcgtccataggccgcagaccacaaagtaaaatgggacaacattcataaaaaaggttggcctcaaaagggcccattcccaagctaatttcggaatttgctgataaaatcaaatagcctaaattatatacgcattataaaaaggaaatgacagaagcctcgaatgttagttatattgcgtgtcacaaaatctcttccggaaaaaattttcaaaaaagtgttccgaaaaaaagagatagtcgtttttacatacgaatattgaaaagaaggcgtaaatggctctgaagcatccataggccgcagaccacaaagtaaaatgggacaacattcataaaaaaaggttggcctcaaaagggcccattcccaagctaatttcggaatttgctgataaaatcaaatagcctaaattatatacgcattataaaaaggaaatgacagaagactcgaatgttagttatattgcgtgtcacaaaatctcttccggaaaaaattttcaaaaaagtgttccgaaaaaaagagatagtcgtttttacatacgaatattgaaaagaaggcgtaaatggctctgaagcgtccataggccgcagaccacaaagtaaaatgggacaacattcataaaaaaaggttggcctcaaaagggacattcccaagctaattttggaatttgctgataaaatcaaatagcctaaattatatacgcagtataaaaaggaaatgacagaagcctcgaatgttagtta

SEQ ID NO: 22650 - DNA, 1960 bp, Heterodera glycines
agacttttgcggcctgctgaaaatcggacatttgcggcccgacaaatgcggttggacatttgcgccttggacattttcggtcaatttcttaagggccgtttttgaatatttgcggcccgacatttgcggcctgctgggaatcggacattttcggacaacggaacgccaaattatcactttattccaaaaacgatatttgctgcccgactttttcgaccccaaccaaaatagggttcatttatcgaaaatcccttttcctcttaaaatttacgccgaactttattcaatttttcaaaaattgatgtcaaaaccccaccagagcttgaaagttgctctaccaactcttgcagcggccagttgatactgtagagatctgagatttcctaatgatgttcatacatctttctccatcattttgggagttgtttcgttgatattcttttcctcctcttcgttgcttccagttggatgggggttaggattttttttagaagacttgaatcggcttattagaaaaagcatgaaaatcggttaaattggatggaaaataattttccgaggtttatatctttttggggtcgaaaaagttgagccgcaaatgtccagaccgcaaatgtcatacaaccgccagaacaatgatgccgaataaatccgtcgcattacgcgtccattcccgctttatttccaaatgaaagcgttaaaaatggaaaaaatgtatttagacgtttcaaaaaccgggttttggcatttccgcaactcgagacatattttttcgtgcttaagacgaatcaattgatatatgatttaacccttttctaagtagggaaaaatggatttgaaaaatagttttcgatttttattcgggtacggggttcggaatttactcacttacagcgaccccgaaaagttgatacttttggttcagatcagtgagtgtcccgtggttgtttatacaaagtcgggttgcggctactgcaaattggctaaggaactgttggaacaggagagaattcgcttctgtgagcacgatttagagacgaaggaacagcaagagccggacaaagcacaggcaaatcggggaaggacggcacggcgcatggaatttgactcgcccgccgaattatcaaaaattagttgatttgagtaaaggttgggcaaaatggtagacctgctgctgggagtgaatcgaactctcggcttcccacccaatgctcttaccgtatgagctaccaggccatcccattcgcccttcccttttaggatcttttacccacttttaagcgttttaaccgtacgttggctcgttccttacatttgttaattatattttgtcattgtatagaatcccaatttgaaaacaaaaaataatgggggcgataaaatgcagtattaacggaatcagcctttcatattcattctgcttggatactttttgaaacagccatctcataatcaatatgtaaagagcttcatttaaatacttttccacttttatttaataacaaaaaaaatttaaataaaaattttaaaggtattttttaattcaaaatgaccctgtattgtgtaaaatatttaaattacacacaacttatcatagtttttttcataaaaaaaacattttgtcgttcattagtctggcagagtttttgtttgtcttttgaggtcccggttcaaacccttttgtctgtgaatgtttcggatttagagttatgtgaacggcttggtctatgtgtccaggcacagattggtgccgcaagtattcatttgtggcaaattcatcggcggtagatttatcagggagaaacaaatgatcaatttagctattttcaggttatacggaattgacaatgcttaaggagtccaatttgctcagagaagagatttcacggtgttcggacgaatgatagcaattggaaggaaaaaaactcacgttcatcaaaattagatcaatttttttttt

SEQ ID NO: 22651 - DNA, 1280 bp, Heterodera glycines
  misc_feature (18)..(18): n is a, c, g, or t
  misc_feature (70)..(70): n is a, c, g, or t
taattagaaagagtatgnacagaattagtgggctatttccacgtattctccgcgaattagctgtgcattntaatcaaatttatttaatataattattcaatttaataagtggtcacataatacggtcctttggtcgtccgccctaacaattacttttattattaccaaaggaattctcccgggctttgttcgtccctcaaaaatggcattgctaattaccacagtttcatttgtaattctcttgtcgtcggtgttgagtgcaaaaggtgatttcttctgctgatgaccacagttctgctgatgttgacgatatcgatggtccgcccttttacggtcgcattttccgcacttttcccttaggcgcgttttcggagaaaagtgcggttgttgtgggggggggggggggcgtttacccatcgaatgggtcactgaactctaagctgatggtcattagcggcgttaggaacgaatggctcagaaaacggtgccgcagggagacaatgttcgccgagtgatgcaactgctgagttctgtgaacacttctaagtgcttgcttagacccgtcgaattcatttacttccacgacaaatggtggaacgccacacttaacaaattgacctcctttttattagcatttttttgtttaactttattgtaatttatttatgttcaaagcattcgatcatttggatgggctgatgagtgttttcattttatcccagcagccccattctccaaagttgcaacttcgtctccatggcattgtttcggaatggcctgcccgtccctcttttcccgaagcccttaacaaaattgaattccaaagcattctttctccagctaccatcatcggaatggtcgccgggtcgaactcggtgtccctcttgccaaagccgatcatcggaatgccggttcccttgatgaattggtctgaatagaccccccccccctgttactgtgttctgcaattgccaattaccgtattcgacttcgcttcgtttccccatcttttcaaagttgtccttctcaatcgacgctgtttagagaattttttaaaaattaacttaccaaaaatcgttcggtcgataagctcaaaggtatcaccgccaaacattcactaaatagcagaaaaagtgggagagtgccgagtttgaacttcatcaaagcttcgcgacggaaactgaatgttttcattcgacaatttaggtcaattttttaaagggtgaagtcacacataaatccatgtgggagtttccctcggcacgggttcaatcgaccgt

SEQ ID NO: 22652 - DNA, 902 bp, Heterodera glycines
ttgaagagccaataaagctttatttttattcgtgcaatctattccatttcgtgtacttcaaatttttaattttaagattgatggaaatgtatcgtaaatttttaaaaatgcatatgcatttattctcggaaacctctaaaagcaggttgcattagtgatgttcgagaccgaaaatttttcgagattcacgagacaagacacaataaacccgagatttttcaaaaacttaataatgacataaaaatcatttaaattttttatgctttttaaaaagcaattttttgacgtatttccttacaaaaaaattttttttcgaattttgattcactttaaaaattttactaatcacgatgttgcaaatgaatttgatttccttgatctatcagtgtatttccgattgaaataatcttccatgcccaatttttccagttggcagtcaatccaggtctcggattttgttaaacttcttgctccaactcatcgctgatattaattatgacaatctatgcttatctatattttagtttaaacagccaacccgtaagatttacttcaagaaaaatcaaaatcataagggcattcattccttgttcgtttaacatcaaaaattttccattagcaaatggaaaagatgatggataatttttaacttttcttctgatcacattaaactttcaaagatggatagtttttgactttgcttctgatcgatcacattgaactttcaattcttcaatcactttcaaatgcaaaaaacatacggcgatgttttcttccgacatgaccaaagtgttggcttgccttcctgaatttaaaaaatctttattttaaaataaccaatcataaatgccaagcaagccaataccagtgatgggccggtttgcgcacctttttatgctcgg

SEQ ID NO: 22653 - DNA, 1098 bp, Heterodera glycines
tttccaaattttcacgatcaaatgcgctgagaaaaaaattccagacaaattagtatcggcgtcattatgctgagagtgcggtgggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaattttcacgatcaaatgcgctgagaaaaaaattccagaacaattagtatcggcgtcattatgctgagagtgcggttggaattcccttgactgtagaccagaaaaagagatagccatttttccaaaaatttcacgatcaaatgcgctgagaaaaaaattccagaacaattagtatcggcgtcattatgctgagagtgcgggtggaattcccttgact

SEQ ID NO: 22654 - DNA, 1145 bp, Heterodera glycines
ttacctctccaccagtgcctcgttttccatcagttcggctatcactttgccaattcgtttgccttggattccctcttgcttcagctaaactgtccctttctgtcggtgcccttttataggcttctctccgccccatcccttctgaccttgttgaagtagtggtagtaagtgaccacgtacgttatgatggacttttcgtccggctgttcaacatttacatcttcaaaagtgccatgccatcattcattttccatttattcccctttttaccctcggggtccaatagtttggccaattgcaattgcttctccgccacgtcgaatgcgttgttcaaattgtgcagtgcgttcgacttttgcagcccttcgtactcaattaggtcggctctgtgcttgtgaatgagtgcgttaaacgcgagcccgtcgcgccatgacgaagtgaagttgcgcacgttcacgttgcggtagccggccgtcttcatttggcaccacagcagcaacgcctccttggccgaccgcgtctcctggttgtccacgtcctcgaaagtgatgtcttggatctgaaacggacagcgggggcatggcaatggcactttttggaagggatttggcccaaaaggcaagggaaagcataggatcaaataagatccaattgtgagggtgggtgtggacctgaaatcgcaaaatgaccgtccaaattaatccgagtgttagccgcggcgccccgtcgacgatgtcctgcgagcccaaattctccaaatggacgtgctggtcgcgcagaaactgcagccccttgtccacgttttccaagcagtgaatgcgcattttccctcgcgtcggccgcggcttaaaattttcgccaaaatgccaatttttcctcttttttcataattattccattttcaccaatcgttcgcccgagagaacttcgagcagtttcatcagcattttgccgtcccttagatcgacgtaaaggtcctggattttgcagttgacgcggatcagatgcgaattcacccatttggtgaacgttttcttctgcacattctcgcgttcgtctgtaaagtgccacaccgtctcattgtgccaagtcggcctttctcctcccccccctccctctcccatcgatcgcacatttgcttcaac

SEQ ID NO: 22655 - DNA, 1351 bp, Heterodera glycines
tgtaagcggcttttttgtacagctcgacgagctctatccatccatgtttttggatttctgaaattttcagaaattttcgagctaggcaccctcaaaaattttccgtttttgaattttatgattttttacagatttttccggggaaaacggagaccactttcaagcaaccgtttttcatgctctatcgattggtgtcattttcagaaaaatttttcaaaaattttttggaaatagaaattttttggttggtaggcctcaatttcagttctggcgcaataactcgtcaggagttgattttatcaaaaaatcgtctaagagcttttttgtagagaattttaagcccaatctaatgtgctttatctcatgtttttaccatgagtttaaaaaaagttataaaattaattgtgattttgaaactcaaaaccataggggggaccccatggttttgcatttcatgaaaaaattttttactcctaaattagccaaaatgcatttttatggcataatttgaggtgctgaatacgtatatacgctttattttgcgtttcagattttttggaaggtgtttaaaattttttgaaaaatcgtcaaaatttgagccccggaaaatccagtgaaatttcgaaaattcataactctcttcgtttttggtcaaatttagtggaataaagctttaaaaatagagaaaaattgggagaattttatgagatttatttggaatttctatcttccaaaataaaaaagttattccagaatttctggaaaaattcgatttttcagaaaaaaattcagaactcccttctgaaaaagtattttataaaaataatatactcaaaaaatccgcaattttttgctctattttataaattttaatttagcttattatcacttttttgaaaaaagttatagaaataaaagtgattttggcattcgggaccaaaagggtgtgaccatgatttctgagtgaaaaaattttttcgacaaaaatcttccaaaaacatgtctttaggggtagtttatgacgctgatcacgaatacgtaatcagattttactttagacatggttaagacctcagaatccctgtgtgattggggattctgaggagtgtgagcgcccgtcctgaggacgcgaagcggccgaatatcccacaaaaaattaaaaaacgggcgcgaagctcctgtcctgaggccgcgaagcggccgaatgtcccccaaaaaaattacaaaacgggcgcgaagcgcccgtcctgaggccgcgaagcggccgaacgtctcccaaaaaattaaaaaaacgggcgcgaaagcgcccgtcctgaggccgcgaagcggccggatccctcccacaaaatta

SEQ ID NO: 22656 - DNA, 981 bp, Heterodera glycines
gtgttggtgacactcggctgtggcagtgctgctgtcgttgcggcgccgtcctgcgactgttgctgcggtgccgtcgttgttgtcgtctccgttgctgttttgtcgtcattggtggaagtggtcgctttcgctaacagtcgctgcattcgtcgcacattgcgtggccattgccatttgctggcgttgagcatcagcacgggctaaaaaagtggggaaaggcgatgagcaaaaaaaaaaacttccgaaattttctggaaacgggccaaatttattttttgcacaaaatgggttttattggcgcgggttcgaatcccattgggtgtatgtgccgatgaaggggggaaagaagacaaattttgaatttgaacaaatttaaaaatttccagtggcgcctatcggcacccttccgccgttcctcaaaattttttttccaaaaaatcgcatttcacacacctgcacagtcgccggatacattcgtcgttccaccgggtacagccaggcgtcgagcagcacacaggcgttgaacagcgacggatattcggcacatgcggacagcgacgaggcggcgccaaaactgtggcccatgcacacgcagcgatccaacgcgagacgattctgacaaaacggggagggaattttctatttattgagtgaagaattttggttggacaacaaaattttttaattttttactacgcttttccaaatcgagcaaaaatttccagatcacaaacccgttttcgaaaaatgtttcattttcatttatttccccccattttccactcactttgaattgtgcccaatcgaatgtttggccgagaagaatttgctgttgtccaatttggcgttcgttgttgttgtccgtcgtcacattttgcagcaaattggcgtccatttcggctaagatccgtcgcatgtgcaccgtctcagcaacacgtcgtttcacctgattttaggggaatttgaaaataaataaaaatt

SEQ ID NO: 22657 - DNA, 1423 bp, Heterodera glycines
  misc_feature (35)..(35): n is a, c, g, or t
attgagagaatgagttgagagaaatgaagagcganagttgagaccaaattgatgaaacaatacaaagattgatgaattctgaattattattttttcttacatgattttcttcgcatgatttaatttgttaacaatgctaaatcaataaattaaaaatggaaaataaattgacaaattggcttaatgttagttgcctccggtcccctcctcttccccctttgtatttttctctggttatctcccttgttgacgcactatttcactgcccccaaagtgtataaatagcgcgagttttcgtctgccaccctcacttttcaaaccattcgaaaaaaattcaacaaaaaatggcgctcaacatgcaagacaagaagggactcctccaccaaattcttggcgaagcagacatcacggtgactacgagcggcatcacgatcagcggtccacgtctctcctccccccgttttattccctttgatgaggccggccgctgccgctcatgtcgtggcaccgaggtggaactggacacgatggtcaccaaggagggcatcaccatttggtgtacacgtatcgaccgggtgcaatttgtccctttcgacatcatttacgacttgcccggtcactgcttcttccgggtgaagaacaaggcgcgggtgttcaacattccctacggggacctgcctgccatcacattcccaaaccatcaagaacaacagcagcagctgcaacagcaacaacaacagaacgatttgcgccaaaaagctaacacggcgatggatttggtggagagtggactgctagctgattcgttacgtgaagaaggcgtgcagagggctgagctaaagcggaaggcaaaagttgcactcgatctgattgatgccggtttgaccggtgatgcactgcatgaggagggacagcgttggaagaaggccaaaactgcactcagcgttctcggaaacatgttgttggccgattcacttccggaaaagaagactgcggagctcccgcttccaccagccgaaaaaattgaaacactgccacttccaccactcgaaaaaatgaaaacgcccccacttccacctgccgacaaaatgccttcgccgctcccaccatcatcaaaagtggaaagtgatgagcaacaattctacgacagcatttctgcggctaccactatgatggacagcgcctcaatgcagcagcaggcaccgctgaagagaaaacagctgactccaaaaggcaaaagcaacaacggtatgaagaaggcagctgagccgcagcatcatcacaacgtgggggacatggacaagactcttgacgaattttttgagagcgttagcgcagcgacgaccaatttgtctatataaattgttgtttcatgcggggggagtgaattttaattaatttattaacacagaaatgcttaatt

SEQ ID NO: 22658 - DNA, 1752 bp, Heterodera glycines
tgatcaggtctagttttttgccatggtcatataaatataattttaatcatttaaaattttaagtcattaaaatgcaaataagctgaaatgaatttatatattcgatagtcctaagaagtctgtgctattgttaattattcaaaaagctcatcgagttttaaaaaagttctggttaaataattcccatttaagattttgtggaatttcatatccataacttttttttactagttataaacaatttcaaaatccaatattatgatagataataacatataaagctattgaatagagctcggacaagagggtcggtcgagcggtttcggttaaaaagtgaaaaactcaaaaaatttgcggtcgcagggttgcggttaaaaatccgcaaacagccgcaaccgagaatctcaacaatttctcgttcagtctttttcggttataaaccgaatccgagaatcgaaaaatgccgaaaaaagccgaccggtgcgatctactaatgaatggcaccatgaaatactaaattagttgaaattggctcaagatgcaatttatatgtctttaaattctattgagaaaaaaatttgcccgatgggcaaaacaacgctgattccgatgccccaaaaattttcggaaatcggaattcttagggtcaaaaattttttggaagtcggaaatcgtaaatagtgccatccctgttccacacccttggctactaatcgcttccacacccttggctactaatcgcatatcattcatatcttttaatttttagggcgacggcattttcttatctttcgcctattttattaaaatattatttaaaatagaatatgaagtaatcaataaataaagtaaagtgatgactatgaagggcaattgcttttggctaacgcattgtattgcaaagaatggcttttaataaacgggaaaattgcctctgtttgaattgcatatgattatggagagatatagagaaacagagaaaaaaagagggctaaaagaaagaggggaaatatgcatattggctatgaagaggggggaaatatgcatattggctatgaaaagaggggggaaatatgcatatgggctatgaaaagaggggggaaatatgcatatgggctatgaaaagagggggcaaatatgcatatggactatgaaaatataaggggaagaaaaagcaattggaaatataaggcaggaaaagaaaaagagagatttacaaatgacgtgttagtttagaccatggactgcataaatagggaattggcgcaagcaaaaggcatcattttaaatccatattagccctctccctatcagggatctgctttcgcgtttcgctttcgcatatttcgcttttttggcactttcgctttcgcgtttcgcattttatttcccgatttggcccatcccagctccctatgtatgtgcataaaacatatccaaaagcttttcactggggcttttcatttgtcctaatccatttaaacagagtctctctcttttggcgattttcaaatggggattagaaatggaaatgtaacgtttgccacgaattttgtcccataatttttttcctcgaaatgttaggatatattttagcattttttagcgcataagtatgcaatcaagcttaatttttcttgtttttgtcggcatttccatttccaagacgttgtcttacgaatggaactcaaaggagtcgctcgacaatgtccgtacatttgccgaaattatgggacgatctttacaggacta

SEQ ID NO: 22659 - DNA, 1106 bp, Heterodera glycines
gcagtggtcgatgatgccaaagaacacattggggatgttaatgcagagccaatgccggaatggttcaatgccctggggacggacgagcagcaaatgaagcagcgcattgatacgctaattgagatggaaaggcaaatgcacgaagatgaccgtaagcaaagcgagaagcttaatttggggatttgaatttaattctaatggtaaaattgatatttattatgcaaaagtgccacttttcagaaagcattgaggagaacaacattgacaccattgagctgagtttgggcgaactccgttcggactttcccaacggattcgccgtcgattggcaaaaactgttcaatgccattgtgcacgatcgcaacttcaccgcctcctccaccgttctgttggtagcgcaaaaaatgaacggacgcactgagaggcaaacgccactcgacgtaatggcggaatatatgcgcaattttgggcccaaaaacgacaccctcaacaagtgggagcagtatgtagagtggctgctgatactgcaacatgccgcactgtcggacaacaaaatgtacacatgggggaagaccgattggaattatttttgtggttatttactttcagatttcatcgtattttccgccggcacccgcggtcagccaatgccatgatgagtgctttgctcgtcaacaaatactttttcgagaggcacgacgacgagcagtatatccgggacggcacatcggaggaacgtcgcgtggcacaaatccggcacaattgcctggaacagctgaagcatttcttcccagaatatgttgaccgaatgtttgcacttggtatgtaaaaatttagaatttaaaaataaatgcttaaaaataattcgaattggaaaatttaaatgccttttaaagggttaaacgacgccattgaggaggagtccaaaacggtgctggacaatgtgaagatggcatttgccgaagtgttggatcaaacggaatggttgagaaatgagacggacaaagcgaaggccaaggagaaattggccaaaatgagcaatttcatcggaaaggcgccggccatcggagatcccaaagacccggaggacccggattggcacggat

SEQ ID NO: 22660 - DNA, 1202 bp, Heterodera glycines
  misc_feature (1187)..(1187): n is a, c, g, or t
ttcatttcctccctcatgaaaccttctccactcttttttaaaaggtcccaattttaggccatttggggcgggggggggggacaactcactttaagctccccaattccccgttctttgttctttttgtccattgggtcgtagcgaaacaatttacaacgagcactgaaaagaacctaaaaaacaaataaataaaaaagatggaacaagcaaaaagcaaaagcacctcctcattttcttcgccgcttttcacatcgacttttgagggcaacggaacaatcggcttaaaagtgcccgtcggaacaaattcttcggccgcttcgtcgtctgaatcgccgcctttgtctgtcactttgccagccttagaaacatcagcagaagaaactaaaccaaatgaaaattgaattcaaatatttatacatccactaaatgaatttattacttgtcgtgagggtgttggcggtggtcgaaccgaagagagtgccaccggcggcggaggagccaaaagaagggaatttggcggtgccgaaagagaaggtggggacggaggaaggcacagcggcgggtgccgtcgttttctgctgagtgccaaagagaagcgggagagtggccgaggcggtggttgtggtggcgacgggggaagcggtggtcgaggcggacgagccaaaggcgaaaggactgcccgcgctcgtcgtcagtgccgtcgtcgtcgctgtcattggcgccgtcgtctttgacgccccaatgccaaaaaggaagttgtcgcctgttgcagctggaaaattaaaaacaatttagaaaagcaattaacatgtgcagaatttgcagcttcagtaaaaattgaaaattttcgcccccatttcttgaggacaattttcggaattttcactaaaagcacaattatatatttcccaagttcttggcttattcagtgcctaatgatacgaatttgtaattctaaaacattctttctctcactcctgtgaaatacccacagcaatgccattgggttcaattccttttcatacacatgcaattaaattttttaattaattaaacgcatcccaattttttataaaatgtaatccagttatttttttgctatgaaacggggcgcaagttcctcgctggagcacaaatgccgcgcggtgtccaaacatttgcggctcggacatttgcggcttccccanaatttcatcttcatt

SEQ ID NO: 22661 - DNA, 1540 bp, Heterodera glycines
  misc_feature (25)..(25): n is a, c, g, or t
tttcgcggcggaatcacccacaccnttgagcaacgacactttgtaggggttgtcgcgtgcagttgtccactccacattttcattcaagatgagcacttttgggtgttcaattgggtaagtggtggagaaactggaaataaaaaattataaattgtgaataatgatcgaaacaaaactcactttacgtacgggtagagggacgtaaagtcatagtacgagattttctcgccctctcccgccttgtggtacagcttcagtggtcctgttcttccacccatgaacgcctcgcgaatgtccaacgggccatcatccacataatcaccaaaactttcgcgcatgtccgggtcacggttcagcattcttttaatttggcattcccagtatacgtccactcgtgacacttgactttcgatgaattccagccgcttctcatcccgctctcgcacctctccagccgtttttccattcggcatcatcatgttgtcattggggaagcattcattgcagccgtgccacacgcacccattcacttcaattacccttctttccgcttccacccagccatccacggaatactgcccgagtttcttctctccgccagccgaatgtgccgtctgcaccacaacaccatgctcctccgcataccaatgaaagaagcgaagtgccagcaacgactggttttgggcgttgtcgtagccgcgttccgggacgatagccaagtgcttcttcggcagatggttggtgcgaaaatgcttcatacatgcgccggcgatcgtcatgcactcccgcaacacatcaatgccgtcgtggtgctcatagaaggccgcacgctccgcaacgattccttcatttcgtttcgtcacatccaaaaactcatgacgaaaagccaccagcgccgccatcagtatctccacgtcgttggtgcagtagcttgccaacgcctcgtcgaggaagaatggttcctgacggtgttgttcataccagtcgtcgaatttctgtcgtttatctggcatcataccattgaccaaatagtcgtctggtgttggatggatctgctttccatagttgtctgggtggttggccatgtgcggaaagaatggtttgtcctccacatccaagccaaatgatggaaccagcgaggcaagagacattggcataaggttgaatgaatcccggaaaacaatgtttgggttgcgcttcttctgccttcgaatccgcatttcgtacattttatttcccttaaaatagaaaaattattcaaatttgaaaaatagtcaatattactttgcgcaacatgtccgggttatatccgcgtttgaacaattcgcggaacaccagcaccatatcaaagcggccgccaaagtgagagaaggcgtaggtgtcgtaggccaaaggcaagtcgtttatcagccagctgacaaacgcttccaatgggttttccgccaccacttgcttgttgactgttgtttcagtgaagcggcgttgacaaaaggcgcctaggaggtttggcccgcacacctcacaccctcccgatgcctct

SEQ ID NO: 22662 - DNA, 3259 bp, Heterodera glycines
ctataataagaggcggtttcatcggtgttgtccaatgtttgtggtcactatgtaattactttcgtttattttatgtccgtcggattgggttttgaaaatattatgcaaattttgaatcgttcaaataaccctgatggatttgtttatcggtttgtaaccaagagcatacaataattattaacggaattagtcttcatcagatgtgtcgtcatcatcatcaaaggcatgtaaacagaaaaaggtaaaggcccaattccgaataaattcagcaaatccatttagtccatcatatttttcataatattcgttgaccactttttggctcgtgccgtcctcttgccttaagaaacccttcacctaaaatagcaataaaatatgaaacatattttccattaacctcaatacagtcttcagcatcgaaaatgtagtgtcgattcaacgatgtcagcgtgcgaatcatcatacatccgcttaccgatagtcacgatggctactgtatgctggagttagtgttgtaaaacgaaagaaacatacccaaggtttggtagtggcgtaatacagccaaattcacgagcaacttcctcaaggattcgcacacattcgatgagtcggaattcggtgttggatgtgacggtcattttttcaataaaaatcgtaaaataagattgaggaaaattaaagtatgaaatatttgtacagtaaacagtacgcgaaataattgaacatttcaaagcactttatgaatcaacactgaagaaacacttgacattgttacggaggaagttatagaattcatcaattcccttttctttgtcgaagtaaatagtctcaacgcttaggacgtatccaaactgtttgataattcccttgaactcaatctggtctccatcttcggtgatgtagatgagacgcggcttgtcctggtgctcgaatacgtaacgcttgtgctcctctcgtacggcaccgggattttgcagtcgaacatgaacgcgaccaggtcaaaggctgtgcaacattcggcgagagtaaacggctcctcctttttgttcagttcttcgtccattttctaaaatattatttctatttgataatattaataaaagttaacctcaacagatcgtagctcgtttgatggttcatccaaagacagggtttcaatcattgtttgttcatcaatcggcgtagtcaaattgttgaaattcatacttcgtttggctaaacagcattgtaaaagacagaaacagaaaatattcatgttaataaataatgaaagaagataagaatgattttgaaaaagggtaggattaaggataatacaaaaaaacgacgccaagccacttttcccgctaattttttgaatttgaatttaacgccaaaggttttcgtttcagtaaattatggcgttatgtatatattgtggcgttttgttctattttgcgtatttttaaatttttcaccggactacagtacccctcgcagtggtgacgtcatcatccttgtagcatatagtagacatttatcctttttctggcaagtggttgcgtgggagagtggtagtgtgttaggtttggtggcagaccaaaagttcgaatccttttgcctgcgacttatttattgcaattttccctggactacagtacccctcgcagtggtgacgtcatcatctttgcagcttatagtggacaattatcctttttctggcaactggtctcgtggcagattggtagtgtgtcaggtttggtggcagagcaaaagttcgagtccactagtctgcggcgtaatttttcgaataaaaaaagtcgcgcacccctgcaataggtttgtgtttcaaaaaaaagtcgcgcacccctgcaataggtttgggtttcaaaaaaagtcgcgcacccctgcaataggtttaggcttgcagaaaaaaaagtcgcgcacccctgcaatagctttgggtttcaaaaaaaagtcgcgcaataggttttggtttcagtactgaaaattttggcgctcagttggcccgcgctcacttggcggagctcacctggctggcgctcagttggccgtgcacccctcccataggtatgggaggctaccgtaacccggacggatttgtgtgcactaactactgtcagtaaatcattcttttgcaaattgtttaggaaattaaatatattcttcatatccttatgtctggttcaaaatttgaaataaaaacattttgactatttaaaaaaaattattggaaatttcttcccataaatattaagaaccatttaaaataatgttattttctttggctacttataattacgcgaatgtaataaaaagaaatttctataaataatatctttttggcaaataaaaagatatatatttttaaccgatttgatatataatattttattttctttattaattattatacaaatattaattactttcaaggtgctgttaataaatatattttttaaccagtacttcttgagaaatgctaaaaggaattaataattttttttttaatttacagttttttttatatgcttcttcttaatataatgtttttttattgtagtttcttggcattctgaacagaaataatatgtatgcgaaaaagtgaattttcattataataaatatattttttagatttaaaaaattttacttattgaaatcagttttactaaatcatgcattaaatgctcattagaatcataatttagcaaattttttttatttaattatcttatgatgaattcactgattcatttgtagtcacttagtttttttattatattttattaataaatttttgcagataaataataatatttagcaaatatttctcttgattattcgtggcagtatttatattgttaattatttaattgtaattacaaaatatataatattttatttttaaaaagattatgtaacgcaattattcaattattcattagtagttctatatttttgttgattactaaaataatttattttgaaaattgtcatccaaaaagttattctttaaaatttttcatgtccaatcttccaacaaattcttttttcataaactttgttttgaggcttcaattttatattatctcgtatgttcttattttttaaattgttcaaaagtaattattaatatttttagttaagaataatccaaaaaaagattatggagaaatgttattaatttaatttttttttattgtatttttaattttaattatttcatatatcttaaaaaagtatttattaagctttt

SEQ ID NO: 22663 - DNA, 1930 bp, Heterodera glycines
caaacacaaaaaagaaagtgtttttcctactaattagagcatggagaaaccaggaaaaaaatatgtatttacataaaattagcagccctatttatataacatgttatatatttattttgttttattttttgaaatcacttcccggtgcacgaaacttaccggtgcccaaacttcccggtgccaaaatttctggtgcccaaacttcatgtcgcctttcctagcagtcatgccagatgtgctgatttgtcatcattttgctgatttcaaggcaaattgaacaaaaaaattttttttttttgattttagcgtgggaaaatcgatgttatcaattttatttaaaaatagtctcgtcattaagttccgccatcccctttcctcccaaatagtgtaatgcaaatgatggcataatgcatcattaaactgtgatcaatagggatagttttttatgtaagaaaaatcgcgaaatatgtaagtaaaatatgtataaaaaatgctaaaatatgtatgaaatatgtacaaaaatccccaaatatgtactaaaatatgtaaataaaaattttttaaatggtaattttttggaaaaaaattcctcgtaaagggtgaaataggcaaaaattaacataaaaatgatctaaataggcttagaatcacattatagcatttcaagaattaatttttgatattcattttttgaaaaaaaaatttcgatttttagggatacattttcaaaaattttttttaatttttcacaaaaaatttctataaattctcaaaaatcctcaaaatatgtaaaaaaatgacaatatatacgaaaaattgcgaaatatgtacgaaaaagttcaaaatatgtacatatgtaatatgtagaaaaatccgaaaatatgtaaataaaaatcccaacatttgttcatgtttttcctacttattaggttatggagaatccaggaaaaaaatatgtatttacataaaaaaaactatccctaatgatcaaacaattaaggcaaaaactttttaaaaagcctgtactattttgtcgtttctctttttctttgttatttctctcactctggaatactatctcttcatttttttaatagaaaaaacaacatttacttcgctctatagaacttttttttcgccttacagattatcttcaaattttctaaatcaatagagaaaaaaattctgcatttttctatgccgaatttatcggaccgggtcagtttagtctggccgttttagtctggccggtttagtcagagggtcgttttagtctggcaagtcgttttcgcccataattcttacaaatgtttttttctgtcaattatttacaagtaaaaacttaaaatactatgtttagctacaaatacgaatggaacaacgcaatcaggaaataaagacaaagcgaaacaagcaaaagctggaacatgaaggtgcactttatgttaaaaaataaaaccattaattttttaaaaattccgtgttaagaattttgatatttgctcgcgcttcggtcttccgcttcatcaacacaattcgatgtgagcaaaactattgatgcagaaatctcacgatgcatcgctggtgaactccctcctcaaaaggcgcccaaatatcgtgccgccgatgcgagaattcttcgactcttgcagagctacaataccatcaacaataaccaggctcaccaaaatgatcacaattaccatgccctatcaatgttaacccctataacatcatcaattttctccttggtatttctcgaaattatgagatgcgcccgtaatactttcaatgttttgttattttttttgttgctaacacattgataaatctgttatagtgttaattttaaagaattttcgagaaacaaatcagaattggatcaatgtaggacaaaaacagcttgccagactaaaccgacccccaccgc

SEQ ID NO: 22664 - DNA, 1089 bp, Heterodera glycines
tcaaattcttcaacaacataatgtaaaaaatattacgcaagaaataatttttacatcctttttagaaatgctgcataaatttttattgtaaatagtcacaaacaaactttttttcactcccaatatctaccagttatcatacaaaaaggcaatagttaagcactgagatataaaaaaatcgtctagaataattatctaaacaatttgtcgggaaagctgtataaattctgggaaaaaaacttttcaagaaaagctgaaaaattttcaatcgcatcagaagcagcctcaaattcttcaacaacataatgtaaaaaatattacgcaagaaattatttttagatcctttttagaaatgctgcataaatttttattgtaaatagtcacaaaaaaacttttttttactcccaatatctaccagttatcatacaaaaaggcaatagttaagctttgagatataaaaaaatcgtctagaataattatctcaacaatttgtcgggaaagttgaataaatttcagttgcaataggcatattggcacaatacataaatgtagagcaggctcaaaatagaggaaataccaaagattaaaaaattcgtgtttatggcccactctgctttggctggacataactcgccagagagtggagatagaccctttgttgatacatttgaaaatgtagagctcggctagcgcattcgaataacacaaaatttgttttcatttgcccccaaacaatccgcttatgacgggccgaaagaaaattcacaaaaatttggcaccggaaaaactccatttttttatgggccagcataataaagtaaacccaaaatgtaagggaatttaaattggtcatgtgagatgtttagttttttatttgacccatccgttttctgggaaaaaacttttcgagaaaagctgaaaaattttccaattgcatcagaagcagactcaaattcttcaacaacataatgtaaaaaatattacgcaagaaattatttttacatcctttttagaaatgctgcataaatttttattgtaaatagtcacaaacaaacttttgttcactcccaatatctacccagttatcat

SEQ ID NO: 22665 - DNA, 1669 bp, Heterodera glycines
ctataaaaaatgttatttaaatcagtaaaattgtctctttttattgaaatgtaatttttcacgaaagaatggaaataaaaataaaaaattataatttgaataaataattaatttaaaaactgatgcaaattaaaaaatagcaatgttgttggaatcgtgactattgctcaaacattaaagtttttcacaatcaaccgcaatttattacgcaatattatctgccgcgtgtgacttttaggatatgtcacaaaggattaagtttaatcatttatttttcagcatatgatttttcacattaactgaagcagtactaatgtacaggtgctgtaaaaatattttaattcgatactaaaatatcggtaattttatgagttaagataaaaatatagatagtgcactttgttacagcttttggtcataaaatgcaaaaaaaacttctaatttggctctatttttaaaaagtggattttatcatcattttaagatatatttgagaaaaatataatttttgtactgttatgagcatttttgtaaatttgaagagttttttaaaattcattaatgtcaaaagtcaatattttctgtaaaataagaaacctgtaagatttacaggattaggttccactataaatgaatttttgtcttttaatatatgtagtgaaaggaaaagacatttgtataaaatttataactaattaagaaaaatacgaataaaaagtttcctttttaaaaacttcagcagtcgcgatcatggaaaaagtcaaatttaccgcaaaaacccatgggtattggctgttttttttcgcgcattttttcgggggaggggggtcgacggtccctggtttttttcacaccgaaacgaaccccggttttttttaccttttttcccaaaccaaagggtattattggctgtttgttttttcgttaataaattaaaataattttggatttaggttggggtttaatattaaacaattttttcatctttattttggtaatacaaaaactttttttttaaattatacaattttgaattacgtatacattaataagacatttgtgtgcaattgctgcagaatgccccctcccccccaattgaccccagacaaaatcaattctgacggataaaaaaatgacttataaactgaaaaaaagtaccacaatagaccaaaaaaagaaaaaaaaaggaaggaatggagagggagggaggaatgtattgagaatggattgagacgagggatggaagagggcaactatgagcaaaaagtaaaataaaacccaaacatttttatcgactttttttcaaataaaaaaataattttattttaaatttagagtttaaaaatttaaactttaatttgtaatagaaattgtcgcctgcccaattctcgcatcatgcccccaaaaaaagtaaaataaaatcctgagattttcaaaaaaaataatttttttttgtttgttttttcagacattggctcaacttttgaagcctctgacaattgtcacgcgcagtgcacaacgaggtgcagcggaggaggacgcggtgccgacaaagagacaaatgggcatacgaagagggccacttgcaaatcgtgagtttgattttaaaaaattcaaaaaaaaattaaaaaaatataaattcgtcatattcccttttttaaattttttg

SEQ ID NO: 22666 - DNA, 1720 bp, Heterodera glycines
acaaactttttatggtaaccgctgaaagtattctaattaaattaatattttttatgtctcataaaagtcgggtgattaatgcgccgaccgaaatccccaaatccccgaaaattccgttttcacggggacaggcagagggactgtggtccttatgggaagtgccggcgaatccgcttaattcctctcttagtcttttgctttgtttggttattgaccaatgccacggcagaaaaagttgccaaaattgccatgaaatataaaaatgaagaaggattactaagcgaatagtttgatgacgtgtttttgctccttcagttggtcaaatgccttctgaattttccactctttggtgtgcttttgccaatcgctgctttccaagtctttccgagtcattttcaacgccacgcatttgttaaacattgtggtgccaatgctcttcaattcgacatggaatacctttgaagcgcaaaagcggacaaaagcaattaaaaattaaaaatttcaattttaatttttctcacttttgaataagtcccttcaccaagcacgtcgtcttctttaaacctaagctcaataggctttttatcctccaaatttgtcagcgttaatttcgccatcgtcgccttttcagtgcgtccgcattggcaatttccctttgttttttgtggcgccgaaatttttttaacgggtgagtaaacttctttttcgtccaattttactaaattggtaaaagtgagtttgctcgttagtttcgggaaccttttaatcatttttctgaattttcttattttttttaatctaagcgttgtgtctattacctataagatttcataaaatccagtttttgataaaattaaaaataatttgttcaaaaaatatttaaaaatataaaatgaagtttgaattttaacgctaatttttaaaaaagaaataatatgaaaaagttttaatcattaatttcacttcacaacgcattaatttaccatttattgctgttggtgataggctattagtgtttctgttttccttattttctgacttaaaaaaaatattttccccaaagagttgacacttacctttaaacacgccaccgtaaatgccgtccaaaaataaaaataataaaaataattttcgcatttttgcggtgtcatttatagtttgagtcatctattaaaaaaatattaaaataattaatttaaaggattcaaaattttttgtgaatttttttctaaggcacttttatttaaaagattttagaaaaaaacaacacaaataagcagtaattttgttgtttcccttctctcttttccctttttttaattgattcgggtgtcatttcttttgctttgtgtgccaacgccacaaattttggcaatttccgccaaattttacaaaaattttattgcatattcgctataatttttccgtctataaacacgtgtaatcaatcattaatcgtgttttataaaaaatattccccccccccctcttttaatgatgccaaacaatcgaagagaggcaaagccaactctaaaaaattgaatagaaaataatatatattatagtgttttgcattggcacaatgtgaacaatttggtgaccgaagtgaaaaaagtatggacgccgtgttttggtgggaagggccgtttcagtccggaaaaattactcgaacaatcagatttaattattttaatatatatttttttggttaaaaggggac

SEQ ID NO: 22667 - DNA, 1896 bp, Heterodera glycines
attccaaatttgattcatcagaataagcatggcaatgcaatcgctttggttggccatttttgctcggcgtgtgcaaccatttggacaacacttggccggcagaagcatttggcccatcatcagcaattgcatcaggcaacagaaaattggaattgattgaattcagatgattgagatcggtgagaattgtcagtgaaatgccattgcgcaaattgtccaaatgattgtcattagtaaagctcaaatggcggatgtttgtcgcaaaattcggccaaatttcacggcaaaaaacatcccaaatcagttggtcattatcaatggacaactccaaattggtgcccattctgtcccaaatttgcttgttggaacgaacaaattcaatgacggaatagtcaatgtagctgaagaagcatacaaatgctttaatatacaaaaaagtttaaaatgacttaatctgaaatgcatcgaagcggtcggaaacagggatgggggcgcgccgcgatgtgcgatccgcggtcgcggtttttttttttttgcgcgatgcgcggaatttgggactccgcggtaatttttgactaaaatttttacaaataaatttttttaaagcgattgttttataactaaatttatttaaaagtaaatttttgtttatgtacataaaaagcaagagatttagaaattggattctcactaattcctccaaaaataagaaatattattcattaacttttctagacaattttcttctgtaatttaaaaccaaatgactcatgaaaaagactctattggttttattttgacaaaattgacaattcttcttatgccaaatgcaaggcatgcaattataaagttgacagagggccgagaaaacgaacatctgatttggaacgccatttaaaatctaagcatcctgaacattacaagcaaagggatgaagctttacgtaaaaagaaggaaaaaattgagaaatctgacaattctcaagtgtgccaccgggaagtgttgagtcggaacgccttttcagcagcgcaggatttattcttaatgatcttcctttaccattttgattattgaaatttttgaattatgtttttataaatgcgcgatccgcggtgcgcgatccgcggcaatttgatgcgcgatccgcggtgcgcggacgcgagatttttctgtgcgcgctccacccctggtcggaaagcaatgccattttgatgccgagttggggacggtcaaaagatgggagaatgtccatccaaacatcgttacaaatccaactgaaacatgaaaaaaagaattgggaatttaaaattttaattttttttaaattgcttaccgtctgttcatttttgctgaacaatttgcacacttttgtcgtaagttgtgcttgttaacgaagtaaaaacttttttatattccaaaaagtaagcagaaaaagatttttaattgatttattttttctttaaaattaaaaaaaaaattttgttgttactgcttaaaatacaataatcatttgtttaatttttatagtcaccgaaactgtactgaaaaattggggtagaaaaaaccgaaaacatgaaaaaaaaactgcaaggaaaccgggtcggagaacactggccgggtttttgcaccggcgaaaaagtcgctacttacagtgagaacgctaaattcaacctttttgactattttagtaataataattcttcgtctggctacatttttagacctttagtttaaaaaattcaatagaactttaagcttttcaaatgataccaagaaattgcaccacaaaaaagcaagcaaataaatgtaagaataaacaaagaaagcatctctaacgagaaaatgatggctatcaaattccaattggtgagattgtcgaccatttctcaaatataa

SEQ ID NO: 22668 - DNA, 1746 bp, Heterodera glycines
tatgtatagcataaaaataagaaaatcctactcaattgcaaataatcccatttggtaaaataatgattaaataaaattttccattaaataaaattccaattatattgtatttcatatgaaaatcgttgagagattaaattttaaaaaaatccactacatatgtaattgactaattaacaactcgactccacggattgcttatgaatagggcttatatttttaggccctaaaagttgccaaaatcggtcagctttaggctttaaaaaccccgtaaaacaggaataaaaatggaaaataggctctaaaaagcctaattttagggttgtaaaatgacaaaattatattcaaaaagcaacaaaattaagccaaaccagtattgcgggccaggcctttttcgtacggcccttttcctatgagtgtatagaaaaaaatatattctaaaagtattatgctttgagtggaggaaggtcagctttaacgtcggcctcactggcacatgatagcaagggctgcacgaaaattaaaaaaaaaaattgtaacgaaaaggaaactgaaaagggcgaaacgaaaaataaaattttatgaaaaaccgaaaacgaaaactcaaaaagtgccgaaaatgaaggatgaaacgaacatgaataagaaaaaagtgaccaatgaaaagaatttttatctatttaatgttttttaatccttatttaattgttctccaaattgtttctttcatttgaaaaatgaccgtcgattgattttcaatatttttgcaattttctcatcactcattttttgggtttctccttttatttgcaaataaattttcattttttccattttttctttctccgttaatcattgtctactcaatccgaattgtttcttccatttttcaattactcttttgcatactccaattttcttacaaatttcggcataatttttcttccattcttttgccgaatattttcttcctttttgtttgtactcgtttttcattgcaataaatttttgcacaatttcaattttttggtcatccgtttttgatttataacatttgtttttttggagatttaattctttgatccatttataaatgtattggcgatttgtccccaatttttttccaattttccattcaattttgctccattcttttgctgaatattttctccccctttgcttgattttctctttaatttgataatatttttcaataatttctttcattttctgttcattttctttttcttcccatttttctccaaatatttcgtcaaatgttttttgttccgtttttttcttttctgctccaatttcaatttgaacgattaacaatacaataacagagaataataggattcgtttcattgctgaatttttcatttatagaagttcatttaatatgaaagaaataaaaataatattaatattccttaaatgatgatttaatgtttttctcttttaaaacatacaaatttaaagtgaaatattgatagtattactgtttcattaaattgcaaattgaatggtttctctctcaactgatttatttatttatttatcgataaagaaattgccatcagaagggcggggaccactttaataataatataaataaaactaattttccgattaattaaaattctgcagcagcaattcgctaactctgtccaaaatccgcattctttgggggggtgcacggtacggccggcataacaaataaaggtagcattttttaagctagaa

SEQ ID NO: 22669 - DNA, 616 bp, Heterodera glycines
attatttctccctccctcccctccattaagcctccgatttccattttcatttccccggtgctttcattgcctgggaaagtttcgcgcactcccatcgataatgagcaggcgacacattaattaaggccaaggataagccacaaaaaagtgcgagcagttcgtccttcctttctttccctcctccgccgtcctggagagacttctttggaaaagtcgggggagagccctctcttccgattccgtgtccctcgtccaaatgaatgggcctttgttcgcctcctccgctttccgtcctcctctccaatcggccagttcgttgaatgtccatcaggttcgattcgctgtgcttgggctgatcattcattctgatcactttttggtcgtacgatgcgttgaatgtttgtcagccttaagcaaagattgactcggaatgttttccccttttgcctacaaattatgcttaatgtcgaaatgccgttgggttatgcctttctccgattgctccgtttccctttcagctgaactgcaccgcgtccatctcccgctcgggcagtgatgcggaaatcatcgccgacccgtccatcctcggtccgtctttttatttatcagctaccaa

SEQ ID NO: 22670 - DNA, 1219 bp, Heterodera glycines
cgtgttgggtcgaaggacaaaaagtgcaaatttggcgaagtacaaaaagtgcaaaatttgctgtttttgactaaatccactcataacttttctcagacgcaacctaattggacaataagagttctctattagcctgccaaatttcaaaaaattatattaagtttttcaaaagttatgacaattttttggctagaacttttgataaacttaataaaattttttgaaatttggcaagctaatagcgcattcaagggctatcgtatgacaccaagattgtgcaattaaattttttttctttatacattttttcactatctaattatcccccagtctctgaggaggttgaaaaataatcccccatggggtataaaagagcatatacggtatctcgaattcgcaaaacctagctaatttaaattcgaatttacaatgattttagaaaagagtaatttagattttcgactttttttcgagttcgggtctgtgattcgaaattggacaaaatcaatgtcagattcatcttcaccgaacccgaaaacccttggaaacatattttcagtgactttttaaaaaagtttgttgttattagggtttttaggtaatttatgcaatttcttcattctcatatattttattacaaagatggtttgcatcccatgaaatgcgatttgttttgtttaaataattttaacagtttttaatttaattattcttttcttattatgctttcaactttttttttatttaaatttttaaaatttatttaatttatgagtttattaaaatgttatttaatgaaagttcataattttctgaatataaatattgtaattttcttccagagtaatgtaacggtcgtagaaactgtaatcgcaaatgcggctctttcatttcatttttattattttttgtataaatatttaaattcattacggcggtcagcacatttagccggattaataggggaccgctatttaataattggtatagttattatgtttaagaatctgcccgatgaatcgataatttaattaattaaattagattattgtgtttttaattaaatatttattttgtttaaatttatactcttattgttaaattctttgtgtacataggcacaaaaacctgcagcgatacttattgatttatttatatcaatttttgtgtcagctttatatattacatttttgaaagccatgtaataaataaaatatat

SEQ ID NO: 22671 - DNA, 1918 bp, Heterodera glycines
  misc_feature (1900)..(1900): n is a, c, g, or t
tgcccccccccgcactttcgcattcgtttaatggtaacaaacatagttattttagtattttaatgtaaaaatggtacttaaatttataaaaaaaaaattgctgacatttgctaataatgttacggttttcacatcaattacggataatacggtaaaattggagaaactgaatatttacattacaggctttatcttctgaaggtcgtatcagcaagctttatgtggaatgtttcaacgaacgcgagaagtgtttaacggtcatcggagggggcaaaatggctactgctttagtgcatggattagtttccgctggtagggatttcgtttaaacaagacttaacagacccttaaacacccgaaatatttttttgatgaataaaagtaaataagctgcttatattgtacttttaggttttatcgacaagtccgaagtgaatatctgctcaagatccaaagaaacggcctttcgttggacggtttttaaagactgcgactgactgggaacggtttttaatttcagacacaaggttaccaaaatgcatatacaaatgatgaattttacagcaaagtgaaaaagccacgtggtaacaactttttgcttatttttgaagacttggtcaatttttaggaattgtgattgtcgcagtaaaaccacagatctttcccgggtttctcgacgaactgcgtaaaaatggttggcttaactttgttgggcctgaagtgctttgtgtgtccataatggctgggattgcacttgacacctttaaacagcaggcacccacagttgttggcttacgtataaaccttttttagttgaaattggttggtttcaatggccatgccgcccgttttatgccaaatgtgaattgtctcgtttctgctggtatcgttttggtctgtgccgatgactgtgttccgacggagatggtttagcagaaattgctctagttatcaaattcatgcaatttgtaggtgactctactgctggaaatgggttcaaaattagggtattcagttcgaatcgacgagtcgctttttgacgccgcgtccgcccttgcgagctgtgcacctgcatatgtacggatgtaattcatttgtatattcctcatattcaacagatgttcactgtgattgaggcattgacagacggaggcgtactgaacggcctgagccgagagatgtccgtccgactcgccgctgaaatggtcaaggtatattcattcgttgtccttttttcggcctgggtgacatttgtgtcacgggatttaccatccatgtcatttaagggctcagcgcagctgatgctaaaatcgccggaagtaacttctccagcgcaattgaaggtttcactacttttgaaatagagatttcaattaccaaaatttgcaggacagggtttgttcgcctgctggcactaccattgctggactgcgtgagcttgaacgctctggggtcagatcggcattcattgaagcattaagcgcttccactcgtcgtgccactgaaatggctccgaagacaaactaacaatttttctggttttgatagttttttcgtcaataaataattgtttttgtaactatgcatatgtttttttaatccgtaacttctacttttacaaatatttctttattttctgatttatttttttttaaattttgttggttccgatgagttgcaattccccccattcaaatagccagaaggagcaccaaaaattgctagaaaaagaaccaataaaagagaaaaggagacggagaccgctgactaaaggccttagatcggaactgaggaccttggtctgtcgagggcgtttaacgttttgaattccatccattgtcagttggagaatgccattttggattccgattccgcgcttctttcatcggttttctctcanagatgacacaactctcgg

SEQ ID NO: 22672 - DNA, 1285 bp, Heterodera glycines
aatttatttgacaaatccaaaacttaaaacctgggggaagcaaggggctgtggctgggggcctaaaatttgggccacattgaagaattaattttgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccataccttcttgtagagctcgagctgctctttccaatggtcttatcccggtctcgatccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttcaaaaaaattttaagagaatttttgattattaatttgaagtcttgaatttatttgacaaatccaagacttaaaactgggagaagcaaggggctgtggctgggggcctaaaatttgggccacattggagaattaattctgatttctgaaaaagtcccagaaataactattttttctttccatacaatggtgtagagctcgagctgctctttccaatggtccctccggaagctcgatccgtgccgaactcacaaagttatggaggaa

SEQ ID NO: 22673 - DNA, 1730 bp, Heterodera glycines
ctctagagtcaaattgggtagagaattccaattattaaacatttaatctctttaaaaacaaaataattctatttccccataaaattcaatgaataatatttcatttttgctgctattctttttgtttgtcgttttcgttgatttcggttagaatatttaaattattattttttgctacattttctgtattttcagctacattgaccataattgccgctggtctgtttctctgcgtgccaaatgatggaagtcagccaaatccagctgaaaatgctgcgaccccttttgattgccatttacgtatgtattttcatccgtttcccattgtttaggcatttgtccgtgccaccgccacttcttccgcctgcttcaaaaggccatttttggcaaccatgtctgttttaacaaatatgaatataaataagctttttagtctatattttgggctttttaagtccatatttggcgttttttagtccatataatttataaccctatttataagttataaaaattaatgtcaaaataagttggtggacgagcacaaccatcggatcatccctcgtcgtcatcacccaaacattcgtcttcttctcattcttcttctgaggatgaagcaaagatggcttcatcatcacttcctcctcatcatcatccccattcatcctccgactcggaaaaggaaggaaaaaacccaaaaaatgatgatgaatttgaagtggtcgtggaatatgtgccgaataaacattgaaacaaatacacaattccggtgaaacggacggacactttggcaacattgaaggacaaaatccgggagaagtacaccgaggattacaatcagtacggatttggcacaattgaactggtcaaagagttcaaaacggatgaacgtgagccatttgtaatgagagatgatgttgagctttggcacgaggatttggacgagtacaaaaccatggagcaatgtggcattagaaaagggtcaacggtttccgtgttttatgctcgtcgactggacaaagaagaatatgatcaaggattttacatccgtccttggccgacaccgaaaaagatttgcttttaatgcttttcctattgcatagtttttcttcaatagcactgaaaattccgaaaaatgcattctttaggttttcaaaaaaggcaatgacgaaaaaaactcgaaaaactaaataatttcttggtataaattgtgaaaataaaatgaaaattttaaacgttttttgcttctgtcactcaaatcactgtcattctatacagtattttttcttcatttctaattgctttttcattttatataatttctttttgtttctatttgaataaaaaactgtcattgttcaaaacttacacaatatttaaattcaaatacataaaattaggatgggctttttagctacataacgtattctgaagtatgtgcttaaattattgctaaatataaatatggacgtgctttttaaaaggcgcattcttttttataactcgtaaaatatcatttttgcttttggcattcttttggcattctgtttaaattcatttcaatttttatagtttcagaccgaaacgggccagttgcgtctgagccaagtttagacctccataacttttttctttgttgaccaaatccaacaatgttggtatcattagaaagctcttaacaagctctatcggccatccaaaaattacaaagacataccgacatgtaaaac

SEQ ID NO: 22674 - DNA, 1197 bp, Heterodera glycines
atgtggcgataaataggacaaacgtccgcggaatttttgccattgtcggcacttaaccagaccggcccatatctgtttcgtttgttctcggacagccagtactgcgacttgagcaaaacatacatgtattttctcagctctattgagcgcaaaaatgccgcaggtgaatgggttccgaccagcgatgctgagccggaggataagcgagtgggtgtaattcaaaactttggcagcagttttgtccgctcactgaaaatcaacatttcgggtatagaagtgttcgacagctccatttactatcattatcgtgactacataatgaaggaactgggccactcccatgaaattcgcaaatctttccatgagtcggcgtgctattacacagatgaggatgatggccaagatagtgccaccaatgagggcttcatcgcccgtgcagcgcgattctctaacggaaagcaatgcgaaacgatggtgaggctgaactttgatcttgcacatcagagtgcattgatgctgaacaaccaagacgtgatattcactattcatcgtaacagcgattctttccttctgcttacgccccccgggaagaaagcggacggaacattgcaggaaaacagcaaagaataccgtattcgcgtgcacgatctgcgtctgtatgttcgcacggtggatgttacacctagccttaacctggcaatcagtcgtcagttggagtcaacctcggccaaatacccgctgcgtaaaattgagatgcgctccattttcctgggcaaaggcaggactgagttggctcacaacgtgttcacttcaactttgccccgtcgtctgatttgctgctttgtctctacagacgcttattctggccggttgtcacccttcaaatttgaacatgcaaatgttcgagcgataagtgcggaggcaaacggacaatcttttcccagcactccatacctgttgtcgtttgatggtgcacagcaacgttttgttcgtgcttttgtcgacatgtacgccggtcttggtctggatgactcagacacaaaaacagtgtccattgggatgcaacgcttcctcggcggatgggccttcttcgtaatcccgatgacctccacgctggatgatacgcccggctttgagttgatccgtcagggcacgtgtacgcttaaggtccaatttgaaaagcctataaaagaggac

SEQ ID NO: 22675 - DNA, 1322 bp, Heterodera glycines
aaaaatcaggatatgttaatctttcatatttcttctctcttttcaggacgattcgaaaaatcaggatatgttcttctttcatattgcctttctccaattcaggacttcttaaaaaatcaggataagttaatctttcattttgcctttctcaaattcaggacgattcgaaaaatcaggatatgttaatctttcatattgcctttctccaattcaggacttcttaaaaaatcaggatagttaatctttcattttgcctttctcaaattcaggacgattcgaaaaatcaggatatgttaatatttcattttgcctttctcaaattcaggacgattcgaaaaatcaggatatgttaatctttcatattgcctttctccaattcaggacgattcgaaaaatcaggatatgttaatctttcatattgcctttctccaattcaggactttcttaaaaaatcaggataagttaatctttcattttgcctttctcaaattcaggacgattcgaaaaatcaggataagttaatctttcatattgcctttctccaattcaggactttcttaaaaaatcaggataagttaatctttcattttgcctttctcaaattcaggacgattcgaaaaatcaggatatgttaatttttcatattgcctttctccaattcaggactttcttaaaaaatcaggataagttaatctttcattttgcctttctcaaattcaggacgattcgaaaaatcaggataagttaatctttcatattgcctttctccaattcaggactttcttaaaaaatcaggataagttaatctttcatattgcctttctccaattcaggacgttcttaaaaaatcaggataagttaatctttcattttgcctttctcaaattcaggacgattcgaaaaatcaggatatgttaatctttcatattgcctttctccaattcatgtagttggaagacaatcatgctcatttcatctgttatgtggatggtatccattcacatagctggtggtatgtggatggtttgacaccgtacccataccatagtgcagggggatggacacataagaaaattaaaactacttaccagactgcacgtctttgcctgcattcttaggcggcgccaacacttgggccaaagttttcttcttagccttttgcgtgggcccttaaaggagttattgttaaggggatgcagatcatcctttagtcattgttttaccggactgaacgtctgtgccagcttcttcctgcaagtcttcgtcgtcgtcttcctccatttcttcttcctgaacgtctccgtcgttgtgctcatcctctt

SEQ ID NO: 22676 - DNA, 1489 bp, Heterodera glycines
gttgcgcaaaatgacctgcttgccaatgtcctctcccagcgaatgtttaatctgaaatcaacggggctaattcactgaataaaaaaataaatgttggccatttttaaccatttcacctcaattgcctggcaaacgattcgaagtgtcagctgacggaaaaactcggattgactgatgcgtttgtggaagaactccgaattgaccagcacatcgacctgacaacaataagaaatttttatttatttttataaaaaaaattatttttcccgaccgtcgattgtgagaaagcgaatgaccggccacaacttgtgacaaacggtttccacacgccgaacgcattggcaatgccaatcagtgtaatgggtgataattattcccttggctaatacgaatggcgcggatggacagaagttctattgactaataatttcggccccatcgcttcgattttccattgccaattcgaccaatgcgttaggtgtgcggcttcaaggccaattgtccaacatgtgtttgtttgtccaaccaacttttgccaccgcttcgccgctgcggtcctccgccgatcggtccaattcgcccacacaaattggaatgcgaaaagcatccgggtcctcttccaccatttgtgccactttgtcctcgtccaattcggcgtgccgatggggcggcggcagctcagtgcaatgggccaaattgatgaagaatttggaggtggaggggccggagacggacgaagcggcggagaaatgggcctaaatgcgacttttcagtgatagtgtaagactcggagttgcgctaatatcggatgcccgaaaccagcacgtttttgtattgtcaaattcattatgttttcgggcccggggttttgtgagacgacccgcaaaagcagggcgtgctgttgcccccccccttccccaccgtcacctctttgaatttgatgcaaatgcccgccgtcggataaactgtccacgtgtcctcctccgtctcatcacttcgtctttccacaattaacggcactctgctgccggtgggcattttaaaaccaatttggtatttaatgcaaaaatgaaacaaaacaaaaagtattttggaaaatgtcgaagaaaagcattgataatttaaggaaaaattcgaaagaatatttatatttatgcaaatggccaacccaaaaaatgaccaaaacaaaggaaaggcataaaagaccgtcaaataacaaaataatacaaaaataaataaataacaatggcagaaaagaggccaaacaaataaatggggggagagtgtcaaaaaatggcgagcagtgcaaacaccgaatagagcaaagtgcagggataggcgacgagcagccgctgacctaaacaaaacacgaaaatttcggctataaaaaacaacggaaaacgaatttgccactttattagaaaaagcgaattttcaaaaaggggacagtagaagaaaaacaacggtttaaacaatttgtaaaagctat

SEQ ID NO: 22677 - DNA, 1731 bp, Heterodera glycines
aaatgattttttggggaaagggggaaaaaagagacggacgggacatttaatgagagaacggcgcccaacagagagagcagagacatgggcagcagacagtagccgagcacagaagcggtgcaagtgaaagagatggagttgtgttgggaggccatcagattgagcagggcgtacatgccgacacagccgcacagaccgatgccgtaaatgtggccgaaatggacccaaaatgggggaaatggtgtaaaacagggggagggaggggattacgaagaaacaaaaacttaaatccaaattgaaagggcccaaaagttcggatgccaaaacgttcgcccccctcacttttccatgcagcaaaagagaggcgccgaagagcaaacagaagacgaggggaccggccaagtcttggtcggcgatcacctcaacaaatagagggcattaaaaacaatgaatttggagggaaagagacaaaggcaaaaaatggcacaaaatttccaacttcggccgatgcgatgcccaacggattgagcacagccatcgttttgagccaaatgtgctggaaattgacgcccaattcctccaacagaggcggctcattggcaatgtcgtcgaattcgctgtcgaatcctttggctaaaacaaagggaaatttactggagggggggggggcaatctaagggcaaaaaatgcctgtttttatgaatatgatcacggcttaaatttagagtaacaatattaaagtagaaatacgagccaacattatgtacatattaacaaaaaaagcgctgaatcacaattttgagcgcttaaatttaattgaacattaaaaaatattttacagaaatttaattttataaataaaagtgaaaagcacaccttcttgggagggcatcgacgggatgaacaagttcggctgctgctgttgagcagcgaagtaattcgggtaaaacggttgttggtttggcggggagggcgcattttgcgggtcaatttgcccattgaaaaagccttaatttacaatttccattagtttcgagttttggcatattcttccgctctgtttttccattgtgccttttcccctcttcgcactttgctgttgcgttcccccaaattccgtggcccccgccgtttcgccggtcgtcgcggcgtttcctccgctgtaccaaatgtcttgcggctgctgtgggctttgaaagggagaagcggtgccctttctgttgctgactttgttgtcataaaaataggcgtaagggtcggtcattggcagaaaattaaaagggcaaagttttttccttttttgccacaacgttaataaagcttttcctcgcggaataaggactcaaagtttaaaagaaacaattgaacataaccccatatttaattttcgcgttattttaaaatctaatcaatttctttttgatttcttattttgataactagcggggtcagcgccttcggcgcatcccccgctaggcagtacgattgtgttatagaattatgaatgataaaatcgactggctcggccgcttcgcgccctcgcatcattttcttggcttttctccaatctctgggactcaacccaccagcaattcaatctctgggactcaattctccggcattccaaacactgggactcaaatctccggcattcaatgacattccaatcactgaaactaaacccaccagcaattcaatctctgggactcaattctccggcattccaaacac

SEQ ID NO: 22678 - DNA, 1402 bp, Heterodera glycines
  misc_feature (9)..(9): n is a, c, g, or t
ttgatttantttggacgcatttatttttctttgcctccaagaatgattcttccaataaattttttctaataattccttattttaacatttatttcttatatttgtcatttttaccccaattttaaaaatttttctccattttcgtgccaaggcttttctttgccattttatggacagtgcagcgacaacccctcaccatcagtcgtttggtggcggcacggcgccgacgagggcatcgacgggcggcggcattggcactgtttcacttggcaccgtcacgtacatttgcggcggtgggttttgcccgatttgtttgatggtattcatttgcttcccgcgcattgcacagattgccacaaggaaaacgaaatccggcccaaagacccgatccgttgccgggagtgtggttaccgtattctgtacaagaagcgcagccgcaaaatgatggtgtacgatgctcgataaagaaattcccaaattggccattgttatttggtttgtgtcactgaatattgtttaagaaagaaaaaaaaccaattcgccctctaatttgagcaatttagcggttttaagtaggaccagcgggagttttacgggattcccgttcccggaaaagtttggacacccgctcccataaattattttttatagaacggagggagggaagtgaatttgggttcttttggaagctcagggaaggggcttaatttgtgtgaagacaatttttcaatttattcattttttgggttttctatgacattttgtttagcgaaacttgcgcgccagcaggacaatcaatgtatttgtgtgaaaattaattaaacaaaattttaacttgaatacagtgtacaatatgtacctaatttcaatgcaatattacatcaaaaaaacatggtaagaatagaagatcatagccatttcatgaattttttgtacatcctcccgacttcccacaaatcattgagaagcgtgcagtcgtttgacctcctcgagcagtgtgatcagatgcacactctccgccttccacctgttgtacatctccaactcgttgtcgttccattttttgattggaccgacctacgagaatcaaaatattgaacatttggcaggacaaaactcccagtgtcataaatcggatttaaatattaaatttcaagaaaaattaggctattttttaaaagccgtcgttttattaactcccaaactttctgtttaccattttctcgcgcctttccttcaacaaattggtgagcattgagctaacatggaacaagtggacggagggcagtccgttttgggcagttaaatgaacaccgaacagtccgacggggcacgagctaatgaaaagagcgggagatggacaagagaattattgggtgggcaatgcatgagaaaatcaaag

SEQ ID NO: 22679 - DNA, 2170 bp, Heterodera glycines
aatttcaaaaattcctggcattctaattcaagctgttgtgactgtgttccatcgcggcttccatggcgatttgaatgaaacttttctggtcggtgatgcggtcagtgaggagaacttgaagctgatctcggttggttttccaccattggaccaaatcaaaccgaaaattttattacgcttttttaattaaatttggtttttgggactagaatttgtgttttaaaaattggtaaacaaaatgagtaaatctccaattactagaaccaacaaaattttacaataaatttttttaatcttgaaaaaaaattttcttaactctacgtaatttttttttcctcactaattttcgggggtgggaaaaagcacgctgacgtttattttaaaaaattccgagaaaaaatggcacattttttgaaaatttaaacaattttctcacaaattgcattaaaatttctagaaacatttttccctggtgaaacctaatgacatcgacggatcttcattcacccattttgccatttttttttgaaaatttggccccaaaatgacaaaaaaaaaaaaaaaaaattatttttggcggaaaaggccactaattcgcaattttctccccgtcgtcgaaaatgttaaaataacactgaaaaaaacgcatcttccactcattgtcaggtcacctacgaatgtctgcgacaggccattgacattgtgcggcccggtgtcaaattccgtgacattggcaacgtgattcaaaagcatgcaaacgcaaacgggttctccgtggtcaagcgctattgtggttgtcaaaaaaaaattttttttttttgaaatttaacgattggatgaagagaatgggtccgacattgctgaaaaattttatgaattctactcaaaacgtcgtcggaaaacaaaatacaaattctttaaaaaattttcttaaagaaatttccagaaaaggctaaaaaatttttaatttttttaaaaatactgttcaaaatttcaaaaatttgtccattatctgggatttttcatgttccaactagtgaaacaaagttttttcgttttttagggccatggcatccaccggctgttccacacggcaccgaatgtgccgcactatgccaaaaacaaaaacgtaggcgtgatgcaggccggtaacgcgttcaccattgagccgatgatcaacgccgggtcttacggtcggttaaatttcatggctcggaattcgggacgagtcaaatatctggactcggacgcccccccacactttttcccttttttctagaaatttttaacaaaaaataaattgcattcaatttccttaaagacgatgaccaatggccggacggatggactgcggtgacaaaggatggacgtaagaaaatgaatttttattatatatattttttgcggggttacaatttttccccaaaaattcaaaatgctttcgcgttacttaatttcggataaaaatgtaaaaatttttcgataaatccaaaaaaaaaaaattttccccaggcgcttcggctcaatttgagcacacactgctggtcaccgagacgggctgtgatgtgttgacagaacggtcagtggctggcgctcctcggccatggttccgagaccagcttgaacaattgggttacaacagaaaaaagcggcagcagtagtgccactacgaatgcggatgttgttgttggaaactgattaattttttgtgtgtatgttttggctgataattcacaaaatttagcctttgatgattgaatgtattatctatcctttcttccattacatacgtacccccatatatttttggaaattcagcagttaaacgagaggattaaaatttgttttacttctcaaaaattaataatattccaagttgaagcaaaacatttgcaatgactaaagacaaatagggtgaactatagtgaacgccccgtgaaaaaatgggtcaaatgatataccaatttttttggtacttaagtgtccagtttcactgggactcagttgtcccacactaagattgcgttggttcgacttaattccttgtcttgtcttttagacttagctcatcaagagctttcgaatgataccaaatttggccattttaaagagtcaggagccccccttttcactcatttttcgagttttgaaccggttcaaaaaccggttt

SEQ ID NO: 22680 - DNA, 1965 bp, Heterodera glycines
gggccaagatgagaaggaaaagaaaaagggaattggacaagcagcaaagcacgggcgagggggactcggtgtcgacaagtacagactcagagaagaaggaggacagtgaccaaacgattacgaaatcaccacaaagcgaaacatcagaaaagtcagagatggtggccgaggatggtaacatttatttgtaacagatttagggcagaaaatcagttttaaattcaacgaacaaaagttgaaacacatttacacaccgtccgaaaaaacgagatgtgtaccaataaatagagtgccagagaaaaacattatctttttttctctaattttttgtctccttttggcgtactatctaatatttttattactaggtcgttgcataaaaaagggcgctttttgaaggaaaaaaatttatgaacaaaaaatgaaaaataacaatcataacaaagccgatcaaaaagctacttaacaaagtaattgccctgactgtctacaaccttttgccgccgagatgggagtttaacaatgccctttttgtaaaattctgtgccattctttgaacctaggtaattttcactggatccacgaccttgccatattctttaaagagcctaccctataaggaatttttgagagaaataatttagccataaattaagtctatagggtccagggaataagacgggtgacgtagcatgtcctataagttgttctcctgtcagccatgggccaatgaaatttggtgccaaaattagggacttggccataaccagaaaattgagtgtaactttattaaaagtgtaacaaattctaataaatttaatatcatctgatgcagaataacgagatgaattgaatggcgtcaattttaatgcactcaaacaatttttaaaaaagttatggccaaaaaatcccaaattttcccacttgaaaaatggccaaaaaaggctttagggaagttgtttaaaattttaaaaaaggatttaaaacaaggatttcctacggataaactatgctggaataattttgcatgtgttcaaaaaatataagaaaaatcctttgtccaaagacaagtgttttctccttggccttcgttttcagaaattcgaataatcgcccataacacaattttggaaacttgtgcgattctgtaattttttatattatttaagggcataaaaagcctcaaaaccccgatggaattattttggattttgtttttgactttcggtttggccaatagatttggaaacttggccaaaataaacatggccaaaaaattttgttttttctttttcagaaaaatttctttcaggctttttcttgttaagctcatcaaatttcataatctgaccaagttttaagtcgttttgacaattttaactcaagttatggacgttggtgtaaaatggtagccaaattttgttgaccttacccaattttttggactgtaactttagatataaaaggacaaaatcaaaatttttggcaaaaacatgacgagaacattcagataaaagaattacacacaaaaaagacataacaaacgttaatcaagtcttaaaaaaagtcattttgaaaaagcgcccttttttatgcaacgacctagtaaataaaatttaattttcaccgtagatggatttggcgtcaattgttgtttttcctgggcttggttcttaaaatgaagaattaaatcaacattatgtcatttgactccaaaatgttaaaatccgtttttgatttttcacacaaatgactttatttatgtatgccaattgtttttgtttatccctttaatttaaataataattatttcgtttttattgaaaattccaaaattttaccatcgatggatttggggtcaattgttttgtctgggaatgattctaaataaaaataagaattcattttttcaaatttaaaatggaaaaatcacctcaaatggatttggagtgaatcgtccaaccg

SEQ ID NO: 22681 - DNA, 1050 bp, Heterodera glycines
tctgactttataagataaatgggaatttaagcgaaggcttcctgcgaaataataatctatagaaattctctaaaaagtagctcctcgcagattcggggaccgtttctataaagctagagacatatgcgctaaccataaaaaagatgaatcattttttgaaaaatttatatagttcgactaaatttgcaaatcgatttatggtgtacaggatgtttgtcgaaacataactcgtcaggcctttaagatagacctgccattgctattcctgcaaatatggagtctagtcagcccaatcgattgctattcgaatggtttggggtcgttggcccaaacaaaagttgtgctgcttcttgcaaagaagacttagccaactgtaaacagcaagccatccaaatgcttcaatgtaaaaaaaaattacatttggatgcaacctttatttttcctcgcctctcttttcgaaaagaaaagctattagcaagcgtgtttggaccaattctaaaacaaatcggggtaattaatttaatctgactttataagataaatgggaatttaagcgaaggattcatgcaaaataataatctatagaaattctctaaaaagtagttcctcgcagattcggggaccgtttctataaagctagagacatatgcgctaaccataaaaaagatgaatcattttttgaaaaatttatatagttcgactaaatttgcaaatcgatttatggtgtacaggatgtttgtcgaaacataactcgtcaggcctttaagatcgacctgccattgctattcctgcaaatatggagtctagtcagcccaatcgattgctattcgaatggtttggggtcgttggcccaaacaaaagttgtgctgcttcttgcaaagaagactaagccaactgtaaacagcaagccatccaaatgcttcaatgtaaaaaaaaattacatttggatgcaacctttatttttcctcgcctctcttttcgaaaagaaagctattagcaagcgtatttggaccaatctaaaacaaatcggggtaattatttaatctgact

SEQ ID NO: 22682 - DNA, 1547 bp, Heterodera glycines
  misc_feature (1520)..(1520): n is a, c, g, or t
gttttttaattttatgattttttaacgatttttccccttgaaacgaagaccacttccaaaacatagtttttcgagctctatcgattggtaatttttttgaaaaaaattcggtttttttccggaaatagaaaaaatttttggcctgagcgggacatttgagtcccgggcctataactcggcaggagttaagtttatcgaaaaattgtcttagaacatttttgtagagcattttaaatgctatcgaatggtgtactacatgatgtaaaattttcaaaaattttcgagctaggccccctagaaattttcaaaaatttttttggggtcgaaaaagggtgtgaaaaatatttttctggggtaaaataaggtgctgagtacgaatatgatgtctattttaagtttcagaattttgggaattttttaaaaattctttattttttggcaattttttggccctcgggattttggcctaatatttgaaaattcataactaacctcagggtaagtcaattttcatacagcaaagctttaaaaatagagaaaaatcaggagaattttatgggatttatttaggttttctaacatcaatatgaaaaaagttattccagaaattctggaaattttagatttttcagaaaaaaattcgtaactgccttctgaaaagctatttgagaaaagtaaaatactacaaaaatccgcaatttttttctctataatataaattttattttaaatttttatcacatttttaaaaaaagatataaaaataaaagtgattttgtgattcgggtccaaaggggggagcacatggtttttgagtggaaaaatttttctcacaaaaatcttccaaaaatatgtctttaggggttatttgggccgctgatcacgaatacgtgatcagattttacttttgacatcgtcaagacctcagaatccctgtgtgattggggattctgaggcatcattttgaggggggggggcaggttcgaatccggacggtgtaacattatttttttgtgcatttttacgttattttcaatgaatttaatttatttaaaatattttgttgagttaataaataaaaaattatatttaatttaatttttttttgataaataaattttataagtttaaattaattatttttttaattgatagaatttcatgtatttttttaattaaatttgttaaaaatattttcttttagatttaatgaatttactaatcactgttgtatcaatttatatttaaagatttgttgtaaattaataataaaagaatttatgtaaaaaataataattatcttataataaagaatttcatattttttttaattgaatttataaaattaatctcattttaatttaaatattcaattattgtacatttcaaaattctctttttattaataaaaggaatgtcgtaatttattttttagaatatataataaattcgattcaactttgtaagtattttaatcaatcgcacatgtacctcttctaatcaagaggtacctcttctancaatttagtacctattcgtgatcacag

SEQ ID NO: 22683 - DNA, 1212 bp, Heterodera glycines
  misc_feature (33)..(33): n is a, c, g, or t
aaaaaataattatgatttattttgcaaaaaatnggaaaagtacgcaaaattgcaatgtctaaaattttaagaaaacattatgggacagttaaataattatatgaataagcattattctcagctgttaccctgcaaaacctggtgcgcttctgagcactactcgaaaaatgagtaaattaattttcactaaaaagttaagcctaaactttttggcctgtttaaagaggaattaaaaattttaaaaaattttattcatcttcctttttgatagaaaaagcatcagagagccttatttaacatgtaaatagaatttggtgcgtttaagagcactttctgaaaaaataattatgaattaattttgcaaaaaataaataaattgtgaacctttaaaaattcataggaaatttaaattcataggtactactgctaaatcaacgcagagacgcctttccttgacctttttaggctcctgcaaaacctggtgcacttctgatcactactcgaaaaatgagtaaattaattttcactaaaaagttaagcctaaactttttggcctgtttaaagaggaattaaaaattttttaaaatttattcatctccctttttgatagaaaaagcatcagagtgcctaaaatagcttgtaaataaaatttggtgcgtttcagagcactttctgaaaaaataattatgaattaattttgcaaaaaataataaataattaaataaaaacgaaagactctgattttcgaaaaaatttttaaacccagctagctcggcgctcatttcagtgtaagttagtcctttaccggggagtttccctgcaaagtttggtgcgcttctgatcagtttctgaaaaaaaaagttaagcctaaactttttggcctgtttaaaaaggaattaaaaatttttaaaaatttattcatctccctttttgatagaaaaagcatcagagtgcctaaaatagcttgtaaataaaatttggtgcgtttcagagcactttctgaaaaaaataattatgaattaattttgcaaaaaattggaaaagtacgcaaaattgcaatgtctaaaatttttaaagaaacattatgggacagttaaataattatatgaataagcattattctcagctgttacgctgcaaaacctggtgcgcttctgagcactactcgaaaggagagtaaattaattttcactaaaaagttaagcctaaact

SEQ ID NO: 22684 - DNA, 2416 bp, Heterodera glycines
  misc_feature (2253)..(2253): n is a, c, g, or t
  misc_feature (2333)..(2333): n is a, c, g, or t
tcattatatcataatatgatgcatcaatcatattaatataataaaaatatattatatctaatacaacaataaaataatttgtttaggaaaaagtaaaacggattaactgattaaatttttttaaatggtattttctggtatttatttgtaaattatcgttaatattcaaaatcttctgattaatctttttaaccattcattagtcatcactcttctgttattatgtcaaacagttctaactctttattttattctttccactatagaatatgtcaaatttatgatcagatcaaattaggtgtcaaaataaatgttattttagtaaccagcgaccatggaaatcctaattgaatctttaatttctgaaaatgattttttaatttcttttatttttgaattatttatttttcccacaacttttggtcgctatttttcttaatcttcattggtctgatcggggtcgtttgtcgcaaaattgttggtgatctggaaccccgaccgaggcgatcacggagataagagtaataccactcctcaattatttgttcctattatttactccttaaaaatagggttggtcggaaccgggaatttgaggtaaaccgggactttttggctggaaaaaccggcaaaacccgggaatttcccggtcaaaactgtcaaaaccgggacttcggtactcagttgtccgtgttttggtcccgggcccgaccaaccctacttaagaactttggcatgctactactctcattagtaagtatactcagtccgcaaatgtccatccgcaaatgtccgtccgcaaatgtccgtccacaaatgtccgtccgcaaatgtccgtccgcaaatgtccgtccgcaaatgtccgtccgcaaatgtccgtccgcaaatgtccgtacgcaaatgtccgtccgcaaatgtccgtccgccaatgtccgtccgcatatgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtccgtccgcaaatgtcccactgcgattcttaggggtatatttttccttattattgcatttaaaattttctaactagcgtttttagtttaatcgataagactttcacaaaaattgttcaatttttaaagcaattaattacccattcattaattttataaatacttacttatacatttaatttgtttcaaaaatgttgtcattgttttataacgtaaatgtataataaattttttcgtttttttgtttagtgaaaattccaaaaaaagggaaattattatttatttatatgaaattaagacccgtaaataaaaaataaattttataaatatatttttcttgtctcttgaataaaattttttaaccgaataaaatattgcttttattttcccattttttacaaatagtttagcattgttctttctttccattctttgaatcttctttcttttattcgatcagaaccatttgacaaatcctgcttaaaagtgaaaaatatttttatattccgtgtccgacgacaattcggagatttattttagaaagtcatgccccccttaaaagttttttttaaataaaataaattttatattttaatttatgaattgaacaaaatattttccattcattcttaatgacaaaaaaagttagttttaattgttcgttcgttctgtctttacattcccccttttcttcttcctttaatccaatcagaaccacttgacaaattcggaaaaatgaaatgattaatgagtcattgctacagtattttttcattaatgatccaacaatacagcaatttttctaacttttatctttgcgttaagccgtggaaaagcttaattaagcgcttctgtgcatttgatatatgcaattcattgccttatattactgcaaaataaataatatattacagattctcttttttaagatggcgcttatacaaatttattaacctgattcagttactgtttttattactgaatttacttcaacggaaagaatggcggcaattaacacggcaaaatgatgcagccgatgctaagcggcgtgttcaagccggtcgctccgctgataacaatcacaacagggggtctggattttgcgattttgataatataatttttanaaaaatgtttttttcaacaagtaccaacattttggataggcctaggcctagtttcaatgtttgacctgagaaaaacccangtctgcgcccaggtcgacctagtccttcacctacccctggataaaacggtcgggcacgttgttgcaaaggtcgtcgctgcagc

SEQ ID NO: 22685 - DNA, 1025 bp, Heterodera glycines
aaattttcaaaatttttcgagttaggcctaaaattcggtttttcggtttttgaattttatgattttttaacgatttttccagggaaaacgaagaccacttccaaaacatcgttttttgagctctatcgattagtgatgtttttagaaatttttcgattttttccaggaaatagaaaaattttttggcctaagcgggacatttgagtcccgggcccataactcgtcgggggttggttctagccaaaaattgccctagggcaaaattgtagagcttttaaagttctatcgaatggtgtactaaatgttcggaaattttcaaaaattttcgagctaggccccctagaaatttttgaaaattttttttgggttgaaaaggggggtgaaaaatttttttctgtggtattttgagatgctgattacgaatatgacctttgtttttcgtttcataatttttagaattttttaaaaattcgaaatttttttcaatttttttgaccctcgggattttggggtaaattttgaaaattcatatctagcctaagggttgaccaattttacaggaataaagccttaaaaatagagaaaaatcaggagaattttatgggttttattaggattttctagcataaatatgaaaaaagttattccagaaattctggaaaaattcgaatttccataaaaaaattcagaactcggttctgaaaagctatttgagaaaagtaaaatactacaaaaatgcgcaatttttttctctataatataaattttattttacatttttatcacattttaaaaagatataaaaataaaagtgattttgtgcttcgggtccaaaggggggatgcacatggtttttgagtgaaaaaattttttcgacaaaaatcttccaaaaatatgtctttaggggttattttggccgctgatcatgaatacgtaatcagtttttacttttgacatcgtttagacctcagaatccctatgtgattggggattctgaggcatcattttttggggggggggggggg

SEQ ID NO: 22686 - DNA, 2264 bp, Heterodera glycines
  misc_feature (15)..(15): n is a, c, g, or t
  misc_feature (43)..(43): n is a, c, g, or t
  misc_feature (48)..(48): n is a, c, g, or t
aaaagcaaaaatatntgccaagtcattaaggatatacataatnttcanaatcaaaaattatcgtcaagaaaataaaataaataaattttggagataaatttttgagaaatttttcatttcttaggggcgcatttttgaaaattttctggtcgattcttagggatgtattttttgaaaaaatttttgggtcggttcttaggggtgtatttttcttttttattgcatttttgttaacaaattttgggcaaaacgccaaaataggtgaaaataagtttttttaaatttttttaggttttttaggtgctaaaaataaaaacctagaaaataggtgctaataactcgaaaagtagcttaacaacagcccaaaaaaacatgtttttcgtgcgtttcaggccacggggagctcaggaaaaaaatatgtaaaaacctaaaaatcgaagccctattaattacaattataattttaaaaatgaattttgataaatctgggcaggccatttgagcgcagccattagggcgcggggaagtaaaaacggggtccggacaatccgtcagtggacaatccgtcagcaaattgcttttttgagcaatgatcaaaaccttgcaaaaatgattgttaaattaaataaatataattttttataggttcttaacatttctagttactttatatttcaattaattgaccatctcgaaaaattcatttaatcttttaaaaatgattatttcataattttttaatcaaattattaattcagattttttaaaaaccgggttatattactgtaaatattcattcatttacagttggcgatgttgtactgattttgcggttcaatatcactgacaattcaatacagtgtttccacagtttgcatatggtagccgtttataaacatttatttgacaaagtttgattcaaggattgtgtccttgaggccaaggacggctctgtttttggacataaaagcaagaaaaatggaaaaattcctttttttatgatcatttcttgaatgaagggccaattcatcggggtacagcagcactacgtttacccctccggaaaatttttttttcagaaatttacaaaaagagaatttttttgttaataaaattaaaaaaaaaattttttttaacattttttaaaaacgtaataaatttactttatcatttttgaaaaaatgtataatttttgctgcggttttaaaaaaaaaaggttatatggccttatggccaaacaattttttttaatttcataccatatgtttttcccccgaaaccccaaatttttgtcccaggaaaatgccaatgtgacatgtcaacatgccgaatttaccgagcatgggctgaagcaaaatgatcggcgtatgttgcaaatttttgctgaatatgatggcttctacggtgcttttgatggagaagaccgtgtgcaaaaatttgcccatcattacacaccggccaaccaaagcgttgccaaaatgtcaatcccaccatgggccattgaccatgtccaagtaaaaattgtgtccgtgccgttcaaaaattaaaaaaaaataataaatttgtggggcggagtcgttatttaaaaaaccatcaatatgatttgatgaaaaactatttataactttgctaaaagcaaccaaataatttttaactcttgatgtattagatagccctacgtattctctatcagtctacaaaatttcaaaccgaataggtccggtcccgatttagcctaaaattcccggccccgctctactcttaataaatctgttaaattggggtaaaaatttcaaaagctatttttatctgtttaaatttcgatttattttttccgtcggttcccaaaaattaaaaaaagacgccgcaaaaaatggcgtaaaaagtcaaacactgaacttttaatatgaaaaattaattttttacaaatatacaaaaattttcaaaaaggcgccgctcgtcggcctcatcttttcccaaaataaagaaaattaatttaaatagaaaattttaatacaatgaaaagaaaaattttttcattaacaaaagattcgcattaaaactaacctaaaataagttaataatatttgactacttaataaacattaatccccattataaaataaaatttgagacagataaaagcttaaacaataaaataagtttataaaaaaagaaattgaaacgtaatgtaaatatgtattaaattaagaaaatttccaagtttttaaaaataaattaaaaaatatgatttttagttcatc

SEQ ID NO: 22687 - DNA, 2362 bp, Heterodera glycines
ggacttgaactattattaagtacagttaaaaatctttcaaatgaatgcccttgggacatatggaaaatgaaaccaatacaatgggcgccacaagttgagagtaaaggagattggaatgggcaagcgtttttccttattccctccggaaatttacacaaaaatgatgttgtaatcgctgatggaacgggttgggcaaggctatcaaaatagagcactggtgcatccacccccttcgcatagatagcgcaccaatgagatccctccttgtggtgggggtcacggttcacaacaagcgctgccgggtactgtagtgtggatggaggcggcaaattgtcactggcgaagcagccccgaaacactcgcccggtccgacgattttcgcccaaaatctttgtgatttgtaagctgtccatttttcagccaaaaaattgagcagagttggtgtagtaccaggctgatgatgagcattaaatagagagcaaagagggcccagcaaacagcttgatgaaaaaagctgctttcctctggtatgtccttgcacatttgaataagcggtggaagaacaccagaaacatgctcatcaattaacttgtcgctctttggaggtgttttagctgttgttgcggttgttgttgtttttgtgctcgggaaggttgtggtacgtttgaataaagacaatcttcttaaatattcagtgtaggaatattcaggctcgtgttgttgtcgagtcaaagtcagattttttagataagcagaataggtattttccggttgtctttgttgttgttgttgttctcgcagtgttgaagaaaccaagggaagggaaattcggagaaagaacaaaataagacccagtctttttgaatacataatttatttatgagacggcaaaatgaaatgacaaacggtttaaatagtggtatctgtgcttattgatcggtttttgtccaacattacaagggaatcgcattctcccatcaccactagcattattcctccgacgggtactggttgattgaatttgatgctaaccgctgtggtcccattctttatcaaatcaaacagtgccgcttgatcatccccgctgttggtcaaattgaacacataaatgcaatgagtttttccgtattgagcaaaagtaatcccgttgctctctgttgagttggcgaaacccaccgcttcgttcatgtcattgaatgggcgaacatattttccatttctgtaatccaaatcatagggcgcttgggggtacggtcgcccatttgcactaatagaaatttcgcgcacattaaatggttgaaagttgaatggactgcgcaaaattgttccagcatagtcagtattagccaccagacccattgtcacacgacgcgggatttggtccataaacaggttagctgtaaactcatatcgaccctgactgatgaacatcgatttcatcattgtcttccgcacagcataacgggcaggtttcaactctagctttcgcgcaatgtctagcgccaacccatccatcagagacacctttttcacatacattttcagtcccacaacctcgaaacggtaccgacccccggtcggcgcaattaacacaaagtcattgtcattgggtagaatttcaatgtccaattcacagaaattgatcaggtatagcggttggttgaataggtcggtgtcaattttgacgatgaattgagctacgttactacccgcaaacaaattacgtcgcgctgtgcatccgcctcccatctccagagtatcgcccgtgtccctataatacccagcagcattcaaatgggagtcttttgctgtcgttgaataagagagttcatgtgagaaatatgatttgtaggccattagggcattggcattaaaaatttcgcgcccattgatactcatttttatgttgcggatgaaggtttgtccgatcatttgaattggtgcaatatttatgtcatcaatgtctaggttaatgagttgaccattagcgttttccttacggattcgaaactcggtgagcaaataacatttggacagatcaatataattttggctggaatgaagtttgaaatggtaaggtgtgtctgtaagcggattgctgggcagaagctcgaatacctttgaagatgaaacgctcacatttgtagggggtatacggaaaaagtccaatgcattggtgattgagttcacggagtcgttgtcgattttatggaaagccatttatttaattaataaagtcccaaagcgtccgatcgaatacgctttttttgcctgttttacaataaggcggcccaattaatgtttgatgaccattgcacataagttccctttcctttttatactccgtttttccgcttccaaa

SEQ ID NO: 22688 - DNA, 1465 bp, Heterodera glycines
  misc_feature (5)..(5): n is a, c, g, or t
aaaancgcagaaatattagacaaaaaacacgaaaatatgccacaccccgatctctgaaaatttgtttgaatttagaaaaaaaaaatcataaacccataaatttttcgtcagtaaagaaaaaaccattttcacgaattacagaattccacaatcgggaactcccggttatcatttaccgaaaaatattgaagttggaaaaaattcaaaaattagtaattttttctaagaaatcatattaagcgaatgttgctaatgaaattttttgcacaatttttgatatttaatcaaaaaattttggattttagggacgtattttccaaaaatttccaataattttccatctttagggttagattttggaatttttaatagaaaatattcaagaaaagaatggcgccaaaattatgccgaaatttgcaagaaaattgacataagttctgcagaaattatgagatggaaaaaacgatttggaattcggtgtagaataactgacatttgtttttctcggcttatgtattttatctaagcttttccaaaaaaaaaaaaaaatttctgcaattgtccgcaaattcccaatgctttgggaacaaaaacaaatagaaaactcattgatttacttgtaaaaagataaatttgattttttaggcctttaaagtcggataaaatcacttaatattctcaaataactaaatgaaaaaattaaaagctattcatatccataaagtaaaaaaaaaatcttaaattttaagattcaatttcaatttatatttttatttacaaaaatattattctatatcagtagaaaaattattcatgatcaaaaatattattatttttttcaattaagtaggatttgtatatttacaggaaatcaataggaataaccaaaataataatcaaaaattatattttacaagaaaaaataaaatttattatttttttaatttgtgaagaagatgaaattccgcctattataccttccaattttattttttgtgattgaaatcaatcaaattaaaatagaaaataaaaaattaacgcaaaaatcatttgatgaaatatttggagaaaaatgggaagaaaaagaaggaaaacaacgaaatgaagagaataaaagagaaataattgaaaaatattataaaataaaagagaaaataaaggaaaaaggaagaaaatattcaaaaaaagaatggaacaaaattgatcagaaaatagcgaaaaaattggggacaaatagttgttatattcaaaaatggattaaagaatttggtcttcaaaaaattaaatgctataaatcaaaaactgatgaagaaaaacgtcaaattattcaaaaattcattaaaatgaaaaatgaatttaagcaaaaaagaaattattcaagaaaagaatggcaccaaaattatgaagaaattggcaagaaaattggcgtaaaacgtggaacaattggtaaatggaagaaacaatt

SEQ ID NO: 22689 - DNA, 1623 bp, Heterodera glycines
tgccatagttaataatattttaaataaattaacataatctcactgggcgatgtaagcctatgttggcgagcgattgcagatttacatattttgtagtgtatgggtatgtgtgccgtggggatgtgtgtgtgtgtgtgggtgtgttttcgcgtggagggggtcagggaggatggacggggtgggacaaaatcactagattttaatagaaatatcaacatgttttctacttcttttagagtgccgttggttccgtgcaaaccggacacggacgtcgtcacctttgtcgaagtccaaaagcgggggcgaaggcatccacgtctgtttcagcgggacctgcagacgcagcccccgctaaagacgaggacgacgacgatgccgaatttgtaggcaatgacgtcgaccatgacgaagattctgctgctgacgatgtcgacgacttcttttgtgtggttggcgtctgggagcgggccggctcccggtcgcgtgccacacagacggagaccatccatgtgcgcttccacaactgggagcgcgcgcagcgccccgaccgcctgctcgcacgctgcattggtcgcttgatgcagcgtgtgttggacgggcgtgcggaaccgctacgcgtcgggctgtcgatgcaaccgcccggctgggacagctgcttccacgtaccaatgcgtccgccacaacagaacagtgcgcacgcgctggcggccgcccttgaggcgttcgcaaagcagtacgacgagctcgacctgttctccgccgacgtctgcttcaaagtgtcggcggtgtgggccttgcccggtgagctcgtcgtaggcacccccaccccccccgtccctcgacaaagtttgacccctccccccaccgtttagccgcgcgcgtggagggcgcatgcgccgaggatgagcagcgcgcacgtggcactgtccgctgccaatcctttgtgccgatcgtgaacggggcgggcggcgaccggtggtgcatggcacgtgccatcgtgctggggctggcccagcggcgcatctgcgtactggagcggcgcaacgtggtccacttccgcgccttctgtctggcgcagcgtggcgaagcgggggcgcccgaggcgcgccgcctgctggaggacgcagcggtgccactcgaccgcccaacgtacggggcgccggaggcgcaacgtgtccagcgctggctggacgccagcctgggcccccaccaagtacggctagtcatcttcgcccgcgagctggcctaccgcgtggcgtggaagggcgcgcggccggcacgctttaacctgtgcttggtggcacaggacggccactacgggtacatacagtgcccggaacagctattccatgtactctacgataagccaaagaacttagaaaattgaaaagtgtttaggcgcgccagtactgtgtggactgcgagcagccggtggaccggcgcacgcacccgcaaggctgccgggcgctgtgcccccagtgtcttcgctttggctggggccgtccctgtgcgcgggagccgggccacgctccgtcgcgctgcgccgactgcctgttcgtgttcgagaacgcggactgcttcgaggcgcaccggcgccgggtggacccgccgccgcctggctgg

SEQ ID NO: 22690 - DNA, 1444 bp, Heterodera glycines
  misc_feature (1417)..(1417): n is a, c, g, or t
gcttccggcaatgtggaggagttcaaatttccgaccgaaaatgttgaacaaatttttgacggacttttcgcattggaaatgaccggcgacaaaatgaaggccaattatgaagtggcgaagaaagcaaagcgagagcatcagaggcaattcactgccgaagaagagaggcgcgcagcgaaacaaaatttggtcaaagccaagccgaccaaatgccaaagtggtgggttggccagagtcttgaagcccgggttttagtgtgcccgagactgtttcatccggaataaaaaccgagaatttttgaattttaattgctttcatcatttagcgtccaaccaaaaggcgattcagtgctatttggacgaaatgactgagaaagccaacaacagctgggccagggttggaaagcggacggaaatgccgagtgggttgataaaataaaatttgcgaaatatttttattgttttttccaggacatcgtctaatgttggcatgactgatggaggggaaagcgaaggtgagaaaaagggggcattggtaaaataaaaatgcaaatggcacagagaatgtgccgtaagaagtcggaaaacggactcaaagaattccttaacttaaaactagggtaggtcgggactgggaattttgggtaaaaccgggaccgagacttttcgagttgaaaaccgggactttttggctgggaaaatcgggaaaaaacccgggaatttcccggtcaaaatcgggaattcggtactcagttgtccgtgttttggtcccggtcccgacctacctacttaaaacaatgttttctcggtggatggaacccaaaaaatgagagggttggacctgctttttctgcaacccctaggtcgatttgtctcattgacagctttcggttggtacatttttgtcgggattaaatgccgattggatgcctaaagtgccaaccatagaaccaaccgtcagggacgtatccaggatttgggcttgggggggggggtaccgatccgaaaagtcaattcttaggggtgtatttttaaaaaatttttcgcccgattcttaggggtgtatttttgaaaattcttcgcccgattcttaggggtgtatttttgaaaaactttcgcccgaacgacctttttttttttgctcataccagcgacgctgggaaaataggggtgtatttgaaacgataaattaccattttttccatcgtttttacggtggaggaagtaatagatgaatttgcgttgattttggaattgaaaagaaaggaaatgaagaaattgaagacagagaaaatgtttctttgtaatttggcgttggaatttaaaattaatatgttgctttcgttatgataatttggcgttaatttaaatttggcattcctttttctctctggggcgctggttggtcttgttggggngggggggggggtaccgcgtgggtgttg

SEQ ID NO: 22691 - DNA, 1987 bp, Heterodera glycines
accatgtctaaagtaaaatctgattacatattcgtgatcagcggcccaaataacccctaaaatcatatttttggaagatttttggtgaaaaaaattttccactcaaaaatcatggtcacacaccactgtggtcccaaattacaaaatcacttttaattctataacttttttcaaaaaagtgataaaaaactaaaataaaatttataaaatagagcaaaaaattgcggattttttgagtttattatttttataaaatactttttcagaacagagttctgaatttttttctgaaaaatcgaatttttccagaaattctggaataacttatttattttggaagatagcaattccaaatgaatctcataaaattctcctaattttttgctatttttcaaactttattccactaaatttgatcaaaaacgaagagagttatgaattttcgaaatttcactggattttccggggctcaaattttgacgatttttcaaaatttgtaaccaccttccaaaaagtctgaaaccaaaaataaagtatatattcgtcttcagcaccataaattaggccataaaaatgcattttggctaatttaggagcaaaaaaatttttcatgaaatgcaaaaccatggggtcccccctttggttttgaatttcaaaattcatttttattttataactttttttaaattcaagataaaaacatgagataaagcacattatattgggctttaaattctctacaaaaatgctcttagacgattttttgataaaatcaactcctgacaagttattgcgccagaactgaaattgaggcctagcaaccaaatttttctatttccaaaaaaattttgaaaaatttttctgaaaatcacactaatcgatagagcatgaaaaacggttgcttgaaagtggtcttggtttttccgagaaaaatccgcataaaatactaaaattcaaaaaccccaaaagtgacaagggggcctagctggaaaatttctgaaaattttcagaatttaaaaaattcacaagatagagctcggcgagctgtacaataagttcgctggcgacgacccgctcagcgtaacccccatcgagttattcccgaaaaccgaaaatccggtttttggcttttcaatttttagccacgcgtaccgggaatacggtaggtcgtagagaaaaatgtttgctggcaaacttgtagggcacacttcaacttaaaatcctcccagcaagtattttttgatcagagcaaaacccatcgtttcacaggctcttgaaaaaagcaaaaagccatttcagcgccgctggcgctcagttggccaccatatcggaatcagcggcccaaatatcccctaaaatcatatttttggaagatttttggtgaaaaaaattttaattctcccaattttttgctatttttcaaactttattccactaaaattgaccaaaagtgaagtgaattatgaattttcgaaattccgcttgatttttggaggcctaaaaattgacgatttttcaaaaatttttaaccaccttccaaaaagtctgaaacgcaaaataaagcgtatatacgtattcagcacctcaaattatgccataaaaatgcattttggctaatttaggagcaaaaaaattttcatgaaatgctaaaccatggggtcccccctatggttttgagtttcaaaatcacaattaattttataactttttttaaactcatggtataaacatgagataaagcacattagattgggcttaaaattctctacaaaaaagctcttagacgattttttgataaaatcaactcctgacgagttattgcgccagaactgaaattgaggcctagtaaccaaaaattttctatttccaaaaaatttttgaaaaatttttctgaaaatgacaccaatcgatagagcatgaaaaacggttgcttgaaagtggtctccgttttccccggaaaaatctgtaaaaaataataaaattcaaa

SEQ ID NO: 22692 - DNA, 1418 bp, Heterodera glycines
  misc_feature (26)..(26): n is a, c, g, or t
attacaccacaaaattacaaatttcntgaagaattcctcccaaatcaacaaaattggatcactccctccaaatcaggacatttctgataaatcagaacagatccgcaccagggctgggcgaaacttcggcttcgaacttcgtgcttcggctattttacccgaagtttctggaaaaacacacccctaaagattgagtttaattggcttttgataaacttaaagttaatatatgtttgtttattaactttttgctttctgttccttattcacatacatggtcaaggggtatcttggttcttttcagtattcttcctttagatcaattcccctccaagtagttgtttttcttctaattttttaaaattattccttttttcaacggaaattcaatacaaatttaacaattaaaatcgcaaaatgtttttatttttggactaaatctgttaacaaaacgcactaaaaatttcaaaattttcccaggcggcgcctatcggcaccgctggaccctaaaaatcctctaaaaatagctcaaagtcgcaaaattggtaattttttgctgtaaatttgttaacaaattgcactcaaattaaaaaaaattttcccggcagcgcttattggcaccgccggcaccctaatttccatttcattttttaattgagtcaaaaaccgtgaatactctaagaattaaaaaaattttcaaaatacattgatcaaaaagttcaatgtatttattttattaaaaagggttggttgatctctagccgttctgttaattgattaaatttgatatttaaccgaaattttgtgatgaaaaaatttttgaaattaaaaaaaattttgaaaaaacttcggcttcgaaaacttcgggttttttgggcttcggacttcgaataaaaattgggcttcgccttcggcttcgagtgctaagccgagcttcgcccagccctcaccctggggcggacgaaatactaaagcaacgcgcctcatttgtgtgccgatggttgtccaccggcttttccctgtgcagcgtgtccatccggtccaaattgcgccagcggatgccgaaaatgacgaagccatggcgacggtgggtggaggggcgacggaggaccgcgacggggggaaggaagcggacgaagagcccatcatcattagttttgggacaaccgcctcattttggcgccattttggtccgacgaaatctgtcggggattgaaagccaaaattgccgaaaacacttggtgatgattagtagttcttacccaattaaatccaaattaattaggcaaaacgtatcaaaagaaggaagtcgtccaggttaattagggatttggttttggaaaggcttttccgggatcccgcaaaatcccgcgcgggatcccgtccccgcgcccggctctagtgtagatttaaaaatc

SEQ ID NO: 22693 - DNA, 2280 bp, Heterodera glycines
  misc_feature (62)..(62): n is a, c, g, or t
  misc_feature (113)..(113): n is a, c, g, or t
  misc_feature (143)..(143): n is a, c, g, or t
tccaaacaaaattgcgacgaccgatgaaaaatgctaaaatcaagcatttaatttctacattngattttaattttattaattagtagttttcaattgatattaaatgtatgttntaatcgaatgaagaaatcaacaaaagcatntgagaaaacgagagcatcaaatcagcttcctattggcgagatcgatcatttctcaaattataattatttttcaatgctttcatccgcttcttcttcttccgctggcagcgacaatggcctaaaattatttatgttttttcgacaatcaaaaattgcttttgctgctcacccaatgcaactatttccaccccacacctcaaatcggatattgttcaaattggcacccgaataattggcatgccgtagagcaaatttgatatagataaattggcacccaaattttcgcggattttccacttaactggcgccgtctccccaattgggtaccgttgcaacagccaatcgaattcatcgatctcctgtttcagtgtcagcttctcattggtccgttcgttcaccaattcaaatggttcaattggccacagtaaaacttcaaaacaaattttgtagctgactgaagtggtggcatggagaaatgtctaaacaaaacaaaaggcaatcaattaattagtagtttaatgaaattatggtcggtcacctccttgaaatagttgatggactttgaaaaatcatcgcaacgcaatcgcttcggttgtccgtctttgctcggcgtgtgtaaccatttggccaacgcctgccaagcagaaattgcatttggtccaccatcatcagcgatcgcactggaagacagataaccggaatcgattgaattcaattgatcaagatcagtgagaattgtcggtgaaaccaaacgaagcaaattgtccaaatcatcgccattaggaaagctcaaatgccgaatgtttgttgcaaaaagtggccaaatttcgcgggtaaaaacatcccaaattcgctgatcatcctcagttttgtttgaccatatagacaattccaatttggtgcctcttctgtcccaaattggcttgttggaacggagaaatgcgagcacagaatggtcaatgtaactgaagaaatataaaaattgctttaatatatacaaaagtctaaaattacttacttaatccaaaggctcttaaagcgaattttggtgggcagcggacggtccggcaatggaaattccacccttttgccatcgatccattcagacagtttcgcttttggtcctttgtccttgcgaattgcgattgctttccaaattgtcaattcgctttttccatcaaaatgcgtgtcaaccaaaacatcgaaacggtcggaaagcaatgccattttgaggccgagttgggcatagttaaaagatggcagaatgtccatccaaacgtcgccacaaatccaactgaaacaaggaaaaaaattgggtagacaaaaattttaatttttcaaaaatttccttaccgtcgattcattttggtggctcaattagcacacttttccctttttcgattgttttttgtcacaaaaggcaaaaatctgttgttaacttaaaacagagacaattaggaaaaatgataaagcaaaaagaacaaaaaacaattttgaaacagaataaaacagacggagatttgtaaaaatattgttttttcactctaattcactttacctattatctctaattagccccccccccccccccccctccctatctaaggaggttgaacaataatcatccggggggataattagagatatacggacggtatcagctcaatcaattttgaattaggatacggagaatccaggaaaaaatatatgcatttacaaaaataaggaagccgtgtaaattatgtatgtattgaacaaaatcagcaaaacacccttccccattactctctctttatatacgcataaattaatgcgttatggccattattttggccaacaaatcattttaatctccccccatccgttcatccgttttcaaatctctcacttttattttggtagatatatagaggtcgaaaagactttttggatgcataatagcgatgcgatacaatcgcttcggttggccattttttgtcggagtgtgcagccatttggccaaagcttggccagcagttgcatttggcccatcgtcagcaattccatcggggcacagataaccggaagagattgaatcgattgatcaagatcgataagaagtggcggtgaattgtgatgccgcaaattgttccaatta

SEQ ID NO: 22694 - DNA, 1362 bp, Heterodera glycines
aattctggttcggaattttgaaaaacaaaggtcatattcgtgatcagcgccacaaattagcctagaaaaattagttcaaatgccttttgagtgctctttatagtgcggtcaattgagtccagcgtcccagctgagtttggcactccaattccggcactttttcggcctgaaaaagggcaagcgcgcccctaattctgtttttccaacccattttgaacatttttacatcgattctgaccgtttttaaacatttttgagtttggggactatgatcaatatttaccaaaactaataaaaaccctaaaaaataatagttcaaaaacgaaataataaatggaatcgaatgattgtttaaaaatatataaattttcgtcatctttttagaattttattgccggaaaataattaataatttttatttataagataatttaataatttcgaggaagaagtgatatttgtatttatcagacatttcaaatccaaatgagcacgcggtgaattggggagatgaatttcaactcggaaatgatgtaaaatattttagttgggaattcagaaacggttatggccaaacaagaattctgggccggcaattgacaaataaaattcttggcccagaattgataaaaaaaaaattcatattaacgctttatcggatttggacattacaatttttgctttaattagaaaggtcgattcgatttacaaaataaattaaatgattttaattaattaccaaaaacatgttaatcttttaatgattttaaaatttaaatcaataattttaaagaaaaatacacttttcctatagtaaatcctgtttaaatttcttaaatgattttctttggtttcataaatagatacaaatcactacaaaaaatggacaaaacttactgaaaaattttataaaaattcgtatgtattatatttaaaagcattaaaaaatttatgtttttttcaattgaattcctttatgaataaagtgactttactatttttttcagtaaaaatcttgccctggtttataattttcaaaatttcttttcatcgcccattaatttggaattgtatttgtataatgagcttcttggaattcccaattctgtggcaatttcgtggtcggtgagctcagaattttgttttttcatcttataatattgcttcatattgtcaattttctcagcaattttgaaaactttacgatctaaaaaagttgaatttgaaaaaaatttcaaaaatttaaatgggagaaaaatatttaaatttgaccttttgaaacattttgtttaatgccgaatttcttgtcccatttttcaattgttctataataaattccaaattatttgctcaattatttgc

SEQ ID NO: 22695 - DNA, 1871 bp, Heterodera glycines
  misc_feature (89)..(89): n is a, c, g, or t
aaagtggcagtctttggtgagaatctgttaacaaattgcacacgaattaaaaaaaaatttaaaaggtcgtcagtttacatggctggacnccttcgcaaaaaatttggttgacccccgcccttttccatgtatgtccccgatcccccggctttcccgccccgtctaagtccttccccgggtttcctttttccttccccgggtttcctttttccttccccgggtttcctttttccttccccgggtttccttttttctttcccggtttccctccccctccccatccacggcatggccaactcgaggaatcgttgtcacattcttttttgttcagctctctgtcccccgggcactctctccgccaatggcctcgccccatgccgttcttgtcaaagttattttttacattttgcagactgttttattcatattagatggaaaatgccaaaagggacaggaaaacgggggacaacgaatgccaattgttacggaggaacaacggcacttcgactgcgccttcgatggctgttcaggccacgggaaatgccaaaatggtcaaaccttttaaaattttaataatattttaatttttaatttaggcttttgcatctgcgctttgggcttcgttggctcggattgttctgttccattcgacctttgtgacgcgcagttttgtctaaattccaccaaatgtctgtttgactcgctcaacggcactttgtgcatttgccagcggggtaaaataaaaaatatatgtattaaaattattttatttgttagggtttaatggtcgacgttgtgatgaacattctttgctctctcagcaacaaattgagccaaaattggcaattaaacagcaaaacggcacatgcaatgggtccgctgctgacaatgagggaatcgctgctaatgaatgtccaaatggagcttgcaaagggcaagcacttagaacttattagtttcaattctcaaatatttaagtggcatttgccaatgcaattccggatttgtcaaatcaacgaatggaagtggccaaatttgcttgccaagaaatccatgtttggcatcaaatccttgccaaaatggtgccaattgcttttatcaaaacaatggcagcgtaaattgcgaatgcgcggaaggtgtgattcattcgttcttttttgatgtaacatgctgagatagagaagaaagcttcccgagcggaagattaatggatcaattgaggcaacaattgatcctatatgatcgagcaaagtgtggggctggagagggcagggtcggtagttcagctcgtagaacactggtccggaaagccagagacgccgattcaaatccggcgcgccccatagtttttccctcaaaggcttccccagctcgttcatatattcaaccggatctttcagattttgtttaaataattaaatccatatcattgaacatttgacatttgaaggtggaagaacacggctttggaagttgttgtataaaagcgatcaaaaaggggaacagagcgaaaaggaaatggccaatctgtgggaaacattggaactttccgaaataattacgggtaaatattttaattgcaaaatattctttttttgatattttggtaattttaagattattgggacgaccgacagctgatttctcattatgaagaagcattgctctgcgatatgaacgatttggtccgaaccgaaggcaaaatgaaagcggagatttttctgttcatccgttggatttcctctcaattttcaccaacaaattcatttccggcaaaagtggtgaaaaatgtgcaaatttattggcccctaagtgtgaaaatgttggacaacttttacgaccagattgtttgacccagcagacactgcagg

SEQ ID NO: 22696 - DNA, 908 bp, Heterodera glycines
ccttggcgaattcatagaaaaataaaaaaattatgaatcctaccatggtaaatctaaacaattaattataaattaaaacttaataaataaataatatttaacaaatctgaataaatatttaggaaatttttccaaatagatatctttcttttttttttaaatattttttcataatttgcttcaaaggtttttgagaaattaatctttaactaatttttaataaaaaatttttaatataaagaaataacttataaaaacaaaaaaccatttgcgcatgctcactctatgatcagaggtaaaagtgtgtttttcatgtgtccgattagagtgttacgggaccgggaatttttgcaaaaccgggaccaggacttgccgggacctgagaagccggaaccgggacctcgatttttttcgggaccgggaaccgggatcaacagggaccaacaaggaattttaaaaaattcaaattttaatttatttcaagtgaaataatacaaaattaatttttgttttactatttatttataaaatccaaaagttaaagcataattaaattaatgaacattttccaatccattttacttcagttatttcagacaattaatcattttttgattcaaatgatcgaatattattagaaattcagatgtacttttcacatcattttttcggcgcgctttttccaaaaaattttggggaaaaaagtccggaggtgccgataggcgccgccgggggaaattttgaaaatttaagtgtatttttgtaaacacattttcaactaaataggtgctggttttttggattactaggctcaatttgtacggattttctttaaaaaatgataaaatatatgtaatttaaaaaaagtatgaagtataatattttgtagataggaaacctgtaagtat

SEQ ID NO: 22697 - DNA, 2568 bp, Heterodera glycines
ggatttcccgggttaggacacttcctcagggccaagggctttcggggcgcttatgtctcgtgttttttcgaatgcaagcacactggtcccccaggcaaaggagttccgatccacgaactcatagggcttgtcaaccatggcaatacgccactcactcgtataccaacaccaccaccaactttaggttcagcatccccagtgctgagttccccacagcatttgtgccttaggcaacatttacacaagtcaattaactcgccaaatttctttaacacacagacgagctgcatgttttattcatttcgacagctgccaatcgctggagaaactgaggccacgacaaaggtggcaccccagcagcagccatcaccgttcaatgccgagcacaagcgcaagcaagcacttaaacccagacggccgcgctccccacagcgaaatcgcttcttttttccagccacaatatcgcaaaaacggcccaaccaccacactcacccacgccaattaaccaacgcaaagcacatacgactaggaactttatacaaatttaaaaaagtaatattttgtatatgcatttaatcaaatttctactttctttataaatgttagctaattagtcagcgtctatttattttctgtaaaaatttgcctctttatttaaaattaaattaatataatttcatgaaataagacactaaatgtatagagaatgaattaacgtggtcgattggaataaatggaaaaaaaagcaaagtcaaaacacaaaaccttaaagcactagccgattgaaataaatggaaaaaaaagcaaagtcaaagacaaaaccttaaagcactagccgattgaaataaatggacaaaaaagcaaagtcaaagacaaaaccttaaagcactagccgattgaaataaatggaaaaaaagcaaagtcaaagacaaaaccttaaagcactagccgaagcaaagtcaaagacaaaaccttaaagcactagccgattgaaataaatggaaaaaaaagcaaagtcaaagacaaaataggaactttatacaaatttaaaaaagtaatattttgtatattgtatatgcatttaatcaaatttctactttctttataaatgttagctaattagtcagcgtctatttattttctgtaaaaatttgcctctttatttaaaattaaattaatataatttcatgaaataagacactaaatgtatagagaatgaattaacgtggtcgattggaataaatggaaaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaataggaactttatacaaatttaaaaaagtaatattttgtatattgtatatgcatttaatcaaatttctactttctttataaatgttagctaattagtcagcgtctatttattttctgtaaaaatttgcctctttatttaaaattaaattaatataatttcatgaaataagacactaaatgtatagagaatgaattaacgtggtcgattggaataaatggaaaaaaaagcaaagtcaaagacaaaaccttaaagcactagccgattgaaataaatggaaaaaaaagcaaagtcaaaacacaaaaccttaaagcactagccgattgaaataaatggaaaaaaaagcaaagtcaaaacacaaaaccctaaagcactagccgattgaaataaatggaaaaaaaagcaaagtcaagaacttattctacctaatttcatggtgactgacgaggcatttgactcccttaagagagccttcccttctcatgtacttgtacctaaaatgttgttggcacaaaaagtaaagggggaaaaagaagacaaatcatccgatcaagggctaagtctcaacagatcgcagtgtaaaagctgctctactgctaacaaccccctgaccagtagtcaagtcgtatacaagtgattttgcgccccgacgttccaccatggcacacgagtgctacggctttggcaatgtgcgagcaattaagcacgcacatcgggccagatgctggggcatttgtgctgcaccgcaagcggcgcataagtagtgcctcccgacaccggggagcaagaatattgctatcttgcctaggcgggattctgacttagaggcgttcagtcataatccctcagatggtagcttcgcaccattggtctatcgaccaagcacatgaaccaaatgtctgaacctgcggttcctctcgtactaagcaggattactatcatagcaacaggtctttagtagggtaaaactaacctgtctcacgacggtctaaacccagctcacgttccctattggtgggtgaacaatccaacgcttggcgaattctgcttcgcaatgataggaagagccgacatcgaaggatcaaaaagcgacgtcgctatggacgcttggccgccacaagccagttatccctgtggtaacttttctgacacctcttgctggaaactttacacattcaaaaggat

SEQ ID NO: 22698 - DNA, 1365 bp, Heterodera glycines
ctagtttctactctatatagaataatgttgggtttcgtttctaaaaccaaaatctcgggaacgggcgccgggaggggcgcgggagtgtgacatcacttaaccaacttttgacggcgcatctgggaaaaatacgggttttccggtccggtggccagttgagcgccagcggcgctgaaacggcccgaaaatttttttgtccgtttttgccggcctgtatctttgcgggaagaagcgggagcgaaaaatgcttggagaaagggcactgcaccgaacaatttccaacatttttcgtctccaacacgttcccgtacgactaacggtattcacggtatgcttgacagaaaattgtatggtcaaaaaccggttttttgaatttcgggaataactcgctgggggttaagcggagcgggtttgcgccgcttgagcatttgtgtagtttttaaagctgcatccgatggcgttttcagattttgaaaattttcaaaatttttcgagctaggccccctcgaaaatttttcgtttttgaattttattattttttgccgatttttcccaggaaaacggagaccactttcaagcaaccgtttttcgagctctatcgattggtggcatttttgaaaaaatttcaaaattttccggaaatagaaaaattttccggaattgagctccccatttccgttcaaggcttataactcgtcaggcgttgattttagcgaaaatttgtcttagagcatttttgtagagaattttaagctctatctaatgtgctttatctcatgtttttatcatgaatttaaaaaaagttataaaattaattgtgattttgaaactcaaaaccataggggggacccaccccatggttttgcatttcatgaaaacattttttactcttaaattagccaaaatgcatttttatggcataatttgaggtgctgaatacgtatatacgctttattttgtgtttcagactttttggaaggtggttaaaattttttgaaaaatcgtcaaaatttgagccccggaaaatccagtgaaatttcgaaaattcataaatctcttcgtttttggtcaaatttagtggaataaagctttaaaaatagagaaaaattggaagaattttatgggatttatttagaatttctatctaaaaaaataaaaaagttattccagaatttctggaaaaattcgatttttcagaaaaaaattcagaactcccttctgaaaaagtattttataaaaataatatactcaaaaaaatccgcaattttttgctctattttataaattttaatttagcttattatcacttttttgaaaaaagttatagaaataaaagtgattttggcatgcgggaccaaaggggtg

SEQ ID NO: 22699 - DNA, 1739 bp, Heterodera glycines
atcctgggaccgtcccagtctcaaacattactagttttggggtgtacgtacccacattccttccttcattccatccccctaccaaaacaaaatttttcccattttttctccatttattttttttattcccagacaaaccctcgtcctcctcctcccgtcggtcgtcgccgttgcccgtccaagtgggccaagactatgtgagcaccattgaactcagcaaacggggaggcggcgccgctgctggcggcggggaccagcgtggatggccactgaagtcgccgacgacgatgaccgcctccacctcgtccgcctgttagggcgggggcctcgctttttttcaaaaaaaacatctctgcctctctccctgtgaatgtaataaactgtttcctcaaacacacaatgtctcttcattttccttttgtttttctttgctgtgatcttcccgtagacttacttacttatcgtgtaatgaatgtatactcttagagtgcctatgcccttgtgaaaaaagtcccagaaatcatttaaaactcgatcattttgtttttcgctctcacttaatttctgctgctgtcatcgactactactgtatactttcactttccagggatggagttccgtttatttaaaaaaaaaattcggaagtcggaattccgtctcatccctgcttctactgtactttctattcatcaatcgcccctcccatttctaagagctctccagtgatcttttgttcgacttttgcttaattataatgccacacaaaaaggcgtgacctgcgcgaccctttgcataaacaaccaacaaacaacatgtgcccaattttcacttatttatttattattttgctttacaaaaaatattccatatttgtattttttccaaatgtactgtaatcactgtgcaataatgccgccaacacatcataatttaatttatttttcaagcttatagtccgtttttcctaaaaaaaaaaaactttccgattacattgttttttagcacacccatatcacattcatttattagacggaactaaaatccgccgctcctttattaaaatattccggactcgaggaatgaaaaggcaaaggaatttggtatttgcgctgcgtgtgatcgatcatcacatctgcgtcattttgtcatgattgatcacacaccatcaccccctttttgctgatcagtttactgcttgctgcacatgatgcttgtgatcgctgtggttttgctggctgatcacttattatgtgtgcattctgcccgctgagcgctcccccctttcacaccttccgccgctgatcaaaatgagctgctgatggtgaaatttcctccaacccccgatttgtcattctcgaacagagagcggcattccatcgtgatagtgatgggaggaaggcgggatgccatccacgaccattattcattcatccattcatgctgcaaaaaccacacagacagacgatagtgtgatcactgatctgcgtaccccggaaaaatatttaccgaatatgctctaattatagtccagtctctattaatcccgcagtctccaattatcccccagtctacgaggtgttttgaaaaataatccctctatcataatcccccagtctctaattatccccccttttctgaggaggttgaaaaataatcccccatgggctataattagagcatatacggtattcgacaactttttaggaaatagaaatttttagtcaaaaaggagggggaat

SEQ ID NO: 22700 - DNA, 1447 bp, Heterodera glycines
ataaaataaagatggatatgtattacgtatttttctccttacttaaaaagtaattctctatcgaatttggtgagaaaactggcgggaccgttggagctgaaatttttcgtaaaaatcctgctgggtcaattctgaatttcattttatcattccagaaatatcaaatagcccctgctaggccagtaaaatttcaaaaaaaatttgacaaatttttttttcttattttgtaacgaatcatagcgcctcaatcgtcccccccccgtcatttttcgctttgtggggggaacatttattatcatttatcaaaattatcagagagaggctcagtttgctgtcaattaggattccaagatctcggattgtttgggtctctttaataatttttccattaaattggcagggaactttaaaattatccttgccaatgtacagagaagctgatttttctggtgaaaatggtagaccccacataaaaaatttttggaaaaatacacatgtatcttatttgtaaccgcaattagtgaataaaattgcttgtcttaattcgaaattacttttcatgtagaaaacagcaattttaaaaattatacccctaaatttggaactttttcgcccttatttacggccttattcatcaccccataactttaaaattggatagaaaataaataaataattcagaatttttttctctattacctaggtacctatatgcaaaatttgttgtggatttatgtaacaagcagaaaaaaaataatttatttttacataattaaaacaaagagatagtacaccaaagtgagagaaattacaaagaaaaaaagcaactacgagatagtatgtgttaggcttttctctgcacagtggagttgacccatagagcacacctctgaactaaaaaaaccttataaatatgtcgtctcttggggttaattttcattttgttgtatcccattgttttttcatttgtttgcattttttctgatttctcccacctttgaaaaccttttgcttctatctctataatatgtaaactcggccaaatttttcttttttcacaaaaaacaatgaaaagctctaaaactgtttccgaattggataagtattccccacaaagtccttgcttttgtgagtcgaccttttgacactttcattggttgggtccatcattttgtgggcttttcctaccaacaaaaaaaccccaatttctgctgatagaggcaataatttattccgtttaaattttcatgtctttatttgctatgggattattgccatccaaaacgacaccatcgccgtcaccaccaccaccgccgaatggcacgactccatcgctgccgcagcaacctccgccagtcgccgcggctccgtcaccgtcgccaccggttggcaatgtgttgccgctgctcgccaacggacagtacgcagttggatgtgccgacattat

SEQ ID NO: 22701 - DNA, 415 bp, Heterodera glycines
cccccccccctcgttcccctccccttttctcggtgccattctccctctttttcagttcatgcgttggcgaccggactccgagtacatggttggggtggcaaattaccagggcgtgagcatgttcaagatgaacctcttcctcgattgggtcgtcggcgacaaaaagtgagtttttcggctgcatattttgggtctttcccatcgccgggttaaactgatttttgaaaaatttcctcaaaaattttgttttttaaatgaattttttttcaaaaaaatcccgttatttccgcttcgtcggtccgggaccccctccccccatcccttttgtcatctccaccattttttaatgtattttgtctttttttcgatcgcccgtccattggcatgcgccggtcgtgccgggtgagcagcgctt

SEQ ID NO: 22702 - DNA, 1121 bp, Heterodera glycines
  misc_feature (31)..(31): n is a, c, g, or t
  misc_feature (54)..(55): n is a, c, g, or t
gtagaatagaatggccattgctctccgcgcncctctgcccatgctgggacattnngtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaattccctgtagaatagaatggccattgctctccgcgcccctctgcccacgctgggaacatttgtatggtacaaaatttctcgcaaaaaagagatagccatttttctggcatagagaataaatttaaaaattccctgtagaatagaatggccattgctctccgcgcccctctgcccatgctgggaacatttgtatggtacaaaatttctcgcaaaaaagagatagccatttttctggcatagagaataaatttaaaaaataccctgccgaataaaatggccattgctctccccccccctctgcccatgtgggaaacatttgtttgggacaaaatttttcccaaaaaaagatagccattttt

SEQ ID NO: 22703 - DNA, 970 bp, Heterodera glycines
ttcaaaaaaaaatcacggtcacggtcacgaaaaccgtgaatttcacgggttttttatgtcacggtcacagtcacgattcacgggctcaattcacggtcacgattgacggttttttaagtcactgcgcatctcttctgtgtacacaccgcatatggtcaaaaattaaaatttttgaattatttcttttgatgctcattttcaaggacttcttgaattcaaggatactttcaaattttcaatcggaagggcccaatttcaaggaagtccttgccattcaaggacggatgggaaccctgcccttgtcgggcagttccgttagacgccgccgggaaatttttttgacattaatgcattttgtgtagaaaaattgattaaaatatttaaaaaattgccaattttccatggaaaattttttaatttttccatttaagggggaggagaagggattcccctccatcccaaacagggatggacgaaatttcgtttcgttttcgtttcgtcctacattttcggcaccttttgagtttcgttttcgttttcgtctaccaaagtttttcgtttcgttttcggtttttaaattttggattttcgtttcatgtttcgttttcgtcagagcaaaattggacgaaaaagacgaaaatatttacacattaagaatgacttttttggtaagaaaaaataagatatttcttgaagtattgtattaaatctgccaggaaattgtatgtaaagtttgaaatgttgattaaaaaccatatttttttttacaaaaatactaatatagattcgttctaaattttattacgaacattaaacaagtttttggagtccggcggtgccgataggcgccggcgggaaatttttttaatttgattgcaaattgttaacagatttatcgaacaaatttgcgctttttaaccgattatatgaattttgctaacgatttttcacaaaaattaggtatctataa

SEQ ID NO: 22704 - DNA, 886 bp, Heterodera glycines
ggtactcaaacaattatggggagcaaaaattcccacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctactcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaaccaattatggggagcaaaagtccaacgcagaattaaagtacaggctatagggaa

SEQ ID NO: 22705 - DNA, 1431 bp, Heterodera glycines
acaacagcaacaacagcaacaactgatcagtgctggcggcactgatcagcaggttgccgccgccgctgccgctgcggccgctaccacactgatggccaccgcgcagatggccgcgcatatggccgcggcatccgccgctggcggatttggttggtgtactattattgcaatgatcggctctgatcagtttcttacctttcttgtgataagcgattatcattgctttctgctgattggtagtaattgccaatgattatggtctgtccaattaagctttcattaattccatatgatcaatattttggtagtaattaccatggctaagatttgcccaatcaatcatcaattgatctcatatgatcaacatttttcactttaagattgggagtaatattatcactgatatacatatatctgctatttattatcaaattgatttacttaatggattttggatttattgccaggttttctggatatgctcggccaagccggcgcctttccaaaagcgtcgcccaccgccgaagaacaaagtcacgctttccaagcagtgccagcactgtgtgcagcagactcatcgcctgccgaccatgggacgaatggcgtcaacgatttgctgaccaatggcaccggtgccaacggacgccgcgccaccgctgctgcaacaatgcgcgcttccgcgccgccaaacgacgaagcggtcgtggacggaagcggtggcggcaccaacatcggtccgcctcgggcaaagcgtgcgcgtgccggaagcacaccgttaattgctggcggcgcggcactgcagcaaacgacgacgatggcactaatgggcaataatgagggcgccacgacgaacggaagcggacggacaagccgcgaatccggcggtgggatttaaatgtgccatttaaaatggggggggggggaacgagagcacttcattaattaatggtatcaaaattagattcgctttttctcgaactctcggcttaattgacacttctacaacgaaattccattcgcatattttgcgatatgcatattttacgtgcatattttggcatttttttaaacatactcaaaaatttgaaaaaatgggaattatgccaaacataatgtccaaaaatctcaattttcttcaaaattaataaagtttacatagctttattttgtattttttcttctaaaaagatgttatgcatttttaatataaaaattcattagcgttttaatcgattttttaattaatttccatcggaaaacaaatttatgtttttataacaaataaaaagtacaaattaatcaattgcatgttgtagacttatgttttccggatgtattttagtttttgttttgttttttgagcagacgacaaaaaataatcgtggcttaaaaattactaaaaaattaataattaaaaaaaatgcccgacaa

SEQ ID NO: 22706 - DNA, 1337 bp, Heterodera glycines
ttttcaaaaacatgacacacattagtgtctcacactaaagtcacagaacaaaccactaatgtttttcaaaagcatgacacacattagtgtctcacactaaagtcacagaacaaaccactaatgttttatcaaaagcatgacacacattagtgtctcacactaaagtcacagaacaaaccactaatgtttttcaaaagcatgacacacattagtgtctcacactaaagtcacagaacaaaccactaatgttttatcaaaagcatgacacacattagtgtctcacacgaaagtcacagaacaaaccactaatgttttatcaaaagcatgacacacattagtgtctcacacgaaagtcacagaacaaaccactaatgtttttcaaaagcatgacacacattagtgtctcacactaaagtcacagaacaaatcactaatgtttttcaaaagcatgacacacattagtgtctcacacgaaagtcacagaacaaaccactaatgtttttcaaaagcatgacacacacttttgtgtcacactaaagtcacagaataaacactaatgttttatcaaagacatgacacacataattgtgtcacactaaactcaaataacgaacactaatgtttatcaaaaacatgacacacataattgtgtcacactaaactcaaataacaaacactaatgtttatcaaaaacatgacacacattagtgtctcacacgaaagtcacagaacaaaccactaatgtttttcaaaagcatgacacacattagtgtctcacacgaaagtcacagaacaaaccactaatgtttttcaaaagcatgacacacattagtgtctcacactaaagtcacagaacaaaccactaatgtttttcaaaagcatgacacacattagtgtctcacactaaagtcacagaacaaaccactaatgtttttcaaaagcatgacacacattagtgtctcacactaaagtcacagaacaaaccactaatgtttttcaaaagcatgacacacattagtgtctcacactaaagtcacagaacaaaccactaatgttttatcaaaagcatgacacacattagtgtctcacacgaaagtcacagaacaaaccactaatgtttttcaaaagcatgacacacattagtgtctcacactaaagtcacagaacaaaccactaatgtttttcaaaagcatgacacacattagtgtctcacacgaaagtcacagaacaaaccactaatgtttttcaaaagcatgacacatattagtgtctcacacgaaagtcacagaacaaaccactaatgtttttcaaagcatgacacacattagtgtctcaca

SEQ ID NO: 22707 - DNA, 2463 bp, Heterodera glycines
ctcgagcacttccgcaatggataccattccaaaagacccttccgccccaaccgaaaaaggcgattttggagaaccgggggattctgaaaaatatgcaatttggtcaaagaatgtttaagatggatgaacagtccaaccaatgtcactggtgctgttctcattctccaccgactgtcccttttggactgtccgtcttcgagaatattcctgcacactctttaaggtaagtgctgaaaatgtttgcaatctctcggcaattcgccgccttcggcagttggaagaagcgtttttcccatccgaacatttttccgatggcgtaggttttggttcatcaactgtcgattgcgagacgttggaccgtttccgttcggctaaagaaaaacacaaacattttgccaatgttctcccactaacccttcgttcttcggttagttaattcctttttaggcttaccaatttcatcactggctaatttgatgaaagtgtcgtcatcgaaagtgtctgggtcggtcgattggcattctttgctttgtgccccctccaaacattttgcatggcacaccaaatcgcatttttcgcattgatttgcccatttcagccaaatttttccgccacagactccacaactcacattgaaacctgaaaagccaaagtaaattcatgcactttcattgaccacactttgtttgtgtttcaatggcacccatcgatgttcgtgatgagaaaagttagccaaactttggcacggatcatccgactgatgagtttgatggacgggggccgattgtgagagagaagcgcactcgcccaattcgacgggcaatccgtcggggaaaaaacgaaaagagatgagcaaatcgccgaagcataaacgccggtcgaacccattgtgacgactcaattggtcaaactcggcaggaacagaatggcaatcactgaagggaagagaaggaatcgggagagaaaagcctaaagggaccttttgggttctctcaaatggaacctttccctgtggcaataagacagtgttaacttaagcaaaagttaatgtaagtgggaattacaggtgacaaaccgaacagtcctcgacgagtcccggcacataaacactcgtctgaataaatgaacaaaaaatgaaatttaactaatagcggggaagtaaacattataaaaatagagaggagtctccaaattgccaattgcttacccatcccaacattatcaattcctctccatcatttcgctgcggttcgccttgtaaattgtttgtagcgtaaagacaaacactcaggtaaatcgtgtctttgttgaggccaaagagattggccattaattgggttctgaaaaatcaaaggttttgcattaatctttgattcatgtaattatatgcccatacaatttcttgctatttagtaaattattattaatggtccatctatctttacaatttcttagaaatcaattgcctttttccattttttatcaaaaaaatttttgacgcctaaaaattgatttaatgttaaagttttatagaatatttgcaccgtcccccgtctcaaaattcagggcaatatcaataaaacaataaatttcattggtaaataccaaacttcaacaaaacccatccaccaccttttctcactgccattggtatcatttacctttgtgtatgagtttcattgtgtcatttccatagccgatctcctcacaaatacgctctctcaattccccaaaatttgttggcatttgctgtctcacttcacttggcttcgcccccgcttcacaattgtttagtgcgcaaaaaacctcctgacaattaattcaggaaaattattgtgacataaattaatgataattattgcaaaccttataaaccaacgcgttggcaaacacggcgcctcgcgccacaaacgaattggcaaagttgcgcttgtttatgcgcttaaattttttttccaaaaattatggttaatacctgaaaatataaataaattaaacatattttaaaatatggtataaacatttaaaaataaaaacaattctacaaatttattaatcatagtattgatattttttagccgggcaaaaaatagcacaattaatttatttttaatggctaccgatttttctctatttctctaacacaattcttttcattttttctctctctctctctctcacttttctatttttcatatcgcacactctcctccctcactattttctctctttatctaactaccgtatttgatctaattatcaacccatgggggattattttttagcctcctcatagactggggataattggagactgggggataattagagcaaatgctgtattttctctctctcgaccccatccaataggtttgggtttgtggaaggggatgtcagagaaaaaaagtcgacacactctcataagggatcgaaaatcaatcgataatttgattgggaatatta

SEQ ID NO: 22708 - DNA, 2290 bp, Heterodera glycines
  misc_feature (5)..(5): n is a, c, g, or t
  misc_feature (2260)..(2260): n is a, c, g, or t
ttacncactttgaacccaatcagccagcgtaaaaaacttgaaaaatacaaactaattaattcatcgcaaaaaataacaaaaaactcactggcacataatttgcctcgtatttgcaatttgggttcagcaaaagtcccgaagtcacatttttaatggtcaccgaccgtcccaaaaaaggacccataaacactcttttcgggtcgtaatcattcgcgtgcaaattgtcccaaatcaaaggctttctccgaagaacagtcgaaaccctttgaagatggtcggcggtgagaaaacgcgaaacaacgcgaggaccttaataatatttgaaaaaagggttaacaataaattatcgacggacctgtccacaaaatgtgaatgtccgggtgaagtttggttcccagcaaattgaggtaatcggactcgctcaaagaaggcgaggcggacgactcgcaatattcggtgggacagaagaaaaacagcggacatccgagcgactcgaagacggagttggacacggtcagctgagccagggcgaacgaggagaactgcttgcggtccatttcgttcatcgacgcctcaatgtcgtcgaagagaagcgaaaaagcggtgcagccgagggaaaagaccgaaaatgcgagggacggatagaaaaaagggagaaaagcatatttcaaaccaataaataacctacctaaaaatgcatcttatgaaaattgttttgttttttgggtgtaaacctgggtcagcttctcgcgaattgccttcagctccttggcactcgaatagacaatgtcaatgcccggtgaaagtgcgtatacaaaagtaattccgttgtctttggccgctctgatcagtgactccaacaatgctaaacaacaaaaaacgattggttcattcatttgcggtgcttctgcccttgcccaacccacccgcttcctccggcgtgtacagcaaccgccactccgcccggtgcttcaagtcgtcctttggcgcatacaaatacgtgttcatgccgaactttcgcaacagtgtgaacaaatgcttccgctgttcagcagtccatggtcggccataaaagcctttttttgtaaaaaagcggaaaatgaagcaattaatggcgctacttgcaaagagcgctcttttgaattctatcaaaaacaaaaggggggacccttttgttttgcaaaaaatttttgagatacaaatccatgaaaatttgttatccgggggttttagaggtcgctgatcacgaatctgacatctaattcgaggtcttggaccccaagaaccccagggaataaattttcatgactaaatattaaaaaattttgcaaacaaaagggtccccccttttgtttttgctttttgataatttcaaaaaggccctctttgcaagtatcgccgaaattgattttcatttgcctttctttgaattttcccttttcaggcgaagtcaaattttggaaaggcatccggaagtgaaggaattctttggcattggtcggtggtcattcaaaccttcagaagacaaatgccacctttttctgactgtttcagaccaaagcttcaaatatgtcgttgtttcgatggtccttttccaattgctcatggccttctttctcaggggtaattaattcattattaattggcccattaaagttttgatttaaaaatgatcgacaatgtcgttgatttcatgaaacaaagcttgacctgatgaaaactaacaattcttaaagttttgccttttcagattcgcattggcttttggtttgcctccaagcgtatttcgtcggtggcactttgtctcattcgctgactttggtttactatttttcttcctttttttcctcaaaatccatccccaatttccaatttatttcccaatttttgtaggctgtccacgagtgctcccacaatttgggctttggccattccaaaatgcttcaggtgagccaattcggctctgttgcagttttttcaaagcaccataattttttctcgtatcgtccaaattaaacattctttgagtcattcgataactctaaaggttttctattagcctataaaattaaaaaaggcttcgcattatttccatttttttgaattttaatttgctttttcaaccctcatggaattctttgcttttttatggtcgtataaattggcaataagtcgccatccccccccctgtttcatttgttcgtccgtccctctcagaatcgtctcctcggcttcgttgccaatttgccccatggcatcnccatgtcgatttcctcaggaaatacatttg

SEQ ID NO: 22709 - DNA, 1231 bp, Heterodera glycines
ttagtagtatagggacagaaatcttgcccccccccccctgggcagagagatgcgcattcaccataggagagttgagagaaacagagaaaaagagtaatttctaaaacaagggaaaacgattaaaatgtaaagagaccccccgaccaataagtttttgtgtaaaaatccctgtttatatggtattgcgggtgctcctcatcagggctggagcgcgaccgagatccgcgattcgcggcgttttttttttgcgcgatccgcggtcgcggccgcggcaatttgaatgcgcggccgcggtttttttttttgcgcgatgcgccgcgcattttttggttgtaaaatttttataaagaaaattttttgaagcgatgtcttttttgaatattcaaaatttaaatgaaatttttttgaaaacttgtattattttctcaaaaattcgttttaaaattccaatttttccccgtcagagctgacaaaaccttaatttttctttaaaaaattggctctaaatcacaaaataggtcattttttacaaaactttaaccaaattgcactgaaattttcaaaatttttcccggcgccgcctatcggcaccgccggatccaccccctcccatcagttcccaaaagtttttagaaaaatcgcgccgaaaaaagctgtctgaaaaacaaaaaatcataggatttccatgaatggaatcctttgcaaatttaaacactgactcaccccctcccccattcagtcccttcccgaattttatatgcatcgtgattttaattaatttttatataagaaaactttaaaaaaatgcgcggtgcgcggccgcggtttttttctgtgcgcgctccagccctgcaccggacccacctcccattccccaactttttttggaaaaatacaccgcaaaaatttttttttgttaaaaatctgtttttcagcccgatttcactgaaatgtatgatttgataattttttccccaaaattgttaaatccataatgggatctgaaaacggacgacacccaactcgtactaggtatgaccaaaactcgtaaaaaaatttcgtccataactttttcaaattggataaaattttttgaaacttggtatattgagagagaattataaaggctatcgaataataccaagaatgtttaatttggtaactttgacaaaagttgtgacgatttttttttgggaaaacggtacgagttggatttttaccgtaaaagaca

SEQ ID NO: 22710 - DNA, 2788 bp, Heterodera glycines
tttttgattaaattcttgtcgaagattgttttcaaattggttagattttttctcctctttaatttcataattgtattcgacctcatttttcaatttcagattgtaataatggaaattactaaatttgtttttaccctttttccaaaaacattttgaattatcattcagaattttgacgacggaaattaactcccttggactatctccataataaatagtaaatattggcttaactgctgaaaatctattggccaattcagagcttttaccttaaatatttatcagattttaaaaccattaatataataatgattgtgagatacgataatttactcatttaacacatttaattgttctccctaatctatcattaacaaatgtccctggggcgaaacggggcggtcccttcaattgttatcctccccccgtcgttctcctctgatcacttttgggatttggccaatccaaattgcgagagggaccccctcaggcgtccctctgttcccgaggacgttctgggctggggcccccagttgtacccctttattattacccaataaaggactattgttgacggtataccatttgtactggggatgcgactgggaaaagggccccccgctacactacgaaagttatggaggtcccgccctcgggaaaatgttaatgaaaatatgtaaataattggcaaatattaaaccaaattgatataatgagtagttttgtgaaattaattattatttttaatagaatgcaacagtaaaaaacatggaatgaataattaaaaattagttaaatggcagtgatcacattaacaaaatgtgtttaacaacttaaaattcaattctcaacatttcgagccatcgctcagacggcagttgccatttgcttggctaaaagccgagaaaaaattgaagaacaatttggcaaaagagagaaagacttacgacagaaagaccgcccaaagtgggatgagcttggctcccacggtgaacgtggcgaaaagtgccaatgttgttggcacgcttggagcgcttgaagcaacatttgtcaaaaaacaaaaacagggcacaaacgacaatgccaccacaaataagcccaatgaagaaattgagaagagtaaaaaggagaaaatgaagttgtggcagcgaaaagtagttgtgaaagccgttcggatcgaccgacggaccaaggcaaatgtttgggttgtcaaaatgtacgggttcccaacaacgattcgggctggcacaaggcattttgcagacggccttgggttcccaaacaatttcaagcatttttttttagactcaagaaataaattaagagaaaagtttaataaaatgggaaaaaggaacacaaattggaaagatgagaaatggatttggacgattaagtgaaatgaatttgaagaaaaaacattcaattgacaaatttccgtcggcttattcaatttcgcacctgcaaaattgtccttttctctcagttcagtgtactatttcgcactttttgtgttgacaattgcacaattttattcaccgttcactctcccacccccacccccctcttcccatctctcagcaccaaattttcgaccaatttcttggaagtgaaaggaaagagtggggacaattggccgaacttcggcctatgaacattgcttcaacaggcgccgttgtgatgatcattaggggccgattggaaacaattagcgggatcagaaaggggattaaagaatgtgactaacaaatgtttaatgggaaaaatttgccaatcacgagaattgggccaaaaatgaatcggctggccagccttaaagtgatcaacataacaattaatcaggaatgtgttgcgaaaatcgccaaaatcgcgaaaaaggccaatcctctaaacagagtaattaattagtaaaagacgggcgaagtaaagtcataaggcaaataatgaaacatttgtgctcaggcgaaaataaaagctcatttgggatcccgttaatactaggccatttgatttccactctcgagactctcgacttaagaaaatattaaataattttcactgattaaatattaactctgtacaatttagtattaaattttcacaattttagcaaaaagcaatcacatatttctctaaccctagttctacaaaataaaatatcaccaattgatttgcactttactgactgatcagacacagctgaacggagagtcgaaagtcgttccaaaaaaaggcaccattggcccaaaaagcctcattacatcaaagagccgttaataattaattaaattaatccgaaatgaataatttttactacagtcgttaagaaccactaattggactaaattttaagtcggagaagattggcacgacatttccaacgcctggaaacactggaaaagagggagattttcaaattggacgcaaacaaagaattgacgggaaaagaagcaaattggtggagattgattggcacgacatttcggacacgcggacacattgcgaacagaggacgaaatttatcggacaaaaacaaggaattgactgaacaagaagagaaggtgactttttgttatcttggaaaacatttttgaaagggctaaggtggtagaagtttcctcattttccattcatttggtgcgaatacggtattaaaattgggtacttttgaaaagtgccattgcttaaaaagcgagtgtctgagatatgtttaaatcatcagatttaatatcgaattggctgacagaaaaaggaaataaggttactaaattcctggcaaaaggaacagaat

SEQ ID NO: 22711 - DNA, 1465 bp, Heterodera glycines
  misc_feature (51)..(51): n is a, c, g, or t
  misc_feature (57)..(57): n is a, c, g, or t
  misc_feature (72)..(72): n is a, c, g, or t
  misc_feature (86)..(86): n is a, c, g, or t
  misc_feature (89)..(89): n is a, c, g, or t
  misc_feature (96)..(96): n is a, c, g, or t
  misc_feature (108)..(108): n is a, c, g, or t
  misc_feature (110)..(110): n is a, c, g, or t
  misc_feature (112)..(112): n is a, c, g, or t
  misc_feature (115)..(116): n is a, c, g, or t
  misc_feature (118)..(118): n is a, c, g, or t
  misc_feature (126)..(127): n is a, c, g, or t
  misc_feature (129)..(129): n is a, c, g, or t
  misc_feature (139)..(140): n is a, c, g, or t
  misc_feature (177)..(177): n is a, c, g, or t
  misc_feature (190)..(191): n is a, c, g, or t
  misc_feature (193)..(193): n is a, c, g, or t
  misc_feature (199)..(199): n is a, c, g, or t
  misc_feature (202)..(202): n is a, c, g, or t
  misc_feature (204)..(205): n is a, c, g, or t
  misc_feature (214)..(214): n is a, c, g, or t
  misc_feature (218)..(218): n is a, c, g, or t
  misc_feature (223)..(223): n is a, c, g, or t
  misc_feature (236)..(236): n is a, c, g, or t
  misc_feature (239)..(239): n is a, c, g, or t
  misc_feature (246)..(247): n is a, c, g, or t
  misc_feature (254)..(254): n is a, c, g, or t
  misc_feature (257)..(257): n is a, c, g, or t
  misc_feature (261)..(261): n is a, c, g, or t
  misc_feature (263)..(263): n is a, c, g, or t
  misc_feature (267)..(268): n is a, c, g, or t
  misc_feature (280)..(281): n is a, c, g, or t
  misc_feature (289)..(289): n is a, c, g, or t
  misc_feature (332)..(332): n is a, c, g, or t
  misc_feature (346)..(346): n is a, c, g, or t
  misc_feature (371)..(371): n is a, c, g, or t
tgcattaattttatttaccgaccgaattccttctcccttctagagtccgtncaattntgaggatattcgggnagactttaacaaanganaaattgnttttggaagggnangnagnngnaaatgtanngnataatgagtnngaaaggtaatttaaaaaaaaaattagtggatttaatnaaattttatggtnntngatagnagnannatttgtggnatgnagttnattagagaataanttnagggggnntttgttnttnaggnantggnnaaaagaagaatnnaaaaaagngtaaaataggggggggggaggagagaaaaaagaaaaaaaggangaattaaaagggangattggagagaggaagaataaaagntaatgaaattggaagaagcaaaatccttttttggacccaagaaaagtccctaattagttaaatgcaccaaaagtttattcaattatttattggaattttatgggaggcatttccatcgataaaatttgtttggccatacaaaaaaggaaaaatcagtgaatttgtgtgagcatttcaaattgtgtgtatgcgtaaggaaactgagagccgaaaagggaaattcagcagcaaaaaatgcaattcccatgccaaattgaattttcaattgtaaaaatgcgctatttgtactgcccaatttgtacccatttctttgtttgtttttgtggtgcgaaagaaagaaaatgttcacgcaaatttaacaacaacaaaaaatgaaagggaaatgaaagattggcacaaaagaatcaaataattaacagcgcaaatggccataccaacgagggaatgcgattgtgtcacggatgttcgtaatgccaaacagtgcctgcatcagccggtcaatgccaagtccgaaaccggcacttcgcgggtggccccggcgccgcagttccacgtaccaatccaaatttgagttgggcggaaggcgctccgaaagtttgtccgcttcccactcgcgcacaccaccgccagccaattcaccgacttgggggacgagcaaatcgaacgactcggtggccttagaaaaatgaatttttgtttttggttaaaggggcaattcttaaccaaaaacatcaaaaagaaaaagggatatgtgaaaatgttttcccaaatcatttcccccatttacatcaaagttttgccctctcgaatcgcaccggcgcatataaaagggcttttccgctgcggggaaatgcgtgacgaaaagcggccctttgaacgcatcgattaactgaaattcctcccgcctgctcaatgagttcgtccattcatgctcagaacgaccaacaattttcacagcttcggagaaagaaacacggggaaagggacgtcgaaagccggtcaaataatcgaaagcattgttcggtttggtcacgttgctcattccggcttccttcggttgatcattttcttcattcgaatttatcgctttgcaa

SEQ ID NO: 22712 - DNA, 1010 bp, Heterodera glycines
gagctgcgatcagccgcaaaaagaggtcactaaatttgtcttccaaatataattatcaccctctctcatagccaccgcggctcatcgttaaactttagcgtgcttcttaaattctctggagctgcgatcagcccacaaaagaggtcactaaatttgtattccaaatataattatcaccctctctcatagccaccgcggcacatcgttaagctttagcgtgcttcttaaattctctggagctgcgatcagcccacaaaagaggtcactaaatttgtcttccaaatataattatcaccctctctcatagccaccgcggctcatcgttaaactttagcgtgcttcttaaattctctggagctgcgatcagcccacaaaagaggtcactaaatttgtattccaaatatcattatcaccctctctcatagccaccgcggcacatcgttaagctttagcgtgcttcttaaattctctggagctgcgatcagcccacaaaagaggtcactaaatttgtattccaaatatcattatcaccctctctcatagccaccacggcacatcgttaagctttagcgttcttcttaaattctctggagctgcgatcagcccgcaaaagaggtcactaaatttgtcttccaaatataattatcaccctctctcatagccaccgcggctcatcgttaaactttagcgtgcttcttaaattctctggagctgcgatcagcccacaaaagaggtcactaaatttgtattccaaatataattatcaccctctctcatagccaccgcggcacatcgttaagctttagcgtgcttcttaaattctctggagctgcgatcagcccacaaaagaggtcactaaatttgtcttccaaatataattatcaccctctctcatagccaccgcggctcatcgttaaactttagcgtgcttcttaaattctctggagctgcgatcagcccacaaaagaggtcactaaatttgtattccaaaaatcattatcaccctctct

SEQ ID NO: 22713 - DNA, 1555 bp, Heterodera glycines
  misc_feature (11)..(11): n is a, c, g, or t
aggcaattttnttgctaaaaccgacccctgcttcttaggggcccgggactcaaatgtcccgcttaggcccctaaattttctatttccggaaaaaaaccgaaatttttccaaaaatcccaccaatcgatagagctcgaaaaacggctgcttgaaagtggtctccgttttccccggaaaaatcggcaaaaaatcataaaattcaaaaaccccaaaacctcttagggggcctagctcgagaaattttgaaaattttcgaattttttaaatttgaaaaaatcgggcttacaaaactctacaataagtccgctggccaccccccgctcagttcaaacgctaatgagttattcgcccggtactgaagtggacaaagttggtactgaatttctagccaagtctacaggctttcctattataggtagaggcctggaattttttttgttttttagaaaacacttcaacttaggttcctaccagcagacattttttggttcaggttttagaaaaaaagttatgggcgttcaaacgcacgcaaaaatgggaaatgggtccctgggactcagttgtccctcggattaaaaaacctatagttttcccagatgcgccgtctcgagctacccctcggtgcaaaatttcagccctgtacgcttagccgttcccgagattttgtttttgcaaacgaaacccctaaccattctaacatatatataaaaagtttcatttccgattatttttattttaatggtaaatgctaaaaatttgtccccattttttaacagggagaagcttaggtcttcattgttcattgtttttgcgattgagactttgaatctagcagtgttatgggttaacaaaaacagaaaatttggcctcaattttgatcaaaatgtttttaaaaatattcggccattttacatataattggtccaaaagccaaatattcaacttttttcgactttaggagggcatttttctaatagaatagaaaaaatttcctatagaaattgtaaaaatgcttcaataagcctttaaaagtgccggcatggtttcagtggcatctaccccaattggtccttacagaatgtggccaatggctttttcatataaataaagaaaaaagtttcatttccgattatttttattttaatggtaaatgctaaaaatttgtccccattttttaacagggagaagcttaggtcttcattgttcattgtttttgcgattgagactttgaatctagcagtgttatgggttaacaaaaacagaaaatttggcctcaattttgatcaaaatgtttttctcaatattcgtccattttacatataaacggtacagatcgtcagataatacggtatggtatccggtatattaaggttgtctactttagtaaaagttacagttaatagagaacatttatttgttagtgcaattgaatgatttcaaaaattaaaaatttagttactcttctctttagcaaaataatgtttggcaaatatggtatttgatggttttgagaaacgtccgtcccatcctacatgggaaacggtgcgtatcaggg

SEQ ID NO: 22714 - DNA, 1511 bp, Heterodera glycines
cctgggcattaatataatacacttagtctatgaaataactttatcgcatactcgttttgggtcgttttgtggacaacaattctgaacaaataacgaatcgacaaatgaaatttccatatgaagcttatagggaacaaacaaacttacatgcttttgaaaatatggatttgtctcgagaatttttgccggacagcactaaaatataatatattaagcaaataaactacaaaattgcataaaattaggtaagtttcaaataagcaataatgttcgtaaaccaagttttttgagtttgtcagagcataactttttttaaacttaactaattttttcaaaattttacagactatagaggacccttagggctatcgaatgataccaagattgttaggtttggctgccaatgaaaaaacttatagttcaaaaactcaggccacgcgaaaacggcatggttcgcccagggttgccgcccgagtctcccgaaccctgaattttctagctcccgaaccctgaattttctagtcctgaatattatggatcaggaagtctgttatcatatcagtttaatatttacgcaaaaatcagcaaaattagtttcaatttttctaataatttttattgtcccaaatccaggcagttttcataattatatttataaacacatacatacctcaagtttgtgtggtggtacacagcacttctaaatataaatatatatatatatttgtccctttactatctcataaaaaccactgagccacacatacttttaagtgttcatctcgaagtgggtcccagaatttcacctgttgacgacagcagcgctgaaaaaggtctccacattcatttaatgcataacacaacaaatattttgttataatttatcattagggctcccaattattatgcacatgcatattttttcctggactgaatagaaggcctgaaacgtatgcaacacatatgtttagcatgttttgaagcttctagaatgtacataacatgtttccatatgcatattttgcgattttatatgcatatttttgggagccctacttatcactcactcacttacccttaggtcggagcagcaagcctaaaaggtgtctcataaatatataaaattgtaattctaaattattttattgaaaacatacgtaaactttacagcaatcctaaaattgacaatttctttaaaatttaaattaaaaagataataacatattgtttctttgagatttaagaaactccgtttccgatcaaagcattttagccattgaaattttttcacctcattccccagtttaagaaaccccgtttgccgaaatttcatccccgctttctccgctgcccggtttccaaattttagactgacccgacggtgggggtcgactgggcgcccagtcgtcccggtccgtgacccgatacccccccccccccaaaaaaaaccctaccgccgctgacgatttggcggggtttatatcaagcgtacaatcagcgatgattttttt

SEQ ID NO: 22715 - DNA, 1217 bp, Heterodera glycines
aaaaatggtagcagcgacgagtcagagaagagaaaatagtaaggaaatgaagagaaaattttatttttttattcaaaacaatttagtgattaaaaaaagattcggacttatttaaaaataaatttgtaacatttttaaattaaaaaaaatttactgcattccacattgaaatttcttcacggatttgcaattcgtcgcgttccaaaatttcgcacaacattttttggtcaatttgcaaaaatccatccgatttgatcaaagtgtcggcattttcgtcaatgtaaaataaacaatggcaggcaaaattctaaatttgaatgaaaataaagtattaaaaaaaattggctcttgattgagaataaaaataagtgaaaaaaggaacattatggaaaaaatcgatgcgataatttccgcttttaaacacaatttagaaatatcaagttaaattgagagaagtttttctctcaaatttccttactatttttctcttctctgcccgccgctaaaaatggtagcagcgacgagtcagagaagagaaaatagtaaggaaattgaagagaaaattttatttttttattcaaaacaatttagtgattaaaaaaagattcggacttatttaaaaataaatttgtaacatttttaaattaaaaaaaatttactgcattccacattgaaatttcttcacggatttgcaattcgtcgcgttccaaaatttcgcacaacattttttggtcaatttgcaaaaatccatccgatttgatcaaagtgtcggcattttcgtcaatgtaaaataaacaatggcaggcaaaattctaaatttgaatgaaaataaagtattaaaaaaaattggctcttcattgagaataaaaataagtgaaaaaaggaacattatggaaaaaatcgatgcgataatttccgcttttaaacacaatttagaaatatcaagttaaattgagagaagtttttctctcaaatttccttactatttttctcttctctgcccgccgctaaaaatggtagcagcgacgagtcagagaagagaaaatagtaaggaaattgaagagaaaattttatttttttattcaaaacaatttagtgattaaaaaaagattcaacaatgatttaaaaataagtacaaaagtgattaaaagaggtacaaaagtgaaaagaggtataaaagtaagtaaaagaggtacaacagtgattaggagaggtac

SEQ ID NO: 22716 - DNA, 1680 bp, Heterodera glycines
atttttaacccccgcggcacgcacaattcagtcgaatttttgttgaaataaatcataaatttatgtgtcattttccaattatgttttatttgccattccgtcaataaaacagtttcttctctgctcgaggcaatgacttgtcaaatgacttgcccctctccgttcccctttcaattttctctcaattaaatgcgttcccacgccccccgggggagtgtcttttcttagtctttcctttccttttcccttcgtccgtccgcccctctttttttgctcattcatttattagccccgtttctccctccgttcctcatttggcagtccgcccccttttttccaaattgaatttgtctctcctttcattccattcatttcctcctcctcctttcccttccttcactcattctttctcccccttttttcttttcttttttcagtcccttaaaatgttccgatcgcccgcacttttcgcgatgtttcttctgatgctgattgtttttcagctgtttggggttggaattgtgcaggggtcgaagcgaagcaaaggccgcgcacggacaaaagaaagcgaaggcatttcgaatcgggggaaagaatcggcaaaagaaagtgagagaatttggaaaaaggaagggaaaggaagggagaaagaaaagaagaagcaatttagaagtggacgaattggagggcaaaaaaacgcagaaaaaggaagaggaggagcaaaaggaggagaaggaaaaggcaaaaaaggaccaattgacgggagagggaattggaatggcaccgacggggggacgaagagcacgtcgagaaggaggagaagtgagaaaagggtcggaggagggagtgggaagggggggggagggacaaatgagcaatgggagagggacatatgagcaatgggagagggacagacgagcaatgggagagggacatatgagcaatgggagagggacagacgagcaatgggagagggacatatgagcaatgggagagggacagacgagcaatgggagagggacatatgagcaatgggagagggacagacgagcaatgggagagggacaaatgagcaattagggagggacaaatgagcaactagggagggacaaatgaacaacgggaaggatggaatgggtggccggccaatggggaaataagaaatggggggatggacaagcaaacccaaaaattaattggaaggtgaatgaacaccgcgaggatggccaagggactgtcactttgagaagggcacccggcgaattgggggaaatgggcacgaagaaaaagcaccgcgaagaaaagaaacgacggatcagacgacgccaccacagcgaaaaatgaagaggaaaaggaaaaagaaggaaattaaaacaaaaatggaaaatttatttaaataaaataaaattaaattaaaaagaataaacatattaatgaaggaattttgaagagaagagattcattcacttaagaatagcggttttattatgtgaatgtcaaatttaaaaatgtacaaaaacaatcggaaaaaacgaagaaaaagtgccgtcggattaacggattataaagcgaaagtgaaacaaaacaaaattatgaagaaaaggacgcacaacggcacaaaatgccaatgcctttggccctattttctctttttttcgtctgtccgtcgcttcgcttccc

SEQ ID NO: 22717 - DNA, 1987 bp, Heterodera glycines
  misc_feature (3)..(3): n is a, c, g, or t
  misc_feature (67)..(67): n is a, c, g, or t
gtntggagacacgtacaattcaatgggaaaaatatcgcggtggtgaccaccaccaaaattgaacacnacatggaagggttgggtactttaacatgacacgatgacgagtgtaaaggtgttgctgaaccgtgattcctaggaatccccggtatgcaaacacctgatttgcaccgatggggcacaaagcatcgggaataatcttaatattttttctaagatggacagtctcaatgtccaattggctcagataggcaaggttctcagtccgtcgtttctgtagttgcttcgtcagtcggtatgggccacagttgttgaatcggcacagcactctcaccaggttgtagtctcgttttcgcgttcgccgtcgctccaatagttgatcagatccagctcgtccactatcaggttgttgctgctgctgttcgatagttcgcaatggcgtgacagacacagcggcgagtctcccgggcaaatcttcaagtccttcagctccacatacagaggttcgctccttaaaaaatgcaaatgaaaatattaatatttagaaaacttaccacactatcccctcgaacttcttcttcggatagcatgttgagtacagttcaacgtcagcgatcagctcaagagaaccttcaatatgcacaggttggttcggatggtcagcgtttgcgatgtgtacacagtcgacagcacaaagtgggttgggatagagacaattcccaccttcaggcccacttttaatttcgtctttcaaacaggtgtacagatcgtctacactgcttagcccgtaactgtcgatcaaataacggattgccctttgcatgcaataagtaggtaaatatggtgtgtcagttttggcaaatgaaaatagcctttattaaaatttaggaaaaaagcggaccaactgaatgcaaacaacaaaaaagcattctttaaatactccggctactggctccacccctttgatcactcgctgtcgcagtttcatactgtatattcagcaattgttgatgttgggacgaataggcgtcgtcaatgaacgggttgctgtaataaccggtgctaccagacccattaagtggattctttcggttcactcgccgtagctgtttaagtatgtatgtgcacagtactattagaaacaaattgaacagatacgagatcggtatccaagcgtccgacatgcgtaaatgactaaaaacaccaccgataatgttttggtcgttgggtttataaattagataattaaagcggacgtcacttgaattggttacaaaagttagcgcacgattcccttttgcatagtcgccaatgtgaaatttatagatgcgctggtctctgatcacaaacacatggttgtccaccaaagtaaagtcgcttttatctggtggaagaaaggcgacaaagttgctcttcaaaatcgtatgtgcggaagattggttttttcgaagccacaaatgctccaggtattcaagctctatttcgctgatccgcctctgatgcttatcgatcagaaacaagcgacccgagaggggatcaaacacaacccgtccatgtttggacagtcgttgcacaatcttctgctggtgaccacggaagatagccgtctcaccagattctctgtcttcaaaaaggttaaaactatacccattgtattcaaaacaggccaatggtgacattttcaccagtgatttcattttgaaaaacacactctgatagctgtgcaaagtgtacacaatttgaagtgaaacggcccattcgctgtcacgctcacacttcgctattcggcatgctgtattccaactataaccaaagtgtagtgctgtcgcatcctttgaaaaggtacgatattttccgctgtcgaaatagttttgattgtcaaccgtcaaatccacatttatcagctccgagtgcaacattaacggcacacagctgaggaggaccagatcggcgtaaaaagcattcatgaaatgaaacatcatttttc

SEQ ID NO: 22718 - DNA, 1719 bp, Heterodera glycines
tctgaattcaagattttttgattacactcctgatgcctcccatctttttacccagtttaaatcaagttaaatatattttaaaaatgttatttttattttatggcatctattttttacttttttaggtgaacaaattggggttaaaatctatactgcaaaatttttccattaaccgaaataatcaagaccgaaaaccggttttagaaaccggtataacagaaaacctggggtaccggttaataaggttatgacgagctattataagttaaaaaatatttttcgcttaaattcaacacaaattcattaattttttcgttaaaataagcattttatcgaagcccaaaattcccggtcccgctcaactctagtatttacgcaaaattttttgccatataaatttgataatttaattatacaaaaagaaaagtgattcgctttgttatattaactaatagcattaccaatgaataaattaattttgaagaaaatcaaagtttgcctatttattttattttaaatatattgtggcaagcttcttcttcgtcggcgcctttcctcgttttttattgtgggcgggcccggaaaggggaccttcgatcggacgagcagttctttaaacagacggtccgccttaatcttaaatggttttttaatgcaatattttgcatatcctcattaatttacgccgtttatgaaccaaacgtgctaaattggaaaatatgaacttttgacttttttgttcgagttcgcgtcttgggtttgaaattagcaatccaaaaatatgctggggcccaaacgtgagggcccaactgaataagggtcgattttttggcgaaatccaaaaaatacacctttaaaccgaaaaattttgaattgttgaaaaaaggctccttagccattgtttgttgtttttaaagtcaattctgaattttacacattttttgtgcattttttgagggttaaaagtcatttttggcagttttaaatgcatattttagtgcatatttggtttatttttagggtttttacggcatatttagccattttaaataatcattttcctaaagttactatcagcagacggtaggtactatgtcgttatctaaagaaccatcacaagtgatattatttaaaaaaatcaccaaataaacaatttttcttatattcttcactggattggaattcagccaatttttttgtcaaaacccttgactttcgtccttttcgaacaaattttttgatattttcaataagatccttcaatctttcttcttcatcaatttgttagttatttttaaattaccctttattggttttgaactaagaacataaaattttggtcgaaattttttgtccaaacaaatgtccggtaaagagattaaagatgttgagactcctacgcaaaatttctggttgacctactccctttttaatgggtttttgattaaaaaaatacagctgaatcaatttcatttaaatttctcgattcccgagtcgagaaatttctcggggtttttgggtctcggctctcttatcgtttcccggggtcatttctcggttctcgtatcctttctcggggtcatttctcggttctcgtatcctttctcggggtcatttctcggttctcatatcctttctcggggttgtttctcggttctcatatcctttctcggggtcgtttctcggttctcatatcctttctcggggtcatttctcggt

SEQ ID NO: 22719 - DNA, 1597 bp, Heterodera glycines
acatcaacttttcaatgtttattcatttttaattatgaaaaaaaaggataaaatttagttcgtagtttggtgttttctgaaatgaaaggcacgcaaaatgctcaaaaatgcacactttttatatattaatttatttattcgtaaaattcaacaaaaaatgcttgcttgaatttttcctatgtttttgctgtttttacgctctttctgatcactgatcactctgtccgatgaccgaagctgttacaacctccctatggtcaaaatggcttggcttttgtggcaaaatcaatacaaaaaattacagataaacccgttgcattgcatggcctgtcaatgtactgtagccaatggataccgttcgccacataacaagtgaaccacgcgaattgttatcaaaaagtgggtataaatttggtatcattggatagagcagcgtcgagcttttttcactttctattaatttccatcctttacatttttttattcttttgcttattttctctaaagaaaaactattatacattttcttagtctaaaaaatgctttttaaaattatttatttatattaaaattaatttatttttgtgtggatttgaacccgagctccaaaaatgcgaatttaaccaactgagccaccaatttttagtgaaaacacagtcaaaatttcgatttttgaggccataactttatattttcctatataccactattactaaaaaaatcacaatagaagtcgaacatgctctctatccaatgataccaaatttatacccattttttgactaacagttcgcgaggttcccttgtaagaacaatttttttttgatttggctattattaaatattaaaatggaacccaattttcaaaccgaaaaaagagagcctgtgccacctgtctctgctttccttgaatccaaaaaggcttgcaaaattattagccgtttgctttagctgtcctgcgtcgattcggagggccgtgcccgtggcatgggactgatctccgcgcccggcctcgtcctgtcggtgtcgcttggctacgcgcgccgtctgctctcggcggactgcaaaattttggccgagctaagcaagcagctcaagttcgagacaaccattggcatgaacggcacaatttggtgcgagagggatgggattttatactcaactttaagagcaaaattctcatttttaatggggaccgccagagatttataatgggtgcgacccaaccctgggaacgggacaaaatttcggccgccataacttggccggcctaaatttcagcaacacagaatttcgccggccgaaatttaaaaaagttaaaacttggaaagtctccaagaaaaaaccttaaatgattttttaaataaagtttcaagaaaaaaacagagtttttagaatttttcaacaaaaaaccttcaaattttttcaaaaaagaatttttagcgattttgtgcaagaatttttgaaaaaattaataattcatcataaaacttgaaaaactcttgaatttttcaattttttgaaaaactcttgaatttttcaatttttcccttggttttcttttaaacaaataagacttctatttttttttattttg

SEQ ID NO: 22720 - DNA, 1108 bp, Heterodera glycines
attaaaaatagtttttattatgctaacagtaactaacgcaaaatagttgcttttttttaactttttgagtatatggcatatatgcaatagaattaattgtttcttaggctccaataatttcagccggaaattggaaagcatttggtgagaattaagttttcgtaatagtaaaataaaattgaaaggattttgttaagccttacatccattaagaaaaatatttatatctaattttataagaaaaggcgacaaaaacaacagtcttgtgtacttaaaattacggggctaaagcgaaattttaatcactaatagcaattttttatttataatatttttattgttgagcaaaatatttttcatttaaaagatttatcgtcttatataatgtgtgtttataggcatgaaattatcgaatattgctaaatatttttactcttatgacgaaatactataatccaatttcgtttcgataattatcgtgtgtctatcggaggcaactaccattataaaaatctttgcatttaaaagcatggaatataaatttttaaatgggaacaagcggatgcgtgcagcaattggttctggcgataagatattgaagctacttatgatttttctaaaatcttttttggggttctttcgactgtcctttagcttcctgcgggcgtttgcacctgactctaaattttttttgaaaatcacaaatagctccagtatctcagccaggaatccactgttgtatgcagccgcttgttgccatttgaaaatttatattccatgcttttaaaaataaaaatatttataatgttaaatgcctgcaatagagacacgataattcccgaaacgaaattggatatataatattttcttatatgaataaaaagattaagcaatattcgataatttcatgcctataaacacacagtatgtaagacaataaattttttaaatattaaatattttgctcaaacaaggaaaaaaatattacaaataagaaattgctactagtgattaaaatttcgctttagccctaattaattttaagttcacaagactgttgttttggtctccttttcttataaaatcaaatataaatatattttcttaa

SEQ ID NO: 22721 - DNA, 2114 bp, Heterodera glycines
ttcataaacagggcttcggtttagaattttcaaaggctcggttttgaaaagtttagataaatttgaaaattttgtgttttctaagccaaagaatttaattgtgataaattttctgacaaatgaaaactttttacatttttgtacaattccagaaaatttattttgttgaagcatttgatcatgcagcagcacacgtacacggaacagcctcaacgccaggcaattaattaatcgaaacttttcgcaatggcataaaccaattggattttgtttagaattaccaatactacccaaatccgcctcccccggtggtgtaagtgccaattgttaaacaatttgaaattaaattaatcagtagggataggaaggaatttgaggcaaattgttttttttaaacaaaaatcgtctatttttaaaaccaattaagcgcactcattagctgcctaattaggcactgccaaattgcttaaggtacgaacgtcgttacgtggagagggacagcggcccgcgctgtgtgccgtgctgctgctgcattccgtgcattccgatccctttgtgcttcgactgcggctgctgaacaccggcggagaagcaaaacgaatgttttgggaaatgcgcgaaaatggaaacgcttttattacaactcatcactcaattaattacataattaattgtcattaatacaaatttacatttgtgaataaattttttcagatctttatggacgtaattttaataaataaattaattgtggtcattcgaaaattcaaaatttatcttatgaggtaggcattttattttccgcaagatttatgcttttttaattttaataatttacaaaatgataaataaatttttttgcaaaatgatgagttgggttttcattggcggatgtgctgactgacgaacatcgatttacgaaggaatttgttggaaaaaagaattaataaaaatattttttcattattaataattttctttcttaattttatatttttcttatccacttattaatgtatataatatatatatatttttttttattatgtgtaatttagcaagtgaacgaaaatttaaagtcactgaaaagctaaaattaattttattattccgtcaattttaatgtttcgcaaaaaactgatcaaaattttattgtttaattttcttttattgccaatattatgcaaaaaaccacaacttcacttcggtactcaaattttaatataaatgattttatgtaaaatgttaaattcttgatacttttgagaaagaaagtctcccgagacttgagccttatttccaaatgttaaatttattaaatttaaatcttttgtatttgtcagtggatttctttttaaaattaccacccttttttcatgtcattagcacttaaaaattctcgccctaattgccaaatttaatttttggtcataatttggcgccacgtccttctgttttaggcatcgatccgctgcatttggacttggaatattgccgtttgtttttcgacccgactttggaccattgcgcccgaagcgaactgagcgcgaaactcagtgccgtgtccatttgcgcaaccatcgagacggatttgaagtacatcgaattgaaaatggaaattttgcagaagtcacgaagtgacagcttcggtttgaacataattcgcggggcatggaaaaattacgaggaaattatggcaaaaattgaggagaaaagtgggggcgaaaggatgggaatggtcgtagtgtgccaattgtggaatttcatggacggcttaaagaaattggtcgaatttatgagcagagacgcggaaaccacgaagaaagagatggacagaacgatggaacagctgagaaagatgaccaataacagaaggtgccgtttaaaacaaatgcaaaattaaaataataataacctattaattaacagttcgcaatgcaatgaattggccaccgtcgaaagtgttttcgaggcgaccaatggccaagtgccgccttgggtgttcgcattccgcgacttcgtctccgaaatgcacttttcatgcctaaacgaactgctggccgtagcggaagaagcgcaacaaaaggatttctccgtttgggccaatttttcag

SEQ ID NO: 22722 - DNA, 1213 bp, Heterodera glycines
caaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagataaccattttttggtcaagaattttttttgtttgcgtttcaaatatcgtaagattgtttgatagggccagacaagagaaggcaactgttggtaccaagtttgcggtaaaaaaatgagaaaaaagagataaccattttttggtcaagaattttttttgtttgcgtttcaaatatcgtaagattgtttgatagggccagacaagagaaggcaactgttggtaccaattttgcggtaaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagccattttttggtcaagaattttttttgtttgcgtttcaaatatcgtaagattgtttgatagggccagacaaaagaaggcaactgttggtaccaagtttgcggtaaaaaaatgagaaaaaagttgtttgatagggccagacaagagaaggcaactgtttgtaccaagtttgcggtaaaaaaatgagaaaaaagagataaccatttttggtcaaaaaattttttttgtttgcgtttcaaatatcgtaagattgtttgatagggcaagaaaaaaaaaggcaactgttggtaccaattttggggaaaaaaaaggaaaaaaaaaaaataaccatttttggtcaagaattttttttgtttgtgttt

SEQ ID NO: 22723 - DNA, 1926 bp, Heterodera glycines
aaaattagttaatattcactatttcaccaactgcacctatcaaaaagatcaaaaaatccctttatttatataattttacaaaaagaaaaagaaataattttttggcgaaaaattcaaaaatttcattattgtccaatacaattggaaaaattttaggcaccgaagaacaaaaaagtttaatggtacttgaaaatttgactgataaatggcatttcattgtcaatagcattatcgggttggaaattttgcatatttttcttctttttgtattgttagttattgaaaaatatcaagagaattatcacctcgaattatgtcatgaatttttcagaaattttcattattcgataagggggggggggagaggcgtagtgcgctctgttcgacgcgtttttgatgttagtgtgcccagagtgagcgcaggcgtcgttcaatatggtcgccagaggcgaaggagtcgccggaagtgtcagcggcggggggagataagacggcggagggggcggaaagggcggcaaaaagggggccaccgggacggagatcacttggggccgtcggaagtcgtctcttccgttgcaatttttgatggttattttcagctgaacacaattttcatcgttgtcctcgtcacaaccaattctgaacaagaaaatgaaacagaaatctaaaagtaattaattaattaattgagctacgtttgagggcatcgccacggcaagtaaaattttggtgccgacgccataaaaggagaaaagggcagcgaaagcacggggaaagggccgccgccgcccccgcagctgtcgcacggggaaagtgcccccggcggaacacaacacggggaagggccggcagacattccgtcacgcttgtcgggttgagactcattctcatcatgtccttcctctttgctttctggacacgaaaaagaagggaagcacgggggcatcacaagcgaaggctgacgccgaaaacgaaagccgcccttaggacaaaaagaaaagtaatgccgaaaatgaaaatgaaaagccgaaattggcaatttatcagtgaataatggtggcttattgttgatcagttcactcacattcttcggctcactaagcccagctgaataacagcaaaaggcgaccattaggaaaagcattcgtcgcccaatcagtgccatttgtctgtcgttgcgccaatttgtgcattcactcaaccgagacggtgttggcttttagctatggctggttgatttgtcgactgagtggtgtgagttagtggtggtctgtcgcttgatcagttcagcagagtgtacctctgccctccgtcggattctgctgatctttcggcttggccttccgtgcccctccctccgtctcttcccttttctctgacctccccgccgtcttcagactgaagaagcggaataaaagtgaccagcagaaattgggggcgtaatttgaggaagaagacggaagaagcaatgaaagagaaaggaaattggacaaaagcggaaggaaaacaaaaagggggaaggaagaggagaaaaaggtgcgaaagagtgaaaagcgcaaggaaaggggggagggggaagaggcggaagagaaagaaagaattgggacgaaaagcgaaagcggaaaaggggggattgtgcaagagatcagatgcagtcaggcggccaattcttttgtcccttttcttgaccacagcttagtttctgtcggtccgatcattgagactctccgccttttacataactctgtctgatcaccacttatttcttatttctttcccattcatttggccatttctctccgattgatcactttcccttcccttttgctctgatcgcatttatacgttgaccatttcatctttcatttctctactgatcactgttcctccacttctgttcatgtccctcttttgcctcgccttttt

SEQ ID NO: 22724 - DNA, 2529 bp, Heterodera glycines
  misc_feature (24)..(24): n is a, c, g, or t
ctgcaggtcgctaccaatttaaanttcgaaaataattcaagaaattatttatttacaataaaagataatgaaagaatcaaaacaaatcaaagaattaattcacagattgtgccgcctggaaagtacaggttgattctgtgggacaaactttctgcggatggccaatcccttcaaaacaatcgttggccaaatgttggcgaccgatcgctgtgccatcgcgacgaaattttctgttattattgtgcagagccggataatttgttgttctacactgacgtcattaagtttcgtctgaatgaattggaaaaatgttttgtgaatttttacacggtcgaaacggacgaaagaggccattttttggtgtacaaaaggaacaaaaaagcatttgatcaattcaatttttacattttgccattgaaaaattcggtaaaaattttttttaagtatttaaaaaagtgcaggaaatgagaaaaagaaaaacatttttttatgattatgaaaaaatctaaacagaatttttgttttacaatttttacgtatttttaaaaaaatgttttcgattattcgtctgcgttagtataacataatatgacttatattgtaatttaataataatgatatatttatatttggctgatatgttttccaatatatttaaattatttgcttatttctattaattttttgaggttccaatcagtggagatgattttgttccatacgctgaacataaaataattgtaaaagaaaatctaagaaaaaattttttcgaccctctcaatttggttgactattttgaatcgtcaaatgattggaaaatgaatgtgctcgatttgctgaaccattggttaagtgacgaaggattttcctatgaattatcggaaaaggcaaactcaaataactaattaattaaaatgttttttgaaatttttaaaattaattttatcttttttaatttttaaataaaaattattcagcaaaatttctttctgattgccaatttcaaatatttggtcgattttgccgagcagcaaaagattttccggcagaaaatggagacgacaaaagcgcaattgctcggcattttctgggactttttctccgaggcagcaaaagcgaatttattatggaagagattgcgatttgcggaccagcgaattgtcgagttggtagaccaattttgcagaattgacaagcaatatttgttgtcacattcccaaataacactggcattacgagtaagcggcgaattgaaatgataagaacaaaattttatccgaatttttgtaatgcctgagaaaagattcccgagaaataaggcggaaaataaattttctccagaaataccattttagaatcgcaaaaagcaggaaaagaaatttttagaaacttaaagaaaaacaaacccttcgctgcatttgttacacaaaattttaaaatttatttagttagtattgcggcgaatatgtgagggaaaacgacctaatttttcacaaaagttccgaaataaatttttatcataattaccacttttatgaccaattttaattaattggttcaatttgctcccaattttgcttatctcatagaatgtggataatgcaatggcattttgccaaaattggcttgttgcgtgtgctaaagcagcaaatgccatgcaaacgaccattgtgatggacgcattttcgcattggatttacagcggaagaccaccattaaatggggctattgaaattgttcatttttggattgaactgttcagcaaaagaacggcaacaaatgacatcagacgaatgtgccgatggcccgaaatcgataagaatcttttccggcgaatcggtgattttggcactttttgaaagtttttacaaaaatcgaaaaacttaggcattctctttgtcgaagccaatgaaaaatatgcactcaaattgaaaatattagaaaaaatcaaaggagtcagacaattgttggacgaaatttgtgccaatgtaaatcatttgtcattgacatgttgtgcacataattctttgcaaattgcgatggaccaatggaaaacgacggtttgcccaaatggccaatttcgagtgggttttctgctgatttgggtagaaaatctctttgttctttcttatgcatttaataattatttgtggaggggggggcacaggaaggggagggataggaactaaatctccaaaattatagtaaattaaattatttaaattattataaaaaattaaggcttttttgagctcattgttgctgattgtaacttattttctttcttttctctttttctggtgaaattggtagcaacaattgttttgcttcatgaacagctttcgaatgatagaatatttgtcaaattgtcaaatcaaatgaatgccctccctccgctacttctcgaacatcgagtcgaataaaggacgagaaagtgccgaccgattagagcttacatatttttttgcaaagctgaaaattaacatttatgcgtatggtttggtgaagtttttagtgtatattttaagc

SEQ ID NO: 22725 - DNA, 1198 bp, Heterodera glycines
aaacatatttcacatttcacttcataactttttgagttcgtcacggatcgagaccgggataagtccattggaaagagcagctcgagctctacaagaagctatggaaagaaaaaaatcgacatttcagggactttttcagaaatcatatttaattccccaatggggccccattttgggtcctcagccacagccccatgcttctcccaattttaagtcttggatttgtcaaataaattaacgatttcgaattaataataaaaaattctattataattttttttttgtagagggaaaaattctgaaccaaactactattttaaaacccaatcaaaactgggaaaaaatttgaagtcaaaaaattattcgaatttctccaattttgtttccataatttccgaatgttattcggtatcataatgccaaaccaaaacgaattcgttttaaaatattcttttctggacttgacttggtttctcaatatcgaagcttttttctccgcaatttctaaaacgcttataccaaaccctagatttttggttccgatgggtttcagaaaaaatcccgtgtggtgaaaacatatttcacatttcacttcataactttttgagttctgcacggatcgagaccgggataagaccattggaaagagcagctcgagctctacaagaagctatggaaagaaaaaatcgacatttcagggactttttcagaaatcatatttaattccccaatggggccccattttgggtccccagccacagccccatgcttctcccaattgtggcgaaaacaatatttcacatttcacttcataactttttgagttcggcagggatcgagaccgggataagaccattggaaagaacagctcgagctctacaagaagctatggaaagaaaaaaatcgacatttcagggactttttcagaaatcatatttaattccccaatggggccccattttgggtcctcagccacagccccatgcttctccccaattttaagtcttggatttgtcaaataaattaacgatttcgaattaataataaaaaattctattataattttttttttgtagagggaaaaattctgaaccaaactactattttaaaacccaatcaaaactgggaaaaaatttgaagtcaaaaaattattcaaggttctcccaattttgtttcccataatttcacgaatgattat

SEQ ID NO: 22726 - DNA, 1302 bp, Heterodera glycines
  misc_feature (28)..(28): n is a, c, g, or t
  misc_feature (67)..(67): n is a, c, g, or t
  misc_feature (91)..(91): n is a, c, g, or t
agtaagtatataataaaaataatacttnaatatttattaaatatataatatatttttgattattgtntggtctgagccatttactttctgnagattttttggtcattatacagaaaatatgtaagataatttctttattataagaaataaaataaacttataaaatttaaatgtatattttggaagatattttttgcagtaaaaatatttgtattttaattttatttttattcaattaattcttattgtataattttcacttcagatattgtgccttataacgtgcattcaaatccgctttgaattcctttaatccaatttttgcgaaatctttaatgaccaaatgtgaacagtttggttgttgttgaagaaaagaatttgcttcaaactaaacaaaaatgcttttgcatttttaaaattattatttattaaaaatacttttaaatttttttaattataattgctcaatgattaccattttgctgtgtgtgaagcatacaatttttaaacaaatcgccggttgaacaaagaatataagaataattggaattgcaatcattttgaatgattaagcacacaatttttctttgcaaataattaggcacattatcaattttatttaagagtataattagtatatgtgagaataaaggacaaaagtgacaaaagtagtgcttattattagggatgtcaattttatgtaaatatattttttcctggattctccatgctctaaataggaataagaacaacactttcttttttgtgtttgcgaacaaaagttgggacttttatttacatatgtttacatatttcggggttttatacatattttacatatttcgtgagtttatgcatatttagtacatattttggactttttcggactttttcatacatttttttttacatattttgaggattttttgcagaaattattggaaattctcaaaaaaatccaaaacttcggcaaatttttcttacatatttccatattttttttttacatttttgaaaatttataaaatttcttgtgaaaaaataaaaattaaccaaaaatcgatttttcaaataacttatctggttctacgcctatttaccttattttatgacattttgtgcctatttcaccctttctgaagaatttttttttccaaaaaaataaccatttaaaaaattttatttacatatttggtacatattttgggtttttcttacatatttcgggatttttttttacatatttatgtacatattttgaccaatttttgtacatatttttgacatcccatacttattata

SEQ ID NO: 22727 - DNA, 790 bp, Heterodera glycines
ttgattttttttctttttgattattttaattatattccatcctgaaattttttaataaacattttcaaactttcaccttattaatttaaggcgaattttgccttttttaataaattctcttgtgaaaaggcaaaaaaataggctcttttaaatatgcctatttaaattactttcattgctttcctttcgcttacgaccataccacgttgaaaccacgccatcccgtccgtctgtcaagttaagcaacgttgggccttcttagtacttggaacggagacgtcctgggaatcgaaggtgttgtaagcttttttccttttttcacttgtaaatttatttaaattttcaatttttttagcttttttcgaaaatttttttgtctttttttcggcaggcactgcctctgacaatgttttttatttatttagaaaaataaattgattttttttctttttgatttattttaattgtatttcatccttaaattttttaataaacattttcaaactttcaccttattaatttaaggcgaattttgccttttttaataaattctcttgtgaaaaggcaaaaaaataggctcttttaaatatgcctatttaaattactttcattgctttcctttcgcttacgaccataccacgttgaaagcacgccatcccgtccgtctggcaagttaagcaacgttgggccttcttagtacttggaacggagacgtcctgggaatcgaaggtgttgtaagcttttttccttttttcacttgtaaatttatttaaattttcaatttttttag

SEQ ID NO: 22728 - DNA, 1092 bp, Heterodera glycines
taaggggaaattttccttttttaataatttctcttgtgaaagggcaaaaaaaataggctcttttaaatatgcctatttaaattactttcattgcttccctttcgcttacgaccataccacgtggaaagcacgccatcccgtccgtctggcaagttaagcaacgttgggccttcttagtactgggaacggagacgtcctgggaatcgaaggtgttgtaagcttttttccttttttacttgtaaatttatttaaattttcaatttttttagctttttttcgaaaatttttttgtctttttttcggcaggcactgcctctgacaatgttttttatttatttagaaaaataaatttttttttcttgttgatttattttaattatatttcatccttaaattttttaataaacattttcaaactttcaccttattaatttaaggcaaatttgcttttttaataaattctcttgtgaaaaggcaaaaaaataggctcttttaaatatgcctatttaaattactttcattgctttcctttcgcttacgaccataccacgttgaaagcacgccatcccgtccgtctgtcaagttaagcaacgttgggccttcttagtacttggaacggagacgtcctgggaatcgaaggtgttgtaagcttttttcctttttttacttgtaaatttatttaaattttcaatttttttagctttttttcgaaaatttttttgtctttttttcggcaggcactgcctctgacaatgttttttatttatttagaaaaataaatttttttttcttgttgatttattttaattatatttcatccttaaattttttaataaacattttcaaactttcaccttattaatttaaggcaaatttgcttttttaataaattctcttgtgaaaaggcaaaaaaataggctcttttaaatatgcctatttaaattactttcattgctttcctttcgcttacgaccataccacgttgaaagcacgccatcccgtccgtctggcaagttaagcaacgttgggccttcttagtacttggaacggagacgtcctgggaatcgaaggtgtgtaagcttttttcctttt

SEQ ID NO: 22729 - DNA, 1460 bp, Heterodera glycines
tttctatttccgggaaaaaaccgaaatttttccacccttttacgagtcgatagaactcgaaaaatgatgttttggaagtggtctccgtttttcccagaaaaatcgttaaaaaatcataaaattcaaaaaccaaaaaaacgttttttaggcctaactcgaaaatttttgaaaattttcgaaattttaaaatttggaaaaatcaagctaattatgctctacaataagtccgctggagccccctcgctcagatcaaacgctgacgcggtattcacctgggactgaagtggacaaagttggtactgaatttctcctattttctgcagcccttcctactataggtagaggcctggaattttttttgacttttagacaacacttcaacttaggttcctaccagcggaaagtttttgattcgggatttagaaaaaaagttacgagccgtcaaacgcacgaaaaaatgagaaatcagtccctggtactcagttggcccttggaccggaaaacctatatttttcccggatgcgcctcaaaaagttgtaagacccttccactactttcagggcgctcccggtcttcggccgggagattttgtttttgcaaacgaaactccttgtcaatataacatatatagtaataactagcgggtgcgtgaaccgttggcattttcgctgggaaaaagcgcttcgcgctttgggagcttcgctacctagactgtgaagcgattcaaattgatcgatttggttggagagatttttttgaatttttaaaaaattattagaggcttttagtccacatcgaggctcaagacgggcgcttcgcgcccgttttttaaatctgctgaacttacacgggagattagcggacgtgctttttgtagtttttgaaaataaaaaattattttaccatttgtataattttaaatttatttaaaaactcaagtataaaatattaaatcattattgaggatatgcattattagagcccagacagggcatgatcttgtacaggattttcccagaccctagtctggctcctgtttttctttatttaaaaaaactgttaagcccttttaatctggaatcctgcccgggttcatcttgggtttccgggtcctgtttttttcaaaatttcgtgctctagtttttggccgctgaattcagttgaaaagcctgtgtggtttaccaagaagctttcaagaaattaaaacgccctcatttccgtaatccttaatctcagtgtccaaaaacgccatcatttccaaaatgcgtaattgcgccttgcgcccatccctgtgtaagtgggatctgaagaccggcgttgccggaatttaaattaatttcactggtaaatttaagcccagtttaaaaatgtaaaattaataaaaaattatcagtttttgtgatcagtaggactggaaattttaatcaatcggtgaaagtatttttatttacattaattta

SEQ ID NO: 22730 - DNA, 2231 bp, Heterodera glycines
agaaatgagctgctcacaaatttgcgttatttagagcatataaataacccattaaatcgccaattaatttaatcgtcgttaattgatttgcctttcaaatccaaggccaatcacacaaaaatctgtgtcggcctttgcaattcaaatccgcatttattttgtgttaaaatggcgccatttcgcctctccgcacttcgcggctttgtgctgtcccatttggcaatgtctcattgctttggaggaagtgttaagcagaaatgccatttaaggagtgtcgatggcatttgagtgcttttcctcttcccctttgaactttttccctcccttttctcttttcccttttcttttttgacctttcctttgctttacttattattattattattattaattttcccactttaaactcattttaatgctttgccaatgaattaataacgttcattcattccttccttcctttactttatgttttatgtgcacattcattcttttttgttcgttttcaattctttttgttctgtggcgcgttaaaagtaaaagataataatggaaaatttactcattttgaaatcgcattaattggttcaattaatgcattcttgttttattctttttattcccctcgcccttttaaggaatgtcactccaaaatggcggcggattttcaatattctcatcaaaagctcagcaactgaaaaagagggtccaaccaagaaaaagaagggacaacaacaaaaggggcaaaaggtgaagcatttaaggagagagagagagagagaaagaaagaaagaaagaaagaaagaaagaaagagtggagggagagagagagaaagaggggaaagagagagaatgagagaaagaaaggagggagaggtgagagagtgagagaaatagaaagaaagaaagtgggaggagggaggggggagagaaagaggggagagagaaaggagggagaggtgagagaggggccattcatcagcagaccgaaaattatatcacagtgattaattaattctttttgctaatggcgctttttcaaagctttgtccgccgttgtgccccctcgagcagatgaagcacaaattggtggtgatccgtgacgagcactccaaactgttgggccatcgttttctcaattcgcaattgtccctttatttgggctccgtccaattgttcttctgtctgtgggcactcactcaacacatttgggcaatggcatctctcaaaaaggcacaaaacattcttttctttttccttttttatttgcttttccatttaaatttttccatcgctcaattcacaaaatgccactaatatttccatttccatttgcatttaagtgctttttcccaaagagtttgcctttggttttgacgaaatttgactctcagagaaaagatttggccaaagacgctcatcagagagtggccatggcatccggttgggccattaagcgaatttggggggttttacgaaatggaaaaatgaaataaaatggggacaatcaataattgtggattgatgggttgattgattaaaattgatcagttggttcattgattgatcggttgttgctcttttgtcaggtgctccattgcgacttttcccccaattcgtcccttccgccgcttctcactctcgacaatgccgtaagtacaaaagaaacgttcgctcattcgtttgctcacttcgctccatccaaacagataatcttcgacattggcctcttccacaatctttggggcatttccggctgtgttgcacaacatttggacggcggatacggtaaaggaacggttacggtcattggtcacaattgagaaacctgcggagaattccttctgttgctgttttggcattttgtcccaattctcccccttcggtggcattttgtcccccctttcgatggcattttgtcccccctttcgatgacattttgtccccccccctttcgatggcattttgtccccccctttcgatggcattttgtctcccctttcgatggcattttgtcccccctttcgatgacattttgtccccccccctttcgatggcattttgtccccccctttcgatggcattttgtctcccctttcaatgacattttgtcccccttttcgatggcattttgttggcattttgtcccccccccctttcgatgacattttgtccccctttcgatgacattttgtcctccttttcgatggcattttgtccccctttcgatg

SEQ ID NO: 22731 - DNA, 2407 bp, Heterodera glycines
ctgccccgaaaacaaaaaaaatcgattttttcaagtgtccgtttaggggtactcaaacaattatcggggagcaaaaatccaacgcagaattaaagtacaggctatagggaagctattcccgaaggattcggtctccccataaatctgggcgcatcggttcggggggactgccccgaaaacaaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaaattttttggataaaaattatttaaatgaactgactagataatatttaaaataggttatttctcttcctttcagtattcctgcaaagtttggtgcgcttctgatcagtttctgaaaaaaaagttaagcctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctcgctcaattagcaaaaaatatgagtgatcgaattttcactaaaaaagttaagcctacattttttggcatatttaaaaagcaattaaaaaatttttaaaatttaataattttcctgcaccgaaggtactcactcggcctcttcgcggcctcgtggggggcgcttcggaccgcagacaaaaaaatttcaatttatatttatttatcaatatttgttcaaacggaatatattaaataaatgaagataaacgaacatgctcagaacggcaaataaaacagagatcatcagacgagaaaaaaataaatagatgaaaataaaaaatcaacttgttagcaggttagaacaaataattttaaataaaaattattacaaaatatataaacgtttttgtgaataataaaaataaataaatttgcattaaaagcatagatttaaaataacataataaatcaaagttattttacctaataaaatgaataaaataagtaataaatgaaaattaaacgattaaaataaattatttttaactgctcgttaaagatctatcaaaaatgttaactaaaggcataacaaaattctaattgatttccttcaaaaaagccaagcttacgagtttttagattagtttacaaattggctaaacattcttaccagtacaaagttttatcagttagtacagtactggagaaacctgaatctgtaattctttttgaaaaaccggtaccggtactggtaaggtgctaaaaataagaaaaataaccattaagaattcttttatcaatctcaatcatttaatattttaacttaatataataagaaatgggcaaaatgttaaaccttgggtgggaatcgaacccactcatgcaccctttccgtgggcagctctaccattaagctaccgaggcacatccgccctttctttttatggatcttatcaacccccgctttccgcgttttaaccgcccagccagcttcttccttacagctccatcctcatcgggaccggtccctcggtccattagttaattgctgctggcgcggtggggcaaccatccggtgctaccaataagaaatgggcaaaatgttaaacctcgggtgggaatcgaacccactcatgcaccctttccgtgggcagctctaccattaagctaccgaggcacatccgcccttaaattgacaaaagtatttagactaattaaacgtaattatttaaaaaaaaccattactaactaatcactagggcttccttttttaacaaatgcttacgcacttaacacgcaaagataagcacgaaaaacacattttccgccgcttggtttggggtgtctccgatgacttttataatgcctatttttacctatttcggggtttttgtgtttaaagtgcttatttaggattttcgaaaaattcctaaataaaaatgcaataaaaacaaaaaatacacccctaagaaatgacccaaaaaaatttcagaa

SEQ ID NO: 22732 - DNA, 754 bp, Heterodera glycines
ctttcaattgggcaccgtaggacagaaaaacattattcacacagagcttgtttggccacttaaaaaatatttccgtgaccatcacataaatccaaaatgactatggcaatttggagttgaattttctcgtgccgacatttcttaaaaaactgccaccatacgcatttcttaaaattgtttcgaaaaatttcaaataaataaacaaaacgcttcttgaaaaaacgcaaagaaaaattttcagagaaaattaatatttctaaagaaatatttttaaaataaaaaatgtaacacataaaaattcattactttgctcaaatacaaaaaattttattattagattttttggccataacctttttttaaaatattattgtttatagattctataaaggatttcaatttctaaatacaaaatttaattttgttgcatctaaaaaaggttaagcattaaacagctatgtttttgccacggtcatcatattatttataatcatttaaaaaatttttaaaatcatttaatatgcattttagtcaattatttttattattattcatacataatcataaatgaaaataaaaaattggtgtcaaatttttggaattgaattttgccgttctcttcaaattgattgtctcccgtcagcagacctttgttattttacaaatttttttgtttagcttcaggccaaaccttcttagacttgggttgctatgcgaaagacaaacattgcgacttttacaacaaagatgtgaa

SEQ ID NO: 22733 - DNA, 1603 bp, Heterodera glycines
ataacgcaattcaagcgctatcatatgataccaagattgtgcaatttggttgcatctgagcaaagttatgagttgatttagtcaaaaatttagcaaatttagcactttttgtccattggccaaccacgaattagtttaatgaactttttttcttcaagcataaattttgttgctttgtaacaaaatctgtcccaaaaaatggcatggttttcagttggcttttttaataaataataaataagaaaaggcttaatttatcaacagattttctccaatttctttatttcaatttgtaaatatttgaaaaatttccattttaattggaatcaaaaacaaaaaaagaaagaaagaaagggacgaagacagaagggcttagccactaagccacatatccaaagactgtatttgtctttaattttgaataattaattattttatttcccctcaaaaatttctcatccaatttacgacactaatttttcgctaacaaataaaacccttctttttatcagtgcatattttttcagttgccttacccgggacctggaaacataccaataaaaactgatttctttcataatttcccttaaattctgattcattttgagacttaattgcttaaaaatgaactgaactgttcgaagccactcatagtttgagctgaaaatgatttgttgttctgacaatgagctccaactgattgggaataacaaattgccaaacaaattgttaaacaaatttgagagaaattaagtaatttctttttaatcataattttttgaattaagatttttacaatattttgagtttattaataccaattagagatcggaattttgcgaaaatacggataagtatcagtattacgtacttgacaccgatacggattaagtacttacggactaaaaatacggaaaatccttagtacataaaaatacgtatcggccgaaaaaaaatacgtattacggactacggatccgtaaaagtacgtatacggatccggtccgtatccgatctctaataccgatggtacggagtcgttatttaaaaaatccatcaatatgatttgatattatataaaacttagttcaaaagcaatagcaataaaattcttaattcttgatattattcgatagcactaagtgttctctaccagtctacaaattttcaaaaaatttcattaagtttcaaaaaagctatggctagaggaactcaaaaaagcttgtttttcgagcatctttggccctaactttttttttttaatttcttgaaaatctttttcaaaaaagggtcttaccatcggtagtattaacataaaaattggagagactgtctatggattcaataaactaaaaatacattgactttgattaaaagtgcatgtaaataaatatgctttttaattttgcagtctgcacacattcattcactttcgacaacacgacttttcgaatgaaacgagaacttgcagatttgattataaaatggggaataacagcggagaagtcgaatcgtacgtgctacgatggcgcgaaggtcggctgtcagacataccagatgagtggatggtaaatgaacactgatcaatcaatagagaccggat

SEQ ID NO: 22734 - DNA, 2704 bp, Heterodera glycines
ttttccgtaaaattttatttttatcaaattgtttatgcaaagtttgcatttaaataaatagaggactatttaatttcgtgtgccgagaaaagtctgaaaaagacaatgaaaatgagtaataaaatagaacataaattgaaatttcagaaatttatttaccccgctataattttccctttaaagagcatatattcacattagactttgaattttatacttttttaaattgtggacctatatctctagaaaatggaatactagcaagttgaatactgcagaaatgttaggccctcgacgaaaaactatgaaaattatagccaagcattaaatatgtatttgactaaggctggaaaatttacattgccagaagctgatcgttgctgagattgatcagcagttagtaacgtggagtgaccagaatcagcatgtggcctagagaaaggcaaatcaacatttttctcttagcgaaaattgttttaataaatatcaacattgacgttgatatttatttaatatcaacataacattatgccatcaacgtaatatcaacgctatttttaaaattgggataattttttaaaatttaaagcaatttttcaaaaatgacttttggcggaaaataagatggggagagagataacgcaaaagtgagagggtgttatattcagccccagtcatacaaaagcatttttggtaaagaagaataaagaaaaatttattaaaaagagagtgttatgggaagagatttaagacagagagaagagaatagagaacatagcgaggaatctgcgtctcttaccaaaagaatcagcgaagaagagacatgactcccttcccattgcgctctctattgaaattgttttctctacctccttcatcaaaaatgttttgtatgactgggactgagatccagcactctctcatttttgcgttatctctcgcactaaaattataaaccgctcatataaattttaaaaaattttcgcaaattttaaaaattacgttgatatttgcgttgatggcataatgttagttgatttaattaaatatcaacatttaaattgataccccgcaaaaactaataaaaaggttgatttgccattctctaatgtggccagcatctctgcatgcattgtccgtaaagtttgaacaggtgttgggtatgaaagaataacacactcatttggaaagtttgctgattccaattggagttttttattttttgttgaaaggcaaataaagatatgcgaaaaatgattttattgattccaaaagcatttgcgagatttattgagtgttcggccacaaatgaatcttttcttgcagaaatgtttttatgtcttacaaaatcatttaatttaatctcaccaaaaatttatcaactattcattgacgaaagttttaaatagtaatttttgtaacaaattctctgtcccatcattcattctttcgtcactgaatttgctttcaaatgaatccgatcattttcctctgatcagatcagcatccgatcaaattccactggctcaatttgactgttcccattgcggtccatgtggccaaaccattcactgttctttgccaaatggtcagccgaagtgccattctttgtgtccaccaaatatgcaatggcttccttcatcgaaatggtgccgcttttgtccgcatcgatctaatttattaaataacaaaaaataaataggattacgaatggatgattcatttttcagctttaaatactagtaaaatttgaaatgacctttttctcactttaatccattcaaatcccaaaactttctatctcactatttttgatcatttttcattttcatttttgctttttaattcctataataatatgatttgcttatgaatggatgaaattaattcgtatataattaccgtatcaaatttttgtcgggattgtttcacctcctccaatggatgcacaaaagttgagttaccaccagccctacaaattatgtccatatttccatattgtgcatgttttggcattaaaatgtcaatcccaaatgtggagccctcatatctatggtcctcaactgttggaaaactcaaatttcaagcgctaggacctcaaaatgtcaaatcttcaaatgccgcaccacatctctctatccatactgtacctgctgcttgcgagacgggcatttggcttcttgttctccggacatccgccctcgccgtccttgcggcaattttggcacccttgcggacagtctttggcatattgtttctcgcaacagtagtaacagctgcacgacacatacaatgtacagtattccttggagcgatcttcgtgagtgagatcaaacgcgcagaccagacagttattgtggaaaatgttgcaccttgggtcaggcacaattggcttacaactaaaaaaattatcaaattacggccaaaactcctatatcaacaccctgcttcaaaaaatattttatttttgcatggaaatgcctgaaaaaaaggaaaaaatgaattaagcatcgttaagatttgagcattgttggcttactcggtggatgatatccgcaagaaaaatgaatacgacggacagcaaaggcaaagatgaggaaaatagcatcacgaaaattaatatttctaccttttgtcaggggtcgggttaggattagggaaaaggaaaaatgaatattttttatatatgacaaaaactttaatt

SEQ ID NO: 22735 - DNA, 2527 bp, Heterodera glycines
tttttttttgctcaaattgttttgaagaaaaggagctccaaaaacgccatttttggcgtaaaaaatttttcatttggacgtcacttttcgtcactagaaatcactattttggcggcttcgtcactaaaatagttaaaaatcactatttgggcgttttgtcactatttttcactatttcgacatttttggaaaattccttaacaaaaatgcaataaaaccaaaaaatacacccctaagaatcgacctaaaaattttttcaaaaaatacacccctaagaatcgacaaaaaaaaatttcaaaaagcactcctaagaaatgaaaaaaattttctcaaaaaggtattttcgtggcaagaattttaattttaaaaattatttttttatgtacctattttgtttttttgcccttaaaaatcccagccctactcatttgcaactgcaaatagtgaataaaaattatttttgctcaatttttggctgaaaattagtcactattcgtcactattttggacttttttcactattttgtcactattttggcactttttcgtcactattttagttaactatttcgggatttttcgtcactaaaagttgctaccctatttattagctttaacttttgggttttattaaataaaaaactaaataaaaatttaattatttaatattttcacttgaaataaattaaaatttgattttttttaattttttaaattttttgaatttttttgaatttttaaaaattcccggttggtcccggttcccggtcccggtcccgaagaaaaatcgaggtcccggtcccggcttctcaggtgccggcaagtcccggtcccggttttgcccaaaattcccggtcccgctctactctactatttttttaattgattgtttttaaggggaaaattattttgaaaaattaaattttcttaaattttttattttaaaacaaataattttacgaagtaattattttagaaaaattaatattttatttaaattaatagattttgatttccctcacttgctgggtcatagactcggcaaatgagtggcgactcgtccacttccgtgtcgttcagctgcaaccgaacttcatgatcacctgcaaatttaaatgcccaaataaaaaatcagattttttaaattgaaactaaatgatttattagtctcctttcaaatattaaacgcactgaccaactctgcgcggagtgaacacaatgcgtcgcgtggttggcccgtcctggtgaatttggaccggcactgtctctctgctgttcacttctatcaatgagaataaattggggcgcctcaagtttaaaaaaaaaacttaagcaaaaacaccaaggcctcaaatttctgaaagaatttttgcttttcaaagggtgcgattttattgggtttggtgcaacacgtcagaaacaatgggaaaacagcaaataaatgcgtgaaggtggtgcccaattggactgtgccatgatttagttttagcgtgaatgagggcatttcaattggaattttcgcttttttcaaatgcgtcctaccgtatgcctgggcctgcacaaccgcgtcagggttcgtcacggtaacgctcagttcaatggggcggtccacgcggctcagagagggcggttcgctgacctgaaaaacaattaatcagtgtttttaagtataataaagcaattagcttaattgtacgaattggattccattttcccacctccattttgcccggtgcatattctgtctctcgcgtgggcgactttggatgagcgccgttcatcacatttttgttggcttttttgtcctttttctttttgccagaacttgaaaaatggtaattaaattgcttgaatctttataaaaaattgaattttttaaaatttttgtcaaattaaaattcatttaattatttcccattttctgcttctcacatcatcgccgcctcgtccgtttggctcggctccaaaatgtgcacttcgaatgggctgcccctcaccacttctttgttgaacctggcaaagtgccaaactcaaaaattgaaatgcttaatcattaaaatttatattaaaaattaattagttattcaaattttacgttatgtgcacagtgtgtgttccggcagtggctgggttgaaagtgaccagaaatttggcggttccgctttcgatttggctgacatgtgatgggattataatgccgtcgtggtcctggcaaaaaaaaataaattaatattttagagttaaataaatagaaagtggtgtatttgttaattaataatttttattatcgttaagattggttgccacaaaaacatattatttttattttttaaagtttttacaacttcaaaataatttcattttttggtggtattgtaaaaatggtttatcaattacaataattaattatttttaataataaatgtgtaaagtctattcaaatttgtgttaaattatgaaatttctaattaatatattggaaataaaagattttttgtgcaaaatattgaaatatttctcaattcct

SEQ ID NO: 22736 - DNA, 1616 bp, Heterodera glycines
gattttctgtcaaattatttcaagagtgaaattctcgactcaattggataaatggcaccgatttggcaattctggtggtaatgccattgattgtgttgtatccgatgctgagattaatgcgcggtgccgagacggcgtgctgacgaagagcaaagtgagcggatgaaccaacacttggccacaaacaacccaaatgaggcgtaggttcgaaatgcgcaacagtccccggtccccgttgttgcccttcgtgtcctccacattgtcaattcgttccacctaagcaaaaccctacggccttgaactcgccagcccgacctttaacaccagcagataaaccaacttacgataaattcgccggcgattagtcgtaataatctgaaagggtcatcaattaatccgatgggcgagaggggggggggggtctttaatttggaagtctttgcccaaacacatggcaagccaaaagcgaacaccgcaacagtaccgggtgtccaagtcgaacaggacgtcccggtcgtgccaaattgagtccgaagcggcaacgtcctttttgcccatttcaacacacaaaattaggtaaaattgcgaatttattcgaaagtttgggaagggtttccatggaaacaatgttatgttatattatgttataaatggtcacatttcacttcaatttgcttccgttattaactcattcattctctggcgaaatcatcagaatttgtttgacgccacagcctaaaaacacaaaaattaaggcaaaggcattttttaatttaaaatggcaattttatttcatttttattgcccccccccctccgttcatttaccaatcgcatttttcatcgcttttccgtaattttccaaggaatttattttgtgcggctgtgctttaattcgtccactcaatgccaatttctgtagttctccaaacatttttcgcactttttctccgttcgccgaatttccgacccattttccaatggaaaagaaatgcgaattgataccctcagcaatttcggcacttttattcgacaattgtcctaaataagcttgttttaatcccccaattttgaagtgctcgtcgctttcccaccatatgaaataatcgtatcgcctttagacagagcggaggagaggagaagggcacttcgaccgccgacgcaatccaacgccaaccgcggcttagggaggcttttagcatctgccctaaacccttttttttggtctgaaaatctatgggatgcttcgctttaaatttcacttttcaaattcctcttcgctaaacacaaagtcggctcccaatgctttcaattcgtcctttagtgcgtcgatttcctttctgtttcgcaccaaattaatggtgtggtagccaaagtctgaatggtccgtccgtcgtttaagcaaatgaattggaaagcaaatcaaaacaattggccaattggatcactgctcggccgaccccgcaatttgacgcattttggaccaaaaagtcgcccttttcgagtgggacaatgtgacggagcatggcaaatgccggtgggaaattgatgcccaaagtagcgggcaaaacctggcaaaaagaaggtaaaagcgtcagaaaagctgcttaatcggtg

SEQ ID NO: 22737 - DNA, 1097 bp, Heterodera glycines
atgcttatgatattggatttgacgaatctcaaaaaatgaaaaatgaacgactgattgtgagtgattggcatttaacgaaccattttcagagagaggagaagagaaagggaaaattgtgaaaagggaaaacgaaggggaaaaaagtgacgagggagggacaattgtaaacaaaaacaacggaaaaggggggggggggggggttcacctttttgagtttgtgccgggggtggaatttaatatatttaatgctattgaaaaatctgtgattctttttacaattcaaaaaagttatttacaaatttcttttctacgtatagagttcttttttcataaaaaattctcatcatccatttaaattgctatttgccaaattacaaaataaattttttacaaatgatatttgtgacgttttattatagataattgatgtaacacaaaagaaaagaagcagggatttgtgccttacattttacaatacatttgattgtgcagttttatcggatggattgttttatttttctgaaatttcgcctaatttcattttgttgcgcgagccctaagcagcggaagtcggcaagaaaaggcgcggaataaaagcctgaagggatgtcaattaggcacgtaattggccaatccgaccgtcacttgcctccacgttgctcagtcggatgccctctttgtttatccgccgaatttgcgtttcgtttaaaagtcccaataacgaaatcgaggccaaatacttgagagagggcggttggagccacatttgctgcagggaattgcagcggcgttcggagagttcgtcggtgcaaccgccaaacacaaacaaacagtcgtcctaacaaatagcagcaaaattggccatttggaatttttaaataaaaatcacgacaatactgacggaggtaagggcagccgaatggaaaaacaccgccttcgccaagttgttgcgcattcggacccattgggcggtgttcatgtcgaacttccaaacgtcggctatcagctgatggcttcgattttgctgaatacccttctctttcgcctcgttcatcacaaaggcccctcacattttgttgtgtttctgcgtcgcgaca

SEQ ID NO: 22738 - DNA, 1254 bp, Heterodera glycines
tgactgattagcgactgatgccgggttggccaatgcacccgtttaaatagggtcgtcggccaagccaaacaaccaaaaaaaaggcacgggcccaacactttgatcacggccgctgatcagacggaattgtgctttgtcattctgatcactttttcgtatttcctgtacagagagagaaaacttcgtgaacataattatcctaatcatcagtcgggcgaaccaattagcagcttcagcagtcgcatttcgttgttcgtcctgctaatttgtgctgcttcgtttcgtcggatgcttttcattttgtaaaaaaatttcccgcgcacctctaaaaaaatgggggaaaggccttaaggcacccaaagaaatgaaagaatcggccgctaattaataagcaaaaaaggggggagaaattgttgtcatttatggagacaaatcaatgagcaaaaaaggcattgatcggacaaaaaagtgatcaattggtgcgaaaaaaacattatgatagggaggggggggagaagaagcagacggaagaaaggagagaacagagcccaaattgggctggaaccaatttatttttatgccactaaaaaactaaacggttccgggcattaaaagagtgaacatttgaaaattgaattttttgtctgtttttttttgttaaattttttatatttaatatttttatttctttttaaattttctcttccaatgctctcttcaaaatttgtgctcttttcaatgtttttctttctcgaattgtttcgtttattctcgtccttctgctgtttttgcgcttattgatcggacagcagcggaaacgataaataatttcagtgcaataatattttttattgaatgaattacccttttaaattgttattaaaataatcaacaaaattctttgttaaaaaattaattcatggaattttatcagacataattattcgcttttttgagtgatctatgaccgaccattgcttggtttcttgaacaaaaaaatcgaagaaaatttgggcatcaaacttctaggaattaatttattataataattttatacgcaaagcgtgacgccgccaaaataaaaacaacaataagataaagcaaaatggtcacatatgagagtggtgcataaatgtgtaaaacgatccaaatcaattgagtcaagaagtttagaaaaaacagttgaattttgtaagctaacttctttaggtaataacctatagaagcgagaagcacgaacaaaaaatgaatggt

SEQ ID NO: 22739 - DNA, 1751 bp, Heterodera glycines
  misc_feature (25)..(25): n is a, c, g, or t
  misc_feature (27)..(27): n is a, c, g, or t
  misc_feature (38)..(38): n is a, c, g, or t
  misc_feature (42)..(43): n is a, c, g, or t
tggcaaattaaaaatttttttttcntnattagcctcantaannttaagttcgataatctcttttcattttatgtcaccttcgttgcacaaagatttggtgcacacgcacagaatggaagacgacgactgaattatttaaaatttggcacaaaaaataatttaagttggcggaaaagcccacccctggcggattttaaaatgcttaaccttttggcaacatttatttaaaagatattaataattgcagaagatgccaaatgacagaatagttaagtcatttgtacctgtgtgttgtgcctgctaattagtggcattttgccattgttttggaaggtcttcttccactattttattattttatgtatttttttaaattttaacatttggaacgattcccaaatgtgcacttgacatatttaattaccccgcccatttaattactcccacccatggcttcctcccccgcgcttttcgctttgccctgcccattgctttccccctttttctcacgtgactcgtcggtgctgcgggtggtcctgccacggtttctgccctgctctgttcctctactgttggtgctgatacgcttctgccgcctcgtcttttgcctttgccaaacggtggcaaaaggcgcgccccggcggtcccttcgacaattaatggcaacaaagggtcggcggaaagacgcgcctaaacaaaaaaccgtaaattatgctaattaaagaatcattagccgcttgcccagctgtccaacggctggcaaatgccgccggcgcctccattttctgccagccgagtcagaaatggcgccagcatttccgcgcttccggcggtcgtgcagaatttgcgtacgcgtgccctcgcggcgccgtctcccgcggaatcggtcggctgctgcaattccgccacggatcggctgtcagcagcgatggtgaagtgcaacagagtggaacaactgttgaacggagcggaaggcataagtgcggatgccgcagggcattccacggcctaaaattgcgcgatgattaagggaaaaggaggggttgtttaaggaataaacccatttcccgcgacttccatttttggcactcatttcccctctatgggtttggcaccctctgttttcccctggcttttccacccaccctttgttggcatggccccgtttcgtcctgtccctcctgcactttgcacgtgtagcagctgaatgtgccgcctccgccgtcttctcccccaattccgttgccattctcatcgccctgttcttgctgctgctgctgcgctgtctcgtgaaaaagcattggcacaaacagaaaaagaacggcacaaattgatgaatttatcaaatggagggaagacatctcttctcactttctaaaaattgagtaaggagcaaaggcttctcagtttatccataatttgtgttaaatattaaaactgatccggaagaattagcgggggaagcgaaaatcaaacaaaaaaagcatttcaattcatttgagccgtcaaagcgccccggggggttgatcagtggcagaagcaaaagcagcagcagcagcagcagcagatccgattgggatggatttgggttgcgcggttctttttttcggcattgtattgccccccggggttgagggattaatcgaacgacgacggacgaacatgacgatgggaagggatgggaagaatgggaattgggggaattggagaggggcaaaagagggggggagggggaaggggaggggggggtt

SEQ ID NO: 22740 - DNA, 1096 bp, Heterodera glycines
tcgatttttttgttttcggggcagtccccccgagccttctcggccagatttatggggagaccgaatccttccggaatattttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaaattttatttacaacttaattttagcactctgatgctttagtatcaaaaaggaagatggagatttaaaaaatttttccttatattttggttatatcgttttgcttttggtggggtgcttggaacagtggaatcatgcgcacccgtccgatctggcaagttaagcaacgattgctgactagccaaaaggttcggtgccgtgatgaaacgaaccagcactgcttaccccgcggcactcggcacggtccccgaaggaatggatttaattaaattctctccttcggggatttttttcattaggtcgtccgttagcgttcaattgctctagtcatttttaaaaaattttttgtgaaatatttgtcgtgtctgaggggggggggggggggg

SEQ ID NO: 22741 - DNA, 1612 bp, Heterodera glycines
ctcagttcgctctcaaccacctctaacgaattgtagggtactggtcgggctttgcgatagactggccttgcgtcatcttttagggcaagatgagccttctcctttaggcaatggcccaattcctcactgaaaatttcgtgaaattctttttccagggcttgaatttcggttcctgtcccagcaatctgcgttgcttcattcgggataaaattctcagcctttttgccattcgcgtggcatgcatttactgcagggttgctgatcttcagctttaattcgtctaaaagcccaaataagtccatcattttgcagctcaacaaatttagtgagcctgctttggcaacaaaaaatgtttgctccacttcaattttaccaaatttgaatgtaccgaatccttttccaataaaggaaatttttgtgccgtcgaaagccttgccaatttcgttgcatttttcgatcggtggtcgtccaacatattggtgcgtcaattgatcaatgacgacaatgtccgaccccgtgtcgagatggaattcgactggcttcttgttgaacagaaccgctgtttttagcagcgaaatggaattgacggcatgcgtggtcattccaatacgaaggtggccaacgcggttgttgcctttctttttggcattttggcgtctgcgccactcttggacacgctcgcattgtttgtccaaatggccaacaaactcacacttgcggcatttgctcgttttgtaacggcattcgtcaggtcgatgcacgccaaagccacatcgccaacatattgtagttgcctcagtgttggtcctttctttgaatttgttcggcaaattatttggctttggactttccttgacgtatttgttcgttgaattgttcggctttgaattttgtcgaatcgaattcactggcctcgaagaacttgtcgcttcgattgcctttgcttctgaaattgtggattggaagctgattaagtcttccaccactccatcatagctgatgttggcgcaatctgctgacaattttgtcagaattcgctgtcgcaatgcagcttcgttgggcgctttgagtgccatcaataacatgaggcaattaaattgctcttttgtcagctcatcgaatttaaaatcggtcagcaattttttgtgccgatttatgaactgcctgaattgttcgccttctcctctcaccgcttttaaacactcgtagcggtcgatgaatatggactgagccttggcaaatagcttctcaagcttttcggtcgtcactttaaaacttaaatctgtgaccgacgatggcagaactgatctgctgtattcactgaatgccgattcgctcagcttattcatcaggcatttaaccttgacttcgtcgtccgccgttggtgctgtgcaatccaacgcgaatttgaatcgctcaatccattccgaaattcggctcttgtcgtccgttggctcgaatggtgaaatgtccggcaatattggcactgaatttgctccttgattgggctgtgccgccgcatttggtgcgttttgtccgatcgcaatcagttgagcaatttgctgtgattggtcctgcaccattttctgttgatccgccagcattttcacga

SEQ ID NO: 22742 - DNA, 885 bp, Heterodera glycines
aggcccaccatgagtccgcgaagcggccgagtgagtaccttcggtgcaggaaaattattaaggaagagagttcattatttatttgttttttgcataattaattcataaatatttttttcagaaactgctctgaaacgcaccaaattttatttgcaagttattttaggcactcagatgctttcactatcaaaaagggagatgaataaaaaatctaaaaatttttaattgctttttaaatatgcgaaaaattttaggcttaactttttttttataaactggtcagaagcgaaccagattttgtgagatcatcaaaaatacaaggaaaagccatgattatgaagctaactccagtaattctgaatttaaaattttttactaagttgagaggttcagtattttatttttttcgcaaaaccaattcttgagataagaagtagtaatctcagatctctaccgttcaactgccgataccagagttggtaggctgtctagcaactttcaatctctggtggggttttgacaacctcaatttttgaaaaaaaattactagattgaataaagttcatcgaaaattcaagaggaaaaacgattttcgataaattagcactattttggttggagtcgaaaaagttgagccgcaaatatcgtttttggaattaaaaaagtgataatttggcgttccgttggccgcaaatgtccgatttccagcaggccgcaaatgtcgggccgcaaatgtccgaaaatggcccttaagaaatgggccgcatatgtccgaggcgcaaatgtccgaccgcatttgtcgggccgctaatgtccgattttcagcaggccgcaaatgtctggaccgcaaatgtccgggccgcaaatgtccggaccgcaaatgtc

SEQ ID NO: 22743 - DNA, 1663 bp, Heterodera glycines
ttgccataatcagcatcagatcactctctctctaatcacctgtaatgcgtcttcaaatgtgtcatattgggcataaaaatgcatcgcgttgagcagcgtcgatttgccgttgcccgttttaccgagcagcaaaaggttcttcactatgttctttttgctctgacgctccaattctctgttcagcaaatcgagtgatgtaaacgcatggaattggtcgccatggtcagcaaaaaaggcacaacggaaagtcaagtgatcgacgcgagtgccaccgcagtcgcagaacaaatgactgatcggagcctgttggaggggggcaaatgatcaagtgaaagtgaatggcataaaagcgattcaaaaacgaaagaaacggccatttcaattggccattataaatttaaaacggccaaattttgtgataattttcggttcatttggcgcttatatgctgacggcactttctcactttctgttccatgtcgtcattcttctgtttcccgaattttaaagtctgtccgcattgttcacatccccaaaaatggtcgtcgtctcggcatttaccaccgaatttttcggcacaaggacacggcaaatgacagggccataaaagttggtcagcaggagaagggatcttttcagagtcagaggactgaaatggtaatatttaaaatcggaatttacaaaaatgcccaaatgttttttcacccacccgcgcagtgcacacgcccaacgtttgcgtctttttggcaacccaatcgtctgtcaccaattgatcaccgctcattttgatcagtcgggcgccgatcagtgggaaaatgtccaacgaattgctgatcactttcggcatttgcgtctttttgtgcccgtccgaaaacagctccaaatccacgaacagacaattcttgcccgcttcggccaatttgaacaaatagtgaagagccaactaaaagaaaaacaaacgaatttaaaaataattaggagcattttgaaatgtgattttacaaaaaactgcttcaaagtgtcgggcgaggaattcggtttgttgctgaaaaggacaaaattctccgtgggtccaattttgccactctttttttggccacacaaagcattcttcaattgttgatggtgacgaacgtacagtatccctggaaatttattagtttaattactgtgtgcttaatgcctaattagaggtaattaccctttgactccaatttcttggccaattccatacgtttgggagcagaagcgcgggatgggtccttttgctgcgcatttttctgatcatcggccacttcctgctcaagttcggccatttgctgttgcgcttcttccccattggcaactcgcagattttcgacactttggattctaagccaaaaatgaatggagataaaaaaggatatcccaagttttagggattatttcaacaatttcagacgacaaatgtaagattttttgttacttgccggttaatctggtgagcagattttcacaaatttttatgtttttcgctataacttttttctttggcatccaaatccaagattgttggtatcattcgaaagcttaacatgtttccgaatctaattctatgtatcacttcgcgattagacaattaccaaaaaagttatacatgaaaattgcgaaaagggcgaaatta

SEQ ID NO: 22744 - DNA, 1141 bp, Heterodera glycines
  misc_feature (1126)..(1126): n is a, c, g, or t
caatcctaatggatttttgaatcgctatttgtttagaaacattgccttggtctgttgggttgactccatcggatgtattaagaaaagtcggcatcattttttgtcaaatctattcaaacaaaataaaaggctttttacgtgaggattttcaacttttttttccaacaatgaatgtaatttggataaaaagatgtgattaaataagtaattgttgattattttaccaaaaacataggatttgttcgagcatgaacaaagttatttataaaaaccaggttatagttaattgattgcactcataaagtgcaataaattttcgacttcttgttcaatcgtccggttcgcggatttcctaatcaggttgaatgaaatagccgaatcgaattcccctatcatgaaaacctcgaaaaacctttgcttatttgaaaaagaaaaattattaaaacttttgtatgtatgcaaaatggacatggaaaaactcaaaaaataaatgtggaaaaatgtgaagaaatgaaaagacaaaaaatggagaaaaaaatccgaaaattaaaaggaggaaatcaatgggaagaagaagttccaccgattattattgctgctgttggtctgtttttgtttatgtaatgttcatttattttgaagtgaactttggaagggatgcggaattttttgataccaagatcgttaagattgaccgtcatttgacaaagttacggaaaaattggggtgtcgtaaacatatgacaatgcttatacattaaaatttatttacttattaacaaataacttcattaaaaataaatttctagattaaaaagcttaaaagtatccaaatgttttaaatgtaaaaatgaaaaattaacataaattaaatttaattacttgcccaattcggacttcgtcctagcaccttttggacatttcgtggcttggacactttgtggggccgccatttggtttgggtccacatttttggtcaaatttttcaaaagcgtaaccagacagtcagacagtggactataattccttaacaaaaatgcaataaaaccaaaaaatacacccctaagaatcgacaaaaaaaatttcaaaaagcactccgaaggaatgaaaaaaattttctcaaaaanggtattttcgtggca

SEQ ID NO: 22745 - DNA, 1822 bp, Heterodera glycines
ctcaagaccgagattcttgtccagcaccaagaatgaatatgaaacgaattaattactgctgcatttcgcatttgcctgaaccctctgtcccactttacgttaaagccgtaatattttttcaaaaattttcataaattttctttttaccaattccttcttttttcaagaaaaatgatgaatgattatttcgttgtcgcattaaatgttttttaatgcttctttaatcaaatgtaaaaactaaaatggcgaagaaaaagttttacgataaaaatgcttagtaatcattcaaatgtctgtctggttgaatttttctaattatttaattaaaaaggcattcttcgcaaaattgtttcacatcaattgcttctccattccttttgtcatacacaaaatgttaacaaccaaacattttttttagtataaattgagaaatttttgtaaacaaaaaatcaaaaataaattaaatccaaaaattcctccattattgaaaaatttaaattaaaaaatgaagaaattttccatcatcccaatgccgcttttgctggtggtggttgtcctgctaataatcccgtttgtcccttttacgctttcacaactgtgcttgtacgacagtgtgacggagagctgtctgaaagtcaattgtctaaatgaatgttatgttgatagtccgggcacgtgcggatgcaatgcgagagtaagcaaaccaaaggcgcctaattaggcacagaaagtttaggtcattatcgacttgagtgtcgagaaatttttcgagtttttttgtctttgttttcttgaaattcagtccaatgatgccaaaattcggtccgaaaaaatgctggatagcgggattctggtagccatggaacatacatgattcagtcccgtaacccgaaggcttctagattgttataaattttgtagagatatatcgaatgatactaaaagattgttcaatttgatagattttttgaaatttttatttttcattttattattatgagccacccttactggaattaattaatatcaattcttctaaagttcaaataaatctaattcttcctgtcatttttccaaatattaagatgaaatttggcagcaattgaagcgcttggtgtagtcgtggcacaaaatgaaaaggaattcaaatcgacggcatcagagttcggcacacattgaatgattttccgaaaaatttgatttgttatttctaattaaaagatgacaaagaataaaaaattaacagattcaatcatcataaattgtcaaaattttaaataaattatctggctaatgattttatttaatttaagtaaattttaattattcttttattcgaaatctaacagaacttttagaagaatatgtacatatttatgcatcaatttaattaaattttaacatatttataattaaaaaattgataaaatcaatcatagtaagcaagacagatttttgatttttacactttttgtccatcgtcactatttgcacttttttgtccatcggccaaccactatctcatcatctcataatcatcgactttctcctacagtacgaacattgaaattctgtattcggttactgtaattcgttgagttgggcatcagttgtgttgttcttattgttgttgttgctgttggagcatttcccttcaaaaagggcacaattttgtaaatcattcgcacaaattcaactcgcatatctttacaaagcgccataaaaagaaccttcaaaagccagacttccggttaatgaattggcttaatgaatggtcagcagaggatcaattagcttaattagtcgacaatttaaattgggg

SEQ ID NO: 22746 - DNA, 1650 bp, Heterodera glycines
atttcatgaattttccccactatgtccttgcaaatcggcatacccgtccttggaagccgactttggacgataccaaccctggtgtaatcagtggctactttgtccaacctctaacacagttctattaaaacaaattaaaaaagattaaattagtaaaaaatgtataaaaaaatccttttttataataagctatatttattcaagtgaaataaaattacaaccatcatgaggtttagcttttctaagtattctcttcttatgaaaaccatattaaaaacgcaaaggacctaaataagaaacaaatagaaaaatcgtgaccggaaaatcggtcagtggaaaatgtttcagtagaaaatgcgtcagttatacaacaaagattttaaaacaaagttctatggcattagtattgtaatatagtagtaaacttcgataagaacatcgttataaattcgaacccggacccgaactataaatacagaacaagatcgcacaaatatcacatgaaaattgataagcaacgataaatttcataacggaattacatattatatagaaatatattattaaaaaggtgatataatttaatacattaatagtttaattaaaaattaatattcaaaaaacttaattccatcaaatttttaataaattgactaatatttaatatcttagaagattaatgctgttcaaaaatctctgtatcgataatcgacttgaaaaagagtaaagtctcggttttttaatttattagaaaattagggcacgtgttgaagtaaaagtaaaaaatcgaaaaggatagaaatattcaaaaaaataataattctaacctaataatactctaaaaaatagaacaaaaaaaaattcttaataggcataaataatatgttatttatataatatttcaaataaaagaaaaattatattattctaacaaaaaaaaacaaaaaaaaaattataatttatgaatataaattttatttaaaaaccgataaataaaactgaaatgagaaaagtttttttttagaattttcaaattttattttaataataattttaattttttttttaattaaagccgcgattttgggcatgaaaatcgctaaattggcacctaaataacttagcaaaatcaagcaagtgattgtgatgcgacatttgcagtgcggaataaaaatgatcccaaaaagatgagattttttgtttatgttacaaggatttcaggataatattaaaataaatataaattaaaaatttttaagaaaattttgaaaatctggaaataattcactcccgacttctgcattctgacatttttcttcggttatttttaaattaaagacaaatgtaaattttattttttagggcttgaagaaatattaaggaatatatattaatgaattaaaataaaatttggaaacaaattaaaattataaacctaaatgctcaaaaatccaataaaaaatttttacacaaaatattaaatcatgttttcataatatttattattgctaaaaatatttttaaaaaaatatttttcataaaatttagaagaaatgtaccaaataaaaaaaaattcaaattattcaaaacatttatataaaaaaatggtgtttaatattcacatttaaaaacccagtcaaaatttaataa

SEQ ID NO: 22747 - DNA, 2164 bp, Heterodera glycines
aatttttcaggaaatatcaaaatattgcatcctttttcagctccgttagctttctctgccgcggccgccggcgcttttgcaaccgccgcggcgatgaccgccgccgccaatggctttgctttttccacggattggtcaaacggcggggcgccgccgcgatttgggtgcgaatttttgcgggggttcgaaatttaattaaaaattgtaatttatttggaacgatttgattatttaccataaatttgcaggaaacaacgccgggagcggaccaccttctcacgcgcccaattggacgtgttggagggcgttttcaagaacacgcgctacccggacattttcgtgcgcgaagaaatggcaacgaagatcaatctgcccgagtcgcgagttcaggtgggaggacacgggcgagcagggcaatgatcggcggataaaaccccgggggggggactgatgagtaattacctaattaaggggaggaaaatcccacaccccccccccctctaatttggcaatggacaatgattgacaataattgttaaggtttggttcaaaaaccgaagggcaaaggcgcgcagccaaaagaaagcccagcagatcaccccccccccaccaggtacagttggggtgttcacacttcccattcgtcctgtttttcttagtccgcttcttcctcctccggttcctctgtcgccggctccaatccgtcctcagccgtcgaccaccacggcaacggctcctccaccgcctcgtccggctccaactcgtcgctggagagcaatggacactctgacgacacacacttggtaattaggacaaaattcgcttttaatttcttaattttgctcattttagcttcaaatcaaattggagaagatcgaagacggcactttgaactcatcggcacaaaacggcggcatcggctcgggtggtatttcgcccggctctcaactcgaagtgggcggaccaccacagagcggtgggctgtcgtcatcgtcggcggatcatttgtcgaaaatgggtggttgttatttacccggcacggctggcatttcgccaagtaattttgaaagcgcgtcaatccgagactccctcgactgatcaatgaatttttcagtgatcggacaatacacctcatattacagtccgttccgcaacggtgccgcccatccgtacatggcggcgtacgccccgtccgcctgctccatggacatgtacacagctgcagtgagttttgctcttcccatttcgtacaattccattttatgagtttaatgaacaattaattcccaattaaggcgtaccccgcggtgacaatagcggcggcggccaacatgaacattaattattcggcagcatcgaacatgaacggattcatgaatggttgacaatgggaaggacagaatgtgaagggacgacgcagtgaaatgatcaaaattttacaattttttcaccgatcaaacgaaaattcttacaattagcagcacaaagaacacttttgatcggagaaacattgcaaatcggaaaaatctatcttttcttttcttttcccactacattttccacccgtcgattgatgcaatattccggaaagtccaaatgttctttaaaaaataattatcgagatttatcccttcatttgaaaggctgagattttaaacgagagaaagagagagagaaaaaacagtttaatggcaattcaaataaattttatggcatttcagactttggcataaaatctcagaccgtcaaaaatatatcagaaaatgtataaaaatgtagaagacacataattaatttaaaaccatatcattgtcattcgtccatttcgtcgtcacatttgcacttctcagcccatcccaatcattcactcgtcaaaatcgaagaaaataacaatgaaaaagggcaaaacgaaatgggagacggaaaaaggggaagaaagtgaaaaggggcgcattttgttaatttttaaaactgcaacttatgtaattaagaagcatttgtttaaattaaattggcgagaaatggacaacatacgaatgaatgaacgattcgttgttcttcgcttttctttcagttcgtttgtccatggtttttgacctttctcctccgtccgtcggtgtgcaaattaaaatttgctctccccaaaggaaattaatggtaatgg

SEQ ID NO: 22748 - DNA, 1621 bp, Heterodera glycines
cggtcgttggccgaccattcaaccaaagcggtgccgctttgttcgatggcatgccgaaaacgcacccattttcggattaattttaaattttccatttttggcatttgcccacttgaaaaggccattggcgtgcggtgacgcggccaaaaggccgacactcgcggcgccggcactgaacccccacagagtgagcagcgacgggtcgcccccaaaacggcgcaaattgtcgtgcaaaaattgcagtgccatcgcctggtcccaaaggccgtaattcccggcaaaggaagcgtcgcccgtcgtggcaaagcccaaaaagtaacaaaaattaaaatagctaattacaataatattattttgtttttattaaatttatttcactaaaaatgagatttaacaaaaatgacagttttttcaattaaattaattatcgtattatttaaatatttttattattttacccaacattgcgagtcggtattgtatggtgacaaacagaaggccacggcgtacaaatttggcaatcgcttcgggtttgaattggcgacttgtgccggcctggaaaccgcccccgtggatatagacgagaacgggggccaaattggcatcatcggacggcaaatggaaaagaaacattcattattattaattaatttaatttaaaatttgtactttttccggtccaaaaatgttcatatagagacaatcctcactgagctgatcaggcttcaacataagatgagattagcattaaattaattaattatttcattcgaaaaatttaataaataaaataaaataaaatattttttattttttaaatttaaatttaataattatattcaacattcattgtgaacctctgcataaatttcggcacgcgcaatgggccaacacgcgggtgccatttcagaagcattgaaaactccgctccatttttccggtttcaaaggcttctgtaaaatttcagctatttgattaattgccacaatttcaattgcctcaaatcgcaatttgcccagcggcggtcgcgcgaagggcacacccaaaaaggcggtgagtgccacgggttggccatcgacggggtcgacgacgtgcaaaagttggccacggattttgccaaatttggtgctgacaattggcgaatcgtcaggaggagacgaggaaaagcatggggacggagagaggaggaggaggaaaagcagggccaagcaaaacggaagagaaagcggaagagcggacggcatcggcaccggaggaagcctaaatgaagaataaaccacaaaggaatactgtagaaaatggtagaaattattgcgtcttttttaatttaacattaaaccgtgttgaatttagaacattctgtcgggtttacggtatggtctgtacaacagaaaataaaacggttggaatggccaaatacacttggttggtcccactaattatccgaggggctagcagcgattaaattaaattgggtcccgggattcgtccgagaatctcgagcaccccgaacaatggaaaacaaaaatatgaacggacaaatgaggaaaatatgcaaatcgatttgcacaaaaatgggacggacaatcggcggacggaccgaaagaattggggggggggg

SEQ ID NO: 22749 - DNA, 2059 bp, Heterodera glycines
tttggttataactctttgtaaatttttttctagattttaaaaaattaaataagataggatttgataggatatgtaatgcatcgcgtaataccaatttttattaatttaactaaatttaagctaagttatggtttcttattagcaataaaattaaaactaataataaatttaaatgtttctatttatattacataattgatttaaaattaaagttataatcggaaacattgctgattttcatgttaaaaaaaattaattacaatatttgtcaaatttttgtatctcaaaataaatcactaaaaattaaggaattgttggatccgggcaaaggattttacgacaaagacgagaacaaagtaaaattggccattgatgtcattgtggatgagccaaaaactgagaaaattatttccgatccaaacaaatccaacggcacactttcgatggaaattgaaaaactatcggaatttgagcgagaaatcgaaggaagtcatcgtaaaagtgaaactgctgtgtacataaagggaatgccatggaaaatatttgcatatatcaaaatgaaaaatgaaagcactgagaaatggttgggctttgcacttttgtgcgacgcttctgaaaaaggtttgcttatcaaattatataatagaaataataattattttttctataaaattggtgtaattaattattgaaaagacttatgtaaacagtaattttttaacataaaattagaagtgattttttaaaggaaatgcgttaaaatataaatttgattattatttaatttgctttaagatggaaattggagccgcaaatgttcgggaacacttcgaattgtctcgcaaaagaacggtgtggaggattttaagaaagaactcgatgaaacagtttttaacaatgaatcgaagtcttgggggaacaatttcatttcatttgtggtgagtggaaattaattagttaatttacattttaataatgtaatggcaaattaaggaattaatggacccaagcaaagggttgtacaacaaagacgaggacaacgtcaccttggcaattgattttacatgtgaatagcgtaaacatttcgagatggattgaaaagtgaaaagaaggaaatcagcaggatgagaagagagtcttggagggcacaaaattttcttggtgcttaaattttatattttttttatgttttgtaaagtattttggtttcataaagcaacatattccaatgatagggatggatttttatgtgctaaaatcgagaaatatatatacctaaagagttgataaaaaggcagaaaaatttgctaaaatgcagaaaaatgccaaaatagttgccaaaaaattggaaaaaatgtcaataaatgtgtgagttttccagaattgcccggattcatgatcagcattcgaaatacgctttcatgattttggtaagaataatttttttgaaaatatgttcggatgcggggttcggaattggcagaaaaagaaagcctaattcttattcagcactccaaaacgcgctttgaaacgttttaaaaatttcgggaccagtaaaacacattactatcgtttaattttagctgcaaaagaaaaagtcaaaaataaaattaaaattaaaaatctgagaaagaacgaattctcgtcaaaaaccaatttacaaagcaagcgcccggagggccaataggcgctccgggaaaactgaaaatttatgttcatttgctaaataaatttatgaagaatataaaaagatgtaacttattgctgatttaaggcttgattcaaaaaacactaattgagaagagaaatattttttgtttttatgagatttggtagaagattttgtgcaaaatgccaattttgaaaatgtgctccgtcagggtccgattatggccttttgccaacaataaaaaaagttttatcacaacaagccaaaataggcatcaacaactttgtatgatatgtatcaccacatgccatgaaactacaataggcacctatctttttttttttttggtagcctacagtacccttatggggggcgtgcgcccgcggggga

SEQ ID NO: 22750 - DNA, 673 bp, Heterodera glycines
caactcatccataaccaactcatccatatacccaactcatccatacccaactcatccatacccaactcatccatatacccaactcatccatgcccaactcatccatacccaactcatccatacccaactcatccatatacccaactcatccatgcccaactcatccatatacccaactcatccatgcccaactcatccatacccaactcatccatacccaactcatccatacccaactcatccatatacccaactcatccatgcccaactcatccatatacccaactcatccatgcccaactcatccatacccaactcatccatacccaactcatccatatacccaactcatccatgcccaactcatccatatacccaactcatccatacccaactcatccatacccaactcatccatacacaactcatccatatacccaactcatccatacacaactcatacatatacacaactcatccatatacacaactcatacatatacccaactcatccatacacaactcatacatatacccaactcatacatgcccaactcatacatacccaactcatacatacacaactcatccatacccaactcatacatatacccaactcatccatacccatctcatatatatacccaacacatacatacccaactcatacata

SEQ ID NO: 22751 - DNA, 959 bp, Heterodera glycines
ctagtcagcaatcgttgcttaacttgccagatcggacgggtgcgcatgattccactgttccaagcaccccaccaaaagcaaaacgatataaccaaaatataaggaaaaattttttaaaacattttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcagggggactgccccgaaaacccaaaaaaaattttttggataaaaattatttaaatgaactgactagataatatttaaaataggttatttctc

SEQ ID NO: 22752 - DNA, 1514 bp, Heterodera glycines
cgcctcgcgcatcactttcccaagacggaaaatcaccccacctttcttaaaattaataatttttagagagccaaataatgtatcagacagcgcgctcatactgctgaatgacctgtaaattagggagaattagaaattggaaatgtgtgaaatttgaaaaaattgcccggatggaaagacaaatggcgcaagggaaacatatgattgaagaacaataggaaaagcagatcaaaagtgacgaacagcttctgcaaaataaaaggaaagaaattttttgtttttccgttgagttttttgccttacccccgcgaatccgtgtcatcagagggcctaaaagagcgcgaagacgattggcgttcaagagaagacattattggtttctgtatgattaagagaggatcgctttgtttgttaaaattacaaaaaaaaaaacaaagcataattgagagggtaaggaaattttacaaattatgaagtaacaaaaagcggaaagtgacagaaaatgtggaaaagggccaacttaaataggcaacgaaatgactgacaattaacatttctcattatgtttttctcccaaattttgccaaattcgtttatttaaaagagaccgactcataaaacttcttaatccacggcttcgaccttttgtcccaatcaacaaatttaatacgcttattgtgttatgtaatgcataaaacaattaaatgcaattaattgtcattaaacaaattggcaattccgaaatccgtctcattgttttcttcgcataagtccaattgttcagattgttcttcaccaattttaagccaaagcaatgcgctgactttcctcctaacggttccgacttttctgacgaggcttttcgttgttggacatatttttttgcacgcgggctttttatatttggccaaacattccacgagggctctgccaaaacaaaaaatgtacaaatagcaaaataaattaatttaacaatttaattaaattaatagtcacattttgacataaaaaggcaattttttttccgtaattgacaaaatttaataaatggagcatcatttcgtcgggggcggaaatgaaaatattggtaaaaaaacgaattttaggtgttgtagctttaggaccatcgatcgcgcaatggccagtcacgaaccaaagatatttttaaatattatttatttttgaaaaattagccaattttttaaaagatccgcgactggccatttatcatttattggcccgtgatcggcaacagatgaatgtccttttccgcagttttttgttcaatgtcagtgacttacaattagcacaatttggttaattcagggttcgcagatgaaaattttcaaaagcctcatttggcaagcaaaaaagcctcattttgggtcaaaacgcctcatttttagaaaatttattcaaaacacgtataaaatgttcaaatgttatatttttgattgtccatgatctatttgaataatttttttgttcgaaataagcattttgtgagattctga

SEQ ID NO: 22753 - DNA, 1083 bp, Heterodera glycines
  misc_feature (1065)..(1065): n is a, c, g, or t
gaaattgtgaataattctcagaaaaatggctatctctttttaggacaattttctatctcgtacccccgatgctaatccgttccgcagagcctcttcaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccgcagagcctcttcaaaattttttccattaccgcaagagttgcggaaattgtgaattaattctcagaaaaatggctatctctttttaggacaattttctatctcgtaaccccgatgctaatccgttccacagagactcttccaaatttttccattacccgcagagttgcggaaattgtgaattaattctcagaaaaatggctatctctttttaggacaattntctatctcgtaagcccga

SEQ ID NO: 22754 - DNA, 1318 bp, Heterodera glycines
tttttttcgtatatttctttcatattaccttttcataacagtgatttaattattttcagaaaaacgaagtttccaaaatttattatcagctaacttcttcattttaagctataaaatcctaaaaaaaagtataaattctccagatttttctctatttttagtgcttttttgcactttaattgatccttttcgaagtgaattatgaattttcaagcattcgcctaaatttccaaggttccaaaaaatgaaaaatctttttaatttaaaaatttcaggttaagatttaaattgtagcaataattttgacctatttcaaaaactaataaaaattgctattggaaaaatttgcataaaaacattgaaattttgtaaaaaagggttgaacattaaagccccaccctcgagtataaccccattttgaagggggttttattcgaggaaatacggtataattatgaaaagcccttaatccagacttggaaccattacaggtccaggtccaacaaggaatccaagccaggttcaagcattttcaagatagcaaactctctaatcatcaaaatattatttattaccaacgctttttgtaaaatcctcttttggtatgagtggaaaacgaatgttggacaaaactgggtcaagcatttttcgtcgattttcagcggaacattcgatgcctttttgacggcactgttcgtcggaccaacggagtgccttaattttagaaaataaataattgtaatttataatatttaatttaccgcattccaaatttcgatttcactgcttctcagctcatctctttcgagaatttcacacaacaaattttgatcaatttgcaaaaaggattctgatttgatcaaagcactgatatttcgatcaatgtagtgcaaacaacggagagaaaaagcccaaaataaaaataaaatatataatataaaaaattatataattattactttaactcgtcggggaccgtaccatagaattttaccgatgttttcggttgagaatttatccttagattatttatagggcccggatttatattgacaaaaaaacaccaaaatatgcattatattataaacgaaaaatatagacaaaaagctaaaatatggacaacaaattacagttgtacgggtccgggaattttaagaaaaaccgggaccagtacttttcggggtgaaaaaccgggaatttttggctggcaaaatagggaaaaacccgagacttttcccggtcccggtcaaaaccgggacgtaggtactcagttgtacgttctttcagtatcaggtcccggtcacgtacaaccctataa

SEQ ID NO: 22755 - DNA, 2503 bp, Heterodera glycines
  misc_feature (179)..(179): n is a, c, g, or t
  misc_feature (1746)..(1746): n is a, c, g, or t
aaaaaaaaaattaaaaaaatttaggccaaaaaagacattttcaaaggaaaaaagaaccaaaaggaaacatttttggcttgatattaaacccggtccaaaagcccggtttccgggccgggttgcattttaaaaaaacgaccggttttcggggcccggtctctcaaaaaccggtcaaacgngattttccaaaaatcaccggttccggttccgggcccggtaaaaaccggtaccgggcccggcccggtccggtctctactattgatcaatcatcgtgcatgttgaatgcctgatttagtctaagtgccttaattcattaatccatttacccttcataaatttatttttcaccccaattcctggctttattttaggaacttggtgtccagttttccggtgttcaattttccttcggtgtccaaaattccaacggtgtccagttttccgcttggtgtccaatttaccggtccccgcccttactattcgtcactgtttcggcctttttgtcactattttgttgctgtttatgtgttctactcgtgaatgcgtgacatcgatttattttcttagcatcaatgcataagcaacactacaacaaattttttatgaattttaagaaaattttcgaattcgggtccgggattgaaatggtctaaatggaggtatgtaatttttaaaaatttaatagaaatttacaaaaagttgtaaacaaaaaagctcgaaaagtttgggctcaacaattttaccgtaacttttttgaaacaataaaattttttgaaatttagcaaaataatagagaaatctttgggctatcttttcatataaagtgcagtgtgaattaattgatctttaaacaatttcatgcatttaaacgaccatacattttttggatagccataaaaatatgacactattaattccttcataacttttttctgaatgaatgaattttaattttgtttatataattagatagcccaaagatttctctattattatattaaatttcgaaaaattttattgaacttcaataaagttagggtcaaaattgttaagtcaaaatttttcgtacttttttggttacaactttttgtaaatttttgcaaaatttttaaaaaaatacataaatagtagaggatactttgagctgtcgctaaatactaaatttcattaatttgacaaagtttaggctaagttatgattaattatttagcaaatttaattaaaataataattaaatttaattacaaacattcagacttttgttacttcggctcaccacgattctctattttatgtactttccggtcatttgaagttcttaaatttctcacatttccctctctctctctctttctccttttttctctccctctctctctctctcctctctttctcttctcatttccactgacccacccgtctctgttgtccccgctgttctcttcccagctctctcatcattgccaactctctctccccgttctccaatcgcattgtccattcggtctctctctccgtccattccatttctttctcctccattttttccaatttggtccttatcccttccaattccgtcctcagtccctcaatgattgcgtctttgccggcacaaatccgtgccaaatccgcaaagtcgcgacccaaaccccggttcaattcggcactcgatgaacttggccatcgtctgctgagtgtgtcgcttccctgtggtaagataccgtacgcctttcgccaaccgtatgntcgatcacctttctgtgggtgcctaactcctctttctctcttctggcccatcttcctcgcctcccaaagactcttttcgtccctcttttttcctgccccccgcctcccttgttggatttggtgggtccccctttccctggcccttcaaaaatccacctggtggtggcccatttcctcccgttaataatttgggggaccaaaatttccaaacccttcaaaattgtttcccctgttttctcataaacttcccaaaaggaaaaaaggtttttcccggcccccctaaaaaaaggaaaaaaaaaatttttttattttttccccccctttttttttttaaaaattttttaaaaggggggggggtaaaaaccaagaaaaaaaaaaaaaaggggcttttctcccccccccccccccccccaaaaaaaaaaatcccccccccgccccccccccccccccccccaagggggaaaaaaaaaaaaaacccccccccccataataataaaaaaaaaaaaacaaaaaaaaacacctcctttttttttttttttttttctttttcgtaaaaaaacaccccccccaaaaaaaaaaaaaaaaaaaaaaggcctctggggggcgggggggagagaagaaaaaagggggcccccccccccccccttctctcctccccccctccccccccctccgccgcccccccccccccccccccccccccccctttttttttttttaataaaaaaaaaagaaaaaaaaaaaaaaaaaaaaaaaa

SEQ ID NO: 22756 - DNA, 1673 bp, Heterodera glycines
  misc_feature (9)..(10): n is a, c, g, or t
  misc_feature (29)..(30): n is a, c, g, or t
  misc_feature (44)..(44): n is a, c, g, or t
tctagagtnncttgcgtgattaatgtaannagaattgaacaaanttgccaatctcgatatgccaaaaattcattttgctaacggatgacaaaacttaatgaatagagggaacgcacctgttcacaaagcacacattcggagtccaaagagaactcttaacaaaaaaggatcagaaagtaatggtaatggcacggttacggtgagaaaatggtacggtaatggacaggtcgaggggatggcattaaattcgccccttttagaggaaacgaaacggaccgaccaatttgtgagaaggcagcgaaatgttggagagacaataattcagcgaagagaagtccaagcgcgggtccctccaaatttggctaaacggcaaaatcatttcggcacaaacgcaccaattcattcattcattcatcggtcggttgcttcacctgaaccaaacgtccgctttgaaactgctggagaattcgctgatctccgttatgctctgcactgttagctcgacgatcaccgaagtgtggttggaggacggcaaattgttcttgtcgtagtgattctcggcgaacagaccctaaatgggacggggggagcgagtgtcggcattttggtcaattagcggatgggaagggcctaatggcggcatgccattgggctttgtgcgactcagttcggcaagtgccatccctgtctcctccccgcgggcgttgcctctgatcagcctaccacccacttggatcagtgccttccttcggttgtcatcgatcggaatgcattccctcgtcggcttttccctcacttttgcctttgtcctcttcgccttttcctcgcgcgctttctttcgctccaaatacgcttttcgcaattccgtcgttgcagcagtgaaattcgctccgccgacaaacgccgcgaggggcggcgcgcctttggcaaattctgccgattggttttccatttttggtatttcttttgctttctttttcttatgcctttttttaccgttctgtcgttccctgcctccttcagcgatttgttcgagacgtacagagtccgtgtaggaaatttgtgggagaagaaggacgagtcgggtcaaaaaggaaataatcattgcattggggggacaattaacggggggaaagcggggggacggggacacggggaagggaggggacgcaacgcatggcaaagggaagggacggacaaacgaagcggcggcggaaggacggcagagacgaagagagactgctggtgattaagcaattaattaagcaattccctaatttcaaattttacaatttctgattttttaacttttcttttgcctttttcgattggtttctcatttagaggttatttttgaatgttaagcctaaaatttcgttttgagtgacaaagtggacaacaaatgtgcttttgaagtcatttcgcctctactgacactaatgaatggtgccgaaaagcgcttggacgtttaatgggatgggaaaatggctaattccctcgaggtcccttcctttcccaccgaattgcaaggcaattcattcattcattatcaaagcgaacactttgacacagcaattgttgtgcattatttggcaacgcaaaatcaatcaaaaaatgccacggcacttttggccatttccgcgaaaattatgctaataatcgcactcattgtc

SEQ ID NO: 22757 - DNA, 1299 bp, Heterodera glycines
  misc_feature (1291)..(1292): n is a, c, g, or t
aaataatggtggcaaagggaaactccgacacggaacccaaaaaagcagcagaaggcaattcccccctcgcctccccctctctctttgtgcttttcccccgccggtgatgccattgcaaagccaatggaagagaccaactttttcttcataaaaggtccttttctgctgcttaaccgtcgttctccgccgccgcccatccattgaggaaatattagggcctcactgaccaaatattgcacattaatatggaccgaaattccttagagtttttgggagtcgaaggaagtgaatgaattgcgtcgggggggggggggggggacggcgccaggcaatggcccggcacgtttttgcttattattatatgtcggtaaggcaaatgggacatttgtcacggggccgtgggcagaaggaaatgtgtaatttggcaatggcagacgacaaatttgggcattcccattcatttgccggtgttgcggcataaaatatccatttctgatgagaacaaaatgaaacgcaatacaattgtttatcaattgacgttaggaaaaagccgaaaagttggcaaagttagcaaattggtcgtctacgaaagtgccgccggcagagggcttcaccccgaacggatcgtcggcgccattttcactcccgccgaacgggtcggaggagcgatgccgaacaaaagggtcgccttgggaaagggacgaaacgaattcgaacaaatgaaatgagacgaaaagccaagccgaccaaattttaagtgctctttacctttagggctgttcatctccgctgagttcgttctgctaccgatgactgtctgaaaaagcgaattccgtcgtaacagtcaatcagcagagaattattgaaaacgaattcaagtaaaacagggaaaaaagaatggggggagtacggtaataatgcaaattacagactatcacattacagaacccagctttcttaattaaaatgccaagtgataaggaattttgacacggctaatcaaaattcgaaattaaattgagagagttgcgttggttaatcaacctttggtttaaaatggtcgaccgaatgccgccgattttgatctggatcattttcttttttcccccaatgaacgattggtcagtcattctgctgaccaaattcaccctgttcagttggaatgtcctctccagcagttccctcttggccccctcgtatcccttttcaacgcctgtcaaaatgcgctccatttcctgggagaccgccttcagtcgtgcgcattcctcactcatttttgacgacctgcagnngcatgca

SEQ ID NO: 22758 - DNA, 2617 bp, Heterodera glycines
tttagaatgggataaatgtttaaatgaagcaagcctcccccaatttccaagaggacttcgttcgctttttgctaatatccttattaattgtgaaccaaaccacccaggtttattatggaacaaatataaagacgacttaagttatgatcttaaaaaacaatatactgaaaacattgcttcgggatcgagaaatggtccgtataatcagttccatctaaggcctacaataaaaagcaaagttctttgggttttttctaaatatttaaattaaatagtatattaaacatataaaaaacttaaaaaaaacttcaaaaaacaaacaaaaaaaagtttatcattcatgcatttctgacatcttccataattattgctatctatcgagagtttttagtttttctattaaaacacaaaaaattctaaggataaattattcgtatttttctctctcaagaattaaatttagaagaaatttaaatgtatgttaaaatacacggtcatgaaaatttacatttttgatatatataaaaaggaatctaaaatttttctagtaaaggattttatactgaaaaaagcttgaggtatttggaaaattggaaatttaattgaggtgcataactcttttgagatacgaaagcaaaaattaaggaacagtgaacggtaaaactaagtgtttgatttgatttcgaccgaagtctatcgatgggaggtgaattaaatgagggaaaatgagaagggctcaaaaaaaggagtagaggaatttggcttcgaccgtatatgaattcaaataaaatttgggattagtcaaaacaaaaggtataattttgtgactcaattatccggaaaaattatttagaaaatttggaattgcttcggcagttttaaagtcaaaaaaaatcaagcaaattcgaaatctttgacaatcctaagaaaaacggctgaatacagtattccagtgactacggtaggaaaatgtcttagcaaactgtttttggtcaaagtccgtcataggtgtaaaattgacggatgcttaacagaacggagagaacgctgccctttcccctgcccttgcaactctccctttgctttcgtccctctgctgtatccctgcctttctcaccgctatttgtctcccccccttcccccccccccggcgatgagaacggcgattgaaatctgccggtctgacggaatcaccgctgcattagcgcttggcttgcccgtatacgattctccttccgccccattccttcccatccaccctttggcgtcgttcaccattctttcaataaacatttagcaattggaaatttatgtgttcattaattgttgaacaatttttaattgtttttaaatttaattattttattacttttaattctttatttctttttagcgaaaagcatttaattagtgatctttcttcaattcaacaccaacaacaaaagagggacatcaacagcaaacagtcagacgatcggacggacttggcccggtggacattcgactggcccggcccatcagtgacattgtgcttcggtatttttggcaccaacgcaccggcagtgtgcttcggcgagctcaaggcgaattgtgcggtccgactgaaggcggacaatttgagtcggtgatattcggcacgtcgacggtgcgttcttccccgcttcggcgatttctacggatctgtggtgttcgactacgtgtgacattggactacgaacgacttgcgcttggcgaatctgattaagagaactttgagtgtggttcggactgtcaactgcattcaacgcttcggcggcaaaagtgcgacacatttcgcattgtgtggacactgtgagtcctagttggaattgtattacgaaggccaaacatttttgttttgcttaacaaacaacatgctttcatttgattaattaaataaacttcgttacgcttttaattattcgttatacactaatgcgcttttatggcccttaaaatttaaaaaataattggtatttaattgatttggtgtgtaaattccggtcaagttataccctcttggtacaattgaaggcgtttaagagcattgttttgttttggatttcaatcaatcattttggagaattacaggtgaagagcgacatcagtggtgaccaaacgcttcggcggattccaagtgaacggataaagctgattgattggacggacatttgacttctgttggtggacaaagtgaattccttttcctctattaattaaattaaacaaaactaaacaacaaaacaaaaccaaataaaataaaaagggggaattgaaataaaaaggggatcaaaatcaaaaattaggtttgcttcggaagcatggagtacacagaccttgcggtctgtgataaaaggcctatagaaggcaaacatatgagtgcgcaggcaaaaatcagtgacctttctcgggtccatgatgatgttattggtttagaagaagggatcaatcgatacctgagggctctaaataggaaagtgactcaagtagtgggccgagttagtgacatcgaagccgatgtgaatacgggttttggcacaacagcggccagggttgacgcgagtggggaagtagttactggattggaacgtaaatttga

SEQ ID NO: 22759 - DNA, 1048 bp, Heterodera glycines
aatcttccaaagaaatttttttagaattcccggcccgttaatcaacaaaatactgcccattttttctgtactttgtttttgcaaccaatcatttccgagttgaaactgacattaacatggtttcagtagcatgaatcttgcaatgaaattttttcagaattccaggccgttaatcaacaaaatactgaccatttttactgtactctgttatcgcagccatacattacgagtcgaaactgacattaacatggtttcagtagcatgaatcttgcaatgaaattttttcagaattccaggccgttaatcaacaaaatactgaccatttttactgtactctgttatcgcagccatacattacgagtcgaaactgacattaacatggtttcagtagcatgaatcttgcaatgaaattttttcagaattccaggccgttaatcaacaaaatactgaccatttttactgtactctgttatcgcagccatacattacgagtcgaaactgacattaacatggtttcagtagcatgaatcttgcaatgaaattttttcagaattccaggccgttaatcaacaaaatactgaccatttttactgtactctgttatcgcagccatacattacgagtcgaaactgacattaacatggtttcagtagcatgaatcttgcaatgaaattttttcagaattccaggccgttaatcaacaaaatactgaccatttttactgtactctgttatcgcagccatacattacgagtcgaaactgacattaacatggtttcagtagcatgaatcttgcaatgaaattttttcagaattccaggccgttaatcaacaaaatactgaccatttttactgtactctgttatcgcagccatacattacgagtcgaaactgacattaatatggtttcagtagcatgaatcttgcaatgaaattttttcagaattccaggccgttaatcaacaaaatactgaccatttttactgtactctgttatcgcagccatacattacgagtcgaaactggaggttcagtagcatgaatttgc

SEQ ID NO: 22760 - DNA, 1439 bp, Heterodera glycines
tagagtcttttccttcataagcgcccttcttttatgcaaccccctccttaaaaatggaaaagagcgcgacccggacggctcaattattttatttggcgtgtttttaattcgagtgaaaatggtcatttcttgaaataaatattgcgtggatcctttaaaaaatgataaaaaagggcttcaattcacaatgcttctctcccattgtcttttgcagtatgtttctgatcagcactgtgctgttcagtgtgccttcctatttgttcgccatacgcaatgatcgccgactgcgcgccgtgacgccgtacggcggtgtgttggccatgctcgcttggttcagtttcgtcctttgatcgcttcccaaaacaattgcaacaaattcggacggaaaagagaataattgatcaaattgtggaattgtaatttcaaatttttaacaatgtatctttattttgataccacaaataattttttgctcgtcattctcaagtttaattgactttatctcattgtctaaataattgcttattaaaaaaaatgttttttttcgtctttatcatttctctattatgttcaatgtacatatttctcttttttcggctgttttttaattttcaattattacaataaaattagaaatgccacaaaagcgtcggaaagaaacccgagcgatcaatcgaattcgaaaacgccgtgcggagttggaattgttggtgagcggcaacaaggatggtggacaaaatatggacagcaaaacggacacaaaacgggccaaagagacgaaaacggaggacgaaggttagcggcaaattgtggggttgatttaacaaaaagtgccacggataaggcaatgattgggtcaatgaattatgatttcaaattcatgggatttgctcgatagtgtcattttcagagcatcttttcgcggaactgcgccagcagcatttgatttctcgcgactttttgagtttgatttgctgatcagaaaattttcaaaatgctaaatagctgatcttcgatttaatttcttaacttttactttctgccaggacttccgattgcggcgagtgtctcttcaatttcggacatttcgcgcacaacgaaagcggtgaaaatttgtgatgctgcagaaaaggtgcacgcggacacaaaaaggacaaaagggacgacaacgaaggaggggaacggaggtgaaagatgttcagagactccccgatatctagcgatatttcacgaacatccctttttgtttataactcatcccaaactcacaccaccgggggatgtgtcccaggaaggggaaagtggcgaggtctaacgctgcctcacttatttgtctaatcagaaaattgaaaatgagcctgtctctcctcagccccattaagtcgaaaggaggtaccgagttaaatctgctcacaaatcttttggtcttttgcatcaca

SEQ ID NO: 22761 - DNA, 917 bp, Heterodera glycines
aaaggtaattttgaccaagtaaatggcactttaggagattccccaatttaaaatatcgaatacaattattagactcaaaatccaaaaatacggcacacacggaagacataccgacgcgtcaccgaacgttcgccaatttttgtaatcgactgcgaaatgtgtttgacgacagaccaacggttggaattgacacgcatttcgatggttggtattgaatgggcgtagttaattgatcattaaaatactttaatttcaaaaaggtaaacgaagcgggcgagacgctaatggatgagctggtgaagccttacaacaaaatcattgactacatcacattcaaaagtgggattaccgagaaaatgctcagcaaagtcaacgtaagagaaaatgaagaggaattttacttttaaatgctaaaatcattaaattgtttattactcattaaaaatcatttttgagccatccaatttctgctcaaagtcgtgccatttttatttttagactcgtctgaaggacattcaaaagcgtttctgtgccttgctcaccgacgatgccattctgtgcgggcacagtttggagaatgatctgctcgccctgcaattgtcccacccgtcagtcccccccccttcatttcgatttattcccccttttcctattattagtatttaattgtatgattaatttcagtttttgcattgacacttcgctgttgttcaacttttctggccgtgcctttgtgcgcagtggcctcaaggcattggcggacatttttctgaacgaaaaaatccaaaactcgcgccagggccattgctctctgcaagacgcaatggccacgctaaagttgctaaagctgaagctggaaaatgggtgggtgttagagagagttatttttaattcgttttttatgagtgtaaaattgc

SEQ ID NO: 22762 - DNA, 2143 bp, Heterodera glycines
acgcaaaaaaaatctgtttgttcacgaatcaggcgtccaattctccctccacatttgcatgagcagcagcctgtacaccataggagagagaatttgtaaaggtaaatttaggaattttctttcagtaattgcatctcccgaaatgggaaaaaataaacatctaccaatcggaaattttaaccatttgtcatctcaaattacaaaaaaaaaaattcaaaaatcaccggcatacgcatcttggcgcgcatcttaattttattttcttcatgcctaacatggaaaagtgtttctggtttcggacctgctgtttttgcactcattgctgaccactctttttcttattgttagcatcctcaagccatttgggtggcatgaacaagcgtttttccatgccattaatttgattgccaatggatgagtttgctatttcatggggctggaagtagtctgatggtgatgttgctgatgatgctgagccacctgcttgttcaactggcatgagccatgatttaaaggatgaactattagcccaatctaatgtcggctttaaaagagttgatctgtcttgaaaatttgtgttgctcctggttgtatcagttccggttaagaactggacactgctagcgaactggtctttgggaacattgtagtgcttttctttcttgggactcgcttcacaaatttttggcaacaacacacaaaccagcaaaacaattgcccgcatcagcacagcagcgaattgcacgttcattttagcggtaatgatgatgatagtgtgtggttagggtttggaaaattgcttaaaacaatatatatatatattaattatatatatatatatatatatatatatattaattatatataatatatataatttactgaaaaaatttgccgcctatgattttgcctagattattggcaaaaaacggtaattctttaagcttcttttaatttagaactaaaaaattttacaaactaaattttaaaaattctgcctgtttttagagccttttagcctaaaaaccaatccctagtaataaaattattaaagcagaaaatatgtatggttgcctgcctgaatttgtgctgttacactggccaagcagtactcttttattggcacagattctacttcatttttacatgcaaaattgatcttaaaattattgcgtaaggccaataccattgttgacttcactgttttctccatgctaagtagaaattatttaattgctttacatattgcgagcgagagatagtgagagtgagaaggagtgagagagagagagaaaatggagaaaaagagggacacagagagactggagactgtgggaaagggaaagcgagacagatagagatagagaaatggggaaaaagaatacaggggtgatagcgagaaagttattagaaaagagaggcagagtgcgagtgagtaagcaaaagaagtaggaagagagagagagagaaaagaatgagtacgagttggagggcgatataaaaagcattaaataatcctactcttcaatgatggcataggtaatgccatgaaaaaacaatgaagccaaaaaattgcaatggccttggcatcacgtaacatcagtagaaaaaattttattgcaaaaacgaaggaaatccaaaaatttaaaaaaaacaggcaaaaaataataatgttcgaccctttttttagcgaatatcttttctaaaaatttactagaattttttcaaagtttccttggcagtccaggttatcctatcgggacgggaacctgtggggaccggaaactcggcttaacccgtccgagtaacccctttttcaccgtggttgccgatggacaaaaagtgcaaattgggcgacggactaaaagtgcaaaatttgctaaatttttgactaagccaactcataacgtttcccagacgcaaccaaattgcacaatattggtgatagcacttgaattgcgtcattagcttgctaaatttcaaaaaaatttattaagattttcaaaagttctagccaaaaaacaggacaaattgtcataacttttgaaaaaattaataaatttttttgaaatttatcaagctaataacgcaattcaagtgctatcgcatgataccaagattctgcaatttggttgcgtctgag

SEQ ID NO: 22763 - DNA, 1642 bp, Heterodera glycines
tcggtgcgcgaacattcgcagaaattggcggtcgcttcgctgaccgaacttttcgttaatgtgttgcccgggtacgaaattcgaccgctgacggactcagaaaagacgcaaaaaatgaaaaaggaaaccaaaaggtaagggaaattttggtgagatatttcgttccctttttcttttgggctggccgaatacgaacacgccctgctcaattactatttgaaattccttcgtttgctcgagaaaaatgcgaacagtcagtctttataagccattcattcattttggttgactttttccagagattcttcagaagggcaaaaggcattcattggctgaggaagcgccgactttttccacccaattttcttttatttgcgtccgatgtttgtgccgactcattgacaaatgttcacattttaatttcgccaagaatgtcatcacttgcttggtccggcttagcacaacgccgtggaaaaaggcaattaaacaatgaatgaattggcggggaggggggggggatggaagaattcgtccaatcgctgtttttgccgccattttagatgtcggaggagatttgtgcgaccatttctgaggtgttcagggccgattttcaactgcaaatttctgcccatgggacgaattcaattgctcttttggttaacaaaaaggctgcttccgtgccggcggcacttctcgcaacttttttggcactgaatataacggtgagcgggaaaaacattttcaagttacacgtttttattatttctgttttaaggaaaatgaagcgaatataactgagaagaaaaatcagaggcaaataggaggaaaatggaaatcgaaacgatcgaaaaaggcaattttatggacaaaaaaagagtaaacaacaaatgattttcagtacgacaagcaaatcggaaagattgatgcggaactgaaagaagcgattgagaccgaagcgaagtcgacgaaaacgcaattggtaaaaagacgagacgattgaccatggattggcataaatcaccaatttcaccacccttaggctactcaaacgatcaaaaatgtcttcttgacatattgtcgtgttctgaagcgaatgcctgccaccgctttgcttcgccccgtcttggccggcttgtcgaagtttgtccatttgattaatgcagaactgcatgaggatttggcacgtcatctcgccaatttggtccatcagaaggtcgtccaatgggcttccgtttcttcaccccccccccctccatttcgtttagcaattcggcttctccgatgttttgcattgtgttcacaccgctgccgtcgttttggagggcgatggccgtctattgggcgtcgatctgctcagtttttatcgggctatatttggcgctttgccgaatgtctgtttccaacccgagcaaagtgcgttttcagttgtaaatgcatttgttcgtcttgccatcgtttcgttgtccaatccttcgcttttcagcactatttacggacctttcgctgctttctaaatcgctgcatttgctcttcgtccgccgtcgtaagtcggccgtttcgcccgcgcgtgtcgccgcctttgccaagcgattggcccttctcgcgttgccccttcagtcccatgctcaggacgtccttctac

SEQ ID NO: 22764 - DNA, 1347 bp, Heterodera glycines
gatgtagatttattgttctttattagttctatgcaaggattttgattcagaaaaaaagacgacaactagtctctgacaaagttcgagcgacgcacgaatgtggacacgcttgcatatgttggcaagcaaaatactcggacggagttgtatccgtaagttggcaaatatggtattgcatagaatcattcaaacaatcggcattttaattagagaccggtaaaaaatttttccgggaacgggaacgggaaaacgaaaaagaaggggcgggattcccgaacgagattcccgtgtttttcccgttcccgtaaaaatcccgtcaattttaacgggaatcccgccgggaacgggaaaaaatttttttcgaaaaaatattgattttttttttctaaattttaatttaattattctcttaagtgaaaatattatattttaaacgattaaaataatttatttctgtgtaaatgattaaatattattgcttttattaacgaacaaaaattaataaaatttaatttttttaattgatttgctttaaaaataagtcgataacaatatttcgaggtacggcaagaactggtaattttcttagttctaaaattcctaaaaaaattttttatagtgtaataattttagttaaatttattatttttttaacttccaaaatattcttttagaatttttctgtcttttcaacttattgacaaaacttaattagattaaatcgtttttttgcggcgcacgtttgccaaaatttttggggaaccggttggaggtgggacggcggtgctgataggcgccgctgggaaaaaatttgaaaatttaatgaaatttgttaacagattttatccaaaatatgtccaatcagtggttaatttatgggtctatggctgtttaaaaaaaaaataattttaaatcttattataaaattttaattaaaataatcaaaacaaaatataaaactctactatcccaatggggaattgaacccaagcgaaaaataatttaagtcaaaagtgttaaccactcggctacacacatatgtccacttgttgatttgaaatctatttatttattcaattttttctttaaaaattctcttttcccaccaatttccttcaaaatttttcactcagacccccattcttaccagtgtacttttatttccgtttttgagaaaaaatttacgggaacgtgaacgagaaaacgaaaaagaacggggcgggattcccgaacgggattcccgcctttttttcccgttcccgtaaaaatcccgtcggcgaaaaaagacgggaaacgggattcccgtcttttcccgcgggattcccgttcccgccggtctctaatttt

SEQ ID NO: 22765 - DNA, 936 bp, Heterodera glycines
ccccccccccccccgcccttcagagcacgacaaatattcaacaaaaattttaaaaatgactagagcaatgaacgctaacggacgacctaatggaaaaaaatccccgaaggagagaatttaattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttaaaaatttttttctccatcttcctttttgatactaaagcatcagagtgctaaaattaagttgtaaataaaatttggtgcgctttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaa

SEQ ID NO: 22766 - DNA, 1681 bp, Heterodera glycines
  misc_feature (1587)..(1587): n is a, c, g, or t
tctacggcctactgtattccgtgtacagtcgtggaactttgcttacttttttggccatttcagcgccggcggaataactcgtcggggttttgagggaggatgtcggtgtaagcggcttttttgtacagctcgacgagctctatccaaccatgtttttgtatttctgaaattttcagaaattttcgagctaggccccctcgtcacttttgaggtttttgaattttagtattttttgcagatttttccggggaaaatggagaccactttcaagcaaccgtttttcatgctctatcgattggtgtcattttcagaaaaatttttaaaattttttttggaaatagaaaatttttggttgctaggcctcaatttcagttctggcgcaataactcgtcaggagttgaatttatcaaaaaatcgtctaagagcttttttgtagagaattttaagcccaatctaatgtgctttatctcatgtttttatcatgaatttaaaaaaagttataaaattaattgtgattttgaaactcaaaaccaaaggggggaccccatggttttgcatttcatgaaaaatttttttgctcctaaattagccaaaatgcatttttatggcataatttgaggtgctgaatacgtatatacgctttattttgcgtttcagattttttggaaggtgtttaaaatttttttgaaaaatcgtcaaaatttgagccccggaaaatccagtgaaatttcgaaaattcataactctcttcgtttttgatcaaatttagtggcataaagtttgaaaaatagcaaaaaataaggagaattttatgagatttgtttggaatttctatcttccaaaataaaaagttattccaaaaattctggaaattttcgatttttcagaaaaaaattcagaactcggttccgtaaaggtgtttttgaaattttaaatactgaaaaaatccgcaatttttcgctctattttatcaaattttaatttagctttttatcacttttttaaaaaaagttatcagaaataaaagtgattttcggccttcgggaccacaggggtgtgaccacgatttttgagtggaaaatttttttcaccaaaaatcttccaaaaatatgtctttagaggttatttgcgccgctgatcacgaatatgtaatcagattttactttagacatggttaagacctcagaatccccgtgttattggggattctgaggggtgggagcgcccgtcctgaggccgcgaagcggccgaatgtcccccaaaaaataaaaaacgggcgcgaagcgcccgtcctgaggccgcgaagcggccgaatgttcccaacaaaattaaaagacgggcgcgaagcgcgcttcctgaggccgcgaagcggccaaatgccccccaaaaattaaaaaacgggcgcgaagcgcccgtcctgaggccgcgaagcggccgaatttccccaaaaaaattaaaaatggcgcgaagcgcccgtcctgaggccacgaagcggccaaatgttctcaacaaaattaaaagacgggcgcgaagcgcgcttcctgaggccgcgaagcggccaaatgccccccaaaaaattaaaaaacngggcgcgaagcgcccgtcctgaggccgcgaagcggccgaatgttctcaacaaatttaaaagacggggcgcgaagcgcccgtcctgacgctgcga

SEQ ID NO: 22767 - DNA, 997 bp, Heterodera glycines
aaaacgccggccccattctatgaaatgatgagcgaaagtgagctgaatgtaagagacgggtgccacgttttgtttaaaaacagaacatttgtgcattttagtttacacaaaaaaatttttttttttttttgaaaaactaaggagtgggggaggggcttggtttgcattttattgtagaaaatggtgtttttttacatattttcagggtcgtttgtcatggaattatatttttttcattagaaaaaaccaaaaagttggttggtcttccctttggttttttaaaaaaaaaatcaaccgccccaactaaaaaagtgacgattttgctataaaatatggcaaagtttagtgtattttgtggtcaaattattgtaaatattcaatgaaattttaagaccaaacaaaaacttttgaaccgaatttatgaggcaacacacccaggtttagcaaaatttaaaaaatggggtacaattttttaatactttcaaatgccactgacaatttttacaatttttttataaaaaagtataaattccataaaaatcgaaattttttttgaaatatttggaaaattttgtaatttttcgaaaataactttaaatttctctcagaaattgggatttacttcatttcttcgttttctccaccgaaatttttaaaacacttaaaattttcaaagattttttttaaacattatctaaaaaattgtaagaaaatagggaggaattggattttccaaatttttttttaaatttccgttttaggcttaccctctccctaaaaaagttcccattttatttatttttcagtgatttcaagcgacacgccaatcccgcggaaagtgcggcgcgcattggcgacggacgacggcggcggtgacaaaaatggggcggctgaacggcaacgggaacggaggaccaagttcgatttttaggggtgtattttagggttttataaaacgattaaaaggtgcttttttgccgtgctaattttcttaaaa

SEQ ID NO: 22768 - DNA, 1785 bp, Heterodera glycines
  misc_feature (1707)..(1707): n is a, c, g, or t
  misc_feature (1724)..(1724): n is a, c, g, or t
  misc_feature (1766)..(1766): n is a, c, g, or t
  misc_feature (1775)..(1775): n is a, c, g, or t
ttcagacggggccacgcggcgtgcgaggcgcaccgtgtttagagggaccggcgggggacagaggggcggacgcgtcgcaaggcacggagggaccggtgggcgaacgcggcccagtgggccctgagggaatgatgggcgtgaggggtgcgcacggggacgaaggaccgacgggacggtgagtaaagtaggagaattttccagacatccccgacaaattggccggggatttatgtccccgacggtcgggggcgaaccaaagtcataaaatataatatacctatttgctctttttatatgcccgggtatattatttttcaaccccctcagaaaggagccaacccaaagaatgattgtttaggactggaccggatgctgagtactgtccatgcccgcaacatttgacagaagttgggctacagcagcagcaatattataaaattggacgacggcagaggctttgatgagccaaagaataagacgatagaaaaaaagaaaaacggcggaaggaagagagagcgagagagagaaggagagacagagagacggagagtttagtatataaattgtaaatcaataatatgtcggattttgaaaaatataaacgattttacttcatgccattcggcagtggtccatcaaggattgccagcctttacagcccaacaaatttcgtcgcaaaatgttctacggcatgggggctggacgggttgagaataaacattctttgaaattgggagaaaataattaaaaagaaataaaaatttaattaattcattgaaatttcaaagatttttgccttggctcctcccccaatacggaatatttttttaaattaaattatgggaattttccaagcaccgaaaataaaaaaattaaaatatttaatttcattttttaaacataatcaaaaagtccaattctttaggtgcaaaatcgtttaacaaattgtgacaaggtttccgaaattttccggcgaagcctgttggaaccgccggacccaaaatccctaaaatttttaattaatcaaaaaaccagaaaagtgacatttgaggttgaaaaataatcccccatgggctataattagaacatatacggtaattttattcagtacaaaaaattctcgtctcttctcgtattctcgcgttttagggtctctcgttctcgtgactcatattttatttttgtctcgtttttctcgtgtctcgtattttttcgcaatatccttgtctttaacttttccttcccgtacacttggaaattgtttggacagctaccaccattgttggagctcgtaatgaattcgaatagttaattaaaagaaataatattataataggacgggtaaaaaattaccgggaacgggatttcgcctttgtccctaaaatcgcgtcaagttttaacgggatcacgccaggaaacgggaaaaatatttttctatgaaaaaattggtttttaaaattttttaatttaattattttttgaagtaaaaataatattaatcttttattttcatttcacaaaagccaaaattaattcaaataattcaatttcacagtgcggaattggaataactttttgctttaatttttggcttttgtgaaatgaaaaataaaaaattaatattacattttttacttcaaaaaatatttaaattaaagattttaaatcaaattttttcatagaaaatagcaacttcgagttttttanattttataacaagctanaacaaaattacctttatataaataatttttcaaaaatacttncaaaatctncaaattttaa

SEQ ID NO: 22769 - DNA, 970 bp, Heterodera glycines
gagtcccagtgattggaatgctgttgggtttagtcccagtgattggaatgctgttgggttgagtcccagtgattgaaatgttggtggattgagtcccagtgattgaaatgttggtggattgagtcccagtgattgaaatgctggtgggttgagtcccagtgattggaatgctggtgggttgagtcccaggcgattgaaatgttggtgggttgagtccaagtgattggaatgctggtgggttgagtcccagtgattggaatgtggtgggttgagtcccagtgattggaatgctggtgggttgagtcccggtgattgaaatgttggtggattgagtcccagtgattgaaatgctggtgggttgagtcccagtgattggaatgctggtgggttgagtcccagtgattgaaatactggtgggttgagtcccggcgattggaatgttggtgggttgagtcccagtgattgaatgctggtggattgagtcccgttgattggaatgttggtggattgagtcccagtgattgaaatgttggtgggttgagtcccagtgattggaatgctggtgggttgagtcccagtgattgaaatactggtgggttgagtccaggcgattggaatgttggtgggttgagtcccagtgacttgaatgctggtggattgagtcccagtgattggaatgctggtggattgagtcccagtgattgaaatgttggtggattgagtcccagcgattggaaagtctgataattgagtcccagtgattggaatgctggtgggttgagtcccagtgattgaaatactggtgggttgagtcccagtgattgaaatactggtgggttgagtcccggcgattggaatgttggtgggttgagtcccagtgattgaatgctggtggattgagtcccgttgattggaatgttggtggattgagtcccagtgattgaaatgttggtgggttgagtcccagtga

SEQ ID NO: 22770 - DNA, 1106 bp, Heterodera glycines
  misc_feature (12)..(12): n is a, c, g, or t
  misc_feature (29)..(30): n is a, c, g, or t
  misc_feature (43)..(43): n is a, c, g, or t
  misc_feature (1090)..(1091): n is a, c, g, or t
tgcaggtcaaantttaattaaattatttnntttccttttaaantggatttttaccttttatgattaaaaaaaatgggtacgataactcgaaatcagctggttggtgtacgatagatgactcgtgggcagctctggcccgtacaagaactcgtacaaaaatttgcatattaaattttcaaggaaaaactttaaggaaaattgatagaatttgggtgatcccagtgcacattcagagatttgttggaatgccggtttccgatatttttgagccgtctgaattcgaattttcgatttcttaaatctttttgagctgtcggaattccgagttccgttattttgggcttaaaattccagtttttcgattgccgaaattttttgaaggcgtcggaattccaattgccggctgaaaaattattcgaactcggatggtcccattataccttgaatttgtccatttttggtcacctaattaagattaacccaaaaaccattccctgttatatgaccattaaatattaatattcatctttcacttttaatttttgataagcaaatagagcacaaagcacgtgaacacttaaaatagtaagaaacgctaaatttgtaagttttgtctgaaattaaaaaaagtttttggcacatcaaaataattgctgacgcctaagtgcttgtggcagggatgtggtgtgccgatgctctcaaaaaatgtttggcaatcggaaatcggcattccgacggcgctgaaaaaatttcggaaatcgggagtccgaggagtccaaaaatacctgaaataggaattccgtacccaaaatcaaaatcggtattcaaacacatccctgctggtgtgtgttccctctgctggttggtttggtccccaattccgcacccggaaaaatgccaaaaaatatttaataccatttttaatacaaaacaaacaaataacggggtgcttgattgcctgcttatctggcacttgctgattatttgaagatgattcattgcatcctgctgctgtgccctctccttaacacccacataaacaccttattgaagtgccaaggcactgaattattggccaaatacccccggnncgggggggggggatt

SEQ ID NO: 22771 - DNA, 878 bp, Heterodera glycines
cgacgaagctttccttcttcagtcacggaaaaattgcatgaatagtcgtgcgcgagactgatgaagatgatggcacaacaaatgctgtccgttccctgtcaatcacacacaccccaaaatttgttggcacacgggttgggggtgtcgttcgtcttgggtcatccataggtttttctgtcgaacgagaggccccctttgaattttatcccgaattttccactgttaagttcgcttgtaggtttggtgccggcaaaatggccactccttggcactgttactttcttctcctgctgttgtgcttttcccccatcagctgtagtgccattcctcacttgagctctcctcatgccccagggcattcattaagtcagtaatgaaccaaagtactgaataatttatgtgccattttttccgtgccgttgctgttgtgttgtgctgtggtatttcagtgccatagcacatgtgtaactcgcgcagcagcacttctcccccccccccatccattcatccatttttacaccaaaattccatctcactggagaattagtgctccaaggttgtgctggaactgtaaaacaaattccttttttaggccaattaattttttttcaccgagggttggcacaaaatttttacgagtgtttgaatcgagagagtagtaataaattgagaaatttacaaatttttttgttagattggcgacaaattacgccctccctcccctacaattatctcagcttaaaaaataaccaaaacgagaattgactgttcccgagaaccagttgaaaatcagagaaatgtttttttggattcagcgcccgaattcacaaaattcacacataatttaaaaatttggctaacggctaacataaagcata

SEQ ID NO: 22772 - DNA, 1591 bp, Heterodera glycines
  misc_feature (1237)..(1237): n is a, c, g, or t
  misc_feature (1291)..(1292): n is a, c, g, or t
  misc_feature (1385)..(1385): n is a, c, g, or t
atgggaccagtaaaagtcagtattacctgttcttctgcccaattcaactcaattaggccagggaaaatgagaaatgtcaaaaaaaaacattgatttttattttgggatagtattattttttaaacttttctactaaacccctccccttccccctaccattaaaccattcgtatatagaagggaagccaacagccatcatcaaaccaaaaatatcttaaagctttattatccaaataaattgttatccttttggatagataaaaaatggtttaatctgaatttcatccatatcaaagtcccaacccaaacaaagaagagctcaagctccaattaagaggcagtgccggtaataagaaagaagacccgccgacacaggcacaggatggcaaaaattgaaattatgatgttggaaaaatggcaaaaagggagggagagaattttatgggacgaacgaaacaaaattgaattgaattgaattgaattgaattatggttaaaaattattatcaaaaattttcttttaataaacatgatgaaaaaagcattaattcctaattcttaataaacaagatacatcgacatatttatagatttatacatcccatcccctcggacccataaatttgaacatgacgtcctagtagtcgggtatattttgaaacattgatcgataaaactgggagttttattgtagacaaaatcaaacaggaaattatatacctttcaagagtccatagttattgactcgagaacttaaatacatacatattatgatatcggtaataaatctatattggtcatatttcggattttagtccatattttaactgccaaacattttttcaaacaaaactcaatctcgggcacaacgttaaacagatgcaaataattagagagaaaagaaaaagtaaacgaaccataagaaatttgctttccgacagacatattttttgggataaaaaataaatgtaatttttggaattaagctattgtgagttacaatcctatttgtgtacaaatatgtattattttttatttactgcttatttattttaataggctgagaatttaaacaatcctaatggcaaatgttaaaaaaatagaatttaatttacttattttttgagtgaaaatagatgatttaaatttcaaatatttttcacttcataaatccataagtttaaattagagtgaagcggaaccgggaccgggccgggaattcccggtcatccgaggtncccggggttttgaaaagctcaggtcccggtaccggtagggcaaccgggaaccgnngaaaacagcactggtaaggaatggggggtctgagtgaaaaaatagtgatgaaaattggagtcaaaggaaaaaaaaattaaaaaataataattnaatattctttaaaagtaacactacccattgtgcaaatggggctagtctccatgactttctctttctcttcccatggttcatttctctacagaaattaaaaaaattttgattttctttttttaaactcatgagtttcctatcaaaaaaaatgaattcctccttaatttttttttttaattaacattttttttatttttttttgaaaa

SEQ ID NO: 22773 - DNA, 1606 bp, Heterodera glycines
ttaccagccaaaacttccttaaaaatttttttcgaaacgggcttttttgctacccggttgagggacgaagcactgtttcttttcgtgaaaggccgtagggattaaacaaaatatttgcccatgtgaatgggttttgccaaaaggggcatcgtcctttcgttacacataaggaaagcatattgctgagtttgaaaccatgttaagtctactgtatttgatgcgcaagcgttggcattgtgccaatgccaaaaagcggttcgccaaaatcggcattgaatgcgccaaattgcgccaatcgtgggacattatgtatgaatatttgttctgactgcactacgacaaagccgacagtgatgccgatgttccaaatgcgcggacctcgattgtaactattttctaattaaacattaattcatgcaaatactagacatcgctacttagtagtgacattttaactacatctaattagctcttcacagattttctttggctcagacgcatcggataggattattcaattgatcccgtccatgatcctcgcaatttttgacagagctaaagaatgtggcgtaaggcgtcgcgccaaggccaggtaccgagaaatcggtcctgcgctgagggcacgcaatcgcgcgcacaggagaaagttagctaaggagaatgaggaatggactcggcgcatcctcttctgaggaggcgccccccgaggatgcaccccatggggtgcagagtgacgtcgtcgctccatggactgcggaggggaagactgcccagtggcaaccaatttttggcgcattctttggcggtaagctcttcccaacatggataaaatcattcaattgattccgtccatgctactggcaatttttgaaagagcaaagaatgtcgcacgaggcgacgtgccaaggccaggtaccgagcaatcggtcctgcgctgagggcacgaaaccgtgcgcacaagcggctgctggcggaggaaaatgacaagtgggttcggctcatcctgtttattttaaattaaaaaaagacattttgagttttgcacagatttgaagttcccaaatggaagagactgtaagttagtgataaaagggcggcatacaggtgaaagattactgagactggtcaaagagtgggaattgagcaatatttatacagtactctgaccccccccccccaccactattgcatagcgtagaaaaattgtaaatcacaccgcatatgaaaccccgtttttaccacagttctttggctcagacgcatcggataggattattcaattgatcccgtccatgatcctcgcaatttttgacagagctaaagaatgtggcacgaggcgtcgcgccaagtccaggtaacgagcaatcggtcctgcgctgagggcacgcaatcgcgctcacaggcgacggttggctgaggagaaagcgaattgggcccggcgcacccttttcggctaaggaggctccgcgctttttctccgcttttttttaaaatgccgcatttagagactggctgctgctgcttatggtttcttttttccactatttgcattttcctaatggtttattttatccgtgccattcataagcacgagaaaggatttaag

SEQ ID NO: 22774 - DNA, 1261 bp, Heterodera glycines
gcgagacaaggagcgcgacgtcagcgagaaaatgccacttggactgcccgactcacgcgcacgcgaaagtggcgaaacacaattcgactcacgccttttcaaccaaaccggggtgggtggactcgagaaatgatttggtgcaccgtttgcctttaaaattgcttttcacagggtctcgacagcggcggcatcgatgacgaaacgtacgccgcctacgataagccatggcgtccccaggatggcattcagcagcacatctaccgaccccgtaaatccatttttgttcacgatgggaatcatccgttctctctcgaattcaggaaaggacattgacagcagcatttatggcgccgatttggatcgaattatcagcaccaatcggtttgtgcctgacaaaggcttttccggagcggatggagccggcaaggagggtggacaacgaagcggaccggttcaggtggattttacggatgattaacagtaatccacttttaattgaatcctgttgttctccctttagtttgaacagcgtgaggaggaggacattttcggcctgggcgaactgctccaaaccacgtcatcctcagccaagcgaaaagcgacggaatcggaggaattgccaagcggcatcaaaaagagtcggagatgaactgagaacggagagcattgtttcggcttcatttctccaaataacgaacacttttttatgtatttgttcaaattggtgatgtcgataaatttggcaccatcaccatttgctcgcacattttgttctgctgacaaattgtttgtacgtcttccgctgcgtgtcgtcgctgcaggcgaactttccattgtccttcctttccaaacgcaaatggcctttggcttcccctccctttggtgagctttcgtccacccttcccccccacctcgccatgtccctcacctcaatttacgcacccctcccctcccgccgccgtgggagtgaaagttgctctgactgtatgccctcgggggagagggccccgccgcgacctttccctttctccccgcctcgccattccctcactcactcgtacagaaagcgcaaaaatagagtggattcggtggcttgggcgagggagggccttggtccctccccctaaccttttcactgcacacaccctcaggtgacggtccgtacttgcctacctttcagtcgccggaggggttttcctccgccccattgctctggaggggatggaatggtcggcaaacacagcccccgggggatgggggg

SEQ ID NO: 22775 - DNA, 1549 bp, Heterodera glycines
tgcgccaacacatcaccgcaaaatatcccaatggcctcatagacgacaactattcctgcccccacttcaaccccaacgaccgcgccttcgtgtcaacctgtacccatcttgaattaaacgcagcattggaggccggctacacagtccgcaaagtcttccacgtcctgcaatacgaccaatggagcgacaatgtcttcaagtcttacgtgagtgaaatgatggccctgaagatccacgcaaccgggttcccgtcgtggtgcgagagcgaagagcagaagagtgaatacattgaggagtgctggatgaaatttgcaattaaactcgacaaagaaaagatgaaagctgaaccggggaagcggtacatcgccaagctctgcctcaactcactttggggccgcttctccatgaggaatctactttcgaaggcggtaatcaacaatgacccttgtgttctccgccaatacaccgacgacaagaaaattgatattatggacattgagctgatggatgaggacaacgacgtattcatgctcacctacaagccgaaagaggagtttgtcgacgaaaataaatactccaatgtcgtcatctcactctacacaacatcaatggcgcgtctatacctttacgaagtgttaaaaaaagtggccgacactcccggatgtgaaattctctactttgacacggacagcatcatctacgttcaccccgaggaaaacgacccactcccgacaggaaagggacatctcggtgagctgactgacgaaaagccggaccacaacattttggagttcatcagcgctggctgcaaaaactacgggctgaagttggaacgtaaggacaatggggaaattgagtacgacttgaaaataagagggataacactggatgaacaaactgtgcaaactatccattatgacagtgtgaaagatcaaattatgcgttatggttccgatgaccccgcggaccctattattgtaacatatccccattttattcgtcccaaccttatccaaggcaaagtgtacactcaatctctaactaagcattatcaacctgtcttcacaaaaggtattattaatgattcattccaagtcctcgaatttggttatcgcaaatgataagtatgcattctcaattaaattttctaaatattagttttcttatggttcccttcttttctttctctctgtttatatcactcatgtgggacggaatgacccctggttgatcctctccaacactccaggccatccatctgagatgaaggtggacgagctgttcattattgtaatgcacagcctggtgcgtgagtgtttggattggggaccgaagggtgaagccgttccctgggtgtgtttgctcacttttttcaaagggaactctaagaattctgatatgtcttcaaatctatcaaaagagttgcatactttctttttataatttcctttattctctattttacacttgtatttttcatttgaatgtttattcagaaataaaattgaaaaaatgtgtcattactaatattaaaaggtataaattaaaa

SEQ ID NO: 22776 - DNA, 1363 bp, Heterodera glycines
aattgggacgaaaagatgcgcttgcaaaaggtcttcctttttgaaggagaaatttcggcaaactttgtacctggaatttaaggaaacccattattcaattatatattcattctcaaaacaacttgtgaaaggtaaatggaaaatccaaaatggattgtatgatgatcagttgggctctggcatcccgacgcacgcaatggcgaattcgaaatccagccgaatttggctcattgccgaggtgtcttttgcagatttgtgaaatcgctttgttgagtaccaatgggggccgtttgcttttgaaacaggcaaccaattcatacgaactgatgtgaaaaaaatgcaattaaaacacattaacattaatgggaaaaaatttttatgaaaatttaaaatatgttcaaccaaaattggaatttttttaataaatgaaattggtaggcttggggcctaaaatgacaaattttttaaaaaattgtaacaacattaggccaaaccaatattaaaatcaaaaattcttcaatgacgaaaataaataaatttgagacaatttatcggaaaattttttcattttaggggtgtatttttgaaaatataaactcataaaacaggcactaggcagctgagaagagctcagaaaataggtaaaaccctaaattgtatccccaagcaaaaactaataaaaccgcaaaataatttaaaagtcaaaatatttttaacgttttaattaaaattttttacttccgacacgtctccgatgttggcaccttttggaatgcatcgaactcatttctcttttgcgaataatttgttggtaaagccgaggtgttcgctggtggtggcatgtggagagaaacgtgacggctgaaaatgaaaaaaaaataacaaaataatttgataatcatgagacaattagtcgttgccgaggattgtggcacggttgtaagcctggagggtcaatgaaaagcattaagacaaaaaatttgacaaagtgtctcattttccgctgaaagaatttttgatttattattggtacttgtaggtcttgctacggacgaccttcaactcgtttttggccaactcgtttttgtatcgactcgtttttgactcaactcgtttttattgttccaactcgtttttattacttcaactcgttttttgggtcaaaactcgagtattttgtttctcaatttgaaatttcaaaaaaaaaattttctagctttttttaaaaaaatttaaattttgttttcggtaaaaatggatgtcatattcgtgatcagcgaccattaaaaccccccggaaatataaaatttcgtcaaaaaaactaagttcaaaagaaagttagaaaattcggattttcaaattt

SEQ ID NO: 22777 - DNA, 2021 bp, Heterodera glycines
tttcttttttgtgtttgcgtacaaaagttggaacttttatttacatattttggaatttttctacatattacatatgtacatatttttatacatattatggaatttttagtacatgtttcgcaattttttcgtacatatttatttttacatattttgggaatttttgagaatttataaaaaatttcttaagaaaaatttaaaaaatttttttttgaaaatgtacccctaaaaatgggctttttccaaaaatcagattcaaaaattaatttttaaaatactaaaaagtgattctaagcctattttagtcctttttatggcattttctgattagttcactttttacgaagaattttttctagaaaaatgaccatttaaaaattatttacatattttagtacaatatgagggtttttgtacatatttccatggtgcgacttttgggatttgcaacttggggacccgacatttggggatccgacacttatggaatccgacatttggagacttcatttacgacatgtgtgtggagttttaatttcttcggatttatgttatttaatatttaaatgtagactgaattatatatacatcattatcatcttctgtatataaagtttttttaatagataaatttagttaaattttaaaaatttaacacattttttaattatttatctaattattccatttatcatggaaaattgctatatattaaatatttaaacacaaaatgacctcaaatattttaacgcacttgctttgttagttatcggaaaaataataccaaatgaaaattattttcatgtacacactttttttagttgtttttattaaacatttaattcaagtattttatattattgtcatatgcgtaaattacaagtattttacatttaagcgattttttcctcacttgggttttcatatttttactaaattcaaattaatttaaattttacattatatatttagaattttgttatgcatagctcaaatttttacatatcatattaattatgattgtttgttgatgttcataggatgcgaaaacaaatgatattctcatttttttaaatagtaaatttttatatttttctcaaaatgacagaatgttgttcttatatttcattcattaaaatttattttttagatgaattttttcatttatttgttaataattttttttaattttgcttaaattttttaattctttgccttatatattatttatatacaatgtgaatgtttcaattaaattgactcgacgcctttcaattcttctatttttagtgagaaaatattttaaaaagctcatttaatttagggcatttgtaattttcttgtaaaattttcttttggctaattttctaaattttcaagaaaactattaaacttgcattttggctattgagtgcattaatttggtcttggagaggtcatagaaaagattttttcgtttaaattgtcttttttattgtataaatattacagattattgttttatttacatattcttataaaaaagttagttgcttttaaacttttacattgcaaatattttgtattgaatatatttaaattgttataatgtcttctttaataataataatccagaaaatagcagactatatgtgatttcatttaattatgtcatgtttttattacgacattgagactttgtccctttaatttgacatttcattaataattctttttagcatattttttcaaactttaatcgtttaaatactttatttatctttttggctatgtaatagctatattcaaaaaatcaataaacattcgaattaataaatctcatttattaaataacatttttatttttttagatacaaatatatttattttacattttaaaattatttttttaaatatatttattattttgttgtatatgtatattttttctcttttgaatgttatttttcacattttctcgtggtaccgaagtcttgtatcttcccagattattaagaacgctgattttgttatatgaaatg

SEQ ID NO: 22778 - DNA, 753 bp, Heterodera glycines
ttactttgatgttcaaaatgtacatcatatattctttttttttatattctccgaaacaatttattttgttttataaaaaaagaattcactgagagaaaaattaaaaaaacaaataaaaaaacaaataattaactgacaaatataagtattcatatgagtaaaaattcttcgttttaacgcccctttccatccttagaaatccctttttgaatttttacccttaaaataataattttccctattattggacaacaaacaattaaaaatctctttaaatattgacctaaaaatgaaaaaaaagccgaaaatagaattttcttaagaaaacctcttttttttttgctttttattcaaaaaaaagatgaaatttaattcttttttaattaaaatggctaaatatgttaattacatcgactttaatttattaaattgaaaaagcacacatttttcaaaattttcgcctttattttaccatttttcgctactatttaggtacctattttgggtttttcgtccctcaaatccatgccctaaatatgagtttttaatggattgtcattaaaaaatgagggggtccgaaaatgcacggattaaatccgcagggaaattttaaaaaatttaataaacttgcacaattaaaaacataaaataaatctttgagacagtgtcaattgttctcattgtggaggagtgctaggcccagcctttggccaaataaagaaaagaattatgatcccaaaatttgaaaattgg

SEQ ID NO: 22779 - DNA, 1747 bp, Heterodera glycines
tttttcttttgtcagtttgtgtaaaaaacagtcttaaaaatgtttcttttaaataaaacaaacgaaaagcccatttttggcattattaatttaaaaaaaaaaatcgccagttgtaattcagttttgtactaaaaaaaaaatcaaatttccagtcccattttttaatgtctccggcggtttcatttcctccatttttgatggtctgattatgtctgttacaaaaccttactgaaaaacctgttcttttatttattttttttaatttaaagaataaaatacaggtgattgtttaggaatgcggtgactcattcatttagacaaaacgaaaactaattgatgaatcagtttgattcttgctgctattgcaattgatgccctttcactgatgattggaaattgttttttattcgtaaacagcaaaagtcgagaccgtttttcatttaaaaacatgaatgaaacatttgtattaatttcgatcattgagaaatttaatttccttcaaatttcgcattttttttatttttagttcttttcccactcccttatttagactttagcctttttgttttcaatcgtattttgttatattaaaaccggcttattatggagaatggcactcttaggtcaatgtatagtgcaacctccgttgatgaccggagccaattttttgaccgaactgccaacataatgcccacaaatgagcaggaaattcttgatgcttttgaagcagttttggtaaatcccatgaaattattttaattttcctaaattttattgttgcaggcgaaaaaggatttgccgcctgacaaaatgcgaattttgagggactgtgatctgaagaaaaaatgggatttggtgtgtgatgagcaccaatttacacacaatcagtgcatcacagaaccccacgtttacctcaaccaattgatggccataatggacaagaaaaagtcgacgaaaaaggtgcgttttaataggaaaacaatactttcattaatttatcactattaggagcacttgtatacttttattggcgtgactttttcttaaaatgaattttttttttaaattttctatgttacacttattttatgctaacatccatttacatgaaattttgccattagcgattaacggaagaagggactcaaaataaaatgataaaacatgccattgtttatagaccagtgatagattataaagtccatttgaaactgcgcagtcacagattacacggcaatctttttgattttcacctaaaattcattaactcacgttaaaggatgctagcttaaaataaaagtcagattccttttcagcgcttaaaatatcacaaaaaaaaattcttgaggtgtgcacaaaaggacaattaccgacttttttaatggatcatttggtttaaaaaattttcattaattttttcacaaattttttttttccatctgaccccatgtacaaatatatataatttatttatatattctaactgtttttatttagaaaaagaagattttggccggtgattcgcccacccaaattctaaaacatttggaaatttcgttgaggaccaattccattgaatgggttcgatcatttttgtcgccacaaaacaatggtcagtctcacaatcagtcattgttgttgtgccaacaaatttttccttttaggactccaagttgtggtggaatatctcagccttctgcagcaatcattgagtaaattgtgccccccagatccgttcccccccccc

SEQ ID NO: 22780 - DNA, 2266 bp, Heterodera glycines
cagtcattttggaattaaaaaaatctaaagctatgcaattaataataattatggcagtcaagagtaaatgataattcaataaatttccatattttttgataaataaaaaattaaaaaaacatattttattatttattttatttgcctgatggctccgatggaaattgccaacgccaaaatggacaatgccggccgaaagagtggcacgcgaatattttggcacttcaacttttgggtatgccattgcgatggtgttcaagtttggcgctgacagcttcaccgaaatttgctccacaacagaagccggatattcgagaagggtggccatgggaggagttcaaaaaattattagtgaatttattatagctaaaattaattaattaatcaattaatcatctctattcaattaggacactgagaaaaacttttttttttctttatccaacgaaaatcttttttttttataatattaaacttaaaataaatggtttttcttattttctttttggaaattgtgataaattataaatttaaaaatctttgcagggattttaaataaatccgtttaaaaagattttttcttaaatataataaatttttaaatttaaaattattactttaagcactaaaatttgcgctattgcttctttgagtgctgtgaaaaatgtttgttcagtaaatatacaactaagcaagcgcacagttatttttagtaaaaaatttaaaagaaataatctttgatcatgccattttaaaaaaatggaaatttaaaagaatatcgaataaaagatgatatttaaaaaataaaataaatttttaatagttaaaaaagctttgcaaataattaaatttagaaatttagcaatcaaatattgtcaaaatttgatgaattatgttaggaaaacaaaaaaaaacttaaattaaaaattttcttcgaaaataaaatgctatttgtccatttgcactgcaattaaataaacgttaatatatataaatttttctcctgttgatcattaattcattatcttattatcaacgccattttatcatcgagtgtcatctgacggacaaagaatggtcagacgaaaattattatttttacagaaaagaggatcataaaatgatttttaaagattgttacccaccattttgtaaataatcatcatttgtatggaaagcgattacttttacaatttttgttcaaaatcgtgaaaaattttaatttaaaaacaaatcatagttaatgttgatttgaaaatacaaattttattggggcgaggagaatgtaaaagattcgttagttcatttaaaaattatggttgaaaaatccaatccacactgatgaagaagtcatatagatcttacaatttgaaaagcccgaatcaggatcaaaaatttggaaatcggtaagtcaaatttcccagcactaattattcattcgataaatgcttatgaacattatatcttttccgaaaaaatattagaattttcataaaaaaaattctgacagcattcttatggttatctatgttttaaaagagagagaatacagaaaaataatagatatttatttgttttcagaaagcttttaactctccaaaaatccgccacaaatcaatgggtaaccgaaaaaatgaaaattactttaaaagctttaaaaatttttattttgacattcttaccatttctaattttgtaatggtgccttaaattgggccagaacccaactgaacttttaccatgaaatgcgtgggccaaaaaagcattgttaaaatgatagacttatttaaatttgcggagtaagtttcggaaacatttttaaaaaattaataaaacatttattgccaattttaggggtgatatttttacagtcaaattttcttttaaacaaatattacaagtgacaaagccaaacgcaaatttgcgtacggaaggaagctatgggccggaaagaaggattaacaaaagccaaagatatttggactctttagaaaactcatttaggaaaatgaaagcaatcgcattattataaacactcaaaaaatgtattaaaaaattgttccgaaaaagtaaataaattaaattaatagaaatgaaaagaagtatattaattttttttaattgctgaaaaactaaacaaaatcaattttttttttaaattactaaataataggaaaggtgtgaatatttgaatttttagaatttgtcggaacactaaataaaattcacttaaaaataagtaccggaattaataggaaagttttgc

SEQ ID NO: 22781 - DNA, 1877 bp, Heterodera glycines
tttttgctccccataattgtttgagtaccccaaacgtacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatgcgcacccgtccgatctggcaagttaagcaacgattgctgactagccaaaaggttcggtgccgtgatgaaacgaaccagcactgcttaccccgcggcacccggcacggtcccccgaaggaatggatttaattaaattctctccttcggggatttttttccattaggtcgtccgttagcgttcgattgctctagtcaatttttcaaaatttttgttgaaatatttgtcgtgctctgaagggcgtgggaggggggggggggcgaaggcccaccacgaggccgcgaagaggccgagtgagtaccttcggtgcaggaaaattattaaattttaaaattttttaattgctttttaaatatgccaaaaaatgtaggcttaacttttttagtgaaaattcgatcactcatattttttgctaattgagcagaagcgtaccaaactttgcagggatactccccggtaaaggactaacttacactgaaatgagcgccgagctagctggctcaaaaaaatttttcgaaaatctgagtctttcgtttttatttatttgcaaaattaattcataaatattttttcagaaagggttctgaaacgcaccaaattttatttacatgttagtttaggcactctgatgctttttctatcaataatggaggtgaataaaattttaattgcttttaacttggggaaaagtttaggcttaactttttagtgaaagtttgatcactcatatttttttagtctaatctactcaaaacggttcagaattcaataaaaataacattcacggtgcgaaaaatggggtttgacaagtttattggggaaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattggggaaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaaaagactttacaaaataatacccctgggagaagggagtgggaaacatgatttcaaaattttcaattttttctagtctaatctactcaaaacggctcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaacggttcagaattcaataaaaataacattcacggtgcgaaaaatggggtatgaaaagtttattggggaaaaa

SEQ ID NO: 22782 - DNA, 1930 bp, Heterodera glycines
  misc_feature (47)..(47): n is a, c, g, or t
  misc_feature (116)..(116): n is a, c, g, or t
  misc_feature (1894)..(1894): n is a, c, g, or t
caaatatttcaaaattcgatacaaaaataaatatctttttgctcacncaatgcactttctgcgggcatcgttaagccaattcgtcaatgttcaaatcgtcccgatttttgtctccncagtgaaccgtcgccgtctccccaattggacaccgtttcatcatcaattggaaaattattacatcttcgcttttcatagtcagcttttcttgcgttcgatcattcaccaattcaaatggcacaattgacggtggcgcctcatgaacaggaaaaagaatttcataactgacagaattggtggcatggagaaatttcgaaacaattggaagcgaagagaaaatggcaatcaaaatcagtctcagtcatttgggaaaatgtggcaactgaccaccttgaaagtgttgacccactcgaagtctcgttgtttgttctccataaaaaacaaccgcttcgactgtccggtgctgtgtcgaagtgacaaaaaggcaaatgtgggcgaagtgacaaaaaggcaaatgtgggcgaagtgacaaaaaggcaaatgtgggcgaagtgacaaaaaggcaaatgtgggcgaagtgacaaaaaggcaaatgtgggcgaagtgacaaaaaggcaaatgtgggcgaagtgacaaaaaggcaaatgtgggcgaagtgacaaaaaggcaaatgtgggcgaagtgacaaaaaggcaaatgagggcgaagtgacaaaaaggcaaatgtgggcgaagtgacaaaaaggcaaatgtgggcgaagtgacaaaaaggcaaatgtgggcgaagtgacaaaaaggcaaatgtgggcgaagtgacaaaaaggcaaatgtgggcgaagtgacaaaaaggcaaatgtgggcgaacgccgtactagaacggaacggctcgcttcgccttttcatatgtgccgccagctcttaataagctatcaattcaaaaacaaatacctatgtcagtttttggcatttcagcaactcgggacctatttgttcacttatctcgccgagacaaaacgattgatacatccatttaacccttttctaagcggagcgttcacaatagtttttccaaaaaatatatagtttttaaaaattatgtataaattgtttttaatttagatggatttcgcaatatcttcgctatccatccaattttgctcgacgaggatttcttcagctttttttactttgagatttcagtcaaaaatatgcaacagtaaataaacagcatttcttatcctaaatagcaaatttattagattattaatacgataataataaaatatgtttatttattattctttttaaatttgttttagttaccctttcggtcgactcaccttcggattcactgccaaaaagtggacaaaattggaaggaacaattgttcctaactttggcacttatgcatactcaaactgtggctattttaccattgatggcaaaaagatagagccaaaagaagattctttcacacataatgatattgtcggatgtggcattaatccggccacccgacagattttcttcaccaaaaacggacggcgtcggggtttgtaaaaacaataataattataattttattacaaaaatactatatttatttatttatttttatttattcgtgaataaaaagtcatcagaagggcaaaaaaccacttactctgacgactgaaaaccatgttctgttcctgatgaattgttcccattcgtttctttgctgagatttggtgacaaaatcgaggcgaactttgggccatatttcacatttaatttggccactctttgaagagagcagaaacattggagcaaggcgataataatttcattaattaatttttttttttttttttttgttaatttcaattccaattttttcaattaactctaattactanttttattcgtgttaatttaacttaataaaaaatgtt

SEQ ID NO: 22783 - DNA, 2078 bp, Heterodera glycines
  misc_feature (24)..(24): n is a, c, g, or t
tttgtggttttaaagcgggctttntcgtaaacaaacaaacatagttcgtttcattttcataggaaatcaaaaatttgcgaaccagaaaaatatattagattaatccgcgccttcttaacgctttacaattaatagagatccgatgattggaagcatttatgttcaaagtttgctcattcatttattgtaacaaatacctatttaatgacgacaaaaaaccaaaaaacaatacacaaaaaatctaatgaaagatctctttcttagtcaacaaaaaatgaattaaggcggcgcccaatgggcgaacagtgaccaagtgattaacgtacaggcgaggacagtgccaaccgaaaaacgcacttttcgcataacggacctcttcacagtgtgcattctgaaattacaataccattggcaccacaaaacaaaaactttatttttttgcaattttttgaaataggtatgataaaattttaaattaaaaagacgacaattaaagagatattttaaactaaaaaaacatacgacacatgtgccgggacttgttctaccgcttcgtaaactcccgtccagacaagcgccttacgctgcaacggcgtagggcaaaaaattttgggccgcttttcaattttttttcctgcaatttaatttttaggttaaatataagccatttatttcatcctacagttcaacattgaataccatttaaacatggacaaaatgtttttttggtacttttctagttttacaacaggcccaattttatacattttaaaatgccaaaaaaggtacttacatgaataaaaatatttcggatgtttcgggattattgattaaacatccatttcgaacctcgtataccgaattcgaaacgttaattcaaaccttcaaattttacattttttgagtccgactttttgttcgaattcagatccgggttcgaagtttgtcgaaatggatgtcataaaaacgattccactcccgagttagaattctgttgcgctttccaaaaaatgaaactgtttcttactccaatgtgtgttgtcgttgcgccaccgttcccacgttcgttcccactcgcccaaattgttgggtttcgttgtcagctgaaagccacgcgcccgcgccttcatttttccgtacaaaatcttaaaaataaaacactaaattttgtgacaaaataaataaacacctggtctggagtcggcggctcacacaacgcttcgaatttcgaggaggacaactcattcttctcactgtgaggctgaaaattgaaaaaacggattaaaatgcgttttggcggttttctaaaatttttaccaaacctcggcctttggaactttctccggaatatttgattcattggcgctgggctcagtcaatgctttttgaggttgggtcatttgtttttgtgggatgaatgttgaaggacaatggaaaatggaatagaataaagcactttatttggatgaaaaaaaattgattaaggattataaagatagtcgaaaaaagggattaaattacatcatattttacaatttgccagatactgaatgtgaacatatgctagtaattgtactacagaatggaagcgtaaagaccattacgctatcatggaaaattgatataaataatatgaccacatttattaaatttcataaaaattgaaaaacaaatcatttgtttttagaaggaaagtgatgctcatgagactaggccaagttgtgaaggcattttgatcagctttgaggccggcaatcggaattcaacttgccacgacgcggcactggaattgccctcctcgtcacagtccaaccccaagaacaacgactcgagatcgtacctgaaaagtgaacaaaacagaattgggaaagtcgttaaatatttttgaatgttcagtcggaatgaaaaatgtgacccggaaattgaggagcaaataatttccggatggcgcccatccaggggcgtatctagaaacatttttcggggggggggggggggaccgacctgaagacctttttttttttttggtatttaaccaatactttttttccactgctggggaacacctgccctttttc

SEQ ID NO: 22784 - DNA, 1614 bp, Heterodera glycines
  misc_feature (6)..(6): n is a, c, g, or t
ggactnttttcttatcaaaaatgaaaaagagaagagagagcatcagactccgatcgacgacgacccgttgctgtgatttcctttcccatttattgagcagttcgggcaaaacggcggcgcctcgccccaacaaaacattttccgatgggtcatttaagaattaattaagcactgataacaaaaaggaaatgtgtgatatgtcagaagcgaaaagaagcccaagcaacaaaaaaaagtgagaattcatcctgattaaaatgagaagcgaaatccgacttgggatttggaaccttgttttggattttatgataactcgtacaaaatgcaattcgtacaattaattaggttaggcttaggcttagacctaagcttcaggctaggcctaggctcaggttttaacgagttttgtttgttttgaatgattggcatgcattttttaattaaagaatctgccatttgcaattttcgcttctttttttttttgctgtttgccacggcttcctcaaatttgatggcacatttccgctggtgctcccggcgggcacaggtcatatcgatttgattagttgggttgcttcccatcagagatttaagcgccgatttcgagttctgattcccgactttcttttgtgggctcggcacgcgccgaatccttgaatttcgaaagcattggcatttccattcccaaattcagaagacgtaaaaaaagtttggtgtgcctttttggcatataaattggttttcctctcatttgtttgtcctctctcattctgtttctccatcctttggcattccgtccaatcaatgcaaattcgtttcctccgctcccgcccgtttccccccccccccctttttgcataatctcaaaattccgcgccacggactttccccccaatggcactggttcttggcgccactgatgaggattttctttgcgttttgctggaaatttctaaattccgccccatcggattaaaaaatgccaccaatgaaaaataccattcattggcttactttgaattccaacaatttgccaatgccattattaacatgccatcatcattttcctcttgtcggcgaaggcgttttttaatgcctccgccggtgtcgtaaatctttgaaaattcgtccgatgaatgcagaagcaaaagcattcaaaaaacaaattcattcattctcccattccatctcaactgctgccaaatggtgaaaggaattggccatttttcgtgtgaaaaatgatattcaaaatttaaacagaaaaacaaaaagggggggggggaggaaatagaaaatggcactgtaaaagaccctttttggaatggcatcgctggcatttttacataataaataaaaggattggcccaatttacgtgacttccttttttaatgccaaattctttcatagaaattgggccagccgaatttcaatggcattttaatgccatttgttccttcaaaatgcattcactcatttttctttgcctgtgattattttacaagtgtttgtttgttggtttgtccccatgtttttcgttggtggttttttgtgattgacgtcttttggcggcaaactttcaaaaataacacccaaaaatttgttggctttttgcc

SEQ ID NO: 22785 - DNA, 1861 bp, Heterodera glycines
atgcttttataccaagtttttcaatgcaaaataatcgataaattaaccagaaagtacatagtttttcatgaaaggacctggttttttgtaaaaacctaggctcaggtttaaaatatataaaaaattcagtggccttcaagaacaacaattactacaaaatgttgacaaaactgaggaagttgtaccaaaagcagccgtggaaattgatcaaaattcgcagcaaaatgtggtaatattttatatgagaatttttatgaatttctctcgttacatgactggactgcaaatatttgaacacgatacaaatccttttttgggtggttttttggaataaatccatttctgtaaatttgaggttttagtctatatttggaatttttgcaaaattttataaaatagaaaaaagcgaaaagatttttagtgtaaaaaagattacaaatttatttaaaattatggtaataaaataaattttcattaaataaagccacaacggcccaactattcgcgtgatcaactgaagaaattggaatgtgtgtttgaagggaaaaattacatttcatcaaacgaaagtgaacaattggccaaggaaattggccttacgaaagagcaaatcgaagtaattgggggcaattaaatgtttataatatttaaaattttctattttattttaatataaatttaattatttagaaatggtttaaaaatcgtcgagcaaaacaaagagcacaaaaacgtgtggaagaagtaatatccgaaacaattaaatcttaaaatatttcctaaataattttgaatttcaaaaagtttgctgctgttgctggtgccaaagtttgtgctcaaattggccttacgcaaatacaagtcaaagtgagaatttgccaattaatatcgataatttcaagaggataaataataaagaatttaactaattagttaattaatcgattataaaaaattgtacaataaattaatagtttaactaaatttaaagcaaaaacaaaatgttgctgttgcgtctcagccgaatgcaaatgccattggcgttgcttctgtcggtagcacttcggtcagtgccgttcgtggccgtgccaagtgccgtcgtttgttttggcgtgccctcacttttccggtcagttatttttttgataaattatagattgttgccatcttgactattttgcctctaacaaaattattttcactagaatctaatcaattctttgaacatgtaaatatcctatgaagaactatttcactagatctgagccccaattcgtgatcggcgacctccagaatccctaacacttatattcattaatttttgatacatttatatgcattaaaaatgcatgtcaaaagtaccttactaactgtataagaacgaaaacggataactcatatttataaaatacgttattaaactatacaatttatgcccacccaatatgccattttattaatatatcagatattgatataaatacaatgacgatgaatatgaatgatatttcacaaatatttaaaaattgaatcacaatatattaatagaaatacaatatatacatattcaagccacatatagaattatcactgttcacaaagagaacatttaataagcataggaacatacaaaacacagcaatcttatggaaaggtaatgttcgaaagcaagagatcagagtagttggagtcacgagacatcctcatcgaacactgttatttgcacgcaacagggcctgactattcctctgcttggctcgactcggctgcactctaatctcccagcgcttcgttcactgtggatgaatgcagaggtgtccttcttcttgccctttcttgtccttcttcccgtgcttgtcct

SEQ ID NO: 22786 - DNA, 1261 bp, Heterodera glycines
aaaaaaaaatcatcttttattccatttttgttaaaggctttctgaattttaattgaaaaattcaaaaagtgccaaattatttacaaaaagtattgacaaaacccaaaaaattgaaataattatcttttccaaaaccccaaaaaatatttaattattttattttggttaaattagaggaacatattttctaatatattttaaaattaaaagctttttaaaaagccacattaatgaaaaaaacatccataacacactatatacagtatctaaaattgccaatctttcttcaaatcttcatatatattttttaaatttttgcgcaaaatcagcccacaattcattaccattatttctatatttgcactttccccctcctgcgtaggtcccccccccccccacactttccattgttgtatgcaaaattccagtttttaaaccaaatcgacccactcactcacaactgaactgactgactaagcgccgcttgtttctgcattcaaaaacgggtttgtttgtggcgttttgtcgttgtcgtctgtccccccccccctcacttttcttggtggttgtggtggtggtggccgctttttggtggcttataggaaacaaatgaaacaaaacgcccgacggggaagcgggggggggggggggggggaagaatcattgcgcacgccgatcggagatttgtctctctctccccttgacgccccgtcccaaggtcatccccccccctgacgcatgccgatttccattccataaatcagatggctttttttccccaatacttcgctttcatcgaaagaagaaacgattgatgtggggtgactacaaaaaaagtgaatggaggggggggggggggaagatctgatcagaaacttatctgctttgattaatttggcgatacatctccccctgccccccttcccaacaaaaaatggaattggggtggaatgaaaagagggtgaaagcaattaacagtaatgaataatgtgctgcacatgaatgacatacacataaaatcactttcactgttgtgatcagattttgacgctgctgcagcaactaaactgtttttttctctactattattggaattttggttcaaggattctttattttttgtgccgttactcaatgagtcgtgaatattaatgcggattttcgatttcatgctttaataggtggaaaacatggggggggggggatatcgctcccctatggggaggtgactcatgcgaaatgcgcaatggaatgcaatttt

SEQ ID NO: 22787 - DNA, 791 bp, Heterodera glycines
cagcagaaccaacaaaacatggcaacaccaacaccactcgctaatcaccaacaatcgtttatcgtttcgttaatcacccttccttctccttcttctcccctttcgttccttcttcattcttacggtggttgttggctgtgcaccgacggaggcggggcgggggaaaaggaggcgaaaaaacgggggacaatgggcgtgccttttgtctctctcacgggaagaaagcactttcttacccaccctcttttccttccttctcttttttactcctctttttcttcttccttctcttccgtttcttctttttccaatcattctgcctcatttccttttctctctctctgtctctcttttttcgtttctctctatcactctctcgcttctgcctccgctttctcgcctctctctgtccattccacgcattaactttttgctcttttcattctgtccaatcttttcttctctcctctcctctcctctccctctttctttcgctttatctctctttgatcatttcctcaccaccgctctaattttttctgattttcgttccgtttagatttgatagtgccgaatgattttatcgtgattttgttctacaaagaaatcttatcgaaatgggtaatcggaaacggaaaacacagcgatcgatggaaagagaaaaagaagggatttttttatttgaattgccaaaattgaaatcggaaatttaaatataccaccaatacaattagcatttaattaaattaattttacgggcgaagggcgcggggaaaggcgggggggggggg

SEQ ID NO: 22788 - DNA, 2171 bp, Heterodera glycines
ccttcaattcactcatattttgtcgtgatttgtgtgctatctgtattatatatatattatatatatataaataaatgcattataattaaacatttttcacctttcggtaaattttcgtttacaaattttttaagttccatttagaagaaacgactaaaagtgatagagtacttttgatcgcgtccagacatttgcggacaatttcgggaaaaataaaaaaaatttataaaaaaaattttttttaaatgcaatgcaaaatttggactcatcacagaacgtttcttctaattttagatataaaaaaatattttgaagatatgcttaatcatgagcaaaatttactttcactatttcaaattaacaattcgtaaattagtccgttcggtttggtgctgtaacatttcgacagtggctgatttcgacagagaataaaattattgtttttttattattaggcattcacacgaacaagccggaacccacagttttgccgaagcaaactgcctcagggtcaaactgacccgaaaagtcatttttatttaaaaaattcactatgtttaatgaaaattgatatatgtgtgtagtaaaaataaagcttttttttaacctttgttatctaatttgatgtcttcaaatgttccaaatggcaaagttaactaaaccagatacaataatattctaatgcccaattaaaattcaaatttaatttcattagtacagtaaacagtaatttttttaaaaataacatttcctttttatgcgaataataataataaaacaataattttattctctgtcgaaatcggtcactgtcgaaatcagccactgtcgaaaattcctggcacgttcggttttacacattttaaacttgaagtgccaattttgaccaattgtaacatgggggtcaaaaaatgagcttttccccactttggcacctatatttaacacaatgtctttgttaaaaaaagacaaatattttttctgaaacaaaatgcattcgatagaagaaagaaagggctaaaaattgatataaataaaatacccaataattgtcgtattttagagaaataatcccggagtactcatttttatcaatttggaggtccatattcaaaaatcaatagctgcacgaaatcccgatttccaacgtcagattcccgtaatttttgtgccatggaatttcggttttcctttccaaaaatttttggggtctcgaaatgctatccaattgaacacgagagcaagagttatatatggttcttcccctactatctgggaaaaaagtcggggaactggtatcaaattccccgaggattatctataaggctaaaaaaaaattttaaatgttgggggggtcaaaaacttggtcgtcaaatagaaaaaaatatttttctaaaaataaaaaaagcactctcacccgacagagtgaaacagacgacgttcgaattccccgaacagtgttggggatcaactcttctttaatcacttaaggaacagcatctcactttgccagtgaaattaattctttgaagtgtaaaaataaaatatgatacctttaaaagccaaaaataaatttttatttagttttgcagtctccattccatgttttgagatttttttttaattttttaagaatattttttatttttttcccgaaattgtccgcaaatgtctggtagccatcaaattgtgtattgctgagttgcctttgtacaagtgtttgtaccagggatgtgcctaggtttcgcttttcgcatttgcctttcgcattattcgcattttttggcgtttcgcatttcgctttttggcgcgaaaagcgacttttacacccttaagaattggattaaattcccataaaatttttcaaaattttacctataaattggctaattttcagtgaaaaactgtttataaatgatcaaaatttccaatttttttccccggcggcgcctatcggcaccgccgcgcccccaaaactgctattttttcttagaaaatggcccaaaatcgcaaaatttggtaatttgatgaaaaactgttctcagcggcgcgccaaaactcttatttctcattagaaaaatgatacaaaaatcacaaaatttgatgattttttggtgaaatctgtcaacaaattttaatcaaattctcaaaaattttcccggcggcgcctg

SEQ ID NO: 22789 - DNA, 1472 bp, Heterodera glycines
cgcgcatgcactagcaacgaagtcctttgcgcgaagcgctcatgtcagcgcccgcccatatataccaaaagtatactgtctacaccgagcaattactgtgcaaagccaactgcctacaccgagcaattgctgcgccacacgctagtttatattaccatagagaaaagtcgggtttcgtcttaaaaactaatttgagtcgaacggctgtcgggaggggtctgaaagtggtggaagggtcttacaactttttgaggcgcattcaggaaaactataggttttccgctccggtggccagttgagcgccggcggcgctgaaacggcgtgaaattttttttgtccgtctttggtggcctgtaactttgcgggaagaagcgggagcggaaaatgcttgctggtaggattttaagttggaatgtttgggaaaacttggcgcttatttggcggggctatctgtaaatgccaatgctgcagaaaatggcaaaatttggcacccaatttcggcattttccgtttttcgggaataactcgctgggggttaagcggagcgggttggcgccgcttgagcatttgtgcagtttttaaagctgcatccgatggcgttttcagattttgaaaattttcaaaatttttcgagctaggccccctcgaaaatttttcgtttttgaattttattattttttgccgatttttcccaggaaaacggagaccactttcaagcaaccgtttttcgagctctatcgattggtggcatttttgaaaaaatttcaaaattttccggaaatagaaaaattttttggcctgaccgggacatttcagtcccgggctcataactcgtcaggggttgattttaacgaaaaatcgtccaagagcttttttgtagagaatttcgagctctatttaatgtgctttatccggtatttttatctttaatataaaaaaagatataaaataaaaataaattttgaaacgcaaaaccaaaggggggaccccatggttttgcattttatgaaaaataattttgcttctaaaattgccaaaaaatacttttctggggtagtttgaggtgctgaacacgaatatgcactttatattgcgttttggattttttggagggaggtaaaaaaattttgaaaaatcgtcaattttttggatttgggaagttaagtgattctttgaaaaatcataactcgcctcaaaatggtccaattcagctcatttaaagcataaaaaatagcaaaaattcgggagaattttattagatttatttgaaatttataccacaaaaaataaaaaagttattccagaatttctggaaattttcgatttttcagaaaaaaatttatatctcggttctgaaaagtcattagagaagagtaaaatactacaaaaatcagcaatttttttctatataatataaattttattttacattaagatcacattttaaaaaaaagatacaaaaataaaagtga

SEQ ID NO: 22790 - DNA, 1399 bp, Heterodera glycines
  misc_feature (65)..(65): n is a, c, g, or t
tcccttcccttgtccatttcggcatttcccttgtccccttctaagtttcccttgtccatttcggnatttcccttgtccctttcggcattttgctgctgtttctaattatcctttttgcttttcctttcccctccgttttttcactttttgctgttccgtaaatgccaatttgagcatcgaatcggccgcgtccattgcgtccggtgacatcgtccgcttcttcgcccctccccccgcgtttctcttcgtctttggcttttccctccgttccgtctcttccacttcgattcgtccgtctttcattatcgtcacaattggctccgcctcattgtctgaatttgtttttgccatttcaatttcactttttggcttttccatttgaccttcgctttccccgtgcctattctccccataattggcaaattctttggccatttcttttgcgtctaaaagcgattgaattagcgccggcgacggtttcggcacgcgcgcggagcgactgaaaacaaaaggcgaaaattaaatggaaagagaataaaatgcaaaaattaccgaagcgttttggtgctttcatcggtcgaacggtcgtcgtcttttttgttcgagggcgaaaaagcgaagggaacggtcgaacgacagcgacgaatttttggggtcgaacgacggggcgaagaggggaaaagggaggaggaacagaggggggcattttgggggggagggggctaaaaagggggaaaattagggaaaatgggggaaataattggacaatatgaaaaatgggaaaataattggaaaatggagtaaaatgggggaatacttgaaaaaaaacggaattcggaagggattcgaacttgcgagctgtggccgtcagtctcacaaaggcgccacttggacaaaaaaaagcggcccaattattccctttttgcggttaaattaaccgcagtttattttaaataaaattgtattttcgttttaattgtggttaaataaaccacaattttgttaaatattatatctttttttaaaatattatgagttttttaggtaggaaaaaccgaaagaaatatgtatcatattgaattatgagtaagaaattgcaaaaagtatgaaaaggtataaaacccccataaaaatgggttaaaaaaatattttttctttttttttgtttcaataaacgatttgatttgactacaaaaaaaaattctctaaaaatttaaaaacaaaaacaagtattgttcaagaaagactaaaataaatattagtgggcaaatttttgaaaaattttcaaattaggaaggggtgtttttttgagttttccattttatgggtgtatttttttgaaagttttccattttatgggtggatttttttgaagtttttaagtcgattgtgtgtaaat

SEQ ID NO: 22791 - DNA, 1579 bp, Heterodera glycines
gcaaatcctaaaaaggcaaaagtcagcgaatgcctttgattttcattttaaaggttttaatgtttttctaatttattttctttacctccaacaattcgtagtccaattcgcctccaaaacattcgtcgcaactgaaaaagaaaaatggcaaaatgttttttttttttttgtttttttcgacaaattcaccggtaaatgattttcttctcgcgtttcggcccaaatgactccaaaagttcgtaaagcgccttcgaatcgcccacaaaaatgttgtgaatctgagcaaaagaaaaggatcccaaatccgttttcccaaatgctttatcccccttaaattaaatttcggattttctttttttccatttttttcccttttcctcgccacctttagcatatgcaattcgtagtaatgtctgctgctcaattccctgttgcatggtacgcaatatttgtcacaatcttttttgtacggttttgcccctttttcgcctccgtcgtccgccgccctttctttttccttttcgttttcctccaaattttggtcgttcgcctcgcgctccccccaaaataaaaattattaaatcatttaaaatcgaattgtgaaaacaaaaaaagaatcaaaaaatatttaactgataatatttttaaaaaaagaagcaaagaatgattcggtgaatgcttaacatttgccaattcccttctctctttttccattttaccaaatgttaagcatttctctttttctttttaaatcaaaaatcgtaattttattttttgttttttaccattcctccgcggtgttcccttcgccatttgtaaatctaaaattattaatcaaataaataagaaatataaaaatatatatttccattttcattgttttaaccgtgcaaagagtcggagaattttcggtgccaaattttccctggaaaatggcatttgtttccacggcactgacgccttttgagaggaaattgcgcgtcatttctcgcaattggtcataagcaatgggagaagtcattttgagcaatgaaaaagagaaaggggaggtgaaaagaagcttaaagaaattaatggaataattttaatatttattaaaataaatatttttaattttaaaagttaaaatgataattaatgggaaatattcgacaaaatcacaaaatgccgaaagaatgttcaattctaaaaatgttttcgttgattctttgaatgaataaatatggaaatgtattaaccaaaaaccatcatcatcaaattattattaataaaatataattgtaactgatcaaactcagaaaatatttctgaattaaagcttaacagaaatttataattcgaaagaaaaacatttaaatgtcatctgaaaatttgtataaaattgacaacaaacaaaaaatggaattctaccgctataaaactttgttttaatgaaaaaattaatatttataatgaaaatagttttgaacataactcaaaaaagaaatcaaaactcaaggcaaaagccaatagacaaattccattaaaatttcatttttagtgatatttttgattttaataaattgcaaaatttacatta

SEQ ID NO: 22792 - DNA, 1691 bp, Heterodera glycines
attatagcgggggggggggggacgtcgcctcccgaaatgtcgtcgggatttaatatcgccgcaaaaaaaaaacttgaaaattcgtgaaaaaatcaaaaaaaaatttttttttgaaaattcattgaaaaattgctatttttttgtctctgtaaatctaacaatttttttcagtatcaccgagtgagggggacgaattcatattgacaaactcaattttttcaaaaaatttcaattcgcaggtactgttgacccatctgacgccggtgctgtgcatgtgccagcagttgccgatccgtcagtgcagcttggtcccgatggtggatttgtcccgcctgttgcagtcgttccgggtaagtttttcaaactcatccttttgaattatgattgctgcactactttcccactgtaccatcccgccgcattccctctactcaatcgtttatccattatttttctctttggaataatttttataaacaaaatttttttctaatttatttggttggtgcctcacccccatttttgtataaaaaatgctaaaaacgtaatgcattcgcattcctgaccctaatttgaaagaaaatccattatattgagatttatccgaatgggctggacattttattctaaaaaattaattttcccaccctctggttacgatttgagtcatcatatttcaacattctcccctcctttcagaagccgaacaggagcagatgacgaatcagggtaaatctgaatgtttttttaaagaaaatctcaatttcttaattacgataatttacgaattttcctaaagtgtaaggccaaatccaattgttgattttgagtttatttacccttttcgtccttaataaaggaaaaacactgatacaaggctaaattcgggggctgcgggagcttgttcccctctttctgtgataataataataatgatctcaaacaaaaatctactattcttaatttaattaattgttcttttacccagaaattttggccattctccaacgtattgaggctgaaattgtgctcgttcgttcgggaatttctgctagaacggggaatcgtaagttgtttgacaataaatgaaatgtttttattttaatttgcatagctcctaactgaaaaaaattgctgaggcttttgcatccgacaaatttttgtttccattttagttctttcaaaattagacactaaaatttttgtcttataattttttaccttttttcaaagtcacacttttggccgccctcgacgagtgtatttctttcctcacaacgttggaggaaagcggagcccagctgctcctcaacggcatggaggccgcgagactgttgccccgcgccgaagtggcccgtcttcttccattggtcaccggtgttttggcaacaccaatttcggttcttcgtggaattaaaatttttgtccaagtcctccgtattttgattttgttgacgctgtcacctggggcatttttttttctggctccttccgttatttatgtttcttttgctattctcggcttccaccacttcaccatttatttgatcgtcatgtcttttttcttcgctatttaccatatttacaatttcttccactgaataaatggtctcgttttatttgttatttaaactgttatcgaatttggtttgaaaaaaaataaaatccaagagaaaaagtttaattttcac

SEQ ID NO: 22793 - DNA, 1109 bp, Heterodera glycines
  misc_feature (1092)..(1092): n is a, c, g, or t
cattttgagcacctccaaagcatttcgtggtagctgatgcgggtggtgacagtgaccacatttgtccgattccgcacatccgctgactgattccatttcatcatcatcatcatcatcgtcattgtcatcatcatcgtcgtcgtcttcgtagtcaaatgatgagtccatgccttgccttcgatgcgttgttgaaatgtcctcatcttcctcactctcctcctcctcattctcctgttcatcaatgaacaaaaggggcccttttgcacaatttgaatgatgtgcatccatgccgttcctgtccgcctcctgtttgacctgttgtccagcctcatcatcatcatcatcatcaccattgtcctcgacggacagctccactttcggtgcgatgatttccgctgtacgcccctgaatcttcttgataaaaaattaaataaccgacaccaatttagagcaaacctgttgttttttctgctgctgctgctgctgcgtcggttcaatctcactaaatagaggcggcggcgctgccgccactgtttgttcatcagtcataaaatcaattttcgtgtcagtgatggcgggagtgtcatttggcgctgccgacatcttttggtcaacagcactcgctgcctcggcagcagcctcagctgctgctgacacatgagcttgctcttcaaccaacaacgacaacggcattgtgcgaggagacgcaacctcgcgctgttggcgttgttgacattgatcgtgtgcagcagagtcggcggcggcgtcgtcggtgtctttgacagcgttatgaacgttgaaccggaacatgtccattgaatgattattcaaaaattcggaagctaaaaactttatatatgtcaatatgcgaaatgtgcgggaggggggagggggaaggataagttgctttttaatatatatatatatatatatatatataatgagtacaaatgtctttttagtttatattttgggacaagagctaaacggcataatgaagcagcagcagcagcagacaaaagagcaaccaagccgccatcaacaagcgccccctgtttcaagcatccagagacaatgtgtgtgtccgggtgntacgggcagtggcaaaa

SEQ ID NO: 22794 - DNA, 2079 bp, Heterodera glycines
ttaaaaatttattgtatttaatagatttttgcacaacccttgaaggaatatagattgaactttcgaaaaaatcgtaatcctttttatttttgttaatataaaaattcggctattttttaaaatatattttaggaaaattgatttcattgattcttcatctttattcgattagcattataaaattacatttgcgaaaaggctttcattttacaatagatttaatttttaatatttcctactcattcaattgtaaaattatatattttttcatttgatcatttatagaaattgaaatagatataaaattttaattcgtaatttatataaatcataaattggaaaattattatttgctatctattgaagccatcggaaatgtcttattttaatacttctaaattagaagcatgaaatatttttaaaaaaattatatataattttttaagaactatgtaggcttcagggattgaaaaacttaagttagaacccgattttcgacataggctcaaatgtaagggaaaccatctattcataaattataagaactgtcctacaaaaaggttccctttcaaagaaaagatgcttaaattatcctttccatttttgcctataattatgatggattttgcgatcggacgcatagcattaaacgacaagtgccaaaaaggtgtggacacatttttaaaaattttcatcatctatcaaaaggtttttaagacttttttgcaacggctgatcaattgcaagaaatggcatcggaaatttttgcagcggcggacaaacaaacggaaaatggaaaattttttgaaaagggatttgacattttctgttgtattgcatttgaaattgaaaaagatgctttaaacaaagatgagttggcaatgattgaagattttgaagcaaagcaacgcaatttttgccaccaaatgaaaaagggccaaaatatttgggaagcgatggaaagtccggcagggaatgccattgtaacagcggcgaagaatttgaaagtgaaccctcaaacatacgaagaaggactccgtaaattgaagaaaatgcaaatttgagccctgaaaatcaaaaagaaattgaaacatttgccaaacattgctttgccgcgttgaaattgtttcaacaattcatcaccggtatttgtttatataaaataattaaatttcagttaggagcaaaatattcatcaaaattgcaaaaaacgcttattctgggctctattgcactttatgaatataaagttacaaaagaaattactcaacaattacttaattaatctaatcttttttggcaattgcctaacgctgatattttatatatttttgcttcttaagacttttactttcgaatgatactaaaaagataggggtttgttcgaataggacattacggtggataatcgatcatatgatgttagaccgcggcaaaagtatgcattcaaaactgctaaaaagtagaatcagaatcccgcggcgttaaaaccgttttcccaaaacctagggattgaccgggatcggtaatccggttgagattgagtgttttatacaacaacaaattaagatgagcgattggctcagactttgctcgctggtggaggacagactgtgtctgatcaaagttcagccttatcagctcaaccggcgcccactcgatctgatcagctgccgaaggggaaatctcacggcgaaggaaaaggtcgagtaaatggccaaaatgccttggtgcttttgcattggccggcttttccggctatgtgtgcagtatatttgtgaggctcttgaaaatgaatcatgttccgatattgacttactttactgctgactattcttctactcttcctttactcattcgtcgtttgcaacggagctgatagttgtgttgtacattttctttgctgtttctttgggcagcatatttttgggcatttatcattgctttgtcaagcgttcttattaatggaaggatttgctttatcggacaattagccggggccataaaattggacaagttcatattttacatgactttatttttattccataaatgaagagagtcatttttgacactttt

SEQ ID NO: 22795 - DNA, 1503 bp, Heterodera glycines
  misc_feature (1467)..(1467): n is a, c, g, or t
gtaattaccagggctgtcaaaaaaaatgcacgaaaaatggccaaaatatgcgcataaatatgcaaataaagtcgtgaaatatgcaccaaatatgcataaaaatcgcaaaatatgcacaaaaaaccttgaaaataaggggtgtaaattaattaaaaaaattttattcctcataaattttatcggttgtttttgcaattgaaacccaaaaatttctcaaggttttcggcagtgaagctcattgttgacccactcgcgcatccttcagatttggattaggtaattttggcataatcaacttttttttccaagggatattcaaatcggaaaatattgaacgaagaatggtaaaatatgcaaaaaaaacctgaaaatatgtacaaaaaatggcaaaatatgcatgaaatatgcagaaaaaccctaaaatatgcaaataaaagtcccgacacttttatatgtaaataccaaaaagaagatgtttttcgtactaattagactacgtagaacccaggaaaacccaaaaaatgcatttgcacatttttgacagccctggtaattactgtttcttcggcatgtggtccaaacagtatattgcaatcccaattcccactgttaccgtacctttctgtacagacggtcccagtcaattggccggaagaattcggtggcttgaatctcgcgatagtcgtccggaccgccgcccagccgcttgtttggatccttgacaaggaggccggacaagagaatcttcgcctcgggcgacagtcgtgagggaaaacggagcgcacattggaggatcagctcgaacagcttctcgtgctctctgaacaaatgggcacacaaattaaattttaaaaagtataaatttcgaaatttcggcgccgttaaaggggaaatgaaatgcaccgtttcaccgaatctcgaagttccctcggaaaatccgtgaaaacttcaactccatggggaaaagggtggatttgaataacattcattaatctgattgcgatctttgatggtatcccattacatgacttggccagaatagtgtattttttaaatttaatcagttttttttctcgaaaatttggttagaaaattgagcgggcaaatatcggccacttttaagcaaaaaaataaaaacaaaaaataaaagtcgtcgccagggggcggcacggcacgcctttccatggccaaacattgggaccgaataggaatagctcgtcaatgcttttgctatcaaatttatttttcatatgtagtagcattaattgcccatttaatcactttgaatagaagggcagccgaccgcacatcatctcgtacatcacaacaccaacgccccaccaatcaacggaacggccataatctgacaatgagcagaaattttgtattaaatgggtggacatgaaagtgtcaaattgggtggtacgccgagatttcttgaaaccaagactctcgagcttcggtgtngaaatttagaaaacaatagcaaaactaatacatata

SEQ ID NO: 22796 - DNA, 1800 bp, Heterodera glycines
acattttgtggcacaataattaattattttatcactttccccctcctttttgctggtaatcatatccccccgcttccgatcaaaccgcagcctctgattcatgatttaagaccgctttggcctttaagctgaatcacttttcaaaacatttcagcaacttaatcttatggcattagtccttggattttactgatcacattcctatatcaattcatggcttagctctctaatccatgctttatccaacattctattgaaatcacccgcttacgccttttgccgctgctctataattggcttcatttttcgtgtttcagttgttatattgttgctgtgtgttgttttcgtcgcgtgttgtctcctcccccttgacaaccccaccaccaaatccacttgatcagaagagagtgaaagtggaaataaaaaaattgtttagcttctgatcagtcgctacataaatcaacaaacgacaacataaaacagtcgactccaattccgctgatccattcaaaatcttttgctgaacaccaaaagcacaccacttggccacacttctgcgccacttcaattctttggccatttgttaaggccgagcacaatacggtgggtgggtgggtgtacatgttggacatgcttttgtagcgcaaattgttggctttttataatagtacagacatatgaattttttatattttagtcaatgctgatcaaaaaaatacacatgaaattttaattgctttttgacactgatcactttggtcaaaagtcaagcttcgataaaacagatttgatttaatcaaagtgttatttcgaattcactgttttttttgtttcggacacttctaataacttagtcatttcgatcagatttggctatcctaattctaccccctgaccagttcatttgattatttatatagactttccgatcagttgtccgggttccaatcacttattcaattctatcagaccattaaggggttttgctcgcttttacccatgattacatgtgctggcctagtcagtctaattaggccagttaggcactttgatctgatcatttttttacccaattatccctaagcctattaagcctttgttaatttttagcaatcctgacacgatgaagcaccaatatcagaatgagctgaatacacagtccagcagagctgtgacatcaccactcgcagatgatgacgaaacgctggacgagtcgcgcgagcgtgcctacaaattggtggcgtacacggcggtcggcttctcgctggtcgccatcctggcggtggccatctgcttgccggtggtgttcaactttgtggaccacatccaacgccagaccaaacgggagctcgacttttgcaaggtgggataacaacggtgatcggacaatgacaaatcagttcaaaggcagctaaggattaattaaaaaataattataataattagagaatcccgctgtgaggtcagggaaaatggctttgagaatcctgaaagcgatgcatttgctctaggattcctgatcaaacattacaaatcagtatataagtgatgaaaaatgacaattctaaaaaatagagaatcccactttgggtcaggaaaatggcaagtgatttgagaatcaagaaatcggtgcatttatcctaggaatcctgatcaaaattcggtggcaaatttcggccgtttggctctgctctctttagcacttggattttaactgatcagaaactaataaataaggataatctggaatgaaaattcgataatatcaaggtgtataaatttaatgaggatttatgttaa

SEQ ID NO: 22797 - DNA, 1404 bp, Heterodera glycines
accccttttaagagagtctggggagggggtgtaaagaatttgaattggatttgcttatcttccgtttttttaaatattattttattttagcaaataaaaaaatagctgagaaaaatgtgcaagtgacagaattatccgtgtagcctttttgccaagtttgaaccgttaattttcttcaaagttttggcttagcatttttgttcaaataaaaattgtggataaagataatccaccaattcaattgaaatttaatcctttggcccattattttgccgttttgtttttttatccccccccccccaccaacgtaaaaataaatcttcaccaataatggaatgttcattttttatatcttgattctccaattttctattaaatcattttttggttagcattaaaaaaatgttgtgttgtgacggccgggcttgagtaaatgagccagggataaatttattgaatctcaaataaaataagccatcaaaatgtgagaacatttactctaatgactttcggaattaaaatatgtcgtcaagtaaatttcaaaccgaaacatttactttacaaaattatgttggtatttatgctctttttttgcttctttcactgtcacatcgatggccaatgtcactttgtcctcgcttttgtcgtaaaagcctttgctcgggtccacagttccttaattagccataattgggtcaattaagggaaattttaattgtgactcactggaaatgaaatgaaataagaacccaagattttctttttgttgtcaaaaaagtagtcattaaattcattcttcaaacgcgacccatcgttcttttgagagacaattcgaaaagttgcaggacatttgcaactccaattttcgtctaaatggaaattaatcatcgttgtaattagcattaattaacagttaattcgcaccttcttttggagcatcgaaaaaggttaaagcccaaacaattctgatcagtgcttccccatttccttttaatttgtgccaatattctccatggataaaaaatggaataaaattttaaaaaaattatattttataagaaaaagcatattaaatttttattttatttatttaaattaattattttaaaaagttgacactcgttgttgaatgagtttaaacttggttttaatctctttttttatcaatatccttcgcaaattccacgtttgacaaaagcggaaaacgtatgttgaaaagtgccggaccaagcatagaacgacaattctctgccgtgcattcaatgccattttcacggcacttcgaatcggcccaaccgagtgccgaaaaacaattaaaatttaatggcgactaattaaatgaattaatttcttactttggttctactagactaatccagcagcaggttaatcatcatacatatc

SEQ ID NO: 22798 - DNA, 1761 bp, Heterodera glycines
gaataattgctcaaaatttcttcaaattcacttttttgacatattttttgcataaattttcaattttatataaccagtgccctacgggcattgattgattggcttgttttaaatgaaaactctcaacccggcaataaattaacagaagaagtgtttttcagttattttcttgaaaattttatattgcttctttgggcattttcagcctgaattaaaaaataactttatttattttaattcagcaatttataaaacgatttgtggcccaggtaattatggaatttatatcacgattaaaatggcattttcaaaagtagaggattgaaccacacaaatttcaaatttaatgaattccaccacaaccttcttaagtttctcgtttttgcataacatatatcctaataatattataattacgataatttatgcagaacgttgaaaagaaaacaatattttaaagacataaaaattaatttgtgttttttaatttattttccattgagcaaaatatcgcaccataaattaaatataattaatttaatgaattccaaatttcttcaaacgcggaaacctctgagcacttcgtaaaatatcctattaacaaaataattactggtcaaaatatttatacattaatccaatattattacgattttaattagccgatgcggcagtcgtccccaacgttttggcgcccatggcattcgttttgccgttgatttttgctggtaattcgttacatttcctatggtttcttttaattttgaatctttagcctatttttgtgttctgccgattttctaggcaatttccatggcatcgtttggccaaaatttgaaagtaaaagaaagaagcccaggacaaactaaattgataatttttgtaattttctatgcctttttaataatttgaatttaatgcattaaaaaaccataaagatttatttattatttgttttttgtagaatattatgtcaaaagcctaaattcaaatttacatcaatccatgaaaatgataacctaatccgccggaaaaatatttaaattttgctgaaatttgcagtgaaaaatggatttgaatttaagaaatttattgtatataattcagaatatttaaaaatggtaatagtgagaatcacaaaaaattcctaatcaccacaaaaatgagcttattaagtcgcacagtttagccttggctggttatgccattcgataaatggagaatttcacgagaccctgacattatcccgagtcttatctcgttgagactctcgacagcagcactaacgtccgctaatataatcccacaaaggattattatgtcaacatctttcggttgagctaaaaagcgaaaaaaaagtacacccctaaagattgggtttttaaaataaaacaatggcattttcgtgtgagaaaaaagcaaaaaatttacacaaaattttgaattttttaaccattttaccaaattttattaaataaagtataatttagtctgctgtttattgatgtgtagtgtggtgtagagttagtgcatcaacccacacttactttctgtcattgtcatgagttctctgccggttgacggcttcatttttaatttatttatttaattgttttaaaaaacaaaaaagtaataagaaattttttgatcatttttttaataaaaaccactatttctatttaatataatctattttttgaattgtaatttctcgaaattgcctttttttgtcgcaaaatattttattataataatttttta

SEQ ID NO: 22799 - DNA, 2090 bp, Heterodera glycines
ttaaatgtcatccaattgcttcaaaaattgtcaaaatataaagattttcgtggagaaaagcaggttactttgatcacgactagcaatctgagttttgtcatctggtcaaattttgtttgaagtgccaaaagataaagatactttccaaaaaataaattgtgaaactgttttactcattgcggttattgtgagattttcgtatgttttgctcattttttcacgattaccacatgtgtgaaaatgcataaattttaattttaatattctgtaataaaaaaaatgaaataattgcatttcaaaaagggtattcaatggcaaaattaaaaaaaaataaatttacgtaagagggattcgaacttgtgggggcaaaaaggaaaagcgagcgcacaacctttgcgccaccgaacagcacaaagtggtgcaattgattattcaatttattgggataaaaaaagtttggcacgtcataactcggcacccgtacttatttggcagaaattgaaaccatctttcttaagaacccataggtgctctattcacccacaaagtttcattcggaaatcccacggacacctggggaccttcctttgtcaggaaaaaaataggccaaaacaaaaaaaattgtagccctatttatcatcatcattttgaagatttcaccgagtcaatgatggttttttttgaaatgatgattttcaaagcgcaaatatgacctaaaaatggctaattttcagtgaaaatcggttaacaaagtgcattcaaattttcaaaaaataggcaccgccggccaactattccttaagtttttctgaaaaaatcgcgccgcaaaaaaaaattttattgatttttttcattttgaattaatattttccaatggggtcttctgaatcggctctactgcagttcacaggaccataaaatattatggcaagtttaatgcaccataactttttcaaaaagcatccaaattaaatcttcttggtacctttctatagctctaagagagtactctattaatctacaaaatttcaaaaaatttcattgtgtttcaaaacagttattgtcaaaaatatttagaaaatcagttttttgaaagaataccaagaatgtttaatttggatgcttttagaaaacgttatggtgcatttaacttgtaaagtaaaaagtgaaaaaccaaagttcgacctccctgactccaatcctgaaaccgtaactcacccagtgaaaactaacctattttgtgcgctgcctttagatgttccttcctattttaagattcttcaaaaaacatttttatttaaattcgaggataataaaaataattaaaaattgtttgcgcgaatttccggctaaacaattagaggagatcatagaaaatgtcttccaagttcatgttgttgatgtcggcagggaattcgaggattccgccgcgtccacgcccacgaccacggccaaagcccggcgccacaccgccccggtgaccagcaccacggccgccagcgccacgaccacgcgtgccacgacctccgctggtggcagcagcagcagcacttgtgcccttgtaggggagaggggcatttttaaacccattttatatgcaataaaccgtagaaactaaaaaaattacagatacaaaccaaattttatagaaaagttaccgacggtaattgtaccgctccttttttaagaaacactaggattatagacgcaaggaaaaaagtttgtttagtcgataaattggaaattttaagttttttttaaaaaaggcaaatttttgcgttcgaccattttttttttgcaaagtcgaacgcagaaaaattggaaaattttagcgaaatttcttaaggaaatttgtcaattttcaagtcccactttttttgcgttcgaaacgcaaatgcgagaccttttctttgatcttgccgctcccttttctcatttttctccttttctttgcctcgtcttcctttttctcgaccccctcccctcttgcacagctaatatattttaaaaggcccaaatttatttaaataattggagcaaaaaattattaatgaaaaatcattttcttcttctactatacatattaaacg

SEQ ID NO: 22800 - DNA, 1366 bp, Heterodera glycines
tttttttgcattttgtcaggacacagactttggcttcaccaccttcgttggtgggcatgacattttgggagggggcgactgcgaagtgaacaacggggacatgaagtacatgttcaagttggctgatggtgtgacgattaaaaatgccattcttaacacgccgggcatgggcattttctgcagaggcacttgcacgctggagaacatttagtattaatttttttgaaaattctttgttttctatcactggttaaggacgttgccatgcaacttgtaaacaatttgaaaaagcctattttgacctattttggcggttttcacctccctagatttgaggctttttaatgcttattttccatatttagtgcctatttttggcggtttttagaacttaaaaatcgtatccccttaatcatcagtgtcgaaaaactggcatattttttttgccttttctcatatgaaaatgccattcttaaggttatatagttttaacgatgagaaacccgaaaaaatagaaaaaaatttcgaggtcggagttcccacccctatccaaaccaatggttccacgaaagtgccatgattatttaattaaattttaattcatttgaaattaaaaaaatattttaatttttatattcattaaatgaagtagtgaggaattagaatattagaaattttggaccttgtcctaattgaacgaacttgttgccaacactcgatagccataaatgtctctattagcagcctggaatatttcaaataatttaactctcaaaaaagttacggccaaaaataaggaatcttttggccacaattttttgaaattaatgaaacttcaaaatgcaggctaacagagagcacttaggacgaccaaatgacaccaaattagtctaattaggccatcattttgggcaatatttccctggttggcacacacttttacaaaacgatgtttcagttacaaaaggttatgctaccatgctgccgggtttggttatgaggacatcaatcaagtgaacacttacaaagtgattggcggcggtggcatgggctcaccggacaaagtgataattgataattaatgaatgatatatgtttctatgggcaaaaatagttaaaaacgggttttcccgcatctacagtacttcactcagtcgggccaaggggaaacgcaaatcagcggcttttgtggagacggtcggtttagggtttattagcattatgataaaatttatcatacagacaagaaaattgaaaatacatcccctaaaatcaagtttctggtcgtttcttaaaaattttggaaatttctttatttattttaaatgctgaaagtaaccaaattgaattcttaattaattcgtca

SEQ ID NO: 22801 - DNA, 1330 bp, Heterodera glycines
  misc_feature (125)..(125): n is a, c, g, or t
aatgtaggcgcgttcgggaagctgtactgctcatgtggcgactgtcatgaacaggtgacacgccatgtcacagtttccaacgtcaaaatgcgggggcccggactgacgattgtctgtaggtttgncagggaaagaaacctacagtatgcatttggaaatttacatttccactgatgcattttccgatagagcacgcccggcctaatgatgtggaattccgaattcagattttgtgtgtcgtttttaagattcgggcgagagaaagagaatgagagagggaaagagagagagagaaagagagagagagagagagagagggagagaaaaagagagatatagtgagagtgagagagaaaaagagagagagagttagagagagagagagagagcgtgagagatagagatagaaagagagagatagtgagagtgagagagaaacatacagttagaggacaaaatctcaattgatatttgtttagctgtcaacaaaaaatacggtgatacagcatcattgagtggcattcagttgtatcaagattcacagggcacaatggtcgattacatttgccaggtttgggcgccgccgggattatcattgtccccccgcctccggcccagatatacagcggcaagtccgacagacatccgcaagaagaatacatgccgaaccaggacgggcagggccagtgcagctacagcaccacccaagtgacactggagacggcggatggtcgaccgtaccaaaacactgtcggcggccaacccgtcaaccaataccgcccaagaacgcctttcaccgacatattcggcatcggcgccaccaacagactgccaagaccgctgttttcctcctcattgtgggattcaagcacgtaagtaaggctggtggcagtgcagaaaacccatacactgatctgtgtcatgacaactcgtacaattgcttaggttaggcctcgctctttaggcttagtcttatgcctaagctttaggctaggcctagacttgagtgaagttcaccagggctggacaaaattttttagattcaaaaatttcggattttgctttttgaggagtttcaaaattatttttcatgttttggggttgttccgtttttcggcttttgtacacaattttgactggcatttatttccatttttaatttgcctacctcaatcgtcattcacagtttctacgtttgtttgctgatcagtttgtttgtgccacaaatcccgaacactctgatgctccgaaggtcatccgaatcatttattttatataaaaaaattcctaagggaaaattgaatttatccacgctaaattcagatcacaa

SEQ ID NO: 22802 - DNA, 1189 bp, Heterodera glycines
tgctgttcggatgaaccaagggatcggaatgacagaagccgaagtagttggatggacaaaaacggcggcgacaacgccaggcaaacagtggcgaagaaagaatgcgaaacatatggcacagagtgccttccgccacagcttctgctcggggagagaccaccttcttcgcccgttcggctcagtcactcactgaactcctcgccgagtccgtgccgtgccgtgccccgtccgtcacccctcgcgctgtcccctcttctgtctacccatcccattcattgttcctcttcccaactgtccgcttcgtcctccgtttcccctttgtcccccgtgccaatgccttcccccgccactctttcggccattgtccgtgttttcgcttcttatgagtgagtgttccttttgtcctccgatggcactttctttccatttttctctcacagaacgggtcttccccagcggaatatttctgttcggctgcgcatcagtggagaaacgagtgcggccgaggtggttcagttggtcgtccgtcagttggccagggttcgtcccatccccccccccgcccaattcagtccctctttagctaagttcctccggtcatcaaaaagtctctcctcccgccccctctgcgcccaatccatgccaattttgcctcgtttccgttgttggtgcccgcgaacgccgtctccgcgatgagttccgcgtccttcggctgcctccgccatgggacaaaggcactctctgcgtccgttacgtccattcattgagtgccgccatcgatttggccaacgaatcagccgtttgagcatttttacagatctcatattttttaaaaatattttactcactaaaatttaaaaattaattttatttttatgtataaatatgatttgtttttaaatttttttttctcattgcaacaaataaaagaaatgagccgaaaaaccattaagaatgtaaggaaacagaaaaaaatacccaaaaaagccatgcccccgaggaagagctcaatttcaaccaaaaagaaagaagtgactccgttctccgcccaaaatgagaagggaaaagggggggggaagagtaagcggaaggactgacagaagagcaaagggttggccaaggacattcggtcgtattgggcgagggaaagggcacagaggcggagagacgtgtccaatggcatccgcag

SEQ ID NO: 22803 - DNA, 1375 bp, Heterodera glycines
  misc_feature (25)..(25): n is a, c, g, or t
atttttaataaatcgccatattttnaggggaaaataaaataaataaatgatcaccggtaaagcaaaaaggagaaagaaatctgttcacaatcagcaaaagatacacaacataaaataaactgcctagaaacgttatcaaaatattatcgtatcattaattgtcactcaaattgctttgctattggccgcctcctcttcggcttttccctcctccctctgttcctcctccttctgcgattcctcaggttcagtttcagcagcaaccggcggttcgaggacgatgtcaccatcatcatcctcttcacacgacgaatcaacgtagaagtcgatatcctccgtcaacgcctgatttattgatgattaggaaaattggaaaattaacgggttggaaggggggggggatgccagcatttgtcattttccatcccctcaacaagttccttgcgttttcgggggtacagaccatgaatccggtatccatttcggccaaatccgaaccccagacccgaattcgaacaaaaactcgaaagtccaaattttcgaatttagcattttttgttcaaaacggcatacatgatctattattgaaagactgatggcttttagtttgtttccgtgtatttaaaccaattttgaagaaaaactctaatttcgaaattttgacttttcgattttttgttcgagttcgggtccggcgttcagaatgcagaacgatgttcttatagaagtttatttctatattacaatacaaatgccatacaactttatttaaagtatttttatcactgacgcattttccactgaccgattttccggtcacgcttcttcttcgtcccattccatgtcctcttcctgctcttcttcctcatcctctacttcaagaatggcctcgcttcttgcccggccaaattttctagaaaaaattttgataaaaaattgtgtttttttaatttaccgaatcaagtgccaacgcgaaatgcgtttgcgcttgaacaattcaatggccaccgcttttatgttaatttagatgacgttaaaacaaaaatttgcggcgcagcatcgagaaaaagttaaagagtttaagaaagaggtggacgaggcggcacaaggggaggatacggcgcggacagccctccatgaggccgctcatgtatcctacctgtggctgcacataaacaacggcgactggtttgacgatgtaggatcggtgtcgggtcttgtgattaagctaacaagggaacatgccgactgtatgtgcccaaatcactttttaaccacttctatcgtgtagagcatggtcgatttgctattgtaaattttcggcttttttggctacggtcgccaaactgatcagaaaaaagtcatcaaataaaaa

SEQ ID NO: 22804 - DNA, 1294 bp, Heterodera glycines
ggaattttacagtgcacagggatttgaattatccataaacacatcatagggtaatatctagcaaaaacaaattttttttacacagaatcctagtccagcagacagatgaagcgacttaataaatcgattatggatttgcaagagtaaatttctcaactcacactagctaacacggaatttgccgagtgtaggcgtaaaatgagccattatgaattacaagcgtatatcttggtccacattgagtgtgtgggcgagattaagtaattttctgaaagagctcaaaagcagctttcgaatggtgtattcaattaattgtttacttgaaaattcacagagatatgtccaaccgaatcttgaaatgaataatggcgtagtattctataaaaaaaaatttttcttaggaattttacagtgcccagggatttgaattatccataaacacatcatagggtaaatatctagcaaaaacaaattttttttacacagaatcctagtccagcagacagatgaagcgacttaataaatcgattatggatttgcaagagtaaatttctcaactcacactagctaacacggaatttgccgagtgtaggcgtaaaatgagccattatgaattacaagcgtatatcttggtccacattgagtgtgtgggcgagattaagtaattttctgaaagagctcaaaagcagctttcgaatggtgtattcaattaattgtttacttgaaaattcacagagatatgtccaaccgaatcttgaaatgaataatggcgtagtattctataaaaaaaaatttttcttaggaattttacagtgcccagggatttgaattatccataaacacatcatagggtaaatatctagcaaaaacaaattttttttacacagaatcctagtccagcagacagatgaagcgacttaataaatcgattatggatttgcaagagtaaatttctcaactcacactagctaacacggaatttgccgagtgtaggcgtaaaatgagccattatgaattacaagcgtatatcttggtccacattgagtgtgtgggcgagattaagtaattttctgaaagagctcaaaagcagctttcgaatggtgtattcaattaattgtttacttgaaaattcacagagatatgtccaaccgaatcttgaaatgaataatggcgtagtattctataaaaaaaaatttttcttaggaattttacagtgccccagggatttgaattatcccataacacatcatagggtaaatatctagcaaaaacaaatttttttacacagaatcct

SEQ ID NO: 22805 - DNA, 1182 bp, Heterodera glycines
  misc_feature (48)..(48): n is a, c, g, or t
atcaattattcgcgatcattttcctaacattttcttcatttccttccncagccccattttttccatctttccattttttagtctcgtaacataaagcatttttacctcgaccgttttttgagtcatttttctttgttattcttaaccaaacagcagaattttcgatttttcttttttgtattaaatataaaactcaaaaaattgttatgtgcaagctttaattcaaaaacaaaatcgtccgaaattagaaaaggacgaaaaagtgttaaaataacaaaaaataataataatattgttttagacggtcaaaaaaccggttttattaatactgctgagtcgtatgtcccctcgtcccctctgcccactcttgatgccgatcgataaaggtgctcgggtagatttattaaatttaactgatttggtttaaagataatttattcaaaaaatatttttattggattttttgtcaaaatattaatttatgtgaattttgttcgccggtgcctcaataggcgcagcaggaggaatttgcaaattttggaacaatataccaatgatgaaatcttgattaaaaattcgatacgattttagcatttacggcaaaatcagtgttaattttgaaacaaaatttattatagattttttggcaattaaagtaaaatattaagtagagattttgaaatgtaaataagtaaattaatattcgctgataattaaataaattgcaaatattttttaaattaattgaaatgatttaacttttcaaattcatagcaaatcaataaattacaacaatttatatgcttttagagccaatttaaagtaaaaaaatattaaaatgtttttttaataaaaccactataataagaacagtgattagataaaaacgaataaaatataccttataaaaaataaaaataacaaacaataaaacataaaacatatataattctctaactaaaagaaacaattacatagataaatactggagggattttacaaaacaaattatcttttaaatcgggaagtgttagaaaattaacaaaattcggatgtttccgttttcagaagcccggttttaaaaaatgaaaattcaaattttttataaatactcagtgggtaaactgaacgtttaagccacaacttgcaaaagaaaattaaaatattaagaccaaaatattt

SEQ ID NO: 22806 - DNA, 2564 bp, Heterodera glycines
ggttttacttaatttaagtaaaatgcaagcactgactcattactattaatgccaaaaattattttagcagcaaagtcgtccaaattccccagcaaatggcgtatccaaattgatacttccgagaagccgagtcgcttcaatacgtcgtgagtcggattgcaattcagagaaaggatttggtgaggcggaagcggcacacgaaaaaatggtaaaatcggcacagcaagtcgcgatgggttttgaggatttttgtctcgtgagtgcaaatatattttttaaaatctatctttgtttttaaggacgacaaggctttcgaggagcgcaaaagggccaagtcgttgtctgagcctatttgcattttcaccaatgcgttccttccccaatgttcgtcaccgtcgccgagtaggggttcaatggatggacagaaagtaaggacaactgactctgattttgaccgccactccgttgtcattcgctcagcaatgctattctccgtctgcccagcaagtcgtccgcagcaatttggcgtattctccgagtccgagtccaactccgtctggcactcagtcaatgcaccgaatgaggtcttgcgagagtcaaacgcaccttcccgatgattaatttattgaattcgctgaaataagagactattaattttccagaaattgtttatgtgttcgcaattcagcgtttattttttgatctttcctctttattttattttattttatttcattagtatggaatccattttttgttttcgtcttacatttttactttttattcatgctattttggccactgacagtaaaattgagacggaaatgcagccccaaccattggacccttctttttcagcagaaaaagccccaaaaaaggatgagccggtgaatgtcaccactctattaattcacaaacctattaggtactttagattattgtcattggcggtggactcgctgggatgtcggccactttggaggcactaagtaatggtgccaaagtgattttgatcgataaggagccgactttgggcggcaacagtgccaaagcgagcagcggttttggattgtcgttgcttttctttcaatggcatgaaggcaattaagggatcaatggttgtgggacgaaagtgcaggaaaagttgggcattgacgacacagcggaacggtttcactcggacacaatggcagcgggcgacagagagaacgaccccggcctcgtcgaccttttggtcgtcctacccgctatttgttatgtcacatttcttctaggttcaccagtcagcgtcggctatcgattttctgacagaaaatggagtcgatttggccgacataaacctttgcggaggacattctgtgcccaggactcattggtcatttcgcgtttcaatggtttttgaagagacaatttgccctttctctaaaggctgctctcgccaaaagaaggaaaaccgttgccggtcggagttgcaataattcgaactttaaacgcgaaattggaagaatggaaagcaagggatcccgaaagactgaaaattattctcggcactgccgttttgggtttggtcacatggaatgattacgtaacgggcgtacggatcagagacggagacaacaaaatcagtgcattaaatgcatttgtcttaaatcgtttcttacacttttagtggagattaatggaaaggcggtgattctgaccaccggcggattttcttccggtagaatttgtcattgtgatccacttctaacttttcttgttactacaatataaagatcgggacaacgagacttccttgttggtcgaatttgcgccctccgttctccccttgccaacgaccaatggcccattcgccactggagacggcgtgaaaatggcccgagcgatgggcgctggtttagttggaatgggaaaggttcaaattcatccgactgcattcgtcggtaggcaaaacagtttttgaattaatcgcttaaactctataccaattcttccaacagatcctaaaaatccaacagcccacacaaaatttttggcagcggaggcattgcgcggaaagggcgcgattttggtaattagggaacttaattggtggcatttccagctaaaacacaaaagttttaggtcaatgaaaaggggcaacggtttggcaacgaactcggacgaagagactatctgactgagaaaatgaacaaagtgaaccactgttgttgttgactgagaaatgagcaaatggctttcctccttctgcagaattgtgctcgacaaaagtctgtggctgatttgcccattgcgtggatgctaatgaacgaccaaatggctgattcctttgggcgtcccgcgtttaatttctatgcaaaaatcaaaggatttttcactgtctttcgatgttctcgttaacaaaggaaaatgccagtttttcagcattttgcgaatgtcgacgaacttgcgactgagattggctgttctggcgaaatgttgcgcaaaacactcgccgaatgcaacgaatacgcggagatgagcacgaaaagtgacaaattcgtcgatcccttcggaaggagtaa
